United States Patent 8,809,059 (PLANTS WITH INCREASED YIELD) - sequence listing, part 2

SEQ ID NO: 2226 - protein, 430 aa, Lotus japonicus
MAQILAPSTQWQTRITKTSPNASPITSNMWSSLLWKQNKKVARASKFRVLAIKSDGSTINRLEGLLNLDVTPYTDKFIAEYIWIGGTGVDVRSKSRTISKPVSHPSELPKWNYDGSSTGQAPGDDSEVILYPQAIFRDPFRGGNNILVICDAYTPQGEPIPTNKRHRAAEIFSNPKVQAEIPWYGIEQEYTLLQTDVKWPLGWPVGGYPGPQGPYYCAAGADKSFGRDISDAHYKACLYAGINISGTNGEVMPGQWEYQVGPSVGIEAGDHIWASRYLLERITEQAGVVLTLDPKPIEGDWNGAGAHTNYSTKSMREEGGFEVIKKAILNLSLRHQDHIRAYGEGNERRLTGKHETADINTFSWGVANRGCSIRVGRDTEKEGKGYLEDRRPASNMDPYVVTALLAETTLLWEPTLEAEALAAQKIQLKV

SEQ ID NO: 2227 - DNA, 1665 bp, Spiraea nipponica
  CDS (86)..(1375)
acactcagctctgaacagcaaaacccagttcaaccttcttccagccaaattggagcggagatcagtgagggaggagtaggccaaaatggcacatattttggcacccactacacaatggcagacgagaattacaaagaacgcaaccagtgcaagtcctatgacagcaaagatgtggggttctctgttgttgaaacagaacaagaaaggaccaactaagacctctactaaatttagagtgttggccgtcaagtctgaaggttataccataaacaggctagagggtttactaaatctcgacttaactccattcactgacaagattattgctgagtacatttggattggagggacaggggtggatgttcgtagcaagtcaaggacaatttcaaaacctgttgaacatccatctgagcttcccaagtggaattatgatggatcaagtactgggcaggcacccggtgaagacagtgaagtaatcttataccctcaagcgatattcaaggacccatttcgtggcggaaacaatatattggtaatttgtgatgcatacacaccacaaggcgagcctatcccaacaaacaagcgagccaaggctgctgagattttcgcaaagcagaaggtcatagatgaagtcccatggtatgggatagagcaagagtacacattacttcaaactgatgtgaaatggcccttaggttggcctgttggaggttatcctggtcctcagggtccctattactgcggtgctggtgcagacaagtcattcggccgtgacatatcagatgctcattacaaggcttgcctatatgctggaattaacataagtggaaccaatggggaggttatgcctggccagtgggagtatcaagtaggtcctagtgtgggaattgaagctggcgatcatatttgggcttcaagatacatccttgagagaatcactgaacaagctggtgttgttctcacacttgatccaaaaccgatagagggtgactggaatggtgcaggatgccacaccaattacagtacaaagagcatgagggaagaaggcggctttgaagttattaagaaggcaattcataaactgtcgcttcgccacaaagagcatattagtgcctacggagaaggaaatgagagaaggttgacaggaaagcatgaaacagccagcattaacacattttcttggggggtggctaatcgtggttgctcaattcgtgttggtcgtgagactgagaagcaagggaaaggttatctggaggatcggcgtccagcttcaaacatggacccttacattgtcaccggactgctggcagaaactacattattgtgggaggaggctgaggctcttgctgctacaaaacttgaacagaatgtctgaaacaattcgtagaggataaatccagttgggcttaagattctgtgaattgagacaatgcagccaagtgtgaatcatttttcctcaccttttaaattccttagagaagatccttcgaaaataaaggtcccattaaggtgattgtaatgtactgcttcagtttgtagaatgttttcttgtatcacacaatcttgtaaatcaggaatatccttaattaaaagcatttgacaaaaaaaaaaaaaaaaaaaaaaaaaaaaaaaaaaaaaaaaaaaaaaaaaaaaaaaaaaaaaaaa

SEQ ID NO: 2228 - protein, 429 aa, Spiraea nipponica
MAHILAPTTQWQTRITKNATSASPMTAKMWGSLLLKQNKKGPTKTSTKFRVLAVKSEGYTINRLEGLLNLDLTPFTDKIIAEYIWIGGTGVDVRSKSRTISKPVEHPSELPKWNYDGSSTGQAPGEDSEVILYPQAIFKDPFRGGNNILVICDAYTPQGEPIPTNKRAKAAEIFAKQKVIDEVPWYGIEQEYTLLQTDVKWPLGWPVGGYPGPQGPYYCGAGADKSFGRDISDAHYKACLYAGINISGTNGEVMPGQWEYQVGPSVGIEAGDHIWASRYILERITEQAGVVLTLDPKPIEGDWNGAGCHTNYSTKSMREEGGFEVIKKAIHKLSLRHKEHISAYGEGNERRLTGKHETASINTFSWGVANRGCSIRVGRETEKQGKGYLEDRRPASNMDPYIVTGLLAETTLLWEEAEALAATKLEQNV

SEQ ID NO: 2229 - DNA, 1299 bp, Crataegus crus
  CDS (1)..(1299)
atggcgcagattttggcacccacttcacaatggcggatgaaagttacaaggagctcagcaactgccagtcctatgacagcaaagatgtggggttctcttgtgttgaaacagaacaagaaaggaccagctcggagctctactaaatttagagtgctcgccaccaagtccgaaggttataccataaacaggctagagggtttactaaacctggacctcactccattcactgacaagattattgccgagtacatttggattggagggtcaggcgttgatgtccgtagcaagtcaaggacaatttcaaagcctgttgaggatccttctgagcttcccaagtggaattatgatggatcaagtaccggacaagcgcccggtgaagacagtgaagtaatcttataccctcaggcaatatttaaggaccctttccgtggtggcaacaatattttggtaatttgcgatgcatacacaccgcaaggcgagcctatcccaacaaacaagcgcgccagggctgctgagattttcaagaacaagaaggttatagacgaagtcccatggtatgggattgagcaagagtacacattactccaaaccgatgtgaaatggcctttgggatggccaattggaggttatcctggtcctcagggtccctactactgtggtgctggtgcagacaagtcattcggccgtgacatatcagatgctcactacaaggcttgcctatatgccggaatcaacatcagtggcaccaatggggaggttatgcctggccagtgggagtatcaagttggtccgagtgtgggaattgaagctggagatcatatctgggcttcaagatacattcttgagagaatcactgaacaagctggtgttgttctcacacttgatccaaaaccgatagagggtgactggaacggtgcagggtgccacaccaattacagtacaaagagcatgagggaagatggaggctttgaagttattaagaaggcaattttgaacctgtcacttcgccatgttgagcacattagtgcctacggagaaggaaatgagagaaggttgacaggaaagcatgaaacagccagcattaacacattttcttggggagtggctaatcgtggttgctcaatccgtgttggtcgtgaaactgagaagcaaggaaaaggttatctggaggatcgtcgtccagcttcaaacatggacccttacattgtgacctcgctgctggcagaaactacattgttgtgggagccaacccttgaggctgaagctcttgcagctcaaaagcttgcattgaacgtctga

SEQ ID NO: 2230 - protein, 432 aa, Crataegus crus
MAQILAPTSQWRMKVTRSSATASPMTAKMWGSLVLKQNKKGPARSSTKFRVLATKSEGYTINRLEGLLNLDLTPFTDKIIAEYIWIGGSGVDVRSKSRTISKPVEDPSELPKWNYDGSSTGQAPGEDSEVILYPQAIFKDPFRGGNNILVICDAYTPQGEPIPTNKRARAAEIFKNKKVIDEVPWYGIEQEYTLLQTDVKWPLGWPIGGYPGPQGPYYCGAGADKSFGRDISDAHYKACLYAGINISGTNGEVMPGQWEYQVGPSVGIEAGDHIWASRYILERITEQAGVVLTLDPKPIEGDWNGAGCHTNYSTKSMREDGGFEVIKKAILNLSLRHVEHISAYGEGNERRLTGKHETASINTFSWGVANRGCSIRVGRETEKQGKGYLEDRRPASNMDPYIVTSLLAETTLLWEPTLEAEALAAQKLALNV

SEQ ID NO: 2231 - DNA, 1696 bp, Lotus japonicus
  CDS (147)..(1439)
  misc_feature (934)..(934): n is a, g, c or t
  misc_feature (997)..(997): n is a, g, c or t
gcgtccgatatctatctcacacgagtctctcctactactattcttcacactctgcctcagggtctctgactcatacacggggcgcattttcacttgaacttagttcaagtttgcatctttagccatttttccactctctactgaacatggcacagattttggcaccctcgacgcaatggcagacgagaatcaccaaaacctctcccaatgcaagtcccattacatcaaacatgtggagttctttattgtggaaacaaaacaagaaagttgcacgtgcttctaagtttagagtactggcaatcaagtctgatggtagcaccatcaacaggctagagggtctgcttaatttggatgtcactccatacactgataagttcattgctgagtacatctggattggggggactggtgtcgatgttcgcagtaaatcaagaactatatcgaagcctgtttcacatccctctgagctccctaaatggaactatgatggatctagcactgggcaggcaccgggcgatgatagtgaagtaattctatatcctcaagcaattttcagagatcctttccgtggtggtaacaatattttggttatttgcgatgcttacacaccacaaggtgagcctatccctacaaacaagcggcacagagctgctgaaatcttcagtaacccaaaggttcaagctgaaattccatggtatggaatagaacaagagtacaccctacttcaaacggatgtgaagtggcctttgggatggcctgttggcggctatcctggtcctcagggtccctattactgtgctgccggggctgataagtcattcggacgtgatatatctgatgctcattacaaggcttgcttgtatgctggaatcaacatcagtggcaccaatggggaggttatgcctgggcagtgggagtatcaagttggtcctantgtaggtattgaagctggtgatcatatctgggcttcaaggtacctccttgagagaatcactgnacaagctggtgttgtcctcactcttgatccaaaaccaattgagggtgactggaacggtgccggagcccacaccaattacagcacaaagagcatgagggaagagggaggctttgaggtaatcaagaaggcaattttgaatctatcccttcgccaccaggaccatattcgtgcttatggagaaggaaatgagagacgattgacgggaaagcatgaaacagccgacattaacacattttcttggggagtggctaaccggggttgctcaatccgtgtgggaagagacacagagaaggaaggaaaaggttacttggaagacaggcgccctgcttcaaacatggatccatatgttgtgacagcattgctggcagagactaccttgttgtgggaaccaactctagaggctgaagctcttgcagctcagaagatacaattgaaggtctaaatctattgattgatggcattcttgatggagagcacgtacactttccttttagattatctacattctgaagatcttgtttggacaaaagaggctcctatgcccagttattgattgtcaaatgaaatgtgcactgtatatcataaattctgttggttatgtttgcatctggacaaacattgatgcttggttatatttcagtgttccttcggatttgaaaaaaaaaaaaaaaaaaaaaaaaaaaaaaaaaaaaaaaaaaa

SEQ ID NO: 2232 - protein, 430 aa, Lotus japonicus
  misc_feature (263)..(263): The Xaa at location 263 stands for Asn, Ile, Ser, or Thr.
  misc_feature (284)..(284): The Xaa at location 284 stands for Ala, Glu, Gly, or Val.
MAQILAPSTQWQTRITKTSPNASPITSNMWSSLLWKQNKKVARASKFRVLAIKSDGSTINRLEGLLNLDVTPYTDKFIAEYIWIGGTGVDVRSKSRTISKPVSHPSELPKWNYDGSSTGQAPGDDSEVILYPQAIFRDPFRGGNNILVICDAYTPQGEPIPTNKRHRAAEIFSNPKVQAEIPWYGIEQEYTLLQTDVKWPLGWPVGGYPGPQGPYYCAAGADKSFGRDISDAHYKACLYAGINISGTNGEVMPGQWEYQVGPXVGIEAGDHIWASRYLLERITXQAGVVLTLDPKPIEGDWNGAGAHTNYSTKSMREEGGFEVIKKAILNLSLRHQDHIRAYGEGNERRLTGKHETADINTFSWGVANRGCSIRVGRDTEKEGKGYLEDRRPASNMDPYVVTALLAETTLLWEPTLEAEALAAQKIQLKV

SEQ ID NO: 2233 - DNA, 1338 bp, Vitis vinifera
  CDS (27)..(1097)
ctgtgtcttattctttctattccaccatgtctctcctcgctgatctccaaaacatcaacctcagtgactccacggagaagattatcgccgaatacatatggatcggcggatccggaaatgatttgaggagtaaagcaaggaccctctccggtccggtcactggcccagcgcaactgccgaagtggaactacgatggatccagcaccggccaggctcccggcgaagacagtgaagtcattttataccctcaggcgatctttaaggatcccttcagaggaggagacaatattctggtcatgtgcgatgcctacactccagggggcgaaccaatcccgacaaacaagagattcaatgctgccaagatttttagccatcctgaagtgaccgccgaggagccttggtatggcattgagcaagaatatactcttcttcagaaggacgtcaactggccgcttggatggccagtcggcggcttccctggccctcagggcattatctactgtggaattggggctgacaaggcctttggtcgtgacatagtagattctcactacaaggcatgcctgtatgctggaatcaacatttctggaatcaatggagaggtcatgcctgggcagtgggaattccaagttgggcctgcagttgggatctctgctggtgatgaattatgggttgcccggtacattctggagaggattaccgaaattgctggagttgtcgtttcattcgacccaaaacctatcaagggagactggaatggtgctggagctcacaccaactatagcacgaaatccatgaggaatactggtggatatgatgtgattaaaaaggcaattgaaaagttgggtttgcgccacaaggagcatatttcagcttatggagagggtaatgagagaagattgacaggtcgccatgaaacagctgacatcaacactttctgttggggagttgccaacagaggtgcctctatccgtgttggccgtgacactgaaaaagaaggaaaaggttactttgaagacagaagacctgcttccaacatggatccaatcgttgtcacttccatgatcgccgagaccaccatcctctggaagccttaacaaggaaagtggaatatagaaattgattgaaggaaaaccagtatggtcagatttcaataaataattgtgttaattcctatttctgctgctttgaattgatgggttgcttgtcaaacttgggtttccttttggctttggtggaaagttctcatctgttgaactctctgtttaaagtactgctatattctgccttcgaatgttgacgttatgaagtggtatgtatgccttctcaattcaaaaa

SEQ ID NO: 2234 - protein, 356 aa, Vitis vinifera
MSLLADLQNINLSDSTEKIIAEYIWIGGSGNDLRSKARTLSGPVTGPAQLPKWNYDGSSTGQAPGEDSEVILYPQAIFKDPFRGGDNILVMCDAYTPGGEPIPTNKRFNAAKIFSHPEVTAEEPWYGIEQEYTLLQKDVNWPLGWPVGGFPGPQGIIYCGIGADKAFGRDIVDSHYKACLYAGINISGINGEVMPGQWEFQVGPAVGISAGDELWVARYILERITEIAGVVVSFDPKPIKGDWNGAGAHTNYSTKSMRNTGGYDVIKKAIEKLGLRHKEHISAYGEGNERRLTGRHETADINTFCWGVANRGASIRVGRDTEKEGKGYFEDRRPASNMDPIVVTSMIAETTILWKP

SEQ ID NO: 2235 - DNA, 1557 bp, Populus tremula x Populus alba
  CDS (114)..(1184)
acactgtactccttaaagctttcaggccctggccccagctagacaccactgctaacacaggcaggttgaagagctagaagaagagaagagttgcctattattactgtgtggacatgtcacttctcacggacctaattaaccttaagctctctgacattactgacaagataattgcggaatatatctggattggaggctcaggtatggatatgagaagtaaagccagaacgctctcaggcccagttacggatccagcacaactacctaagtggaattacgacggctctagtaccggccaagcaccaggcgaggatagcgaggtaatactttatcctcaagcgatctttaaagacccgttcagaagaggtaataacattctcgttatgtgcgacgcgtatactccgcaaggcgaacctatcccgaccaataagaggtatgccgctgcgaagatatttagctcaccagaggttgctgctgaggaaccatggtatggaatcgaacaggagtatacattacttcaaagggacgtcaactggccgataggttggcctgtcggaggctatccaggaccgcaaggtccttattactgcggtatcggcgccgataaggcgtatgggcgagacattgttgatgctcactataaagcttgcctatacgcaggtattaatatcagtggcatcaacggtgaggttatgcctggacaatgggagttccaggtgggcccgtcagtaggcatctctgctggtgatcatatttgggctgcacgatatatattggaaagaatcactgaacaagctggcgtggtactctccttcgacccgaagcctatcaaaggcgattggaacggagcaggtgcgcatactaattacagcacgaagtcgatgagagaggacggtggatacgaagttattaagaaggcgatcgaaaagttaggtctcagacataaggagcatatcagtgcgtacggagagggtaacgagcgtcggcttacaggtagacacgagacagccgatattaatacgttctcatggggagtagcgaatcgaggtgcgtctatccgagtcggtcgtgatacagagaaggagggtaaaggctactttgaagatagaagaccagcgtcgaatatggacccgtacgtggtcacgtcgatgatcgctgagactacgattctatggaagccgtaagcaagttcatgctggcaataactaaaaatttgaaacacctttgtttttacgctgtgtctgtcccagtgtacaaagaactgtgaatcagtcccaacttgaactccatgtccaatcaacttgctctttgatatgaaattttactattgtttgctcagttcgagtttgtatgcatcattgtccgaggtgtagcttggttgatttattgcatcagatcgattctttgcatatgacttcattctcctagatgcaggttaatataataaaacgccctaatacaatatcattagaatcatgcgttacctgacagatccctctagttagtacgctcgaatactactaggtatggtaaaaaaaaaaaaaaaaaaaaaaaaaa

SEQ ID NO: 2236 - protein, 356 aa, Populus tremula x Populus alba
MSLLTDLINLKLSDITDKIIAEYIWIGGSGMDMRSKARTLSGPVTDPAQLPKWNYDGSSTGQAPGEDSEVILYPQAIFKDPFRRGNNILVMCDAYTPQGEPIPTNKRYAAAKIFSSPEVAAEEPWYGIEQEYTLLQRDVNWPIGWPVGGYPGPQGPYYCGIGADKAYGRDIVDAHYKACLYAGINISGINGEVMPGQWEFQVGPSVGISAGDHIWAARYILERITEQAGVVLSFDPKPIKGDWNGAGAHTNYSTKSMREDGGYEVIKKAIEKLGLRHKEHISAYGEGNERRLTGRHETADINTFSWGVANRGASIRVGRDTEKEGKGYFEDRRPASNMDPYVVTSMIAETTILWKP

SEQ ID NO: 2237 - DNA, 1541 bp, Glycine max
  CDS (30)..(1328)
ccactgtttattgagaacaactgcagaacatggcacagattttggctccctctacgcaatggcagatgagaatctcaaaatcctctcccaatgcaagtcccattacatcaaacatgtggagttctttattgtggaaacaaaataagaaagtttcacccacaagttctgctaaatttagagtgatggcaattaagtctgacaatagcatcatcaacaggctagagggtctacttaatttggatatcactccattcacggacaagataattgctgagtacatttggattggggggacaggaattgatgtgcgcagtaaatcaagaacaatatcaaagcctgttgaacatccctctgagctccctaaatggaactatgatggatctagcactggacaggcaccgggtgatgatagtgaagtaatcctatatcctcaagcaattttcaaagatccgttccgtggtggtaacaatattttggtcatttgcgattcttacaccccacaaggtgagcctatccctacaaacaagagacacagagctgctgaaattttcagtaacccaaaggtccaagcagaagttccatggtatggaatagaacaagagtacaccttacttcaaacaaatgtgaaatggccattaggttggcccgttggtggctatcctggtcctcagggtccttattattgcagcgctggggcagacaagtcatttggacgtgacatatctgatgctcattacaaggcttgcttatatgctggaattaacatcagtggtacgattggagaggtgatgcctggtcagtgggagtaccaagttggtcctagtgtaggtattgaggctggtgatcatatctgggcttcaaggtacatcctcgagagaattactgagcaagctggtgttgtgctctctcttgatccaaaaccaatagagggtgactggaatggagcaggatgccacaccaattacagtacaaagagcatgagggaagatggaggctttgaggtaataaagaaggcaattttgaatctatcgctacgccacaaggatcacatcagtgcatatggagaaggaaatgagagaaggttgacaggaaagcatgagacagcaagcattaacacattttcttggggagtggctaaccgtggttgctcaatccgtgtgggaagagacacagagaagaatggcaaaggttacttggaagacaggcgaccgacttcaaacatggatccatatgttgcgacatcattacttgcagagactacactattgtgggagccaactctggaggctgaagctcttgcagctcagaagttagcattgaaggtctaaacctattgaatgatggcattctggatgcaaaatcactttccttttagattatctatatgtattctaatgatcttgtttggactaaagaggttgccatgcccagttattggttatcatatgaaatgcacattgtatatcagaagtttggttggtactacttgcttcaggacaaattttctttgatgcttggttaaaaaaaaaaaaaaaaaaaaa

SEQ ID NO: 2238 - protein, 432 aa, Glycine max
MAQILAPSTQWQMRISKSSPNASPITSNMWSSLLWKQNKKVSPTSSAKFRVMAIKSDNSIINRLEGLLNLDITPFTDKIIAEYIWIGGTGIDVRSKSRTISKPVEHPSELPKWNYDGSSTGQAPGDDSEVILYPQAIFKDPFRGGNNILVICDSYTPQGEPIPTNKRHRAAEIFSNPKVQAEVPWYGIEQEYTLLQTNVKWPLGWPVGGYPGPQGPYYCSAGADKSFGRDISDAHYKACLYAGINISGTIGEVMPGQWEYQVGPSVGIEAGDHIWASRYILERITEQAGVVLSLDPKPIEGDWNGAGCHTNYSTKSMREDGGFEVIKKAILNLSLRHKDHISAYGEGNERRLTGKHETASINTFSWGVANRGCSIRVGRDTEKNGKGYLEDRRPTSNMDPYVATSLLAETTLLWEPTLEAEALAAQKLALKV

SEQ ID NO: 2239 - DNA, 1296 bp, Beta vulgaris subsp
  CDS (1)..(1296)
atggctcaaatacttgcacctaacatgcaatgtcagatgaaactatcaaagagcttgacaaactcaatgataccaaactcttggacctccatattactgaaaggaagtcaaaagggatcaattaagtgctctacgaagtttaaagtatgtgccgctctcaagactgaacatggcactgtgaacaggatggagcaattactcaatttggatgtcactccatttactgacaagattattgcagaatacatttggattggaggatctgggattgatcttcgtagcaaatcgaggacactatcacgacctgttgaggacccatctgagcttcccaagtggaactatgatgggtcaagcacaggacaagcacctggagaagacagtgaagtaatcttatacccccaagcaatttttaaggatccattccgtggtggtaacaatattttggtaatatgtgacgcatacacaccagcaggtgagccgatcccaacgaataaacgacacaaagctgccgagatcttcagcaacccaaaggttgcttctgaggttccatggtttggaatagagcaagaatacacgctgcttcaaccaaatgttcaatggcccttgggatggcctgtcggagcctatcctggtccccagggaccatattactgtggtgttggtgctgataaatcgtttggacgtgacatatctgatgctcattataaagcttgcctgtatgctggaataaacataagtggcaccaacggggaggtcatgcctggccagtgggaatttcaggttggtcctagtgttgggattgaagctggagatcatatctggtgtgccagatatcttcttgagagaatcactgagcaagctggtgtagttttgacacttgatccgaagccaattgagggtgattggaacggcgcaggttgccataccaattacagtacaaagacaatgagagaagacggtggttttgaagtaataaagaaggccattttgaatctatcattacgccataaagaacatatcagtgcatatggagaagggaatgaaagaagactgacagggaagcatgagactgccgacatcgacacattctcttggggtgtcgccaatcgtggttgttcaatccgtgtgggtcgtgatacggagaaggaaggcaaaggttacatggaagacaggcgacctgcttcaaacatggacccttacgtggtaacaggtttgctagcagagtcaacactactttgggaacccacactcgaagctgaggcacttgcagctcaaagactctctctcaatgtgtaa

SEQ ID NO: 2240 - protein, 431 aa, Beta vulgaris subsp
MAQILAPNMQCQMKLSKSLTNSMIPNSWTSILLKGSQKGSIKCSTKFKVCAALKTEHGTVNRMEQLLNLDVTPFTDKIIAEYIWIGGSGIDLRSKSRTLSRPVEDPSELPKWNYDGSSTGQAPGEDSEVILYPQAIFKDPFRGGNNILVICDAYTPAGEPIPTNKRHKAAEIFSNPKVASEVPWFGIEQEYTLLQPNVQWPLGWPVGAYPGPQGPYYCGVGADKSFGRDISDAHYKACLYAGINISGTNGEVMPGQWEFQVGPSVGIEAGDHIWCARYLLERITEQAGVVLTLDPKPIEGDWNGAGCHTNYSTKTMREDGGFEVIKKAILNLSLRHKEHISAYGEGNERRLTGKHETADIDTFSWGVANRGCSIRVGRDTEKEGKGYMEDRRPASNMDPYVVTGLLAESTLLWEPTLEAEALAAQRLSLNV

SEQ ID NO: 2241 - DNA, 1071 bp, Beta vulgaris subsp
  CDS (1)..(1071)
atggctcttcttaacgatctaattaaccttaatctctcagaaacatctgacaagattattgctgagtatatatggatcggaggatctgggttggatatgagaagcaaagcaaggacattaacagggccaataagtgatcctgcaaaattaccaaaatggaattacgatggatcaagtactaatcaagctcctggtgaagatagtgaagtcattttataccctcaggctattttcaaggatccattcagaagaggagacaatatcctagttatgtgtgatgcatacaccccagctggagaaccaattccaacaaacaagaggtacaatgctgagaaaatcttcagccacccagacgttgtcgctgaggagccatggtatggaattgaacaagaatacacacttcttcagaaggatatcaactggcctcttggatggccaactggtggcttccctggtcctcagggaccatactattgtggtgtaggggctgataaatctttcgggcgagacattgtagatgctcactataaggcttgcatctatgctggtgtcaatatcagtggaattaatggtgaagtcatgccaggacagtgggaattccaagttggtcctactgttggaatttcatctggtgatcaagtctgggttgctagatacattcttgagagaattgctgagattgccggagttgttgtgtcttttgaccccaaaccagtgaagggtgattggaatggtgctggtgctcacaccaactacagcactaagtcgatgagggaagatggtgggatcaatgttataaaggctgccatcgagaagttgagtctccgtcacaaggagcacattgctgcctacggggagggcaacgagaggaggctcactggtcgtcatgagacagccgatatcaccactttctcctggggtgttgcaaataggggtgcctctgttcgtgttggccgtgacacagagaaagatggcaaaggttactttgaagacagaaggccagcatcaaacatggatccatatgtggttacctccatgattgctgaaacaactatcctcggaaagccttga

SEQ ID NO: 2242 - protein, 356 aa, Beta vulgaris subsp
MALLNDLINLNLSETSDKIIAEYIWIGGSGLDMRSKARTLTGPISDPAKLPKWNYDGSSTNQAPGEDSEVILYPQAIFKDPFRRGDNILVMCDAYTPAGEPIPTNKRYNAEKIFSHPDVVAEEPWYGIEQEYTLLQKDINWPLGWPTGGFPGPQGPYYCGVGADKSFGRDIVDAHYKACIYAGVNISGINGEVMPGQWEFQVGPTVGISSGDQVWVARYILERIAEIAGVVVSFDPKPVKGDWNGAGAHTNYSTKSMREDGGINVIKAAIEKLSLRHKEHIAAYGEGNERRLTGRHETADITTFSWGVANRGASVRVGRDTEKDGKGYFEDRRPASNMDPYVVTSMIAETTILGKP

SEQ ID NO: 2243 - DNA, 1374 bp, Avicennia marina
  CDS (65)..(1135)
gcccacgcgtccggccgaacacgggaaacacaaggagtgaaagagcagttgaaagttttccataatgtctctgctttcagatctcctcaacctcgacctctctgagaccactgagaagatcattgctgaatatgtttgggttggtggctccggtatggaccttaggagtaaagccaggactatttctggacccgttagcgatccttcaaagctgccaaaatggaactatgatggatctagcacaggccaagcccccggcgaagacagtgaagtgatcctatatccccaagcaattttcagagatcctttcaggaggggaaagaacatcctggtcatgtgtgatacttacaccccagctggcgaaccaattccaaccaacaagaggcacgctgcagccaaaattttcagccatcctgatgttgctgctgaagagccttggtatggaattgagcaagaatacactttgctgcaaaagaatgtcaagtggcccatgggatggcctactggaggttaccctggaccccagggcccatactactgtggagtcggagcagacaaagcttttggacgcgatattgtggatgcacattacaagtcttgcctttatgctggaatcaacatcagcggtattaatggggaagtgatgcctggacagtgggaattccaagttggacctgctgttggcatctcagctggtgatgagttgtggatggctcgttacattttggagaggatcacagaaattgctggggttgtgctgtcctttgatcccaagcctatccagggtgactggaatggggccggcgcccacactaattacagcaccaaatccatgaggaaggagggaggctttgaagttatcaagaaggcaattgagaagctcggacacaggcacaaagaacacattgctgcctatggcgagggcaacgagcgccgtctcactgggagacatgaaactgctgacatcaactccttcaaatggggggttgcgaaccgtggtgcatccgtccgtgttggtcgggacactgagagagaaggcaaggggtactttgaggacaggaggcctgcctcgaacatggacccttacattgtcacttccatgatagccgagaccaccatcttagggaagcactgagcttgtttggtgtcaactggtcttctgtgaagggagaaatggattgttatttagtataagatgaaggttgattgtttgctttagggaagcactgcatttgtttactatttgctggtttacttgttatgctatgacaacctctgcatttctggctgcaaggtttgagcttgtctcaaccttcttgattgagcctgcctaataatattgagatcataaataaaaaaaaaaaaaaaaaaaaa

SEQ ID NO: 2244 - protein, 356 aa, Avicennia marina
MSLLSDLLNLDLSETTEKIIAEYVWVGGSGMDLRSKARTISGPVSDPSKLPKWNYDGSSTGQAPGEDSEVILYPQAIFRDPFRRGKNILVMCDTYTPAGEPIPTNKRHAAAKIFSHPDVAAEEPWYGIEQEYTLLQKNVKWPMGWPTGGYPGPQGPYYCGVGADKAFGRDIVDAHYKSCLYAGINISGINGEVMPGQWEFQVGPAVGISAGDELWMARYILERITEIAGVVLSFDPKPIQGDWNGAGAHTNYSTKSMRKEGGFEVIKKAIEKLGHRHKEHIAAYGEGNERRLTGRHETADINSFKWGVANRGASVRVGRDTEREGKGYFEDRRPASNMDPYIVTSMIAETTILGKH

SEQ ID NO: 2245 - DNA, 1403 bp, Glycine max
  CDS (60)..(1130)
tctaaaagagatctttttctgctctttgaagaaagaagggtctttgcttgattttggagatgtctctgctctcagatctcatcaaccttaacctctccgataccaccgagaaggtgatcgcagagtacatatggatcggtggatcaggaatggacctgaggagcaaagcaaggactctcccaggaccagttagcgacccttcagagcttcccaagtggaactatgatggttccagcacaggtcaagctcctggtgaagacagtgaagtgattttatacccacaagccattttcagggatccattcagaaggggtaacaatatcttggttatctgtgatgcctacactcctgctggagaacctattcccactaacaagaggcacgctgctgccaaggttttcagccatcctgatgttgttgctgaagtgccatggtacggtattgaacaagaatacaccttgttgcagaaagatatccaatggcctcttgggtggcctgttggtggtttccctggacctcagggtccatactactgtggtgttggcgctgacaaggcttttggccgtgacattgttgacgcacactacaaagcctgtatttatgctggcatcaacatcagtggaattaatggagaagtgatgcccggtcagtgggaattccaagttggaccttcagttggaatctcagctggtgatgagatttgggcagctcgttacatcttggagaggatcactgagattgctggtgtggtggtttcctttgaccccaagccaattaagggtgattggaatggtgctggtgctcacacaaactacagcaccaagtccatgagagaagatggtggctatgaagtgatcaaagcagcaattgacaagttggggaagaagcacaaggagcacattgctgcttatggagaaggcaacgaacgtcgtttgacaggacgccacgaaaccgctgacatcaacaccttcttatggggagttgcaaaccgtggagcttctgttagggttgggagagacacagagaaagcagggaagggatattttgaggacagaaggccagcttccaacatggacccatacgtggttacttccatgattgcagacacaaccattctgtggaagccatgagcaaaacctgcatgttttctccctttggatggaaaggaacagttatgcttttcttagtaggatttggtctctctctctttttaccttttgattggtactatggttggtgccttgttggttggtgcaactaactggcaagggttgttcattgttttcttctattcctttccctcgttttccgattgttacaatgacaataatttaatggttattatcagtcttgaacaaagaaatgctgattgtgaagtataataataatatatgaaattgccg

SEQ ID NO: 2246 - protein, 356 aa, Glycine max
MSLLSDLINLNLSDTTEKVIAEYIWIGGSGMDLRSKARTLPGPVSDPSELPKWNYDGSSTGQAPGEDSEVILYPQAIFRDPFRRGNNILVICDAYTPAGEPIPTNKRHAAAKVFSHPDVVAEVPWYGIEQEYTLLQKDIQWPLGWPVGGFPGPQGPYYCGVGADKAFGRDIVDAHYKACIYAGINISGINGEVMPGQWEFQVGPSVGISAGDEIWAARYILERITEIAGVVVSFDPKPIKGDWNGAGAHTNYSTKSMREDGGYEVIKAAIDKLGKKHKEHIAAYGEGNERRLTGRHETADINTFLWGVANRGASVRVGRDTEKAGKGYFEDRRPASNMDPYVVTSMIADTTILWKP

SEQ ID NO: 2247 - DNA, 1577 bp, Canavalia lineata
  CDS (91)..(1383)
gacacacacagacacaaccgcattttcacttcaacttctctgctttacccatttttctactctctattgtaaagagcagaagtgcagaacatggcacaaattttggcaccctctacgcaatggcagatgagaatcacgaaaacatcacccaatgcaagtcccgtcacatcaaacatgtggagttctttgttgatgaaacaaaataagaaagctacaagttctgctaaatttagagtgctggcaatcaagtctgaaaatggcaccatcaacaggctggaaaatctacttgatttggacatcaccccatacactgacaagataattgctgagtacatttgggttgggggaacaggaattgatgtgcgcagtaaatcaagaacaatagcgaggccagttgaacatccctctgagctccctaaatggaattatgatggatctagcactggacaggcaccgggtgatgatagtgaagtaatcttatatcctcaagcaattttcaaagatcctttccgtggtggtaacaatattttggtcatttgtgatgcttacacgccagcaggtgagcctatccctacaaacaagcgacacagagctgctgaaattttcagtaacccaaaggtccaagccgaagttccatggtatggaattgaacaagagtacaccttacttcaaacaaatgtgaattggcctttaggttggcctgttggtggctatcctggtcctcagggtccttattactgcagtgctggggcagataagtcattcggacgtgatatatctgatgcacattacaaggcttgcttatatgctggaattaacatcagtggcaccaatggggaggttatgcctgggcagtgggagtttcaagttggtcctagtgtaggcattgaagctggtgatcatatctgggctgcgaggtacattcttgagagaattactgaacaagctggcgttgtgctctcactcgatccaaaaccaattcagggtgattggaatggtgcaggatgccacactaattatagtacaaagagcatgagggaagagggaggctttgaggtaataaagaaggccattttgaatctatcactccgtcactcggatcacattagggcatatggtgaaggaaatgagagaaggttgacaggaaagcatgagacagccgacattaacacattttcttggggagtggctaaccgcggttgctcaatccgtgtgggaagagacacagagaagaatggcaaaggttacttggaagacaggcgtccggcttcaaacatggatccatacgttgtgacatcattactggcggagactacactattgtgggaaccaactctagaggctgaagctcttgcagcacagaagatagcgttgaaggtctaaatctattgattggtggcattctggatggaatcggtagtctgtgggagctgttctttcactttccttttagattatttatattctaaagatcttgtttggactaaagaggttgtcatgcccagttattggttaccatatgaaatgcacatttgatatcagaagtttcgatggttaaaaaaaaaaaaaaaaaaaaa

SEQ ID NO: 2248 - protein, 430 aa, Canavalia lineata
MAQILAPSTQWQMRITKTSPNASPVTSNMWSSLLMKQNKKATSSAKFRVLAIKSENGTINRLENLLDLDITPYTDKIIAEYIWVGGTGIDVRSKSRTIARPVEHPSELPKWNYDGSSTGQAPGDDSEVILYPQAIFKDPFRGGNNILVICDAYTPAGEPIPTNKRHRAAEIFSNPKVQAEVPWYGIEQEYTLLQTNVNWPLGWPVGGYPGPQGPYYCSAGADKSFGRDISDAHYKACLYAGINISGTNGEVMPGQWEFQVGPSVGIEAGDHIWAARYILERITEQAGVVLSLDPKPIQGDWNGAGCHTNYSTKSMREEGGFEVIKKAILNLSLRHSDHIRAYGEGNERRLTGKHETADINTFSWGVANRGCSIRVGRDTEKNGKGYLEDRRPASNMDPYVVTSLLAETTLLWEPTLEAEALAAQKIALKV

SEQ ID NO: 2249 - DNA, 1666 bp, Juglans nigra
  CDS (96)..(1394)
aagaagccaactgggtcatcactctccctctgtatatcttcacccaaggtaattccggcaaaacccaccggccatccgccgttcctgagctgaaaatggcacatatcttgacacccactacgcgatggcagatgagaatcacaaagaattctgcaaatgcgagtcctatgacagcaaagatgtggggttctctgttgttgaaacaaaacaagaaagggtcatctaagagctcagctaagtttcgggtttttgccacgaagtcggagaacagcactgtcaacagaatagaaaaactactaaatttggacctcactccatatactgacaaaatcattgctgaatatatttggattggagggtccggaattgatctgcgtagcaagtcaaggacaatttccaagcctgttgaacatccatctgagcttcctaagtggaattatgatggatcaagtactggtcaagctccgggtgaagatagtgaagtaattctataccctcaagcgatctttaaggacccttttcgtggtggtaacaacatcttggtaatttgtgatacatacacaccagcaggtgagcctatcccaacaaacaaacgccacagggctgctgagatcttcactaacaagaaggtcgcagatgaagttccctggtatggaatagagcaagagtacaccttactacaacaaaatgtgaaatggccattaggttggcctgttggaggctatcctggtcctcagggtccttactactgtggtgctggggcagacaaatcatttggccgtgacatttcagacgcccattacaaagcttgcttatatgccggaattaacatcagtggtacaaatggggaggttatgcctggccagtgggagtatcaagttggacctagtgtgggaattgaagctggagatcatatatggtgttccagatacattcttgagagaattactgaacaagctggtgttgttctctcactcgatccaaaaccaatagagggtgatcggaacggtgcaggatgccacacaaattacagtacaaagagcatgagggaggatggaggctttgaagttataaagaaggcaattttgaatctgtcacttcgccataaagatcatatcagtgcctatggagaaggaaatgagagaaggttgacaggaaagcatgaaacagccagcattaacacattttcttggggagtggctaatcgtggatgctccatccgtgttggacgtgaaactgagaagcaaggcaaagggtacttggaagatcggcgtccagcttcaaacatggacccttatattgtgacctcgctactggctgaaactacaatattatgggaaccaacactggaggctgaagctctagctgctcagaagctggcactgaatgtttaaagttgattggttcaacgtaatctgaaggcattcgggagtggattcacagggaattagttaatcctcatgcagtgaacctttttcccttctagattggttagagcagatttattgtaaattagggatcttggagtgaggggtcgtacatgcccaggcatgtagaattgcagatggaatacttcttatgcaccatcataaatagatttgttagattatatatatgcatgttacttgggatgtatgcttctcaaaaaaaaaaaaaaaaaaaaaaa

SEQ ID NO: 2250 - protein, 432 aa, Juglans nigra
MAHILTPTTRWQMRITKNSANASPMTAKMWGSLLLKQNKKGSSKSSAKFRVFATKSENSTVNRIEKLLNLDLTPYTDKIIAEYIWIGGSGIDLRSKSRTISKPVEHPSELPKWNYDGSSTGQAPGEDSEVILYPQAIFKDPFRGGNNILVICDTYTPAGEPIPTNKRHRAAEIFTNKKVADEVPWYGIEQEYTLLQQNVKWPLGWPVGGYPGPQGPYYCGAGADKSFGRDISDAHYKACLYAGINISGTNGEVMPGQWEYQVGPSVGIEAGDHIWCSRYILERITEQAGVVLSLDPKPIEGDRNGAGCHTNYSTKSMREDGGFEVIKKAILNLSLRHKDHISAYGEGNERRLTGKHETASINTFSWGVANRGCSIRVGRETEKQGKGYLEDRRPASNMDPYIVTSLLAETTILWEPTLEAEALAAQKLALNV

SEQ ID NO: 2251 - DNA, 1590 bp, Nicotiana sylvestris
  CDS (67)..(1365)
ttcatattctctctcttcaacatatttttccagcatagcattaccaagttagttggttaggtgaagatggctcagatcttggctccatcaggagaatggcagatgagaatgacaaagagctcaacagatgctaatcccttgacttcaaagatgtggagttctgtggtgttgaagataataaaagaacttgctgttaaaagctctgccaaatttagattctttgctctggaatctgatagtggcactgtgaaccagagtgaacagctgctaaacttggacgtaactccatacactgacaagatcattgctgaatatatttggatcggaggatcaggaattgacatgcgcagtaaatcaaggactatttcaaagccagtcaagcatgcttctgagctcccaaagtggaactacgatggatcaagtactggacaagcacctggagaagacagtgaagtcattctataccctcaggcaatatttaaagaccctttccgtggtggtaacaacatcttggttatctgtgatgcctacacaccagctggagagccaattccatcaaacaaacgccataaagctgctcagatttttagcgactcaaaagttgtatctgaagttccatggttcgaaatagaacaagagtacaccttactccaacaaaatgtgaagtggcctttaggttggcctgttggaggctatcctggtactcagggtccttactacttgtgtgctggagcggataagtcatttggccttgatatatcagatgctcactacaaggcttgtctgtatgctggaattaacattagtggtactaacggagaggttatgccaggacagtgggaatttcaggtaggtcctagtgttgggattgaagctggagatcacatctggtgcgccagatacatccttgagagaattactggacaagcaggagttgttctctcacttgatccaaaaccaattgagggcgactggaatggtgccggatgccacactaactacagtacactaagtatgagagaagatggaggatttgaagtaataaagaaagcaaatctgaatctctcccttcgccacaaggagcatataaatgcatatggagagggaatcctcgagaagttgactggaaaccatgaaactgcaagcattgacaaattttcatggggagttgcattccgtggtgcctcaatccgtgtgggcgctgacactgagaagcaaggcaaaggttatttggaagaccgccgtccagcttcaaacatggacccctatgttgtgactggattacttgccgaaactactattctgtgggagccaaccaatgaggctgaagctcttgctgctcaaaagctcgcactgaaggtatgatgttttaattatttaagggcagattgatccataatcttcttagagttcatgatctgctaagtgaagaaacttgtaccttgtttagattgggttttagggaaaatcttgtaaaggaaccacaatttatcagttattcctataaaagaggttccttaagacaatgagactgtaattgttggaactactttgaacatatttatctttctttctccagatgaaaaaaaa

SEQ ID NO: 2252 - protein, 432 aa, Nicotiana sylvestris
MAQILAPSGEWQMRMTKSSTDANPLTSKMWSSVVLKIIKELAVKSSAKFRFFALESDSGTVNQSEQLLNLDVTPYTDKIIAEYIWIGGSGIDMRSKSRTISKPVKHASELPKWNYDGSSTGQAPGEDSEVILYPQAIFKDPFRGGNNILVICDAYTPAGEPIPSNKRHKAAQIFSDSKVVSEVPWFEIEQEYTLLQQNVKWPLGWPVGGYPGTQGPYYLCAGADKSFGLDISDAHYKACLYAGINISGTNGEVMPGQWEFQVGPSVGIEAGDHIWCARYILERITGQAGVVLSLDPKPIEGDWNGAGCHTNYSTLSMREDGGFEVIKKANLNLSLRHKEHINAYGEGILEKLTGNHETASIDKFSWGVAFRGASIRVGADTEKQGKGYLEDRRPASNMDPYVVTGLLAETTILWEPTNEAEALAAQKLALKV

SEQ ID NO: 2253 - DNA, 1345 bp, Canavalia lineata
  CDS (83)..(1150)
gctaaaccctgcttattactctatactctccatcatcatttgcttctctcaccacagtgttcttcttcagcacaaccagtccatgtctttagtctcagatctcatcaacctcaatctttcagaatctactgagaagattattgctgagtacatatgggttggtggatctggtatggacctaagaagtaaagccaggactcttcctggaccagtgagtgatccttctaaacttccaaagtggaactatgatgggtcaagcacagatcaagctcctggggatgacagtgaagtcattttatatccacaagctattttcaaggacccatttaggagaggcaataatattcttgtgatttgtgatgtttacaccccagctggagaaccacttccaacaaacaagaggcatgatgctgccaaaatcttcactcaccctgatgttgttgctgaggagccatggtatggtattgagcaagagtataccttgttgcagaaagatgtgaattggccacttgggtggccacttggtgggtatcctgggccacagggaccctactactgtggagttggtgctgataaagcctatggtcgtgatattgtagatgcacattacaaagcttgtgtttatgcaggaattaacatcagtggcatcaatggagaggttatgcctggccagtgggaattccaagtgggtccttctgttggaatctctgctggagatgagctatgggctgctcgttacattttggagaggattactgagatagctggagcagttgtttcatttgatcctaaaccaattccgggagattggaatggagctggtgctcacacaaactatagcaccaagtctatgagagatgagggaggttatgaggttattaagaaagccattgaaaaacttggattgaagcacaaagagcacattgcagcatatggaaaaggcaatagacgtctcactggaagacatgaaacagcagacatcaacaccttctcttggggtgtggcaaaccgtggaagctccattagagttggaagagacacagaaaaggagggtaaaggttactttgaggacagaaggcctgcttctaatatggatccctatgtggtaacctccatgattgcagagaccaccatcctctggaagccatgaaatcatagaccaccaccatcaattatgtgtgttccattgcattttaatcaacaacttatatctccaaggtgttattttgctgagtggtcttttcaaccaaagtatttccctatgtcctttgtatggttcaacactaattttctcattaataataataataataataattgcttcttgaaaaaaaaaaaaaaaaaa

SEQ ID NO: 2254 - protein, 355 aa, Canavalia lineata
MSLVSDLINLNLSESTEKIIAEYIWVGGSGMDLRSKARTLPGPVSDPSKLPKWNYDGSSTDQAPGDDSEVILYPQAIFKDPFRRGNNILVICDVYTPAGEPLPTNKRHDAAKIFTHPDVVAEEPWYGIEQEYTLLQKDVNWPLGWPLGGYPGPQGPYYCGVGADKAYGRDIVDAHYKACVYAGINISGINGEVMPGQWEFQVGPSVGISAGDELWAARYILERITEIAGAVVSFDPKPIPGDWNGAGAHTNYSTKSMRDEGGYEVIKKAIEKLGLKHKEHIAAYGKGNRRLTGRHETADINTFSWGVANRGSSIRVGRDTEKEGKGYFEDRRPASNMDPYVVTSMIAETTILWKP

SEQ ID NO: 2255 - DNA, 1579 bp, Mesembryanthemum crystallinum
  CDS (88)..(1389)
  misc_feature (1405)..(1405): n is a, g, c or t
ctctctttctctctcctcctcttcttcagttccgcagctttgtcttcaacggctccgatccggcaacagagaaacaagtagccaaacatggcgcaaatacttgcaccaagcttgcaagtgaagatgagcatcacaaaaagctcaacccctgcaagctcaatgttgccaaacacatggacctctgtagtgttgaagcagagccgaaaaggatcgatcaagaactcgaccaaatttaaagtctgtgcttctattaagccagatgtaagtgttcagaacagggtggagcagctactcaatttggatgtcactcctttcactgacaagatcattgctgaatacatttggatcggaggagctggcattgatctccgtagcaaatcaaggacactctcgaaacctgttgagcacccatctgagcttcccaagtggaattatgatgggtctagcacagggcaggctccaggagaagacagtgaagtcatcttatacccacaagcaatttttaaggacccgttccgtggtggtaacaatatcttggtaatttgtgatgcatacacgccagcaggcgagccaattccgactaacaaaagacacaaggctgccgagatctttagcaatccaaaggtcgtttctgaggttccatggtatgggatagagcaagagtacacgttgatgcaaccgaatgtcaagtggcccttgggttggcctgttggagcctatcctggtcctcagggtccatactactgtggtgttggtgctgataaatcctttgggcgtgacatatccgatgcccattacaaagcatgcttgtatgctggaattaacataagtggcaccaatggggaggttatgcctggccagtgggaattccaagtgggtccaagtgtcggaattgaagctggagatcacgtctggtgtgccagatatattcttgagagaatcactgagcaagttggtgtagttctcacccttgatccaaaaccaattgagggtgattggaacggtgcagggtgtcataccaattacagtacaaagagcatgagagaagaaggtggtttcgaagtaattaagaaggcaattttaaacctttcattgcgccacaaagatcatatcagcgcatatggagaagggaatgaaagaaggttgacagggaagcatgaaactgccagtatcgactctttctcttggggagtcgctaatcgtggttgctcaatccgtgtgggtcgtgatacagagaaggcaggaaaaggatacttggaagataggcgaccggcttcaaacatggacccatacgtggtaacaggcttgctagcagagaccacattactttgggagccaacattagaggctgaggcacttgcagctcagaaaattgcaatgaaagtttaaaaattcttgtagatcnaacctgaaaacattggaaagggcctatatggcacttactgttgacttaacaattttatgttctgtccttagtattatgcatttgggacttgggagtgtggactgcatttttttttttgttttccaattgttggttatgaatattttgaaataaaagaattagttacttcaagcc

SEQ ID NO: 2256 - protein, 433 aa, Mesembryanthemum crystallinum
MAQILAPSLQVKMSITKSSTPASSMLPNTWTSVVLKQSRKGSIKNSTKFKVCASIKPDVSVQNRVEQLLNLDVTPFTDKIIAEYIWIGGAGIDLRSKSRTLSKPVEHPSELPKWNYDGSSTGQAPGEDSEVILYPQAIFKDPFRGGNNILVICDAYTPAGEPIPTNKRHKAAEIFSNPKVVSEVPWYGIEQEYTLMQPNVKWPLGWPVGAYPGPQGPYYCGVGADKSFGRDISDAHYKACLYAGINISGTNGEVMPGQWEFQVGPSVGIEAGDHVWCARYILERITEQVGVVLTLDPKPIEGDWNGAGCHTNYSTKSMREEGGFEVIKKAILNLSLRHKDHISAYGEGNERRLTGKHETASIDSFSWGVANRGCSIRVGRDTEKAGKGYLEDRRPASNMDPYVVTGLLAETTLLWEPTLEAEALAAQKIAMKV

SEQ ID NO: 2257 - DNA, 1451 bp, Pinus sylvestris
  CDS (78)..(1145)
ggaattcggcacgagggccttcactgcttgcgaaattatacttgtgcgggagtctgtgattttgttgtacatccaagatgtctctactgacggatttgatcaacttggacctctctgatatcactgagaagataatcgctgagtacatatggatcggaggctctggcatggatatccgcagcaaggccaggaccttatctcacccagttacggaccccaaagatctacccaagttgaattatgatggatccagtactggacaggctcctggaaaggacagtgaagtcatcctttaccctcaggctatcttcagggatccattccgcagggggaacaacatcttggtgatttgtgatacatataccccagctggagaacctattcctactaacaagagagcaaatgcgcaaaaatatttagccatccagatgttgtttgccgaggaaccatggtatgggattgaacaagaatacactcttctgcaaaaggatgtgaattggcctcttggatggcccgtaggtggttaccctggtcctcagggtccttattattgtggaacgggagcagacaaagcctacggccgtgatatcgtcgatgcccactataaggcttgcctgtatgcaggaatcaacattagtggcatcaatggagaagtcatgcccggtcaatgggaatttcaagttggcccgacggttggtatttcatctggtgatcaagtctgggctgcacgttaccttcttgagagaatcacagaagtggctggtgttgtcctctcatttgaccccaaacccattcagggtgattggaatggtgctggtgctcacactaactacagtacgaaatcaatgagggaagaagggggaattaaagtgataaaaaaggccattgaaaagttagggttgaggcataaggaacacattgctgcctatggagagggcaacgagaggcgtttgactggccgacatgagacagcagacataaacacattttcatggggagttgcaaatcgtggagcttctattcgagttggccgtgacacggaacgtgaaggcaaagggtacttcgaagaccgcaggccagcttccaacatggacccctatattgtaacatctatgattgctgagaccaaccatcctttgaagtgagagtaacattgattactcaatgaataaagatgccgatacgattgaagtgttcttgatgctagtcaaattgcgaggggatccccaattgtttgtgggggatattctcatttgaatctctctgtgcctaaagtatttcccctatttctgttaataagaacattctagaaataggacttgagatttagggtgcattatattcagtgtctagtttgtcattcagatttgcattattccatgactctgatatgattggtgtgcaattgaatttaatgaattcagaagttcttttattgcttgcgaaaaaaa

SEQ ID NO: 2258 - protein, 355 aa, Pinus sylvestris
MSLLTDLINLDLSDITEKIIAEYIWIGGSGMDIRSKARTLSHPVTDPKDLPKLNYDGSSTGQAPGKDSEVILYPQAIFRDPFRRGNNILVICDTYTPAGEPIPTNKRANAQKYLAIQMLFAEEPWYGIEQEYTLLQKDVNWPLGWPVGGYPGPQGPYYCGTGADKAYGRDIVDAHYKACLYAGINISGINGEVMPGQWEFQVGPTVGISSGDQVWAARYLLERITEVAGVVLSFDPKPIQGDWNGAGAHTNYSTKSMREEGGIKVIKKAIEKLGLRHKEHIAAYGEGNERRLTGRHETADINTFSWGVANRGASIRVGRDTEREGKGYFEDRRPASNMDPYIVTSMIAETNHPLK

SEQ ID NO: 2259 - DNA, 1071 bp, Arabidopsis thaliana
  CDS (1)..(1071)
atgagtcttgtttcagatctcatcaaccttaacctctcagactccactgacaaaatcattgctgaatacatatgggttggtggttctggaatggacatgagaagcaaagccaggactctacctggaccagtgactgacccttcgcagctaccaaagtggaactatgatggttcaagcacaggccaagctcctggtgaagacagtgaagtcatcttataccctcaagccatattcaaggatcctttccgtagaggaaacaacattcttgtcatgtgcgatgcgtacactcccgcgggtgaaccaatcccgactaacaaaagacacgctgcggctaaggtctttagcaaccctgatgttgcagctgaagtgccatggtatggtattgagcaagaatacactttactccagaaagatgtgaagtggcctgttggttggcctattggtggttatcccggccctcagggaccgtactattgcggtattggagcagacaaatcttttggcagagatgttgttgattctcactacaaggcctgcttatacgctgggatcaacattagtggcatcaatggagaagtcatgccgggtcagtgggagttccaggtcggtccagctgttggtatctcggctgctgatgaaatttgggtcgctcgttacattttggagaggatcacagagattgctggtgtagtggtatcttttgacccgaaaccgattcccggtgactggaacggtgctggtgctcactgcaactacagtaccaagtcaatgagggaagaaggcggttacgagatcatcaagaaagcaatcgataaattgggactgagacacaaagaacacattgctgcttacggtgaaggcaatgagcgtcgtctcacaggacaccacgagactgctgacatcaacactttcctttggggtgttgcgaaccgtggagcatcgatccgagtaggacgtgatacggagaaagaagggaaaggatactttgaggacaggaggccagcttcgaacatggatccttacattgtcacttccatgattgcagagactacaatcctctggaatccttga

SEQ ID NO: 2260 - protein, 356 aa, Arabidopsis thaliana
MSLVSDLINLNLSDSTDKIIAEYIWVGGSGMDMRSKARTLPGPVTDPSQLPKWNYDGSSTGQAPGEDSEVILYPQAIFKDPFRRGNNILVMCDAYTPAGEPIPTNKRHAAAKVFSNPDVAAEVPWYGIEQEYTLLQKDVKWPVGWPIGGYPGPQGPYYCGIGADKSFGRDVVDSHYKACLYAGINISGINGEVMPGQWEFQVGPAVGISAADEIWVARYILERITEIAGVVVSFDPKPIPGDWNGAGAHCNYSTKSMREEGGYEIIKKAIDKLGLRHKEHIAAYGEGNERRLTGHHETADINTFLWGVANRGASIRVGRDTEKEGKGYFEDRRPASNMDPYIVTSMIAETTILWNP

SEQ ID NO: 2261 - DNA, 1071 bp, Arabidopsis thaliana
  CDS (1)..(1071)
atgagtcttcttgcagatcttgttaaccttgacatctcagacaacagtgaaaagatcatcgctgaatacatatgggttggtggttctggtatggacatgagaagcaaagccaggactctccctggacctgtgaccgatccatcaaaacttccaaagtggaactatgatggttcaagcactggtcaagctcctggtcaagacagtgaagtgatcttataccctcaagcaattttcaaagatccattccgtagaggcaacaacatccttgttatgtgtgatgcttacactccagcgggagagccaatccctactaacaagcgacatgctgcggctgagatctttgctaaccctgatgttattgctgaagtgccatggtatggaatcgaacaagaatacactttgttgcagaaggatgtgaactggcctcttggatggcccattggtggcttccctggccctcagggaccatactactgcagtattggagctgacaaatcttttggaagagacattgttgatgctcactacaaagcctctttgtatgctggaatcaacatcagtgggatcaatggagaagtcatgccgggacaatgggagttccaagtcggcccatcggtcggtatctcagctgctgatgaaatatggatcgctcgttacattttggagaggatcacagagattgctggtgtggttgtatcttttgacccaaaacctattcctggtgactggaatggagctggtgctcacaccaattacagtactaaatcaatgagggaagaaggaggatacgagataatcaagaaggcgatcgagaagcttggcttgagacacaaggaacacatttccgcttacggtgaaggaaacgagcgtcgtctcacgggacaccatgaaactgctgacatcaacactttcctttggggtgttgcgaaccgtggtgcatcgatccgagtaggacgtgacaccgagaaagaagggaagggatactttgaggataggaggccagcttcaaacatggacccttacgttgttacttccatgattgcagagactacactcctctggaacccttga

SEQ ID NO: 2262 - protein, 356 aa, Arabidopsis thaliana
MSLLADLVNLDISDNSEKIIAEYIWVGGSGMDMRSKARTLPGPVTDPSKLPKWNYDGSSTGQAPGQDSEVILYPQAIFKDPFRRGNNILVMCDAYTPAGEPIPTNKRHAAAEIFANPDVIAEVPWYGIEQEYTLLQKDVNWPLGWPIGGFPGPQGPYYCSIGADKSFGRDIVDAHYKASLYAGINISGINGEVMPGQWEFQVGPSVGISAADEIWIARYILERITEIAGVVVSFDPKPIPGDWNGAGAHTNYSTKSMREEGGYEIIKKAIEKLGLRHKEHISAYGEGNERRLTGHHETADINTFLWGVANRGASIRVGRDTEKEGKGYFEDRRPASNMDPYVVTSMIAETTLLWNP

SEQ ID NO: 2263 - DNA, 1065 bp, Arabidopsis thaliana
  CDS (1)..(1065)
atgtctctgctctcagatctcgttaacctcaacctcaccgatgccaccgggaaaatcatcgccgaatacatatggatcggtggatctggaatggatatcagaagcaaagccaggacactaccaggaccagtgactgatccatcaaagcttcccaagtggaactacgacggatccagcaccggtcaggctgctggagaagacagtgaagtcattctataccctcaggcaatattcaaggatcccttcaggaaaggcaacaacatcctggtgatgtgtgatgcttacacaccagctggtgatcctattccaaccaacaagaggcacaacgctgctaagatcttcagccaccccgacgttgccaaggaggagccttggtatgggattgagcaagaatacactttgatgcaaaaggatgtgaactggccaattggttggcctgttggtggctaccctggccctcagggaccttactactgtggtgtgggagctgacaaagccattggtcgtgacattgtggatgctcactacaaggcctgtctttacgccggtattggtatttctggtatcaatggagaagtcatgccaggccagtgggagttccaagtcggccctgttgagggtattagttctggtgatcaagtctgggttgctcgataccttctcgagaggatcactgagatctctggtgtaattgtcagcttcgacccgaaaccagtcccgggtgactggaatggagctggagctcactgcaactacagcactaagacaatgagaaacgatggaggattagaagtgatcaagaaagcgatagggaagcttcagctgaaacacaaagaacacattgctgcttacggtgaaggaaacgagcgtcgtctcactggaaagcacgaaaccgcagacatcaacacattctcttggggagtcgcgaaccgtggagcgtcagtgagagtgggacgtgacacagagaaggaaggtaaagggtacttcgaagacagaaggccagcttctaacatggatccttacgttgtcacctccatgatcgctgagacgaccatactcggttga

SEQ ID NO: 2264 - protein, 354 aa, Arabidopsis thaliana
MSLLSDLVNLNLTDATGKIIAEYIWIGGSGMDIRSKARTLPGPVTDPSKLPKWNYDGSSTGQAAGEDSEVILYPQAIFKDPFRKGNNILVMCDAYTPAGDPIPTNKRHNAAKIFSHPDVAKEEPWYGIEQEYTLMQKDVNWPIGWPVGGYPGPQGPYYCGVGADKAIGRDIVDAHYKACLYAGIGISGINGEVMPGQWEFQVGPVEGISSGDQVWVARYLLERITEISGVIVSFDPKPVPGDWNGAGAHCNYSTKTMRNDGGLEVIKKAIGKLQLKHKEHIAAYGEGNERRLTGKHETADINTFSWGVANRGASVRVGRDTEKEGKGYFEDRRPASNMDPYVVTSMIAETTILG

SEQ ID NO: 2265 - DNA, 1346 bp, Alnus glutinosa
  CDS (50)..(1120)
ccgagattcacttcaaagtctctgctttgtgtttgtgtttcttctcaacatgtcgctgctttcagatctcatcaaccttaacctctcggacgctactgataaagtgattgcagagtacatatggatcggtggatctggtacggacctcagaagcaaagctaggacgcttactggaccagtcaatcatccttcaaagcttcccaagtggaattatgatggttccagtacaggtcaagctcctggtgaagacagtgaagtgatctatatcctcaggcaatttttcaaggatccattcaggagaggcaacaatattctagtcatctgtgatacttacactccggcgggagagccaattccaacaaacaagagacatggtgctgcaaagatattcagccatcctgaagttgttgctgaagtaccctggtacggtattgagcaggagtacaccttgttgcagaaagatgtcaaatggcctcttgggtggcctgttggtggttatcctggtcctcagggaccatactactgtggtattggtgctgacaaagcctggggccgtgatatagttgatgctcattacaaggcttgtctatatgcaggcatcaacattagtggcatcaatggagaagtgatgccaggccagtgggaattccaagttggtccttctgttggcatctctgctggagatgaggtgtgggctgctcgatacattttggagaggattacagagattgctggggtggtgctcagccttgatcccaagccaatccagggtgattggaatggagctggtgctcacacaaactacagtaccaagtccatgagaaacaatggaggctatgagatcatcaagaaagcaattgagaagctagggctgaggcacaaagagcacattgcagcatatggggaaggcaatgagcgccgtctcactggccgacatgaaacagctgacatcaacactttcaaatggggtgttgccaaccgtggggcatctatccgtgttggcagagacacagaaaaagaaggcaaaggctattttgaggacaggaggcctgcttctaacatggatccatatgtggtcacttccatgatcgcggaaaccaccctcctgtggaagccatgagtgccagctacgcccgcctttgggaacattgtcattgtcttttcatgaagataaaagcaacgtgtcatttgtgtaaccattgtgctttccattagagtagctttgtcctgttatttctgtctcatttgccctttttatatgaggtggtagcaattcatgatactgcctcatgtgttaaataatgggttttgtataaactacaaaatgaaagggttggctattttgt

SEQ ID NO: 2266 - protein, 356 aa, Alnus glutinosa
MSLLSDLINLNLSDATDKVIAEYIWIGGSGTDLRSKARTLTGPVNHPSKLPKWNYDGSSTGQAPGEDSEVIYILRQFFKDPFRRGNNILVICDTYTPAGEPIPTNKRHGAAKIFSHPEVVAEVPWYGIEQEYTLLQKDVKWPLGWPVGGYPGPQGPYYCGIGADKAWGRDIVDAHYKACLYAGINISGINGEVMPGQWEFQVGPSVGISAGDEVWAARYILERITEIAGVVLSLDPKPIQGDWNGAGAHTNYSTKSMRNNGGYEIIKKAIEKLGLRHKEHIAAYGEGNERRLTGRHETADINTFKWGVANRGASIRVGRDTEKEGKGYFEDRRPASNMDPYVVTSMIAETTLLWKP

SEQ ID NO: 2267 - DNA, 2030 bp, Chlamydomonas reinhardtii
  CDS (84)..(1232)
aagccaattctttactctgctgcctgtccactcgcctgtccaactactaccagtcggggatttcttctcctgaaggtctaaccatggccgcgggatctgttggcgtcttcgccaccgatgagaagattggcagcctgctggaccagtccatcacgcgccactttctgtcgactgtgaccgaccagcagggcaagatctgtgccgagtatgtgtggatcggcggctccatgcacgacgtgcgctccaagtcgcgcaccctgtccaccatccccacgaagcccgaggacctgccccactggaactacgacggctcctccaccggccaggcccccggccacgactcagaggtctatctcattccccgctccatcttcaaggaccccttccgcggcggcgacaacatcctggtcatgtgcgactgctacgagccgcccaaggtcaaccccgacggcaccctggccgcgcccaagccgatccccacgaacacccgctttgcctgcgccgaggtgatggagaaggccaagaaggaggagccctggttcggcattgagcaggagtacacgctgctcaacgccatcaccaagtggccgctgggctggcccaagggcggctaccccgccccccagggcccctactactgctcggccggcgccggcgtggccatcggccgcgacgtggcggaggtgcactaccgcctgtgcctggccgcgggcgttaacatcagcggcgtgaacgccgaggtgctgcccagccagtgggagtaccaggtgggcccgtgcgagggcatcaccatgggcgaccacatgtggatgagccgctatatcatgtaccgcgtgtgcgagatgttcaacgtggaggtctcgttcgaccccaagcccatccccggcgactggaacggctccggcggccacaccaactactccactaaggccacccgcaccgcgcccgacggctggaaggtcatccaggagcactgcgccaagctggaggcgcgccacgccgtgcacatcgccgcctacggcgagggcaacgagcgccgcctgaccggcaagcacgagaccagcagcatgagcgacttcagctggggcgtggccaaccgcggctgctccatccgcgtgggccgcatggtgccggtggagaagtcgggctactatgaggaccgccggcctgcctccaacctggacgcctacgtcgtcacccgcctcatcgtggagaccaccatccttctgtaagcgcaggagcagcggcacgcaggagcagcagtgggcgatggtggtggtggcgtttgtgctggcctgagcgaggggggggccacggaagggcgatcgtggccaaggcggagggaagcggcggtcgagccgcgtggtgatcaaggtgaggcgtggtgcgcgtgtttgcattgacatgcgggctcgtttggcgccgtggcttgaagctggagcaattccaactgcatttggtttgccgggacgtgtagcggttcaggaaagatggggtgacggcagcgaggacccgctgtgtgttctggtccagtctgccaaagggacttcggacgcaggatgctgcatcatctgtggcgcagtcaactgatctctacgaagagccgcagtgccataccatttgtcgtgtgcgtttcgagcctggctgtgtggacgccggcgcagaggtcgcctggttgtgtgcaagtgtatgccgtcggcgacggaagggagcgtacacgtgcggccaagcgacacggcgctctgtacgtgcccgtcgtcaagtgcatgagcggaggaccccgcgcagcgcggggtgcgtggcatgacgtgagctcttattggctgtgcgcgacgcatgtgttccctcatgtaggggaggcgttgcatacaggaacggtcgcggccgtgtttggtgttcaaactgtgttttgtcttggtattgtgtcctggttccaacagtggttgggtgattgtgcacttgaaacattctttgtgtgggtcggacccactctgtcgttctgtaacacgggaaagcataaaaaaaaaaaa

SEQ ID NO: 2268 - protein, 382 aa, Chlamydomonas reinhardtii
MAAGSVGVFATDEKIGSLLDQSITRHFLSTVTDQQGKICAEYVWIGGSMHDVRSKSRTLSTIPTKPEDLPHWNYDGSSTGQAPGHDSEVYLIPRSIFKDPFRGGDNILVMCDCYEPPKVNPDGTLAAPKPIPTNTRFACAEVMEKAKKEEPWFGIEQEYTLLNAITKWPLGWPKGGYPAPQGPYYCSAGAGVAIGRDVAEVHYRLCLAAGVNISGVNAEVLPSQWEYQVGPCEGITMGDHMWMSRYIMYRVCEMFNVEVSFDPKPIPGDWNGSGGHTNYSTKATRTAPDGWKVIQEHCAKLEARHAVHIAAYGEGNERRLTGKHETSSMSDFSWGVANRGCSIRVGRMVPVEKSGYYEDRRPASNLDAYVVTRLIVETTILL

SEQ ID NO: 2269 - DNA, 1376 bp, Daucus carota
  CDS (84)..(1142)
ggtctctgcattccacaccatctatcatcaaacatcactccatataatcttcttcactacccttctctgtttcaccaataaccatggcttcacttacagatctcatcaatcttgacctttctgacaccactgacaagttcattgctgagtacatctggattgatgctgttggtggcctcaggagcaaagctagaaccctttctggtccggttgatgatcccaccaagctcccaaaatggaattttgatggatcaagtactggtcaaggaccaggggatgatagtgaagtgatcatatatccccaagcaatatttaaggatccattcagaaggggtaaccacatattggtcatgtgtgatacctacacaccagctggtgagccaattcctacaaacaagagatgtaatgcggctaagattttcagccaccctgatgttgcagctgaagttccttggttcggtattgagcaagaatacaccctattgaagaaagaggtcaactgccctattgggtgtcccactggaggatatccaggaccacaggggccttactactgtggtattggtgctgataaagcctttggacgggacattgttgatgctcattacaaagcatgtctgtatgctggtattaacataagtggcataaatggggaggttatgcctggacaatgggaattccaagtgggaccagctgttggtatctcagcaggtgatgaactgtgggtggcccgttacattcttgagaggataactgaaattgctggggtggttgtttcattggatcctaagcctatccctggtgattggaatggtgcaggtgcccacacgaattacagcaccaagtccatgagaaatgagggaggatttgagatcatcaagaaggctattgccaaacttgagactaagcatgcacaacacattgctgcatatggtgaaggcaacgaacgtcgtctcactggaaagcacgagactgccagtattcacaagttctcatggggtgttgcaaaccgtggagcatcagtccgggtgggtagagacactgaaaaagaaggcaagggttactttgaggaccgtaggcctgcttccaacatggaaccatatgtcgtcacttccatgatcgcagaaacaacaattctgtgaagccttgagggagaatttgctgcagatactttgcggtgaaagagtaccatgattgtgttccataccaacccttctagatttctattagaattagctcgtctggtcatcatttgttgttactggatttgcctttatattcctggtatttacggcatgagcaatgctcagttactttattttcaaaaactagttgcaatatgaaagggtttggtatctattaagcatttctcatgt

SEQ ID NO: 2270 - protein, 352 aa, Daucus carota
MASLTDLINLDLSDTTDKFIAEYIWIDAVGGLRSKARTLSGPVDDPTKLPKWNFDGSSTGQGPGDDSEVIIYPQAIFKDPFRRGNHILVMCDTYTPAGEPIPTNKRCNAAKIFSHPDVAAEVPWFGIEQEYTLLKKEVNCPIGCPTGGYPGPQGPYYCGIGADKAFGRDIVDAHYKACLYAGINISGINGEVMPGQWEFQVGPAVGISAGDELWVARYILERITEIAGVVVSLDPKPIPGDWNGAGAHTNYSTKSMRNEGGFEIIKKAIAKLETKHAQHIAAYGEGNERRLTGKHETASIHKFSWGVANRGASVRVGRDTEKEGKGYFEDRRPASNMEPYVVTSMIAETTIL

SEQ ID NO: 2271 - DNA, 1359 bp, Zea mays
  CDS (10)..(1083)
gcccgagtgatggccagcctcaccgacctcgtcaacctcgacctgagtgactgcaccgacaggatcatcgccgagtacatctggattggaggaaccgggatagacctcaggagcaaagcgaggacggtgaaaggccccatcaccgacccgatccagctgccgaaatggaactacgacggctccagcaccgggcaggctcccggagaggacagcgaagtcatcctctaccctcaagccattttcaaggacccgttcaggaagggtaaccacatccttgtgatgtgtgactgctacacgccacaaggcgagccaatccccaccaacaagaggtacagcgccgccaaggttttcagccaccccgacgtcgcagctgaggtgccgtggtacggtattgagcaggagtacaccctccttcagaaggacgtgagctggcccctcggctggcccgttggtggataccctggtccccagggaccatactactgcgccgccggtgccgacaaggcctttgggcgcgacgtggttgacgcccactacaaggcctgcctctacgccggcatcaacatcagcggcatcaacggcgaagtcatgcctggacagtgggagttccaagtggggccgtccgttgggatctctgccggcgacgagatatgggtcgcccgctacattctcgagaggatcaccgagatggccggaatcgtcctctccctcgacccgaagccgatcaagggcgactggaacggcgccggcgcccacaccaactacagcaccaagtcgatgagggaggccgggggatacgaggtcatcaaggcggcgatcgacaagctggggaagaggcacaaggagcacatcgccgcgtacggcgagggcaacgagcgccgcctcacgggccgccacgagaccgccgacatcaacaccttcaaatggggcgtggcgaaccgcggcgcgtccatccgcgtcggccgcgacaccgagagggagggcaagggctacttcgaggaccgcaggccggcgtccaacatggacccctacgtcgtcaccggcatgatcgccgagaccaccatcctgtggaatggaaactgatcaagcatgtgcattctcgagggagcccactgtttttcttctgcacaacgcatccgccgtggtgtcgctttggttttgaaatttagattccgttgtcctaaaatttatcactacggtctccagtgtattgctcgggaacgaatgaataacgactgcgatgtttgtttttttttttgctggcgtagtagatgtacgtttggctgtgcttccagtttattgggtaaatgaaaaaatgtaatggtctaccggtcttaaaatagtagtcattttagctct

SEQ ID NO: 2272 - protein, 357 aa, Zea mays
MASLTDLVNLDLSDCTDRIIAEYIWIGGTGIDLRSKARTVKGPITDPIQLPKWNYDGSSTGQAPGEDSEVILYPQAIFKDPFRKGNHILVMCDCYTPQGEPIPTNKRYSAAKVFSHPDVAAEVPWYGIEQEYTLLQKDVSWPLGWPVGGYPGPQGPYYCAAGADKAFGRDVVDAHYKACLYAGINISGINGEVMPGQWEFQVGPSVGISAGDEIWVARYILERITEMAGIVLSLDPKPIKGDWNGAGAHTNYSTKSMREAGGYEVIKAAIDKLGKRHKEHIAAYGEGNERRLTGRHETADINTFKWGVANRGASIRVGRDTEREGKGYFEDRRPASNMDPYVVTGMIAETTILWNGN

SEQ ID NO: 2273 - DNA, 1071 bp, Medicago sativa
  CDS (1)..(1071)
atgtctctcctttcagatcttatcaaccttgacctctccgaaaccaccgagaaaatcatcgccgaatacatatggattggtggatctggtttggacttgaggagcaaagcaaggactctaccaggaccagttactgacccttcacagcttcccaagtggaactatgatggttccagcacaggtcaagctcctggagaagatagtgaagttattatctacccacaagccattttcaaggacccatttagaaggggtaacaatatcttggttatgtgtgatgcatacactccagctggagagcccattcccaccaacaagagacatgcagctgccaagattttcagccatcctgatgttgttgctgaagtaccatggtatggtattgagcaagaatacaccttgttgcagaaagacatcaattggcctcttggttggccagttggtggttttcctggacctcagggaccatactattgtggagctggtgctgacaaggcatttggccgtgacattgttgactcacattacaaagcctgtctttatgccggcatcaacatcagtggaatcaatggtgaagtgatgcctggtcaatgggaattccaagttggtccctcagttggtatctctgctggtgatgagatatgggttgctcgttacattttggagaggatcactgaggttgctggtgtggtgctttcctttgacccaaaaccaattaagggtgattggaatggtgctggtgctcacacaaattacagcaccaagtctatgagagaagatggtggctatgaagtcatcttgaaagcaattgagaagcttgggaagaagcacaaggagcacattgctgcttatggagaaggcaacgagcgtagattgacagggcgacatgagacagctgacattaacaccttcttatggggtgttgcaaaccgtggtgcgtcgattagagttggaagggacacagagaaagcagggaaaggttatttcgaggataggaggccatcatctaacatggatccatatgttgttacttccatgattgcagacaccaccattctctggaaaccataa

SEQ ID NO: 2274 - protein, 356 aa, Medicago sativa
MSLLSDLINLDLSETTEKIIAEYIWIGGSGLDLRSKARTLPGPVTDPSQLPKWNYDGSSTGQAPGEDSEVIIYPQAIFKDPFRRGNNILVMCDAYTPAGEPIPTNKRHAAAKIFSHPDVVAEVPWYGIEQEYTLLQKDINWPLGWPVGGFPGPQGPYYCGAGADKAFGRDIVDSHYKACLYAGINISGINGEVMPGQWEFQVGPSVGISAGDEIWVARYILERITEVAGVVLSFDPKPIKGDWNGAGAHTNYSTKSMREDGGYEVILKAIEKLGKKHKEHIAAYGEGNERRLTGRHETADINTFLWGVANRGASIRVGRDTEKAGKGYFEDRRPSSNMDPYVVTSMIADTTILWKP

SEQ ID NO: 2275 - DNA, 1434 bp, Pisum sativum
  CDS (83)..(1150)
cgcatagaatctgaggattcatcatccaacgatccacagtgattcaatttcaagtttcttttttcttcactttttcaaaaccatgtctctttcagatctcatcaaccttgatctctcaggaaccaccgagaaaatcatagcagaatacatatggattggtggttctggtttggacttgaggtgcaaagcaaggactcttcccggaccagttactgacccttcagagctccccaagtggaattatgatggttccagcacaggacaagctcctggacaagatagtgaagttatcttatacccacaagccatttttaaggatccattcagaaggggtaaccatatcttggttatgtgtgatgcatacagtcctgctggagaaccaattcccactaacaaaagacacgcagctgctaaggtttttagccatcctgatgttgttgctgaagaaacatggtatggtatagagcaggaatacaccttgttgcagaaagacatcaattggcctcttggttggccagctggtggttatcctggacctcagggaccatattattgcagtgttggtgctgacaaggcttttggccgtgacgttgttgaggcacattacaaagcctgtctttttgccggcatcaacatcagtggaatcaatggagaagtcatgcctggtcaatgggaatttcaagttggtccctcagtcggtatctctgctggtgatgagatatgggttgctcgctacattttggagaggatcactgaggttgctggtgtggttcttacctttgaccctaaaccaattaagggtgactggaatggtgctggtgctcacacaaactacagcaccaagtctatgagagaagacggtggatatgaaatcatcaagaaagcaattgagaagctcgggaagaggctgcccgagcacatctccgcttatggagaaggcaacgagcgcagattgacagggaaacacgaaacagctgacattaataccttctcatggggtgttgcaaaccgaggcgcttcggttcgggttggaagggacacagagaaagaagggaagggttattttgaggacaggaggccagcatctaacatggacccatacgttgttacttccatgattgcagagactaccatcctcttgaaaccataagctaccacttgtaccacaaaaaacttatactacattgtattgcaacctttgagagtcattgttggttcctcgttagagattggttcttggtttttctaggacatggctttgtgttcttgttatggttcacacgttgtttgtttctttctcttgttttacttatgtgtcacaataataatgtaatggttatcagtataataattattgttgattgtgattattaataaaaatgtatgaattgaaaatgcccatgataatgaatatgaatgagggtgtctttgtag

SEQ ID NO: 2276 - protein, 355 aa, Pisum sativum
MSLSDLINLDLSGTTEKIIAEYIWIGGSGLDLRCKARTLPGPVTDPSELPKWNYDGSSTGQAPGQDSEVILYPQAIFKDPFRRGNHILVMCDAYSPAGEPIPTNKRHAAAKVFSHPDVVAEETWYGIEQEYTLLQKDINWPLGWPAGGYPGPQGPYYCSVGADKAFGRDVVEAHYKACLFAGINISGINGEVMPGQWEFQVGPSVGISAGDEIWVARYILERITEVAGVVLTFDPKPIKGDWNGAGAHTNYSTKSMREDGGYEIIKKAIEKLGKRLPEHISAYGEGNERRLTGKHETADINTFSWGVANRGASVRVGRDTEKEGKGYFEDRRPASNMDPYVVTSMIAETTILLKP

SEQ ID NO: 2277 - DNA, 1454 bp, Phaseolus vulgaris
  CDS (123)..(1193)
ggctcacgtacgagttgaatctcaggattcagagagaaaaggagagagagagagagaaagagagattttttttttctgtgaagaagggtctttccttgtttcttcgtctcttcatttctaccatgtcgctgctctcagatctcatcaaccttaacctctccgacaccaccgagaaggtcatcgcagagtacatatggatcggtggatcaggattggatctaaggagcaaagcaaggactctcccaggaccagttaagaacccttcagagctgcctaagtggaactatgatggttccagcacaggtcaagcccctggacaagacagtgaagtgattatatacccacaagccattttcaaggatccattcagaaggggtaacaatatcttggttatttgtgatgcttacactccagctggagaacccattcccactaacaagaggcacaatgctgccaagatattcagcaatcctgatgttgttgctgaagaaccctggtacggtattgagcaggaatacaccttgttgcagaaagaagtgaactggcctgttgggtggcctgttggtggtttccctggacctcagggaccttactattgtggtgttggtgctgacaaggcttttgggcgtgacattgttgacgcacattacaaagcctgtgtctatgctggcatcaacatcagtggaattaatggagaggtgatgcctggtcagtgggaattccaagttggacctgcagttgggatctcagctggtgacgagttgtgggtagctcgttacatcttggagaggatcactgaggttgctggtgtggtgctttcctttgaccccaagccaatcaagggtgattggaatggtgctggtgctcacaccaactacagcaccaagaccatgagaaacgatggtggctatgaagaaatcaaatcagctatacagaaattggggaagaggcacaaggagcatatcgctgcttatggagaaggcaatgaacgccgtctgacaggacgacacgaaactgccgacatcaacaccttcctatggggagttgcaaaccgtggagcttctattagagttgggagggacacagagaaagcagggaagggttactttgaggacaggagacctgcttctaacatggacccctatgttgtcacttccatgattgcagacacaaccattctgtggaagccatgagcaacacctgcactttgtctcttctttcggatgaaacaaggaacactactacttgtgcttttctaagtaggatttggtcctttatttttcacctcttactttttaggatttggatttgtggtaattgctgtggttcgctctctgcttggagccttgttggttggtacaactaactaccaaggattcttcattgctttccatttctttcccatgttttcctattgttataataataataatatcattaataatcataataat

SEQ ID NO: 2278 - protein, 356 aa, Phaseolus vulgaris
MSLLSDLINLNLSDTTEKVIAEYIWIGGSGLDLRSKARTLPGPVKNPSELPKWNYDGSSTGQAPGQDSEVIIYPQAIFKDPFRRGNNILVICDAYTPAGEPIPTNKRHNAAKIFSNPDVVAEEPWYGIEQEYTLLQKEVNWPVGWPVGGFPGPQGPYYCGVGADKAFGRDIVDAHYKACVYAGINISGINGEVMPGQWEFQVGPAVGISAGDELWVARYILERITEVAGVVLSFDPKPIKGDWNGAGAHTNYSTKTMRNDGGYEEIKSAIQKLGKRHKEHIAAYGEGNERRLTGRHETADINTFLWGVANRGASIRVGRDTEKAGKGYFEDRRPASNMDPYVVTSMIADTTILWKP

SEQ ID NO: 2279 - DNA, 1450 bp, Glycine max
  CDS (78)..(1145)
ccgtgaatctcagaattctctaaaagagatccttttctgctctttgaagaaagaagggtctttgcttgattttggagatgtctctgctctcagatctcatcaaccttaacctctccgataccaccgagaaggtgatcgcagagtacatatggatcggtggatcaggaatggacctgaggagcaaagcaaggactctcccaggaccagttagcgacccttcagagcttcccaagtggaactatgatggttccagcacaggtcaagctcctggtgaagacagtgaagcgatttatacccacaagccatttcaggatccattcagaaggggtaacaatatcttggttatctgtgatgcctacactcctgctggagaacctattcccactaacaagaggcacgctgctgccaaggttttcagccatcctgatgttgttgctgaagtgccatggtacggtattgaacaagaatacaccttgttgcagaaagatatccaatggcctcttgggtggcctgttggtggtttccctggacctcagggtccatactactgtggtgttggcgctgacaaggcttttggccgtgacattgttgacgcacactacaaagcctgtatttatgctggcatcaacatcagtggaattaatggagaagtgatgcccggtcagtgggaattccaagttggaccttcagttggaatctcagctggtgatgagatttgggcagctcgttacatcttggagaggatcactgagattgctggtgtggtggtttcctttgaccccaagccaattccgggtgattggaatggtgctggtgctcacacaaactacagcaccaagtccatgagagaagatggaggctatgaagtgatcaaagcagcaattgacaagttggggaagaagcacaaggagcacattgctgcttatggagaaggcaacgaacgtcgtttgacaggacgccacgaaaccgctgacatcaacaccttcttatggggagttgcaaaccgtggagcttctgttagggttgggagagacacagagaaagcagggaagggatattttgaggacagaaggcctgcttccaacatggacccatacgtggttacttccatgattgcagacacaaccattctgtggaagccatgagcaaaacctgcatgttttctccctttggatggaaaggaacagttatgcttttcttagtaggatttggtctctctctctttttaccttttgattggtactatggttggtgccttgttggttggtgcaactaactggcaagggttgttcattgttttcttctattcctttccctcgttttccgattgttacaatgacaataatttaatggttattatcagtcttgaaggttattatcagtcttgcaagaaatgctgattggaagtataataatatatatgaaattgtcatgttcattgagtaggaaa

SEQ ID NO: 2280 - protein, 355 aa, Glycine max
MSLLSDLINLNLSDTTEKVIAEYIWIGGSGMDLRSKARTLPGPVSDPSELPKWNYDGSSTGQAPGEDSEAIYTHKPFQDPFRRGNNILVICDAYTPAGEPIPTNKRHAAAKVFSHPDVVAEVPWYGIEQEYTLLQKDIQWPLGWPVGGFPGPQGPYYCGVGADKAFGRDIVDAHYKACIYAGINISGINGEVMPGQWEFQVGPSVGISAGDEIWAARYILERITEIAGVVVSFDPKPIPGDWNGAGAHTNYSTKSMREDGGYEVIKAAIDKLGKKHKEHIAAYGEGNERRLTGRHETADINTFLWGVANRGASVRVGRDTEKAGKGYFEDRRPASNMDPYVVTSMIADTTILWKP

SEQ ID NO: 2281 - DNA, 1416 bp, Vitis vinifera
  CDS (88)..(1158)
gagaaagagaggaagaggccaagtcaagctttgaagttttttttttatatttatttttctcatttcatccgttttcctgtgttcgtcatggcactgctctccgatctcatcaacttgaacctctctgagaccactgagaaggtgattgtagagtacatatgggttggtggatctggtatggaccttagaagcaaagccaggaccctttctggaccagttagcgatcctgcaaagcttcccaaatggaactatgatggttctagcactggccaagctccgggggaagacagtgaagttattctatatcctcaagcaattttcaaggacccattcaggagaggcaacaacattcttgtgatgtgtgatacttatacccctgccggagagccaattccgaccaataagaggtgtaatgctgcaaagattttcagccaccctgatgttgcagctgaagtgccttggtatggtattgagcaggagtatactttgttgcagaaagaggtaaaatggccaattggctggcctgtgggcggttttcctggacctcagggaccatactattgtggtattggtgctgacaaagcttggggccgtgacattgttgatgcacattacaaagcgtgcctttatgctggcatcaacatcagtggaatcaatggagaagtgatgccaggccagtgggaataccaagttggcccttctgttggcatctctgcaggagatgaattatgggtgtctcgttatattcttgagaggatcacagagattgctggggtggtgctttcttttgacccgaaacccatccagggtgattggaatggagcgggtgcgcacacaaattacagcaccaagtcgatgagaaatgatggagggtttgaagtcatcaaaaaagccattgaaaagcttgggctgaggcacaaggaacacattgcagcttatggagaaggcaatgaacgccgtctcactggacgacatgaaactgctgacatcaacacattcttatggggagtggcaaaccgaggagcctccattagagttggaagagacacagagaaagctgggaaaggatattttgaggacagaaggcctgcttcaaacatggatccttatgtggtcacctccatgattgcagaaactaccatcctctggaagccataagacacccatctcctccgtcccaacaggcttgtgggattgtcttgttggaatttcctgtgaaaattgtctccttagaactgcttgtcctggtttaatagcttccatgtgtttggattacgataaagatcagtctcataaaataagaggctattggggttgctccaatttcgatcattttatgctgtcttatgtattatgctacggaaatatcatcatatgatttaatgtcgtattggttaggccacctctatttactat

SEQ ID NO: 2282 - protein, 356 aa, Vitis vinifera
MALLSDLINLNLSETTEKVIVEYIWVGGSGMDLRSKARTLSGPVSDPAKLPKWNYDGSSTGQAPGEDSEVILYPQAIFKDPFRRGNNILVMCDTYTPAGEPIPTNKRCNAAKIFSHPDVAAEVPWYGIEQEYTLLQKEVKWPIGWPVGGFPGPQGPYYCGIGADKAWGRDIVDAHYKACLYAGINISGINGEVMPGQWEYQVGPSVGISAGDELWVSRYILERITEIAGVVLSFDPKPIQGDWNGAGAHTNYSTKSMRNDGGFEVIKKAIEKLGLRHKEHIAAYGEGNERRLTGRHETADINTFLWGVANRGASIRVGRDTEKAGKGYFEDRRPASNMDPYVVTSMIAETTILWKP

SEQ ID NO: 2283 - DNA, 1324 bp, Arabidopsis thaliana
  CDS (1)..(1293)
atggctcagatcttagcagcttctccaacatgtcagatgagagtgcctaaacactcatcagtcattgcatcatcatccaagttatggagctctgttgtgttgaaacagaagaagcagagcaacaacaaagtcagaggctttagagttcttgctctccaatctgataacagtactgtcaatagagttgagactcttctcaatttagacaccaaaccttactctgacaggatcattgctgaatacatttggatcggaggatctggaattgaccttagaagcaagtcaaggactatcgaaaagccggtggaggatccttctgagctacctaagtggaactatgatggttcgagtaccggtcaagcacctggtgaagatagtgaagtgattctatacccgcaagctatcttcagagatcctttccgtggaggcaataacatcttggttatctgtgatacttggacaccagctggtgagccaattccaacaaacaaacgtgctaaagctgctgagatcttcagtaacaagaaggtctctggcgaggttccatggttcggcattgaacaagagtacactttacttcagcaaaacgtcaaatggcctttaggttggcctgttggagcgttccctggtcctcagggtccttactactgtggagttggagctgacaagatttgggggcgtgacatttcagatgctcattacaaagcttgtttatatgctggaattaacattagtggtactaatggtgaagttatgcctggacagtgggagttccaagttggcccgagcgtaggaattgatgcaggtgatcatgtttggtgtgctagataccttcttgagagaatcacagaacaagctggtgttgtcctaacacttgatcccaaaccgatagagggtgactggaacggtgctggttgccacaccaattacagtaccaagagcatgagagaggaaggaggatttgaagtgatcaagaaggctatcttgaacctctcgcttcgccacaaggagcacatcagtgcctacggtgaaggaaacgagagaaggttgaccggaaagcacgagacagctagtattgaccagttctcatggggcgtggctaaccgtggatgctctattcgtgtgggacgtgacaccgaggcgaaaggaaaaggttacttagaagatcgccgtccagcatctaacatggacccatacattgtgacctcacttttggcagagaccacactcctgtgggagccaactcttgaggctgaagcccttgcagctcaaaagctttctttgaatgtttaaaattagtcgaaactttcatgaatctgatgaa

SEQ ID NO: 2284 - protein, 430 aa, Arabidopsis thaliana
MAQILAASPTCQMRVPKHSSVIASSSKLWSSVVLKQKKQSNNKVRGFRVLALQSDNSTVNRVETLLNLDTKPYSDRIIAEYIWIGGSGIDLRSKSRTIEKPVEDPSELPKWNYDGSSTGQAPGEDSEVILYPQAIFRDPFRGGNNILVICDTWTPAGEPIPTNKRAKAAEIFSNKKVSGEVPWFGIEQEYTLLQQNVKWPLGWPVGAFPGPQGPYYCGVGADKIWGRDISDAHYKACLYAGINISGTNGEVMPGQWEFQVGPSVGIDAGDHVWCARYLLERITEQAGVVLTLDPKPIEGDWNGAGCHTNYSTKSMREEGGFEVIKKAILNLSLRHKEHISAYGEGNERRLTGKHETASIDQFSWGVANRGCSIRVGRDTEAKGKGYLEDRRPASNMDPYIVTSLLAETTLLWEPTLEAEALAAQKLSLNV

SEQ ID NO: 2285 - DNA, 1035 bp, Bradyrhizobium japonicum
  CDS (1)..(1035): transl_table=11
atgaccaagtataagctcgagtacatctggctcgacggatatacgccgactccgaacttgcgcggcaaaactcagatcaaggaattcgcgtcgttcccgacgctcgagcagcttccgctctggggcttcgatggctcctccacccagcaggccgaaggccacagctctgattgcgtgctgaagccagtcgccgtcttcccggacgccgcgcgcaccaacggcgtgctcgtgatgtgcgaagtcatgatgcccgatggcaagaccccgcacgcctccaacaagcgcgccaccattctcgacgacgccggcgcctggttcggcttcgagcaggaatacttcttctacaaggacggccgtccgctcggcttcccgacctccggttatccggcgccgcagggcccgtactacaccggcgtcggcttctcgaacgtcggcgacgtcgcccgcaagatcgtcgaagagcatctcgacctctgcctcgcggccggcatcaaccatgaaggcatcaacgcggaagtcgcgaagggccagtgggaattccagatcttcggcaagggctccaagaaggccgctgacgaaatgtggatggcccgctacctgatgctgcgcctgaccgagaagtacggcatcgacatcgagttccactgcaagccgcttggcgacaccgactggaacggctccggcatgcacgccaacttctcgaccgagtacatgcgcacggtcggcggcaaggagtacttcgaggcgctgatggctgccttcgacaagaacctgatggaccacatcgccgtctacggcccggacaacgacaagcgtctgaccggcaagcacgagaccgcgccgtggaacaagttcagctacggcgtggccgaccgcggcgcttcgatccgcgtgccgcactccttcgtcaacaacggctacaagggctatctggaagaccgtcgcccgaactcgcagggcgacccataccagatcgcttcgcagatcctgaagacgatctcgtccgtgccgaccgagaagaaggcggtcgcctaa

SEQ ID NO: 2286 - protein, 344 aa, Bradyrhizobium japonicum
MTKYKLEYIWLDGYTPTPNLRGKTQIKEFASFPTLEQLPLWGFDGSSTQQAEGHSSDCVLKPVAVFPDAARTNGVLVMCEVMMPDGKTPHASNKRATILDDAGAWFGFEQEYFFYKDGRPLGFPTSGYPAPQGPYYTGVGFSNVGDVARKIVEEHLDLCLAAGINHEGINAEVAKGQWEFQIFGKGSKKAADEMWMARYLMLRLTEKYGIDIEFHCKPLGDTDWNGSGMHANFSTEYMRTVGGKEYFEALMAAFDKNLMDHIAVYGPDNDKRLTGKHETAPWNKFSYGVADRGASIRVPHSFVNNGYKGYLEDRRPNSQGDPYQIASQILKTISSVPTEKKAVA

SEQ ID NO: 2287 - DNA, 1537 bp, Daucus carota
  CDS (17)..(1315)
ccattctaaggtgaggatggctcagatcttagctccgtcagtgcaatggcaaatgagattcacaaaaaattctaccgaagtaagttcaatgacatcaaagatgtggggttctctattcctgaaacaaaacaagaaagcaccagctagaagttctaccaaatatagagcattagcagtgaagtctgaggatggcaccataaataggatggaagatctactaaatttggatgtaactccatacaccgataagatcatagccgagtatatatggataggaggaactggcattgatgtccgaagcaaatcaaggacaatctcaaagccagttgagcacccgtctgagctaccaaaatggaactatgatggatcaagtactgggcaagcacctggagatgatagtgaagtaattttataccctcaagcaattttcaaggaccctttccgtggtggtaacaacatcctcgtcatatgcgatacctacacgccacaaggagagcctattcctacaaataaacgccacaaggctgctcaaatatttagtgatgcgaaggttttaggtgaagttccatggtttggaatagagcaagagtacaccttgatgcaacaggatgtaaactggcctttgggatggaatgttggaggctatcctggtcctcagggtccatattactgtgctgctggagcggataagtcatttggcagagacatatctgacgctcattataaggcttgcttatatgccggaattaatattagtggcacaaatggagaagttatgcctggccagtgggaatttcaagtgggtcccagtgtcggtattgaagctggcgatcacatctggtgtgccagatacctcctggagagaattactgagcaagctggggtcgttctcacacttgacccgaaaccaattgatggtgactggaatggagcaggctgccacaccaactacagtacaaaaagtatgagagaggagggaggctttgaagtaattaagaaagcaatcttaaacctttcacttcgccacaaagagcacatcagtgcatatggagaaggaaatgaaagaagattgacaggaaagcatgaaactgcgagcattgacagcttttcttggggagttgctgaccgtggttgctcaatccgtgtggggcgtgatactgagaaggaaggcaaaggttacttggaggatcggcgccctgcttcaaacatggacccatatgttgtgactggtttacttgctgaaactacattactgtgggagccaacacttgaagctgaagctcttgctgcacagaaactatctttgaatgtctagattcagttcaagataaatttacattttccacaaaattcattgtcgtcagttgaaccgcctcctgctttctttggatcattagttgataatttctgtaaataaagggagccccagtggttaacctttccttctattatgaaagacattcttggaggtcattaggtgttcaaaagaataattatgatgattttgagaatactctacccggaagcaattgtcatc

SEQ ID NO: 2288 - protein, 432 aa, Daucus carota
MAQILAPSVQWQMRFTKNSTEVSSMTSKMWGSLFLKQNKKAPARSSTKYRALAVKSEDGTINRMEDLLNLDVTPYTDKIIAEYIWIGGTGIDVRSKSRTISKPVEHPSELPKWNYDGSSTGQAPGDDSEVILYPQAIFKDPFRGGNNILVICDTYTPQGEPIPTNKRHKAAQIFSDAKVLGEVPWFGIEQEYTLMQQDVNWPLGWNVGGYPGPQGPYYCAAGADKSFGRDISDAHYKACLYAGINISGTNGEVMPGQWEFQVGPSVGIEAGDHIWCARYLLERITEQAGVVLTLDPKPIDGDWNGAGCHTNYSTKSMREEGGFEVIKKAILNLSLRHKEHISAYGEGNERRLTGKHETASIDSFSWGVADRGCSIRVGRDTEKEGKGYLEDRRPASNMDPYVVTGLLAETTLLWEPTLEAEALAAQKLSLNV

SEQ ID NO: 2289 - DNA, 1600 bp, Hordeum vulgare
  CDS (281)..(1585)
cttggtttctggcctggtttgcctccgttgcagctgcaaggggcgcctcaaatctcgtccacccagagccctatcgcctaatgacgagccagatgccatgcccgccccgcgccactcagaatctccccccgcaatctaaaatacttataccacccaccccccgcttccataaatattatttccagcgcgatctcacaggtcgcccccccttccctccctcgcctccgccgcgtccgccgtctctctggtttaggggccgcggagtcgctgtacgtaagtaatgcaagtacgtagagacgacgatggcgcaggcggttgtgcaggcgatgcagtgccaggtgggggtgaggggcaggacggcgtcccggcgaggcagcccgcgggcagggtgtggggcgtcagcagggccgcccgcgccacctccgggttcaaggtgctggcgctcggcccggagaccaccggggtcatccagaggatgcagcagctgctcgacatggacaccacgcccttcaccgacaagatcatcgccgagtacatctgggttggaggatctggaattgacctcagaagcaaatcaaggacgatttcgaagccagtggaggacccgtcagagctgccgaaatggaactacgacggatcgagcacggggcaggctcctggggaagacagtgaagtcatcctatacccacaggccatattcaaggacccattccgaggaggcaacaacatactggttatctgtgacacctacacaccacagggggaacccatccctactaacaaacgccacatggctgcacaaatcttcagtgaccccaaggtcacttcacaagtgccatggttcggaatcgaacaggagtacactctgatgcagagggatgtgaactggcctcttggctggcctgttggagggtaccctggcccccagggtccatactactgcgccgtaggatcagacaagtcatttggccgtgacatatcagatgctcactacaaggcgtgcctttacgctggaattgaaatcagtggaacaaacggggaggtcatgcctggtcagtgggagtaccaggttggacccagcgttggtattgatgcaggagaccacatatgggcttccagatacattctcgagagaatcacggagcaagctggtgtggtgctcacccttgacccaaaaccaatccagggtgactggaacggagctggctgccacacaaactacagcacattgagcatgcgcgaggatggaggtttcgacgtgatcaagaaggcaatcctgaacctttcacttcgccatgacttgcacatagccgcatatggtgaaggaaacgagcggaggttgacagggctacacgagacagctagcatatcagacttctcatggggtgtggcgaaccgtggctgctctattcgtgtggggcgagacaccgaggcgaagggcaaaggatacctggaggaccgtcgcccggcctccaacatggacccgtacaccgtgacggcgctgctggccgagaccacgatcctgtgggagccgaccctcgaggcggaggccctcgctgccaagaagctggcgctgaaggtatgaaggacctgaaaaaag

SEQ ID NO: 2290 - protein, 434 aa, Hordeum vulgare
MQVRRDDDGAGGCAGDAVPGGGEGQDGVPARQPAGRVWGVSRAARATSGFKVLALGPETTGVIQRMQQLLDMDTTPFTDKIIAEYIWVGGSGIDLRSKSRTISKPVEDPSELPKWNYDGSSTGQAPGEDSEVILYPQAIFKDPFRGGNNILVICDTYTPQGEPIPTNKRHMAAQIFSDPKVTSQVPWFGIEQEYTLMQRDVNWPLGWPVGGYPGPQGPYYCAVGSDKSFGRDISDAHYKACLYAGIEISGTNGEVMPGQWEYQVGPSVGIDAGDHIWASRYILERITEQAGVVLTLDPKPIQGDWNGAGCHTNYSTLSMREDGGFDVIKKAILNLSLRHDLHIAAYGEGNERRLTGLHETASISDFSWGVANRGCSIRVGRDTEAKGKGYLEDRRPASNMDPYTVTALLAETTILWEPTLEAEALAAKKLALKV

SEQ ID NO: 2291 - DNA, 1369 bp, Zea mays
  CDS (103)..(1209)
cgaaagcacacacggatcaatcacactcactcgcggccattgtcctgcccgtgcgtgctctgccttttcaggcgatcgaccaaccaacttctcgtcactgccatggctctgctctccgacctcatcaacctcgacctctcgggccgcaccgggaagatcatcgccgagtacatctgggttggcggttccgggatggacgtcaggagcaaagccaggacgctgtccggacctgttgatgaccccagcaagcttccgaagtggaacttcgacggctccagcaccggccaagctccgggcgacgacagcgaagtcatcctttgccctcgggccatcttcagggacccgttcaggaaggggcagaacatactggtcatgtgcgactgctacgagccgaacggggagccgatcccgagcaacaagcggcatggggccgcgaagatctttagccaccctgacgtcaaggctgaggaaccatggttcgggattgagcaggagtacacccttctccagaaggacaccaagtggcctctcggttggccgctggcgtaccctggccctcagggaccttactactgcgccgccggagcggacaagtcctacgggcgggacatcgtggactgcgcatacaaggcctgcctctacgccggcatcgacatcagtggcatcaacggggaggtcatgccggggcagtgggagttccaggtggcccctgccgtcggcgtctcggccggcgaccagctctgggtggctcgctacattcttgagaggatcaccgagatcgccggcgtggttgtctccttcgaccccaagccaattccgggggactggaatggcgctggtgcacacaccaactacagcaccaagtcgatgaggagcgacggcgggtacgaggtgatcaagaaggcgatcggcaagctgggcctccggcaccgggagcacatcgccgcgtacggggacggcaacgagcgcccgctcaccggccgccacgagaccgccgacatcaacaccttcgtctggggcgtgccgaaccgcggggcgtcggtgcgggtgggccgagacaccgagaaggaaggcaaaggctacttcgaggaccggaggccggcgtccaacatggacccgtacgtggtgacctgcctgatcgcggagacaaccatgctgtgggagcccagccactccaacggcgacggcaagggcgccgcggctccttgatttgattctgcggagactgagctctgtgtgtgagccggcctgcgtagatggcaaatgggactgaccctgtcagaaacttgagatgaccataataatagctgcagtgtgctcgttctggggttggataagacccaagaactttttttagctttcttcgaac

SEQ ID NO: 2292 - protein, 368 aa, Zea mays
MALLSDLINLDLSGRTGKIIAEYIWVGGSGMDVRSKARTLSGPVDDPSKLPKWNFDGSSTGQAPGDDSEVILCPRAIFRDPFRKGQNILVMCDCYEPNGEPIPSNKRHGAAKIFSHPDVKAEEPWFGIEQEYTLLQKDTKWPLGWPLAYPGPQGPYYCAAGADKSYGRDIVDCAYKACLYAGIDISGINGEVMPGQWEFQVAPAVGVSAGDQLWVARYILERITEIAGVVVSFDPKPIPGDWNGAGAHTNYSTKSMRSDGGYEVIKKAIGKLGLRHREHIAAYGDGNERPLTGRHETADINTFVWGVPNRGASVRVGRDTEKEGKGYFEDRRPASNMDPYVVTCLIAETTMLWEPSHSNGDGKGAAAP

SEQ ID NO: 2293 - DNA, 1540 bp, Pisum sativum
  CDS (68)..(1360)
gctcattctcacttgaacccattttcaacctttgctgtttttgccatttttcaactctgtattgaaaatggcgcagattttggcaccttcgacgcaatggcagatgagaatcacaaaaacctctccttgtgcaactccaatcacatcaaagatgtggagttctttggttatgaaacaaactaagaaagttgcgcattctgctaaatttagagttatggcagtcaactctgaaaatggcaccatcaatagggtagaggatttgcttaatttggacatcactccgttcaccgacagcattattgctgagtacatatggattggtgggacaggaattgatgtgcgcagcaaatcaaggaccatatcaaagcctgtttcgcatccctctgaggttcctaagtggaactatgatggatctagcactggacaagcccctggtgaagatagtgaagtgatcctatatcctcaagcaattttcaaagatcctttccgtggcggaaacaatattttggtcgtttgtgatgcgtatacaccagcaggtgagcctatccctacaaataagagacacagagctgctgaaatcttcagtaacccaaaggttgaggctgagattccatggtatggaatagaacaagagtacactttacttcaaacaaatgtgaaatggccattaggttggcctgtaggtggctatcccggtcctcagggtccttattactgtgctgccggagcagataagtcatttggacgtgatatatctgatgctcattacaaggcttgcatatatgctggaattaacattagtggcaccaatggagaagttatgcctggacagtgggagtatcaagttggtcctagtgtaggtattgaagctggtgatcatatctgggcttcacggtacatccttgagagaattactgaacaagctggtgttgtgctcactcttgatccaaaaccaatagagggtgattggaatggtgcaggatgtcacaccaattacagtacaaagagcatgagggaagatggagggtttgaggtgataaagaaggccattttgaacctttcccttcgccacaagatccacattgaagcatacggagaaggaaacgaaagaaggttgacaggaaagcatgagacagccagcattaacgacttttcttggggagtggctaaccggggatgctcaatccgtgtgggaagagacaccgagaagaatggcaaaggttacttggaagacaggcgtccggcttcgaacatggatccatatgtggtaacagcattactggcagaaagtacattattgtgggaaccaactctagaggctgaagctcttgcagctcagaagattgcattaaaggtctaaatctattgacttccagatggaggctgtgaggaactgagaagctgttttagatgatttatattatattatgaagatcttgttttctggactcgccatgcctagttactggttatgagatgagtgcacattgtatttgcatatatggtatggacagaattgcattgatgatttgctttggtt

SEQ ID NO: 2294 - protein, 430 aa, Pisum sativum
MAQILAPSTQWQMRITKTSPCATPITSKMWSSLVMKQTKKVAHSAKFRVMAVNSENGTINRVEDLLNLDITPFTDSIIAEYIWIGGTGIDVRSKSRTISKPVSHPSEVPKWNYDGSSTGQAPGEDSEVILYPQAIFKDPFRGGNNILVVCDAYTPAGEPIPTNKRHRAAEIFSNPKVEAEIPWYGIEQEYTLLQTNVKWPLGWPVGGYPGPQGPYYCAAGADKSFGRDISDAHYKACIYAGINISGTNGEVMPGQWEYQVGPSVGIEAGDHIWASRYILERITEQAGVVLTLDPKPIEGDWNGAGCHTNYSTKSMREDGGFEVIKKAILNLSLRHKIHIEAYGEGNERRLTGKHETASINDFSWGVANRGCSIRVGRDTEKNGKGYLEDRRPASNMDPYVVTALLAESTLLWEPTLEAEALAAQKIALKV

SEQ ID NO: 2295 - DNA, 1353 bp, Phaseolus vulgaris
  CDS (116)..(1186)
agaatgtaactgtcatcaggggcttcagattcattcacttcaccctatcaagctttttcaccttttggtatcttctacaatatcctctcatactatctttttcctctttatcaccatgtctttgctttcagatctcatcaacctcaacctctcagaatccacagaaaagatcattgctgagtacatatgggttggtggatctggtatggacctcagaagcaaagccaggactcttcctggaccagtggatgaccctgcaaaacttccaaaatggaactatgatgggtctagcacagatcaagctcctggggatgacagtgaagtcatcctatacccacaagctattttcaaggacccctttaggagaggcaataatattcttgtgatttgtgatgtttacaccccagctggtgagccacttccaaccaacaagaggtatgatgctgccaaaattttcagtcaccctgatgttgttgcagaggtaccatggtatggaattgagcaagagtacaccttgttgcagaaagatgtgaattggccacttgggtggccacttggtgggtatcctgggccacagggaccctactactgtggagttggtgctgataaagcctatggtcgtgatattgtagatgcacattacaaagcttgtgtttatgcaggaattaacatcagtggcatcaatggagaggttatgcctggccagtgggaattccaagttggtccttctgttggcatctctgctggagatgaagtgtgggctgctcgctacattttggagaggattacagagttagcaggagcagttgtttcatttgatcccaagcctattccgggagattggaatggagctggagcacactcaaactatagcactaagtccatgagagaagagggtggttatgaggtgattaagaaagccattgaaaagcttggattgagacacaaagagcacattgcagcatatggaaaaggtaatgagagacgtctcacaggaagacatgaaactgcagacatcaacaccttttcttggggtgtggcaaaccgtggaagttcagttagagttggaagagacacagagaaacaagggaaaggttactttgaggacagaaggcctgcttctaacatggatccttatgtagtcacctccatgattgcagagaccaccattctctggaaaccatgaacatgtggttagaccactcaaaattgtgttttcaataccatttgattccacaatttggttatatctccaaggagttgttgtttttttaggtcttctaagccttctgtgttctctgatggttgaaaataacttctttaataacaagaattgattcttgagttcactct

SEQ ID NO: 2296 - protein, 356 aa, Phaseolus vulgaris
MSLLSDLINLNLSESTEKIIAEYIWVGGSGMDLRSKARTLPGPVDDPAKLPKWNYDGSSTDQAPGDDSEVILYPQAIFKDPFRRGNNILVICDVYTPAGEPLPTNKRYDAAKIFSHPDVVAEVPWYGIEQEYTLLQKDVNWPLGWPLGGYPGPQGPYYCGVGADKAYGRDIVDAHYKACVYAGINISGINGEVMPGQWEFQVGPSVGISAGDEVWAARYILERITELAGAVVSFDPKPIPGDWNGAGAHSNYSTKSMREEGGYEVIKKAIEKLGLRHKEHIAAYGKGNERRLTGRHETADINTFSWGVANRGSSVRVGRDTEKQGKGYFEDRRPASNMDPYVVTSMIAETTILWKP

SEQ ID NO: 2297 - DNA, 990 bp, Rhizobium meliloti
  CDS (1)..(990): transl_table=11
atgaccaagtataagctcgagtacatctggcttgatgctacacgcccgtaccaaactctccgcggaaaaacgcagatcaaggaattcgacgcgtttccgacgctcgagcagcttccgctctggggctttgacggcagctctacgctgcaggccgaggggcgcacgtccgattgtgtgctgaagccggttaccgtctatcccgatccggtccgcacgaatggcgcattggtcatgtgcgaggtgatgatgccggacgcagagacaccgcatgcgtcgaatacccgggcaacggtcctcgatgacgaaggcgcctggttcggcttcgagcaggaatatttcttctacaagaacggccgcccactgggcttcccggagcagggctatccggcgccgcagggcccatactataccggcgtcggctacaagaatgtcggcgacgtcgcgcgccagatcgttgaagagcatctcgacatctgccttgctgcgggcatcaaccacgaaggcatcaacgccgaagtggccaaggggcaatgggagttccagatctttggcaagggttccaaaaaagctgccgacgaggtctgcgtggcgcgctatctcctcgtgcgcctgacggaaaaatacggcatcgacgtcgaattccactgcaagccgctcggcgacacggactggaacggctcgggcatgcacgcgaacttctcgacggcctatctgcgtgaagtcggcggccaggactatttcgaagcgctgatggcagccttcgagaagaacctgcacgaccacatcaacgtctatggccctgataaccatttgcgcctgactggcaagcacgagacggcgccgtgggataagttcagctacggcgtggcagatcgcggcgcctctatccgcgtgccccatagtttcgtcaacaatgcgtatccgggctatctcgaagatcgccgcgcgaactcccagggcgacccctaccagatgcttctatcatcctga

SEQ ID NO: 2298 - protein, 329 aa, Rhizobium meliloti
MTKYKLEYIWLDATRPYQTLRGKTQIKEFDAFPTLEQLPLWGFDGSSTLQAEGRTSDCVLKPVTVYPDPVRTNGALVMCEVMMPDAETPHASNTRATVLDDEGAWFGFEQEYFFYKNGRPLGFPEQGYPAPQGPYYTGVGYKNVGDVARQIVEEHLDICLAAGINHEGINAEVAKGQWEFQIFGKGSKKAADEVCVARYLLVRLTEKYGIDVEFHCKPLGDTDWNGSGMHANFSTAYLREVGGQDYFEALMAAFEKNLHDHINVYGPDNHLRLTGKHETAPWDKFSYGVADRGASIRVPHSFVNNAYPGYLEDRRANSQGDPYQMLLSS

SEQ ID NO: 2299 - DNA, 1087 bp, Glycine max
  CDS (1)..(1071)
atgtcgttgctctccgatcttatcaaccttaacctctccgacatcaccgataaagtgatcgccgagtacatatgggtaggtggatctggcatggatatgaggagcaaagcaaggacactctcaggaccggttaaagacccttcgaagcttcccaagtggaactatgatggttccagcactggtcaagctcctgggcaagatagtgaagtgatcttatatccacaagcaattttcaaggatccattcaggaggggtagcaatatcctggttatgtgtgatgcttacactcctgctggggaacccattcctacaaacaagagaaataatgctgcaaagatattcggccatcctgatgttgctgctgaagaaccctggtatggcctagagcaagaatacaccttgttgcaaaaagatgtccaatggcctctaggatggcctcttggtggttttcctgggccacaaggaccatattattgtggtactggtgctaacaaggctttcgggcgtgatattgttgactcacattacaaagcatgtatttatgcgggcattaacatcagtggaatcaatggagaagtgatgcctggtcagtgggaattccaagttggtccatcaattggcatctctgctgctgacgaattgtgggttgctcgttatattttggagaggatcaccgagattgcaggagtggtgctttcctttgaccctaaaccaattcagggtgattggaatggtgctggtgctcacacaaattacagtaccaagtccatgagaaacgatggtggctatgaagtcatcaaaaaagcaattgctaagttggaaaagagacacaaggagcacattgcagcttacggagagggcaacgaacgccgtttgactggacgacacgagacagctgacatgaacacctttgtatggggtgttgcaaaccgtggtgcttctattagagtagggagggacactgagaaggcagggaaggggtattttgaggataggaggcctgcctctaatatggacccttatgtggtcacttccatgattgctgagacaaccattctttggaaaccataagcagcctcaaaaataa

SEQ ID NO: 2300 - protein, 356 aa, Glycine max
MSLLSDLINLNLSDITDKVIAEYIWVGGSGMDMRSKARTLSGPVKDPSKLPKWNYDGSSTGQAPGQDSEVILYPQAIFKDPFRRGSNILVMCDAYTPAGEPIPTNKRNNAAKIFGHPDVAAEEPWYGLEQEYTLLQKDVQWPLGWPLGGFPGPQGPYYCGTGANKAFGRDIVDSHYKACIYAGINISGINGEVMPGQWEFQVGPSIGISAADELWVARYILERITEIAGVVLSFDPKPIQGDWNGAGAHTNYSTKSMRNDGGYEVIKKAIAKLEKRHKEHIAAYGEGNERRLTGRHETADMNTFVWGVANRGASIRVGRDTEKAGKGYFEDRRPASNMDPYVVTSMIAETTILWKP

SEQ ID NO: 2301 - DNA, 1305 bp, Vitis vinifera
  CDS (24)..(1094)
gtttttttttttttttcgccaccatggctctgctttcagatctcatcaacttgaacctctctgatgtcactgagaaaattattgccgagtacatatggatcggcggatccggaatggacctcagaagtaaagcgagaacgctatcagggcccgtcagcgacccccacaagctacccaaatggaattatgacggatccagcacaggccaagcccctggagaggacagtgaagtgatcctataccctcaagcaattttcaaggacccattcaggagaggcaacaatattcttgtcatgtgtgatacttacactcctgctggggagcccattccaaccaacaagaggcataacgcagctaaaatatttagccatcctgaagtccttgctgaagaaacttggtatggtattgagcaggagtacaccttgttgcaaaactcggttaaatggcccattggctggcctgtgggaggttatcccggcccccagggaccatactactgcggtattggtgctgacaaagcctttgggcgggacattgttgattctcattacaaggcatgcctttatgctggaatcaacattagtggcatcaatggtgaagttatgccaggacagtgggagtttcaagtaggccctgcagtcggcatctctgctggggatgaattgtgggttgctcggtacattctagagaggattacagagattgctggagtggtggtttcctttgatcccaaacccattcagggtgactggaatggtgccggcgctcacacaaattacagcactaagtccatgagaaatgatggaggttatgagatcatcaagaaagcaatcgaaaaacttgggctgaggcacaaagaacacattgccgcatacggagaaggcaatgagcgcagactcacaggacgacatgaaactgctgacattaacacattcttatggggcgtcgcaaaccgaggggcatccatccgagtaggcagagacacagagaaggaagggaaagggtattttgaggacagaaggcctgcttccaacatggatccatatgtggtgacttccatgatcgcggagagcaccatcctgtggaagccataagtgtttccagatgttgccgttgttccaggggataaaatttgagtcagtcagttgtgttattttggtgctgtgtctcattgtttgcccttgtatttgaggtagcaaggggggtgggtttatggcccccttgcctgatcatttcgcctcttgttaaaataaccattaccttagcattaataacaacatttgaaggcctggcttctattgttgc

SEQ ID NO: 2302 - protein, 356 aa, Vitis vinifera
MALLSDLINLNLSDVTEKIIAEYIWIGGSGMDLRSKARTLSGPVSDPHKLPKWNYDGSSTGQAPGEDSEVILYPQAIFKDPFRRGNNILVMCDTYTPAGEPIPTNKRHNAAKIFSHPEVLAEETWYGIEQEYTLLQNSVKWPIGWPVGGYPGPQGPYYCGIGADKAFGRDIVDSHYKACLYAGINISGINGEVMPGQWEFQVGPAVGISAGDELWVARYILERITEIAGVVVSFDPKPIQGDWNGAGAHTNYSTKSMRNDGGYEIIKKAIEKLGLRHKEHIAAYGEGNERRLTGRHETADINTFLWGVANRGASIRVGRDTEKEGKGYFEDRRPASNMDPYVVTSMIAESTILWKP

SEQ ID NO: 2303 - DNA, 1317 bp, Zea mays
  CDS (63)..(1133)
caatcccacaccaccaccacctcctccggtccccaacccctgtcgcaccgcagccgccggccatggcctgcctcaccgacctcgtcaacctcaacctctcggacaccaccgagaagatcatcgcggaatacatatggatcggtggatctggcatggatctcaggagcaaagcaaggaccctctccggcccggtgaccgatcccagcaagctgcccaagtggaactacgacggctccagcacgggccaggcccccggcgaggacagcgaggtcatcctgtacccgcaggccatcttcaaggacccattcaggaggggcaacaacatccttgtgatgtgcgattgctacaccccagccggcgagccaatccccaccaacaagaggtacaacgccgccaagatcttcagcagccctgaggtcgccgccgaggagccgtggtatggtattgagcaggagtacaccctcctccagaaggacaccaactggccccttgggtggcccatcggtggcttccccggccctcagggtccttactactgtggaatcggcgccgaaaagtcgttcggccgcgacatcgtggacgcccactacaaggcctgcttgtatgcgggcatcaacatcagtggcatcaacggggaggtgatgccagggcagtgggagttccaagtcgggccttccgtgggtatttcttcaggcgaccaggtctgggtcgctcgctacattcttgagaggatcacggagatcgccggtgtggtggtgacgttcgacccgaagccgatcccgggcgactggaacggcgccggcgcgcacaccaactacagcacggagtcgatgaggaaggagggcgggtacgaggtgatcaaggcggccatcgagaagctgaagctgcggcacagggagcacatcgcggcctacggcgagggcaacgacggccggctcaccggcaggcacgagaccgccgacatcaacacgttcagctggggcgtggccaaccgcggcgcgtcggtgcgcgtgggccgggagacggagcagaacggcaagggctacttcgaggaccgccgcccggcgtccaacatggacccctacgtggtcacctccatgatcgccgagaccaccatcatctggaagccctgagcgccgcggccgttgcgttgcagggtccccgaagcgattgcaaagccactgttccttccgttctgtttgcttattattgttattatctagctagatcatccggggtcaggtcgtcgtggtgtgccaaaacagaacacagaaagaggaagaagaaaaaaaaaacaagacgtgtggcgtttatgtt

SEQ ID NO: 2304 - protein, 356 aa, Zea mays
MACLTDLVNLNLSDTTEKIIAEYIWIGGSGMDLRSKARTLSGPVTDPSKLPKWNYDGSSTGQAPGEDSEVILYPQAIFKDPFRRGNNILVMCDCYTPAGEPIPTNKRYNAAKIFSSPEVAAEEPWYGIEQEYTLLQKDTNWPLGWPIGGFPGPQGPYYCGIGAEKSFGRDIVDAHYKACLYAGINISGINGEVMPGQWEFQVGPSVGISSGDQVWVARYILERITEIAGVVVTFDPKPIPGDWNGAGAHTNYSTESMRKEGGYEVIKAAIEKLKLRHREHIAAYGEGNDGRLTGRHETADINTFSWGVANRGASVRVGRETEQNGKGYFEDRRPASNMDPYVVTSMIAETTIIWKP

SEQ ID NO: 2305 - DNA, 1372 bp, Medicago sativa
  CDS (92)..(1162)
ggcacgagtagagattcctgtgtagctatttgtctattacttgcttttcacacactgtgtttttcttcttcttccttcactgttcatcgtcatgtctttgctttcagatctcatcaacctcaatctctcagaatcctccgaaaagattattgctgaatacatatgggttggtggatctggtatggaccttagaagcaaagccaggactcttcctggtccagtgagtgaccctgcaaaactgcctaagtggaactatgatggatcaagcacaaatcaagctccaggacaagatagtgaagttatcttatatccacaagctattttcaaggatccatttagacaaggcaacaatattcttgtgatttgtgatgtttacaccccagctggtgaaccactcccaacaaacaagaggcacaatgctgccaaaattttcagtcaccctgatgttgctgctgaggtaccatggtatggtattgagcaagagtatacattattgcagaaagatactaattggccactaggatggcctattggtggctttccaggaccacaaggtccatattattgtgggattggtgctgataaagcatatggtcgtgatattgttgatgcacattacaaagcttgtctttatgctggcattaacattagtggcatcaatggagaggttatgcctggccagtgggagttccaagttggcccttctgttggtatttctgctggagatgaaatatgggctgctcgttacattctagagaggatcacagagatagctggagtggttgtttcatttgaccctaagccaattccgggtgattggaatggagctggtgctcacacaaactatagcaccaagtcaatgagagaggatggaggctatgaaatcatcaagaaggccattgaaaagcttggattgaggcataaggagcacattgctgcttatggggaaggaaatgagagacgtctcactggaaaacatgaaacaacagacatcaacaccttttcttggggtgtggcaaaccgtggtgcctcagttagggttggaagagacacagaaaaagatggcaaaggttactttgaggacagaaggccttcttctaatatggatccctatgtggtcacttccatgattgctgaaaccacccttctatggaaaccatgaagtcacaaccacttgtctttggatttggaccacatcacattatgtgttcaataaatagtctagtttatatctattattatcctgcaaagtgttgcttcattagtagtaattgtccaagtggtctttaagcacaaagcatttagtccatgtatttggatgacaataattttatcattaataacatggttgcttcttgattttactctaata

SEQ ID NO: 2306 - protein, 356 aa, Medicago sativa
MSLLSDLINLNLSESSEKIIAEYIWVGGSGMDLRSKARTLPGPVSDPAKLPKWNYDGSSTNQAPGQDSEVILYPQAIFKDPFRQGNNILVICDVYTPAGEPLPTNKRHNAAKIFSHPDVAAEVPWYGIEQEYTLLQKDTNWPLGWPIGGFPGPQGPYYCGIGADKAYGRDIVDAHYKACLYAGINISGINGEVMPGQWEFQVGPSVGISAGDEIWAARYILERITEIAGVVVSFDPKPIPGDWNGAGAHTNYSTKSMREDGGYEIIKKAIEKLGLRHKEHIAAYGEGNERRLTGKHETTDINTFSWGVANRGASVRVGRDTEKDGKGYFEDRRPSSNMDPYVVTSMIAETTLLWKP

SEQ ID NO: 2307 - DNA, 1373 bp, Pisum sativum
  CDS (63)..(1136)
ctgtagctatctttcaacaaaaccgcgttcttctttttccttcaaagcttttcattatcattatgtcttcactttcagatctcatcaattttaatctttcagattccacagaaaagattattgctgaatacatatgggttggtggatcaggcatagacattagaagcaaagccaggactcttcctggaccagtgagtgaccctgcaaaacttcctaagtggaactatgatgggtctagcacaaatcaagcaccaggaaaagatagtgaagttattttatatccacaagctattttcaaggacccattcagaagagggaataatattcttgtgatttgtgatgtttacaccccagctggagaaccattacccacaaacaagagatacaatgctgccaaaattttcagtcaccctgatgttgctgctgaagtaccatggtatggtattgaacaagagtatactctattacagaaagacatcaactggccactaggttggcctattggtggatatccaggaaaacagggtccatattattgtggaattggtgctgataaagcttatggacgtgacattgttgatgcacattacaaagcatgcctttttgctggcattaacatcagtggcatcaatggagaggttatgcccggtcagtgggaatttcaagttggcccttctgttggtatctctgctggagatgagatatgggctgctcgttacattctagagaggattacagagattgctggagttgttgtttcatttgacccaaagcctattccgggtgattggaatggagctggggctcatgcaaatttcagcaccaaatcaatgagagaaaatggaggctacgaggtaatcaagaaggcgattgaaaagctcggattgaggcataaggaacacattgcagcttatggagaaggaaatgagagacgtctcaccggaaaacatgaaaccgccgatatcaatgtcttctcttggggtgtggcaaaccgtggaagctcaattagggttggaagagacacagaaaaagatggaaaaggttactttgaggatagaaggcctgcatctaacatggatccttatgtggtcacttccatgattgctgaaaccaccattctctggaagaaaccatgaagttccaaccaccacaagtctttggatttacaccactacgtataatgagtccaatgccatttatatatatctactttatatctattattattattattaaaataataatatctattattatgcaaatgtgttacttcattagaagtaattttcaagtggggtctttaagcaaagagtatatggtccatgtatttggattacaataattttatcatcaataacatgtggtgcttcttc

SEQ ID NO: 2308 - protein, 357 aa, Pisum sativum
MSSLSDLINFNLSDSTEKIIAEYIWVGGSGIDIRSKARTLPGPVSDPAKLPKWNYDGSSTNQAPGKDSEVILYPQAIFKDPFRRGNNILVICDVYTPAGEPLPTNKRYNAAKIFSHPDVAAEVPWYGIEQEYTLLQKDINWPLGWPIGGYPGKQGPYYCGIGADKAYGRDIVDAHYKACLFAGINISGINGEVMPGQWEFQVGPSVGISAGDEIWAARYILERITEIAGVVVSFDPKPIPGDWNGAGAHANFSTKSMRENGGYEVIKKAIEKLGLRHKEHIAAYGEGNERRLTGKHETADINVFSWGVANRGSSIRVGRDTEKDGKGYFEDRRPASNMDPYVVTSMIAETTILWKKP

SEQ ID NO: 2309 - DNA, 1448 bp, Phaseolus vulgaris
  CDS (69)..(1139)
attgaaaggaagagaaagagaaaatttctctgtgaagagtctctgctgaaagttttggtttcttgaagatgtcatcaatctccgatcttgttaaccttaacctctctgactccaccgagagggtgatcgccgagtatatatgggttggtggatctggcatggacatgaggagcaaagcaagaactctctccggaccggttaaagacccttcaaaacttccaaagtggaactacgatggttccagcacaggtcaagctcctggacaagatagtgaagttatcttatacccacaaacaattttcagggatccattcaggaggggtaacaatatcctggttatgtgtgatgcttacactcctgctggggaacccatccctaccaataagagacataatgcggcaaagatatttagcaatcctgaagttgttgctgaagaaccctggtatggcattgagcaggaatataccttgttgcagaaagatgttcagtggcctgttggatggcctcttggtggttttcctgggccccagggaccatactattgtggtattggtgctaacaaggctttcgggcgtgatattgttgattcacattacaaagcatgtctttatgcgggcattaacataagtggaattaatggagaagtgatgcctggtcaatgggaattccaagttggtccatcagtaggcatctctgctgctgacgagttatgggttgcccgttacattttggagagaatcactgagattgctggagtggtgctttcgtttgaccctaaaccaattcagggtgattggaatggtgctggtgctcacacgaattacagtaccaagtccatgagaaacgatggtggctacgaagtcataaaaaaagcaatcactaagttggaaaagaggcacaaggagcacattgctgcttacggagaaggcaacgaacgtcgtttgacagggaaacacgagacagcagacatgaacaccttcatatggggtgttgcaaaccgtggtgcttctataagggtagggagagacacagagaaggcagggaagggatactttgaggataggaggcctgcatctaacatggacccttatgtcgtcacttccatgattgctgagacaacccttctttggaaaccatgagcaacctcaaaaacacaaccacagatggcttctacaatgcgtagttgcttgtaccttaggattgtcaatttgttcttctctctgttttgtgacctgcttgcctgttgttaggcattgtttgttagtggtactcactgccaagcgaggaattgttgcttcattccctcaatgaacgttttaagttgtagaataatgcaatggctttcaagtattagtgttgttgtttggttcgaatttcaagtattagtgtggttgtttggttcgaatttcaggtttttatttgactaaacaaaggcatgcgcatctctc

SEQ ID NO: 2310 - protein, 356 aa, Phaseolus vulgaris
MSSISDLVNLNLSDSTERVIAEYIWVGGSGMDMRSKARTLSGPVKDPSKLPKWNYDGSSTGQAPGQDSEVILYPQTIFRDPFRRGNNILVMCDAYTPAGEPIPTNKRHNAAKIFSNPEVVAEEPWYGIEQEYTLLQKDVQWPVGWPLGGFPGPQGPYYCGIGANKAFGRDIVDSHYKACLYAGINISGINGEVMPGQWEFQVGPSVGISAADELWVARYILERITEIAGVVLSFDPKPIQGDWNGAGAHTNYSTKSMRNDGGYEVIKKAITKLEKRHKEHIAAYGEGNERRLTGKHETADMNTFIWGVANRGASIRVGRDTEKAGKGYFEDRRPASNMDPYVVTSMIAETTLLWKP

SEQ ID NO: 2311 - DNA, 1490 bp, Zea mays
  CDS (85)..(1152)
ccacatcctcccctcattcctccttgggttcccagcccgtgcgccccgcctgtcgcagtgccagtcgcgccgcagccgccggccatggcctgcctcaccgacctcgtcaacctcaacctctcggacaccacagagaagatcatcgccgagtacatatggatcggtggatctggcatggatctcaggagcaaagccaggaccctcccgggcccggtgaccgatcccagcaagctgcccaagtggaactacgacggctccagcaccggccaggcccccggcgaggacagcgaggtcatcctgtacccgcaggccatcttcaaggacccattcaggaggggcaacaacatccttgtcatgtgcgattgctacaccccagctggcgagccaattcccaccaacaagaggtacagcgccgccaagatcttcagcagccctgaggtcgctgccgaggagccctggtatggtatcgagcaggagtacaccctccttcagaaggacaccaactggcccctcgggtggcctattggcggcttccctggccctcagggtccttactactgtggaatcggcgcggagaaatcgttcgggcgtgacatagtcgacgcccactacaaggcctgcctgtacgcaggcatcaacatcagtggcatcaacggggaggtcatgccggggcagtgggagttccaggtcggaccgtccgtcggcatctcttcgggcgatcaggtgtgggttgctcgctacattcttgagaggatcaccgagatcgccggcgtggtggtgacgttcgacccgaagccgatcccgggcgactggaacggcgcgggcgcccacaccaactacagcaccgagtccatgaggaaggagggcgggtacgaggtgatcaaggcggccatcgagaagctgaagctgcggcacaaggagcacatcgcggcctacggcgagggcaacgagcgccggctcaccggcaggcacgagaccgccgacatcaacaccttcagctggggagtcgccaaccgtggcgcgtcggtggccgtgggccagacggagcagaacggcaagggctacttcgaggaccgccggccggcgtccaacatggatccctacgtggtcacctccatgatcgccgagaccaccatcgtctggaagccctgaggcatcccgtggccgtgtcgtgtcggtttgctccgcgtacggcgctggccgttgcatcgcagggcccagcggttgcgcaactattttcccttccccgttccgtttgcttgtactactactctaccgctagtcctgcatagcattttagctagaacacaacaacagccaaaaaaaaacattgttgcttgcttcgacttcgacgcttcccaccactagttccattccatgccgtccgtccacttccttcctgtgtaatcctcctccaataatagacgtgtcatgctgcatcctctgcattgtataaaagaaagtggtgtaatccttttgctggcgcctcc

SEQ ID NO: 2312 - protein, 355 aa, Zea mays
MACLTDLVNLNLSDTTEKIIAEYIWIGGSGMDLRSKARTLPGPVTDPSKLPKWNYDGSSTGQAPGEDSEVILYPQAIFKDPFRRGNNILVMCDCYTPAGEPIPTNKRYSAAKIFSSPEVAAEEPWYGIEQEYTLLQKDTNWPLGWPIGGFPGPQGPYYCGIGAEKSFGRDIVDAHYKACLYAGINISGINGEVMPGQWEFQVGPSVGISSGDQVWVARYILERITEIAGVVVTFDPKPIPGDWNGAGAHTNYSTESMRKEGGYEVIKAAIEKLKLRHKEHIAAYGEGNERRLTGRHETADINTFSWGVANRGASVAVGQTEQNGKGYFEDRRPASNMDPYVVTSMIAETTIVWKP

SEQ ID NO: 2313 - DNA, 1510 bp, Phaseolus vulgaris
  CDS (64)..(1353)
ccactttccaagttccaacctttccccattttttctactctgtattgagcagaactgcagaacatggcacagattttggctccctctacacaatggcagatgagattcacaaaatcctctcgccatgcaagtcccattacatcaaacacgtggagttctttattgatgaaacaaaataagaaaaccagttctgctaaatttagagtgctggcagttaagtctgatggtagcaccatcaacaggctggagggtctacttaatttggatatcactccattcacggacaagataattgctgagtacatttggattggggggacaggaattgatgtgcgcagtaaatcaagaacaatatcaaagcctgttgaacatccctctgagcttcctaaatggaactatgatggatctagtactggacaggcacccggtgaagatagtgaagtaatcctatatcctcaggcaattttcaaagatcctttccgtggtggtaacaatattttggtcatttgtgatgcttacacacctgctggtgaacctatccctacaaataagcgacacagagctgctgaagttttcagtaacccaagggtcattgctgaagttccatggtttggaatagaacaagagtacaccttacttcaaacaaatgtgaactggcctttaggttggcctgttggtggctatcctggtcctcagggtccttattattgcagtgctggggcagataagtcatttggacgtgatatatctgatgctcactacaaggcttgcttatttgctggaattaacattagtggcaccaacggggaggttatgcctgggcagtgggagtatcaagttggtcctagtgtaggtattgaggctggtgatcatatctgggcatcaaggtacatcctcgagagaattactgaacaagctggtgttgtgctctctcttgatccaaaaccaatagagggtgactggaatggtgcaggatgccacaccaattacagtacaaagagcatgagggaagatggaggctttgaggtaataaagaaggcaattttgaatctatcacttcgccacaaagagcacattagtgcatatggagaaggaaatgaaagaaggttgacaggaaagcatgagacagcaagcattaacacattttcttggggagttgccaatcgtggttgctcaatccgtgtgggaagagacaccgagaagaatggcaaaggttacttggaggacaggcgccctgcttcaaacatggatccatatgtcgtgacatctttacttgcagagagtacactattgtgggagccaactctggaggctgaagctcttgcagctcagaagttagcattgaaggtctaaatttattgattgatggcattctggacggagcctgtagtttgtaaggagcttgaaagctctcgcactttccttttacatcattacttgtttggaccaaagaggttaccatgcccagttatattggttgtcatatgaaatgcacatcgtaatatcagaa

SEQ ID NO: 2314 - protein, 429 aa, Phaseolus vulgaris
MAQILAPSTQWQMRFTKSSRHASPITSNTWSSLLMKQNKKTSSAKFRVLAVKSDGSTINRLEGLLNLDITPFTDKIIAEYIWIGGTGIDVRSKSRTISKPVEHPSELPKWNYDGSSTGQAPGEDSEVILYPQAIFKDPFRGGNNILVICDAYTPAGEPIPTNKRHRAAEVFSNPRVIAEVPWFGIEQEYTLLQTNVNWPLGWPVGGYPGPQGPYYCSAGADKSFGRDISDAHYKACLFAGINISGTNGEVMPGQWEYQVGPSVGIEAGDHIWASRYILERITEQAGVVLSLDPKPIEGDWNGAGCHTNYSTKSMREDGGFEVIKKAILNLSLRHKEHISAYGEGNERRLTGKHETASINTFSWGVANRGCSIRVGRDTEKNGKGYLEDRRPASNMDPYVVTSLLAESTLLWEPTLEAEALAAQKLALKV

SEQ ID NO: 2315 - DNA, 1575 bp, Brassica napus
  CDS (95)..(1381)
ttcatatttgtcaactcttcctttgccatttgttgcaaacactcaagtctcctgatatcagagttagagtcttcttcaagttccagggataaaaatggcgcagatcttggcagcttctccaacatgtcaaatgagattgactaaacccagctccattgcatcgtcaaagttatggaactcggttgtgttgaaacagaagaaacagagcagcagcaaagtcagaagcttcaaagtgatggctctccaatctgataacagcacaatcaacagagttgagagtcttctcaatctagacaccaaacctttcactgaccggatcatcgctgagtacatctggattggcggatctggaattgaccttaggagcaagtcaaggacgcttgaaaagcccgtggaagatccttctgaacttcccaagtggaactatgatggttcaagtaccggtcaagcacctggtgaagatagtgaagtgattctctatccgcaagctatcttcagggatcctttccgtggaggcaataacatattggttatctgtgatacctacacaccagctggtgagccaattccaacaaacaaacgtgcaagagctgctgagattttcagcaacaagaaggtcaatgaagagattccatggtttggcattgaacaagagtacactttacttcagccaaacgtgaactggcctttgggttggcccgttggagcgtatcctggtccccagggtccttactactgtggagttggagctgaaaagtcttggggccgtgacatttcagatgctcattacaaagcttgtttgtatgctggaattaacatcagtggtactaatggtgaagttatgccaggacagtgggaattccaagttggcccgagcgtaggaatcgaagcaggtgatcacgtttggtgtgctagataccttcttgagagaatcacagaacaagctggtgttgtcctaacacttgatcccaaaccgattgagggtgactggaacggtgctggttgccataccaattacagcacaaagagcatgagagaggacggaggatttgaggtgattaaaaaggcaatcttgaacctctcgcttcgtcacatggagcacatcagtgcctacggtgaaggcaatgagagaaggttgactggaaagcacgagacagccagtatcgaccaattctcatggggagtggctaaccgtggatgctcaattcgtgtgggacgtgataccgagaagaaaggaaaaggttacttggaagatcggcgtccagcgtctaacatggacccatacattgtgacttcactgttggcagagaccacacttctctgggagccaacccttgaggctgaagcacttgctgctcagaagctttctttaaaagtttaatttattaatgaacacacatgtctgtttatgtggtcttcccgggatcatcagtcttgtttagaacacgtgttcggattacgacattcttgtctcttttttttcatttgcattgtttaaaaaacccagaatttcgtggacaatgttcatccttttctattggttgtttatggtcttaaaaaaaaaaaaaaaaaaaa

SEQ ID NO: 2316 - protein, 428 aa, Brassica napus
MAQILAASPTCQMRLTKPSSIASSKLWNSVVLKQKKQSSSKVRSFKVMALQSDNSTINRVESLLNLDTKPFTDRIIAEYIWIGGSGIDLRSKSRTLEKPVEDPSELPKWNYDGSSTGQAPGEDSEVILYPQAIFRDPFRGGNNILVICDTYTPAGEPIPTNKRARAAEIFSNKKVNEEIPWFGIEQEYTLLQPNVNWPLGWPVGAYPGPQGPYYCGVGAEKSWGRDISDAHYKACLYAGINISGTNGEVMPGQWEFQVGPSVGIEAGDHVWCARYLLERITEQAGVVLTLDPKPIEGDWNGAGCHTNYSTKSMREDGGFEVIKKAILNLSLRHMEHISAYGEGNERRLTGKHETASIDQFSWGVANRGCSIRVGRDTEKKGKGYLEDRRPASNMDPYIVTSLLAETTLLWEPTLEAEALAAQKLSLKV

SEQ ID NO: 2317 - DNA, 1483 bp, Zea mays
  CDS (48)..(1319)
gggcggcggccggtccgtgtccgtgtccgtcgacggttggttcgggaatggcgcaggcggtggtgccggcgatgcagtgccgggtcggagtgaaggcggcggcggggagggtgtggagcgccggcaggactaggaccggccgcggcggcgcctcgccggggttcaaggtcatggccgtcagcacgggcagcaccggggtggtgccgcgcctcgagcagctgctcaacatggacaccacgccctacaccgacaaggtcatcgccgagtacatctgggtcggaggatctggaatcgacatcagaagcaaatcaaggacgatttcgaaacccgtggaggatccctcagaactaccaaaatggaactacgatggatctagcacaggacaagccccgggagaagacagtgaagtcattctatacccccaggctatcttcaaggacccattccgaggtggcaacaacgttttggttatctgtgacacctacacgccacagggggaaccccttccaactaacaaacgccacagggctgcgcaaattttcagcgacccaaaggtcggtgaacaagtgccatggtttggcatagagcaagagtacactttgctccagaaagatgtaaattggcctcttggttggcctgttggaggcttccctggtccccagggtccatactactgtgccgtaggagccgacaaatcatttggccgtgacatatcagatgctcactacaaggcatgcctctacgctggaatcaacattagtggaacaaacggggaggtcatgcctggtcagtgggagtaccaagttggacctagtgttggtattgaagcaggagatcacatatggatttcgagatacattctcgagagaatcacagagcaagctggggttgtccttacccttgatccaaaaccaattcagggtgactggaacggagctggctgccacacaaattacagcacaaagaccatgcgcgaagacggcgggtttgaagagatcaagagagcaatcctgaacctttctctgcgccatgatctgcatattagtgcatacggagaaggaaatgaaagaagattgactgggaaacatgagactgcgagcatcggaaccttctcatggggtgtggcaaaccgcggctgctctatccgtgtggggcgggataccgaggcaaaagggaaaggttacctggaagaccgtcggccggcatcaaacatggacccgtacattgtgacggggctactggccgagaccacgatcctctggcagccatccctcgaggcggaggctcttgccgccaagaagctggcgctgaaggtgtgaagcagctgaaggatggttcaggcaccaatataaaccggtccgcgacaagattgatctttgtgtccatggccgttgggtcttgcgactctctgctcggcggtgccactctgtacaaaatcacggctgtctttgattcatcggatattcggatacgtttgtttgtt

SEQ ID NO: 2318 - protein, 423 aa, Zea mays
MAQAVVPAMQCRVGVKAAAGRVWSAGRTRTGRGGASPGFKVMAVSTGSTGVVPRLEQLLNMDTTPYTDKVIAEYIWVGGSGIDIRSKSRTISKPVEDPSELPKWNYDGSSTGQAPGEDSEVILYPQAIFKDPFRGGNNVLVICDTYTPQGEPLPTNKRHRAAQIFSDPKVGEQVPWFGIEQEYTLLQKDVNWPLGWPVGGFPGPQGPYYCAVGADKSFGRDISDAHYKACLYAGINISGTNGEVMPGQWEYQVGPSVGIEAGDHIWISRYILERITEQAGVVLTLDPKPIQGDWNGAGCHTNYSTKTMREDGGFEEIKRAILNLSLRHDLHISAYGEGNERRLTGKHETASIGTFSWGVANRGCSIRVGRDTEAKGKGYLEDRRPASNMDPYIVTGLLAETTILWQPSLEAEALAAKKLALKV

SEQ ID NO: 2319 - DNA, 1245 bp, Amanita muscaria
  CDS (96)..(1160)
atatttgcgctccttatcgtccaatgagattcgttcaaatagatgtcaacattcttcctttatctattttactcggcgcttccaacttgtccgtcatggctaaccagtaccacaacgatctcctcgctccctacctcgctctcgaccaaggcggcaaattccacgctgaatatgtctggattgacggcgatggtggtctccgttcaaagactactactgtcgaccagaaggtgacagatatcagccaacttcgtgtttgggatttcgatggctcttccacaaaccaagccccttctggtaattccgatgtatatctccgcccgtctgccatctttaaagaccccttccggggcggagaaaacatcctcgttctttccgaaacctacaacaacgacggtactcctaacaggacaaaccaccgccaccacactgccaaggttatggagctggccaaggacgagataccatggtttggtattgagcaggaatatacccttttcgacgcagacggttcaccttacggatggccaaaaggcggtttccctggaccccagggtccctactactgcggtgcaggcaccggtaaagtctttgctcgtgacctcatcgaggctcattatcgcgcatgtctatatgcgggtgtcaacatcagcggcatcaacgcagaggttatgccatcacaatgggagttccaggtcgggccatgtgagggtatttccatgggcgaccatctgtggatggctcgttacttgcttatccgcgtcgcggagcaatggggcgtcaaggtttctttccaccctaaaccccttcaaggagattggaacggtgctggtgctcacaccaactactctacattagctatgcgcgagcctggtggtatgaagtacatcgaggctgcgattgaaaagttggccaagagacacgacgaacacatcgcggtttatggtgaagataacgaaatgcgtctcaccggccgccacgagacaggccacattggcactttctcgtctggcgtagccaaccgtggtgcttccattcgtgtaccaaggcatgttgctaacaaaggatatggatacctcgaagatagacgccctgcttccaacattgacccttaccgtgtaaccggcatcatcatagagacgactatccttgacaaatagattaaatccagtgtgtatctgtagattgatatgtaggcaaaattaaaggacggacttgttgaatcacaaaaaaaaaaaaaaaaaa

SEQ ID NO: 2320 - protein, 354 aa, Amanita muscaria
MANQYHNDLLAPYLALDQGGKFHAEYVWIDGDGGLRSKTTTVDQKVTDISQLRVWDFDGSSTNQAPSGNSDVYLRPSAIFKDPFRGGENILVLSETYNNDGTPNRTNHRHHTAKVMELAKDEIPWFGIEQEYTLFDADGSPYGWPKGGFPGPQGPYYCGAGTGKVFARDLIEAHYRACLYAGVNISGINAEVMPSQWEFQVGPCEGISMGDHLWMARYLLIRVAEQWGVKVSFHPKPLQGDWNGAGAHTNYSTLAMREPGGMKYIEAAIEKLAKRHDEHIAVYGEDNEMRLTGRHETGHIGTFSSGVANRGASIRVPRHVANKGYGYLEDRRPASNIDPYRVTGIIIETTILDK

SEQ ID NO: 2321 - DNA, 1110 bp, Ashbya gossypii
  CDS (1)..(1110)
atgagcgagctagtagagaagacatcgacgttgctgaaatacctcgatttggaccagcgcggggcggtgatcgcggagtacatctgggtcgactcggccgggcacttgcggtcgaaggggcgcacgttgcagcggcgcgtggagagcgtggacgagttgccggagtggaacttcgacgggtcgtcgacggggcaggcgcctgggcacgactcggacgtgtacttgaagccggtggccttctacccggacccgttccggcgcggggacaacatcatcgtgttggcggagtgctggaacaacgacggcacgccgaacaagtacaaccaccggcacgaggcggcgaagctctttgaggcgcacagggcggcggacatctggtttgggctcgagcaggagtacacgttgttcgaccacaacgacaacgtgtacgggtggcccaagggcggcttccccgcgccgcagggcccctactactgcggcgtgggcgcgggcaaggtgtacgcgcgcgacgtggtcgaggcgcactaccgcgcgtgcctctacgcgggccttcgcatctcgggcatcaacgccgaggtgatgccctcgcagtgggagttccaggtcgggccgtgcacgggcatcaccatgggcgacgagctctgggtggggcgctacttgctccaccgcgtcgccgaggagttcggcgtgaaggtctccttccaccccaagcccttgaagggcgattggaacggcgcgggctgccacaccaacgtgtccacgagggagatgcgccagcccggcggcatgcgctacatcgaggaggccatcgacaagttgtccaagcgccacaaggagcacatcaagctctacggctccgacaacgagctccgcctcaccggccgccacgagaccgcctccatggccaccttctcgtccggcgtggccaaccgcggcgcgtccatccgcattccgcgctccgtcagcaaggagggcttcggctacttcgaggatcgccggcccgcctccaacatcgacccttacttggttaccggcataatatgcgagaccatctgcggtgccattgagaatgcagatatgtccaaggagttcgagcgtgaatcttcttga

SEQ ID NO: 2322 - protein, 369 aa, Ashbya gossypii
MSELVEKTSTLLKYLDLDQRGAVIAEYIWVDSAGHLRSKGRTLQRRVESVDELPEWNFDGSSTGQAPGHDSDVYLKPVAFYPDPFRRGDNIIVLAECWNNDGTPNKYNHRHEAAKLFEAHRAADIWFGLEQEYTLFDHNDNVYGWPKGGFPAPQGPYYCGVGAGKVYARDVVEAHYRACLYAGLRISGINAEVMPSQWEFQVGPCTGITMGDELWVGRYLLHRVAEEFGVKVSFHPKPLKGDWNGAGCHTNVSTREMRQPGGMRYIEEAIDKLSKRHKEHIKLYGSDNELRLTGRHETASMATFSSGVANRGASIRIPRSVSKEGFGYFEDRRPASNIDPYLVTGIICETICGAIENADMSKEFERESS

SEQ ID NO: 2323 - DNA, 1119 bp, Candida glabrata
  CDS (1)..(1119)
atgcatgaacacagtgttgaaaagactcaaatcttacaaaaataccttgagttgccccaaaacggtaaggtcatcgccgagtacgtctgggttgacggtactggtaacctacgttccaaggctagaactttgaacaaagtcataacgtctattgagcaactgccggagtggaactttgacggttcttctactaaccaagccccaggctacgactcagacatctacttgaagccagtggcgttctaccctgatccattcagaagaggtgacaacatcactgtcttggctgaatgtttcaacagtgacggtactccaaacaagttcaaccacagacatgaggctaacaagttgttccaagcacacaaggacgaagagatctggttcggtatcgagcaagaatacactttgttcgacatgtacgacaacgtctacgcttggccaaagggtggttacccagccccacaaggtccatactactgtggtgttggtgccggtaaggtctacgccagagatgtgatcgaagcccactacagagcctgtctatacgctggtatcaacatctcaggtatcaacgccgaagtgatgccttcccaatgggaattccaagttggtccatgtgagggtatctccatgggtgaccaattgtggatggccagatacttcttgcacagagtggcagaagaattcggtgtcaagatttccttccatccaaagcctttgaagggtgactggaatggtgctggttgccatactaacgtctctacaaaggacatgagagtgccaggtggtatgaagtacatcgaacaagccatcgaaaaactttcaaagagacacaacgaacacatcaagctatatggtgccgacaacgaacaaagactaacgggtagacacgaaaccgcctccatgacatccttctccagtggtgtcgctaacagaggtgcttccatcagaatacctagaccagtcgccaaggaaggattcggttacttcgaagaccgtagaccagcctccaacatagatccatacttggtcaccggtatcatgtgtgagactgtttgtggtgccatcgaaaacgccaacatgtccaaggaatacgaaagagaaactaacgaacaataa

SEQ ID NO: 2324 - protein, 372 aa, Candida glabrata
MHEHSVEKTQILQKYLELPQNGKVIAEYVWVDGTGNLRSKARTLNKVITSIEQLPEWNFDGSSTNQAPGYDSDIYLKPVAFYPDPFRRGDNITVLAECFNSDGTPNKFNHRHEANKLFQAHKDEEIWFGIEQEYTLFDMYDNVYAWPKGGYPAPQGPYYCGVGAGKVYARDVIEAHYRACLYAGINISGINAEVMPSQWEFQVGPCEGISMGDQLWMARYFLHRVAEEFGVKISFHPKPLKGDWNGAGCHTNVSTKDMRVPGGMKYIEQAIEKLSKRHNEHIKLYGADNEQRLTGRHETASMTSFSSGVANRGASIRIPRPVAKEGFGYFEDRRPASNIDPYLVTGIMCETVCGAIENANMSKEYERETNEQ

SEQ ID NO: 2325 - DNA, 1077 bp, Cryptococcus neoformans
  CDS (1)..(1077)
atgtctcaactaattgccaccaagcgagttgatcttcttgccccttacctcgcccttgatcagggttctcgtgttcaggccgagtacatctggattgacgctgagggaggtatccgaagtaagaccatgactctcgataaggctccttcatctgttgccgatctcaaggagtggaatttcgacggttcttctaccaaccaggcccctgctgataactctgatgtcttcctccgtcctgttgccatcttcaaggaccccttccgaggtggcgccaacattctcgttctctgcgaatgttacgacaacgacggtacccctaacaagtccaactaccgagctcactgcaagaaggtgatggacgccgccaaggacactgagccttggttcggtctcgagcaggagtacactctttttgacgccgatggtcaagtctttggctggcccaagaatggtttccccggtcctcagggtccttactactgtggtgtcggtgccggcaaggtgtttgctcgtgatttcatcgaggctcactacagggcttgtctctacgccggtatcaagatttccggtatcaacgccgaggtcatgccatctcagtgggagttccaggttggtccttgtactggtatcgagatgggtgaccatctctggatggcccgattcctccttcttaggattggtgaggagtggggtatcactccttctctccatcctaagcctctgaagggtgattggaacggtgccggttgccactccaactactccaccaaggacatgcgaacacccggtaagggtatggctgctatcgaagatgccatcaagaagctagaaaagaagcacctcgaacacatcgcggtttacggtgaagataatgacttgcggttgaccggcaagcatgagaccgcatcaatgaccaccttctctgctggtgttgccaacaggggtgcctctattcgaattcccaggcatgtcggtgcgcagggttacggttaccttgaagatcgtcgacccgcctctaacgttgacccttatcgagtcacagccatcctcgtcgagaccaccgttcttaacaactaa

SEQ ID NO: 2326 - protein, 358 aa, Cryptococcus neoformans
MSQLIATKRVDLLAPYLALDQGSRVQAEYIWIDAEGGIRSKTMTLDKAPSSVADLKEWNFDGSSTNQAPADNSDVFLRPVAIFKDPFRGGANILVLCECYDNDGTPNKSNYRAHCKKVMDAAKDTEPWFGLEQEYTLFDADGQVFGWPKNGFPGPQGPYYCGVGAGKVFARDFIEAHYRACLYAGIKISGINAEVMPSQWEFQVGPCTGIEMGDHLWMARFLLLRIGEEWGITPSLHPKPLKGDWNGAGCHSNYSTKDMRTPGKGMAAIEDAIKKLEKKHLEHIAVYGEDNDLRLTGKHETASMTTFSAGVANRGASIRIPRHVGAQGYGYLEDRRPASNVDPYRVTAILVETTVLNN

SEQ ID NO: 2327 - DNA, 1113 bp, Debaryomyces hansenii
  CDS (1)..(1113)
atggtgtcgattacagaacaaactgctattttagccaaatatttggatctttctcaaaacggtaaggtgttagccgaatacgtgtggattgatgctgatggtaactctagatctaagtgtaaaacattagacaagaagccaagctcagttgaagatttaccagaatggaactttgacggttcttctaccggtcaagctcctggtcatgattccgatgtgtatttaagaccagtcgcattctacgcagatcctttcagaaagggtgacaacatcattgttttaaccgaatgttggaacaacgacggtactccaaacaagttcaaccacagacacgaatctgctaagttaatgaaggcccatgctgatgaagaagtctggttcggtttagagcaagaatacaccttattcgaccaatttgaccaaccatacgcatggccaaagggtggtttcccagctccacaaggtccttactactgtggtgtcggaaccggtaaggtttacgccagagacttaattgaagctcactacagagcttgtcttcacgccggtgtcgatatttctggtatcaacgctgaagtcatgccatcacaatgggaattccaagtcggtccttgtgaaggtatccaaatgggtgacgagttatggattgctcgttacttgttacaaagagtcgccgaagaattcggtgttaaggtttctttccatccaaagcctttgaaaggtgaatggaacggtgctggttgtcacactaatgtttctaccaagtctatgagattaccaggtggtatgaagagtatagaagttgctttatctaaattagcaaagagacataaggaacatatgttgttatacggtgctgataatgatcaaagattaacaggtcgtcatgagactgcttctatcgaaggtttctcatctggtgttgctaacagaggtgcttctgttagaatcccaagatctgttgccaaggaaggctatggttatttcgaagatagaagacctgcttccaatatagatccttacttggttactggtattatggttgaaaccatttgtggttccattccagatgctgatatgttcaaagaatatgctagagaatcttctgattaa

SEQ ID NO: 2328 - protein, 370 aa, Debaryomyces hansenii
MVSITEQTAILAKYLDLSQNGKVLAEYVWIDADGNSRSKCKTLDKKPSSVEDLPEWNFDGSSTGQAPGHDSDVYLRPVAFYADPFRKGDNIIVLTECWNNDGTPNKFNHRHESAKLMKAHADEEVWFGLEQEYTLFDQFDQPYAWPKGGFPAPQGPYYCGVGTGKVYARDLIEAHYRACLHAGVDISGINAEVMPSQWEFQVGPCEGIQMGDELWIARYLLQRVAEEFGVKVSFHPKPLKGEWNGAGCHTNVSTKSMRLPGGMKSIEVALSKLAKRHKEHMLLYGADNDQRLTGRHETASIEGFSSGVANRGASVRIPRSVAKEGYGYFEDRRPASNIDPYLVTGIMVETICGSIPDADMFKEYARESSD

SEQ ID NO: 2329 - DNA, 1218 bp, Hebeloma cylindrosporum
  CDS (71)..(1135)
acgcggggagtgcattccatttcttcaacaccaccaccaccaccaccacctccttctctttccctctcctatggcctaccgttatcacaacgaccttcttgctccttacctcgccctcccgcaaggtgacaagatccaggctgaatatgtctgggttgatggagatggcggtcttcgttcaaagaccaccaccgtgagcaagaaggttacggatattggtagtctccgcatctgggacttcgacggctcgtccaccaaccaagcccccggtcacgattccgatgtctacctccgaccagccgccatatttaaagatcctttccgcggcggagataacatcctcgttctcgccgagacctacaacagtgacggcaccccgaacaggaccaacttccgtcaccatgctgccaaggtcatggagcaggctaaggaagatgttccctggtttggcctcgaacaggaatacactctcttcgacgctgacggttcaccctacggttggcccaagggcggcttccctggtccccaaggaccctactactgtggtgctggtaccggcaaggtcttcgctcgtgatctcatcgaagcccactaccgagcttgtttatactccggtatcaacatcagtggtattaacgcagaggtcatgccctcgcaatgggagttccaagtcggcccttgtgagggtatctccatgggtgaccacctttggatggcccgctatctcctcgtccgaattgctgagcaatgggccgtcaaggtttccttccaccccaaacccctccagggcgactggaacggcgctggctgccataccaactacagcacgaaggctatgcgggaacccggaggcatgaaagtcatcgaagaggcgatcgagaagctgagcaaaaggcacgacgaacacattgccgtctacggagaggacaacgatctccggcttacgggtcgtcatgagaccggccatattggagctttcagctctggtgtcgctaaccgtggtgcttccattcgtgtgccccgacatgttgctgcccagggttacggttacctagaggacaggcgaccagcttccaacattgacccttaccgtgtcacgagtatcattgttgaaaccactcttctcaacgcttagagtgttgtcgttttctcgccgggtgttgtattttgctcggaataatcttactgtttacccgtgaagtggagtatggaaaaaaa

SEQ ID NO: 2330 - protein, 354 aa, Hebeloma cylindrosporum
MAYRYHNDLLAPYLALPQGDKIQAEYVWVDGDGGLRSKTTTVSKKVTDIGSLRIWDFDGSSTNQAPGHDSDVYLRPAAIFKDPFRGGDNILVLAETYNSDGTPNRTNFRHHAAKVMEQAKEDVPWFGLEQEYTLFDADGSPYGWPKGGFPGPQGPYYCGAGTGKVFARDLIEAHYRACLYSGINISGINAEVMPSQWEFQVGPCEGISMGDHLWMARYLLVRIAEQWAVKVSFHPKPLQGDWNGAGCHTNYSTKAMREPGGMKVIEEAIEKLSKRHDEHIAVYGEDNDLRLTGRHETGHIGAFSSGVANRGASIRVPRHVAAQGYGYLEDRRPASNIDPYRVTSIIVETTLLNA

SEQ ID NO: 2331 - DNA, 1119 bp, Kluyveromyces lactis
  CDS (1)..(1119)
atggctgctactagtgatattgtcgaaaagactcacattttacaaaaatatttggaattagaccaaagaggtgctatcatcgccgaatacgtttggattgattccgaaggtggtttgagatccaagggtagaaccttgaacaagaaggtcacatccgttgattctttgccagagtggaactttgatggttcttctaccggccaagctccaggtcatgactccgatatctacttgaagcctgttgccttctacccagatccatttagaagaggtgacaacattgttgttttggctgaatgttggaacaacgatggtactccaaataagttcaaccacagacatgaagctgctaagttgttcgaagctcacaaggatgctgagatgtggttcggtttggaacaagaatacactttgttcgaccaatacgatcaagtatatggctggccaaagggtggtttcccagctccacaaggtccatactactgtggtgttggtgccggtaaggtctttgctcgtgacgtcatcgaagctcattacagagcctgtttgtatgccggtgtgaacatctctggtatcaacgctgaagtcatgccatctcaatgggaattccaagtcggtccatgtgaaggtatcgccatggctgatcaattgtggatcgccagatacttcctgcatagagtagccgaagaattcggtgttaaggtttctctacatccaaagccattgaagggtgactggaacggtgctggttgtcacaccaacgtttctaccaagctaatgagagctccaggtggtatgaagtacatcgaagatgctatcgaaaagttgtccaagagacataacgaacacatcaagctatatggtgctgacaacgaacaaagattgactggtagacatgaaaccgcatccatgtccaccttctcttctggtgtcgccaaccgtggtgcttccattagaatcccaagatctgtcaacaaagagggatacggatatttcgaagacagaagacctgcctccaacattgacccttacttggttactggtatcatgtgtgaaactgtctgtggtgctattgaaaacgccaacatgactaaggaatacgaaagagaatctttataa

SEQ ID NO: 2332 - protein, 372 aa, Kluyveromyces lactis
MAATSDIVEKTHILQKYLELDQRGAIIAEYVWIDSEGGLRSKGRTLNKKVTSVDSLPEWNFDGSSTGQAPGHDSDIYLKPVAFYPDPFRRGDNIVVLAECWNNDGTPNKFNHRHEAAKLFEAHKDAEMWFGLEQEYTLFDQYDQVYGWPKGGFPAPQGPYYCGVGAGKVFARDVIEAHYRACLYAGVNISGINAEVMPSQWEFQVGPCEGIAMADQLWIARYFLHRVAEEFGVKVSLHPKPLKGDWNGAGCHTNVSTKLMRAPGGMKYIEDAIEKLSKRHNEHIKLYGADNEQRLTGRHETASMSTFSSGVANRGASIRIPRSVNKEGYGYFEDRRPASNIDPYLVTGIMCETVCGAIENANMTKEYERESL

SEQ ID NO: 2333 - DNA, 1429 bp, Lactuca sativa
  CDS (16)..(1092)
catcacttcgatctcatggctctgctttcggatctcgtcaacctcgacctctctagtatcaccgataagattatcgccgagtatatatggatcggcggatcgggtatggatcttagaagcaaagcaagaacactttcagggcctgtgtcggatcccagtgagcttccgaagtggaactacgatggctctagcacagggcaagctcccggagaagacagtgaagtcatcatataccctcaagcaatcttcaaagatccattcaggagaggcaaccatatcttggtgatgtgtgatgcttacactcccgccggcgaaccaatccccaccaacaagagggccgccgccgccaaaatcttcagcaacccagaagtcgaaaaggaggttacatggtacggaattgagcaagaatacaccttgttgcagaaggacaccaactggccattgggttggcctctaggtggtttccctggtccacagggcccatactactgtggaattggcgctgataaagcttttggacgtgatattgttgatgcacactacaaagcttgcctttacgctggcgtcaacattagcggcatcaatggcgaagttatgcctggacaatgggaatttcaagtaggaccttccgtaggcatagctgcagctgatcaaatctgggtcgctcgttacattcttgagaggatcactgagatttatggggtggtggtttcatttgaccccaagcctattccgggtgactggaatggagctggtgctcacacaaattacagtacaaaaaccatgagggaagagggaggatatgaggtgatcaagaaagctatcgagaagttgggattgaggcacaaggaacacattgctgcatatggtgaaggcaatgaacgtaggctcactggtcgacatgaaacagctgatatcaacacctttttatggggtgttgcaaaccgtggagcttctattcgtgttggaagagacacagagaaagaagggaaaggttactttgaggacagaaggccagcttcaaacatggatccatatgtcgtgacttccatgattgctgagactaccattctgtgggacaacaaatcttgaaaagagatcgaaaattatgaagcctgattgggagggagatttgaaaaaatgaaattagaattgggaacaaacaaaacaacccttcttgtttattttcttgaaaattagatattgttcttgtttgtttgtgttgcatgttgatcgttatggttattatggtaatggtagttttgtgtttcatgtttcttgtagcaaagcattttgagtccaaaatgcatgtaaagctactacttgatttgagatttctcccatggtgattcatgggaatattgtcgatattgtctatgataataacaaatatgaagggttgatttttatccaaaaaaaaaaaaaaaaa

SEQ ID NO: 2334 - protein, 358 aa, Lactuca sativa
MALLSDLVNLDLSSITDKIIAEYIWIGGSGMDLRSKARTLSGPVSDPSELPKWNYDGSSTGQAPGEDSEVIIYPQAIFKDPFRRGNHILVMCDAYTPAGEPIPTNKRAAAAKIFSNPEVEKEVTWYGIEQEYTLLQKDTNWPLGWPLGGFPGPQGPYYCGIGADKAFGRDIVDAHYKACLYAGVNISGINGEVMPGQWEFQVGPSVGIAAADQIWVARYILERITEIYGVVVSFDPKPIPGDWNGAGAHTNYSTKTMREEGGYEVIKKAIEKLGLRHKEHIAAYGEGNERRLTGRHETADINTFLWGVANRGASIRVGRDTEKEGKGYFEDRRPASNMDPYVVTSMIAETTILWDNKS

SEQ ID NO: 2335 - DNA, 1340 bp, Nicotiana plumbaginifolia
  CDS (16)..(1086)
gtcttctattttattatgtctcttctttcagatcttatcaacctcaatctctctgattctaccgagaaaatcatcgctgaatacatatggattggtggatcaggcatggacttaaggagcaaggccaggactctttctggtcctgttactgatcctgcaaaactacccaaatggaactatgatggatctagcacaggtcaagctcctggagaagatagtgaagtgatcttatacccacaagctatctttaaggatccattcagaagaggcaacaatatcttggtcatgtgtgatgcttatactcctgctggcgagcctatcccgacaaacaagaggcatgctgctgccaagatcttcagcaaccccgatgttgttgctgaggaaccctggtatggtattgagcaagaatacaccttgttgcaaagggatattaactggcctctgggctggcctattggaggcttccctggacctcagggaccatactactgtggaaccggagctgataaggcctttggacgtgatattgtggactcccattacaaggcttatctttatgctgggattaacatcagtggtatcaacggagaagtcatgcccggacagtgggaattccaagtcggaccttctgttggcatctcagccggtgatgaagtgtgggtagctcgttacattcttgagaggattgcggagatagctggagtggttgtgtcatttgaccccaagcctattccgggtgattggaacggtgcaggtgctcacacaaactacagcaccaagtcgatgagggaagatggaggctacgaagtcattttgaaggctattgagaagcttggcctgaagcacaaagagcacattgctgcatatggtgaaggcaatgagcgtcgtctcactggaaagcacgaaacagccaacatcagcaccttcaaatggggggttgccaaccgcggtgcatctgtccgtgtaggaagggacacagagaaggcgggcaagggatactttgaggacagaaggccggcttcaaatatggacccatacgtcgttactgccatgatcgcggacaccaccatcatcgggaaatcttgaagcttttagtatgaattgcttgtttctggtttgcacaatttgggatagaaaaggattgatttatgaaacagccctttcgcttcgccagtgtctttagttaggatagtctggtcttttcttatttcttcttttattccggttgaagttgtattttcatacagcaatgctgatttcattcgcctatgatttggtaatggtgttacaaacaaaacaatgttattcttattaataacaaattatgaaagggttggttc

SEQ ID NO: 2336 - protein, 356 aa, Nicotiana plumbaginifolia
MSLLSDLINLNLSDSTEKIIAEYIWIGGSGMDLRSKARTLSGPVTDPAKLPKWNYDGSSTGQAPGEDSEVILYPQAIFKDPFRRGNNILVMCDAYTPAGEPIPTNKRHAAAKIFSNPDVVAEEPWYGIEQEYTLLQRDINWPLGWPIGGFPGPQGPYYCGTGADKAFGRDIVDSHYKAYLYAGINISGINGEVMPGQWEFQVGPSVGISAGDEVWVARYILERIAEIAGVVVSFDPKPIPGDWNGAGAHTNYSTKSMREDGGYEVILKAIEKLGLKHKEHIAAYGEGNERRLTGKHETANISTFKWGVANRGASVRVGRDTEKAGKGYFEDRRPASNMDPYVVTAMIADTTIIGKS

SEQ ID NO: 2337 - DNA, 1423 bp, Pinus sylvestris
  CDS (34)..(1107)
ttcccttcctctggtttgttttggagagtggccatgtcgagcgtattaacagaccttctcaaccttgacctgagcgacgtgacagagaaggtcattgcagagtatatatggattggaggatcaggaatggatatgcgcagtaaagccagatctctgtcaggacctgtgagtagcgttaaagagcttcccaaatggaactatgacggctccagcactggacaggctcaaggacatgacagcgaagtcattctatatccacaagctatcttccgtgatccatttcgcagaggaaagcacattttggtaatctgtgatgcctactctcctaatgggactgctattccttccaacaagagggctgcagcagcgaaaatttttaacgaaaaggcggttagtgatgaagagacatggtacgggcttgaacaagaatatacactgttgcaaaaggacgtcaaatggcctcttggctggccaattggtggctaccccggtcctcagggcccatattactgtggagttggagctgacaaagcctggggacgagacattgttgatgcccattataaggcttgtctctattcaggaatcaatatcagtggcatcaatggagaagtcatgccagggcagtgggaatttcaagtaggtccgtcagtgggtatctcagcagcagatgagctgtggtgtgctcgttttattatggagaggattacagaaaaggcgggtgtcgttctgtcctttgatcccaagccaattgagggggactggaatggtgctggatgccacacaaattacagcaccaagtccatgcgcaaggagggaggcttcgaagtaattaagaaagcaatagaaaaactgaagttgaggcataaggagcatatttctgcctatggggagggaaatgagagacgcctcactggtcggcacgagacagcagacatgaataccttttcctggggtgttgcaaatcgaggagcttcagttagagtgggccgggacacagaaaaagaaggaaaaggttattttgaggaccgtcgacctgcttcaaacatggatccatacatagtgacttctatgattgctgagacgaccattctatggaaaccttaaattacaaagtggaggccagttacacgcgtggtcgtggtgctttgctttggaggccagcgtcactgataagctaatatgtatgtaaatgtgatgccaatgtttaagtaggttggtaactttgctttggttgtgggtagacctgaactttggtcaaacaatttcctcttgctatatggatatatatatatttttgtatttgttctacttgtaatatggcgagggctttaaaagactctcttttacctttatttattccgttgtggaagatgtattcgacaaattgtttagaatgtttgaatatgatatattctttgtg

SEQ ID NO: 2338 - protein, 357 aa, Pinus sylvestris
MSSVLTDLLNLDLSDVTEKVIAEYIWIGGSGMDMRSKARSLSGPVSSVKELPKWNYDGSSTGQAQGHDSEVILYPQAIFRDPFRRGKHILVICDAYSPNGTAIPSNKRAAAAKIFNEKAVSDEETWYGLEQEYTLLQKDVKWPLGWPIGGYPGPQGPYYCGVGADKAWGRDIVDAHYKACLYSGINISGINGEVMPGQWEFQVGPSVGISAADELWCARFIMERITEKAGVVLSFDPKPIEGDWNGAGCHTNYSTKSMRKEGGFEVIKKAIEKLKLRHKEHISAYGEGNERRLTGRHETADMNTFSWGVANRGASVRVGRDTEKEGKGYFEDRRPASNMDPYIVTSMIAETTILWKP

SEQ ID NO: 2339 - DNA, 1080 bp, Schizosaccharomyces pombe
  CDS (1)..(1080)
atgtctcaatacgacgttgaacctcttctctccaaggctgctattttaaacaagtatgccgatcttcctcaaaatggtaaggttatggctgagtacatctggatcgatggtttcaaccatcttcgtagcaagaccatgactctcgatgccaagccttcctctattgaccaattgcgcgtttggaactttgacggctcttccaccggtcaggcccccggcaacaattctgacactcttttgaagcctgttgccatgtacaatgatcccttccgtcgcggtgacaacattctcgttctcgctgcttgctacaccgctgatggctctcccaacggcttcaaccatcgtgacgcttgcgccaagttgttggagaagcacgctgacaaagaaacttggtttggtattgaacaagaatataccatgttggactactatgaccgtccctttggctggcctaagggtggtttccctggtcctcaaggtcctttctactgcggtgttggtactggccgcgtctttgctcgtgacatcgttgaggcccattacaaggcttgtctttacgctggtatcaacatttccggtatcaatgctgaggttatgccttcccaatgggaataccaagtcggcccttgcgctggtattgaaatgggtgaccaactctggatgtctcgtttccttcttcaccgcattgccgaagattttggtgtcaaaatctccttccaccccaagccaattttgggtgactggaatggtgctggttgccacactaacgtttctactaaggacactcgtgctgaaggtggtataaaagctattgagtcttatctcgagaagtttgccaaacgccataaggagcacattgctgtttatggtgacgacaacgacttgcgtcttaccggtcgtcatgaaactggttcaatcgataagttcacttatggtgttgccgatcgtggtgcatccgttcgtatcccccgttctgtcgccatgaatggttgcggctactttgaggatcgtcgtcctgcttcttccatcgatccttacctcgtcactggtatcatcactgagaccatgtttgagcattag

SEQ ID NO: 2340 - protein, 359 aa, Schizosaccharomyces pombe
MSQYDVEPLLSKAAILNKYADLPQNGKVMAEYIWIDGFNHLRSKTMTLDAKPSSIDQLRVWNFDGSSTGQAPGNNSDTLLKPVAMYNDPFRRGDNILVLAACYTADGSPNGFNHRDACAKLLEKHADKETWFGIEQEYTMLDYYDRPFGWPKGGFPGPQGPFYCGVGTGRVFARDIVEAHYKACLYAGINISGINAEVMPSQWEYQVGPCAGIEMGDQLWMSRFLLHRIAEDFGVKISFHPKPILGDWNGAGCHTNVSTKDTRAEGGIKAIESYLEKFAKRHKEHIAVYGDDNDLRLTGRHETGSIDKFTYGVADRGASVRIPRSVAMNGCGYFEDRRPASSIDPYLVTGIITETMFEH

SEQ ID NO: 2341 - DNA, 1300 bp, Tuber borchii
  CDS (45)..(1121)
tttactcaacacaacttgttttttagaccaaatagtcaatcacgatgagcgaaaactctactatcgtctccaatacggcgaatctcgtcaaatttctcaacctagatcagaaagggtcgattttggcggagtatatctggattgacggtgcgaacggcgtcagatctaagaccaagactctcttcaagaagccatcctctgtcgaagacttgcctgaatggaactttgacggttcctccactggtcaagctcctggtgaggattcggacatctatctccgtcctgtcgccatatttccagatccgttcagaatgggtgacaacattcttgtgttggctgagtgctggaatgcggacgggtctcctaacaagtttaatcatcggcacgaatgtgctaagattatggaggcccacaaggatcagaagccttggtttggattggagcaagagtatactctcttcgatctttatgggaacccgtacgggtggcccaagggaggtttcccaggccctcaggggccatactactgtggtgtcggaactggcaaggtttattgtcgcgacattgtcgaggcacattacaaggcctgcttgtttgccggaatcaagatctccggaatcaacgccgaggttcttccctcccaatgggagttccaagtcggtccgtgtgtcggtatcgagatgggcgaccatctctggatttccagataccttctgcaccgtgttgccgaagaatttggggttaagatttcgttccaccccaagcccatccctggtgattggaatggctccggtctccataccaacgtgtcgacccaagctatgcgcgatgagggaggcatgaaggctattgaggaggccatccagaagctttcaacccgccatgctgagcacatcgccgtctacggcgatgacaacaccctccgtctcactggcagacatgaaactggaaacattgatgccttctcctatggtgtcgcggacagaggatcttctattagaatccctaggtcttgcgcaaaggaagggaaggggtactttgaagataggcgccctgcatctaatgcttgtccataccagattacgggcatcatgatggagacgatttgtggtggtatttagattatgggtttcctttcctggcggagtttgtttctcttgggttgttttgtattttttccttctttcgtctttttattttagacacgaacgttagcgagaccccatcgaatgaaaagggttcacggaagtctaactattaatgcaaaaatgaaattatggttaaaaaaaaaaaaaaaaaa

SEQ ID NO: 2342 - protein, 358 aa, Tuber borchii
MSENSTIVSNTANLVKFLNLDQKGSILAEYIWIDGANGVRSKTKTLFKKPSSVEDLPEWNFDGSSTGQAPGEDSDIYLRPVAIFPDPFRMGDNILVLAECWNADGSPNKFNHRHECAKIMEAHKDQKPWFGLEQEYTLFDLYGNPYGWPKGGFPGPQGPYYCGVGTGKVYCRDIVEAHYKACLFAGIKISGINAEVLPSQWEFQVGPCVGIEMGDHLWISRYLLHRVAEEFGVKISFHPKPIPGDWNGSGLHTNVSTQAMRDEGGMKAIEEAIQKLSTRHAEHIAVYGDDNTLRLTGRHETGNIDAFSYGVADRGSSIRIPRSCAKEGKGYFEDRRPASNACPYQITGIMMETICGGI

SEQ ID NO: 2343 - DNA, 1407 bp, Vigna aconitifolia
  CDS (78)..(1148)
attcagaaaaaggagaaagagagatctttttgtgctgtgaagaagggtctttccttgtttcttcgtgtcttacttacatgtcgctgctatcagatctcatcaacctcaacctctccgacaccaccgagaagatcatcgcagagtacatatggatcggtggatcaggactggacctaaggagcaaagcaaggactctcccaggaccagttagcgacccttcaaagctgcctaagtggaactatgacggctccagcactggtcaagcccctggagaagacagtgaagtgattatatacccacaagctattttcaaggatccattcagaaggggtaacaatatcttggttatgtgtgatgcttacactccagctggagaacccattcccactaacaagaggcacaatgctgccaagatattcagccatcctgatgttgttgccgaagagccctggtacggtatcgagcaggaatacaccttgttgcagaaggatgtcaactggccacttgggtggcctgttggcggtttccctggacctcagggaccttactactgtggtgctggtgctgataaggcttttgggcgtgacattgttgacgcacattacaaagcctgtctttatgctggcatcaacatcagtggaattaatggagaggttatgccgggtcagtgggaattccaagttggacctgcggttgggatatcagctggtgacgagttgtgggtagctcgttacatcttggagaggatcactgagattgctggtgtggtgctttcctttgaccctaagccaatcaagggtgattggaatggtgccggtgctcacaccaactacagcacgaagacaatgagaaacgatggtggctatgaagtaattaaatcagcaattgaaaaattggggaagaggcacaaggagcatatcgctgcttatggagaaggcaatgaacgccgtctgacaggacgacacgaaactgcagacatcaacaccttcttatggggagttgcaaaccgtggagcttctattagagttgggagggacacggagaaagcagggaagggatactttgaggacagaaggccagcttctaacatggacccgtatgttgttacttccatgattgcagacacaaccattctgtggaagccatgagcaacaacacctgcactttgtctctttctttggggatgggaggaaagggaacattaagtagggatttgctcctttatttcatacctcttactttttaggatttggatttctggtaattgttgtggttcgcttgcttggggccttgctggttggtacaaccaactaccaaggattcttcattgccttccatttctttcccatgttttccgattgttataataatatcattaataatcatatatatatgaaacgtatcctc

SEQ ID NO: 2344 - protein, 356 aa, Vigna aconitifolia
MSLLSDLINLNLSDTTEKIIAEYIWIGGSGLDLRSKARTLPGPVSDPSKLPKWNYDGSSTGQAPGEDSEVIIYPQAIFKDPFRRGNNILVMCDAYTPAGEPIPTNKRHNAAKIFSHPDVVAEEPWYGIEQEYTLLQKDVNWPLGWPVGGFPGPQGPYYCGAGADKAFGRDIVDAHYKACLYAGINISGINGEVMPGQWEFQVGPAVGISAGDELWVARYILERITEIAGVVLSFDPKPIKGDWNGAGAHTNYSTKTMRNDGGYEVIKSAIEKLGKRHKEHIAAYGEGNERRLTGRHETADINTFLWGVANRGASIRVGRDTEKAGKGYFEDRRPASNMDPYVVTSMIADTTILWKP

SEQ ID NO: 2345 - DNA, 1095 bp, Yarrowia lipolytica
  CDS (1)..(1095)
atggttttgtcaaaatacctggacctcccccagcacggagctgtcctggccgagtacatctggatcgatgcccatttcaacatccgatccaagtgcaagactctagacaagaagcccacttccatcgaagacctccccgagtggaactttgacggctcctccacagatcaggctcccggccacgactcggatatctatctccgacccgccgccatctaccccgatcctttccgacgaggcgacaacattattgttctggccgagtgctggaacaacgacggaacccccaacaagttcaaccaccgacacgagtgcgccaagctcatgagcgcccacgagaaggaggtcatctggttcggaatcgagcaggagtacaccatgttcgacgagagcgataaccccgtcggatggcctaagggcggtttccccgctccccagggcccctactactgtggtgtcggaaccggcaaggtctttgctcgagacgttgttgaggcccactaccgagcctgtctctactccggaatcaacatctccggtatcaacgccgaggtcatgccttcccagtgggagtaccaggttggtccctgcgagggtatctccatggccgatgagctgtggatgtcccgatacctgctgcaccgagttgccgaggagtttggcatcaagatctccttccaccccaagcccctgcagggagactggaacggagccggctgtcacaccaacgtgtccaccaagtcgatgcgagagcccggtggaatgaagcacattgaggctgccatcgagaagcttgctgcccgacacaaggagcacattgccgtctacggcgaggacaacgacatgcgactcaccggccgacacgagaccggctccatcggctctttctcttccggagttgccaaccgaggctgctccatccgaattcctcgatctgtggccaaggagggctacggctactttgaggaccgacgacccgcctccaacattgacccctaccttgttaccggtatcatgaccgagaccatctgtggctccattcctgatgccgacatggttgaggagaccaagcgaggtgaggaggagggcttttaa

SEQ ID NO: 2346 - protein, 364 aa, Yarrowia lipolytica
MVLSKYLDLPQHGAVLAEYIWIDAHFNIRSKCKTLDKKPTSIEDLPEWNFDGSSTDQAPGHDSDIYLRPAAIYPDPFRRGDNIIVLAECWNNDGTPNKFNHRHECAKLMSAHEKEVIWFGIEQEYTMFDESDNPVGWPKGGFPAPQGPYYCGVGTGKVFARDVVEAHYRACLYSGINISGINAEVMPSQWEYQVGPCEGISMADELWMSRYLLHRVAEEFGIKISFHPKPLQGDWNGAGCHTNVSTKSMREPGGMKHIEAAIEKLAARHKEHIAVYGEDNDMRLTGRHETGSIGSFSSGVANRGCSIRIPRSVAKEGYGYFEDRRPASNIDPYLVTGIMTETICGSIPDADMVEETKRGEEEGF

SEQ ID NO: 2347 - DNA, 1071 bp, Brassica napus
  CDS (1)..(1071)
atgagtcttcttacagatctcgttaaccttaacctctcagagaccactgacaaaatcattgcggaatacatatgggttggaggttcaggaatggatatgagaagcaaagccaggactcttcctggaccagtgagtgacccttcggagctaccaaagtggaactatgatggctcaagcacaggccaagctcctggtgaagacagtgaagtcatcttataccctcaagccatattcaaagatcctttccgtagaggcaacaacattcttgtcatgtgcgatgcttacactccagcgggcgaaccaatcccaacaaacaaaagacacgctgcggctaaggtctttagccaccctgatgttgtagctgaagtgccatggtatggtattgagcaagagtacactttacttcagaaagatgtgaagtggcctgttggttggcctattggtggcttccccggtcctcagggaccatactattgtagtgttggagcagataaatcttttggtagagacattgttgatgctcattacaaggcctgcttatacgctggcatcaccattagtggcatcaatggagaagtcatgccgggtcagtgggagttccaagttggtccagctgttggtatctcggccggtgatgaaatttgggtcgcacgttacattttggagaggatcacagaggttgctggtgtggtggtatcttttgacccaaaacctattcccggtgactggaatggtgctggtgctcactgcaactatagtaccaagtcaatgagggaagatggtggttacgagattatcaagaaggcaatcgataaactgggaatgagacacaaggaacacattgctgcttatggtgaaggcaatgagcgtcgtctcacgggtcatcacgagactgctgacatcaacactttcctctggggtgttgcgaatcgtggagcatcaatccgtgtaggacgcgacacagagaaagaagggaaaggatactttgaggataggaggccagcttcgaacatggatccttacattgtgacttccatgattgcagagaccacaatcctctggaaaccttga

SEQ ID NO: 2348 - protein, 356 aa, Brassica napus
MSLLTDLVNLNLSETTDKIIAEYIWVGGSGMDMRSKARTLPGPVSDPSELPKWNYDGSSTGQAPGEDSEVILYPQAIFKDPFRRGNNILVMCDAYTPAGEPIPTNKRHAAAKVFSHPDVVAEVPWYGIEQEYTLLQKDVKWPVGWPIGGFPGPQGPYYCSVGADKSFGRDIVDAHYKACLYAGITISGINGEVMPGQWEFQVGPAVGISAGDEIWVARYILERITEVAGVVVSFDPKPIPGDWNGAGAHCNYSTKSMREDGGYEIIKKAIDKLGMRHKEHIAAYGEGNERRLTGHHETADINTFLWGVANRGASIRVGRDTEKEGKGYFEDRRPASNMDPYIVTSMIAETTILWKP

SEQ ID NO: 2349 - DNA, 1065 bp, Brassica napus
  CDS (1)..(1065)
atgtctctcctctcagatctcgtcaacctcaacctctctgactccaccgagaaaatcatagccgaatacatatggatcggtggatctggaatggacatcagaagcaaagccagaacactcccaggaccagtgagcgatccatcaaagcttcctaagtggaactacgacggatccagcaccggtcaagccgccggagatgacagtgaagtcattctataccctcaggcgatattccgtgatccgttcaggaaaggcaacaacattctggtgatgtgtgatgcttacacgccggcagggaatccaattccgaccaacaagaggcacaacgctgctaagatcttcagcaaccccaaagttgcctctgaggagccttggtatgggattgaacaagaatacacattgatgcaaaagggtgtgaactggcccattggttggcctatcggtggcttccctggcccacagggaccatactactgtggtgtgggagctgacaaagccattggtcgtgacatcgtggatgcgcactacaaggcctgtatttacgcaggtattggcatctctggtgtcaatggagaagtcatgcctggccagtgggagttccaagtcggtcctgttgagggtattagtgctggtgaccaagtctgggtcgctagataccttcttgagaggatcaccgagatctctggtgtcaatgtcagcttcgaccctaagccagtcccgggtgattggaacggagctggagctcactgcaactacagcacgaagtcgatgaggaacgacggaggattagctgtgattaagaaagccatagagaagcttcaggtgaagcacaaggagcacattgctgcttacggtgaaggcaacgagcgtcgcctcacggggaagcacgagaccgcggacatcaacacgttctcttggggagtggcgaaccgtggagcttcggtgagagtgggacgtgacactgagaaagaaggcaaaggttacttcgaggacagaaggccagcttctaacatggatccttacgttgttacttccatgattgctgaaaccaccatcctcggttaa

SEQ ID NO: 2350 - protein, 354 aa, Brassica napus
MSLLSDLVNLNLSDSTEKIIAEYIWIGGSGMDIRSKARTLPGPVSDPSKLPKWNYDGSSTGQAAGDDSEVILYPQAIFRDPFRKGNNILVMCDAYTPAGNPIPTNKRHNAAKIFSNPKVASEEPWYGIEQEYTLMQKGVNWPIGWPIGGFPGPQGPYYCGVGADKAIGRDIVDAHYKACIYAGIGISGVNGEVMPGQWEFQVGPVEGISAGDQVWVARYLLERITEISGVNVSFDPKPVPGDWNGAGAHCNYSTKSMRNDGGLAVIKKAIEKLQVKHKEHIAAYGEGNERRLTGKHETADINTFSWGVANRGASVRVGRDTEKEGKGYFEDRRPASNMDPYVVTSMIAETTILG

SEQ ID NO: 2351 - DNA, 1071 bp, Glycine max
  CDS (1)..(1071)
atgtctttactttcagacctcatcaacctcaatctctcagaatccacagaaaagatcattgctgagtacatatgggttggtggatctggtatggacctcagaagcaaagccaggactcttcctgggccagtgagtgaccctgcaaaacttccgaagtggaactatgatgggtctagcacagatcaagctccaggggatgacagtgaagtcattttatacccacaagctattttcaaggacccctttaggagaggaaacaatattcttgtcatttgtgatgtgtacaccccagctggtgagccacttccaaccaacaacaggtatggtgctgccaaaattttcagtcaccctgatgttgctgctgaggaaccatggtatggtattgagcaagagtataccttattgcagaaagatgtaaattggccacttgggtggccacttggcgggtttcctggaccacagggcccatactactgtggaattggtgctgataaagcctatggccgtgatattgtagatgcacattacaaagcttgtatttatgctggcattaacattagtggcatcaatggagaggttatgcctggccagtgggaatttcaagttggtccttctgttggtatctctgctggagatgaggtgtgggctgctcgctacattttggagaggattacagagatagctggagcaattgtttcatttgatcccaagcctattccgggagattggaatggagctggagctcactcaaactacagcaccaagtccatgagagaagagggtggttatgaggtgatcaagaaggccattgaaaagcttggattgaggcacaaggagcacatcgcagcatatggagaaggcaacgagagacgtctcacgggaagacatgaaactgcagacatcaacaccttctcttggggtgtggcaaaccgtggaagctccattagagttggaagagacacagagaaaaatggcaaaggttacttcgaggacagaaggcctgcttctaatatggatccctatgtagtcacctccatgatcgcagagactaccatcctctggaaaccatga

SEQ ID NO: 2352 - protein, 356 aa, Glycine max
MSLLSDLINLNLSESTEKIIAEYIWVGGSGMDLRSKARTLPGPVSDPAKLPKWNYDGSSTDQAPGDDSEVILYPQAIFKDPFRRGNNILVICDVYTPAGEPLPTNNRYGAAKIFSHPDVAAEEPWYGIEQEYTLLQKDVNWPLGWPLGGFPGPQGPYYCGIGADKAYGRDIVDAHYKACIYAGINISGINGEVMPGQWEFQVGPSVGISAGDEVWAARYILERITEIAGAIVSFDPKPIPGDWNGAGAHSNYSTKSMREEGGYEVIKKAIEKLGLRHKEHIAAYGEGNERRLTGRHETADINTFSWGVANRGSSIRVGRDTEKNGKGYFEDRRPASNMDPYVVTSMIAETTILWKP

SEQ ID NO: 2353 - DNA, 1065 bp, Triticum aestivum
  CDS (1)..(1065)
atggccagcctcgccgacctcgtcaacctcgacctcagcgactgcaccgacaagatcatcgtcgagtacctctggattggaggatccggtatcgacatcaggagcaaagcaaggacggtgaacggccccatcacggacgcgagccagctgcccaagtggaactacgacggctccagcaccggccaggctcccggagaggacagcgaagtcatcctctacccccaggccattttcaaggacccgttcaggaggggcgacaacctccttgttatgtgtgactgctacacaccacaaggtgtgccaatccccaccaacaagaggcacaatgccgccaagatcttcaacacccccaaggttgcagctgaggagacatggtatggaattgagcaggagtacactctcctccagaaggacgtgaactggcctcttggctggcccattggtggctaccctggtcctcagggaccatactactgcgccgccggcgccgacaaggcgttcgggcgtgacatcgtggacgcccactacaaggcgtgcctctacgccgggatcaacatcagcggcatcaacggggaggtcatgcccggccagtgggagttccaagtcgggccgtccgtcgggatcgccgcctcagaccagctgtgggtggcgcgctacatcctcgagaggatcacggaggttgccggggtggtgctgtccctggacccgaagccgatcccgggcgactggaacggcgccggcgcgcacaccaactacagcaccaagtcgatgcgggaggccggcgggtacggcgtgatcaagacggccatcgagaagctgggcaagcggcacgcgcagcacatcgccgcctacggcgagggcaacgagcgccgcctcacgggccaccacgagaccgccgacatcaacaccttcaagtggggcgtggcggaccgcggcgcgtccatccgcgtgggccgcgacacggagaaggacggcaagggctacttcgaggaccgcaggccggcctccaacatggacccctacgtcgtcacctccatgatcgccgagaccaccctcctcctctga

SEQ ID NO: 2354 - protein, 354 aa, Triticum aestivum
MASLADLVNLDLSDCTDKIIVEYLWIGGSGIDIRSKARTVNGPITDASQLPKWNYDGSSTGQAPGEDSEVILYPQAIFKDPFRRGDNLLVMCDCYTPQGVPIPTNKRHNAAKIFNTPKVAAEETWYGIEQEYTLLQKDVNWPLGWPIGGYPGPQGPYYCAAGADKAFGRDIVDAHYKACLYAGINISGINGEVMPGQWEFQVGPSVGIAASDQLWVARYILERITEVAGVVLSLDPKPIPGDWNGAGAHTNYSTKSMREAGGYGVIKTAIEKLGKRHAQHIAAYGEGNERRLTGHHETADINTFKWGVADRGASIRVGRDTEKDGKGYFEDRRPASNMDPYVVTSMIAETTLLL

SEQ ID NO: 2355 - DNA, 1284 bp, Triticum aestivum
  CDS (1)..(1284)
atggcgcaggcggtggtgccggcgatgcagtgccaggtgggcgtgcggggcaggtcggccgtcccggcgaggcagcccgcgggcagggtgtggggcgtcaggaggaccgcccgcgccgcctccggcttcaaggtgctcgccctcggcccggagaccaccggcgtcatccagaggatgcagcagctactcgacatggacaccacgcccttcaccgacaagatcatcgccgagtacatctgggttggaggatctggaattgacctcagaagcaaatcaaggacgatttcgaagccagtggaggacccgtcagagctaccgaaatggaactacgatggatcgagcacaggccaggctcctggagaagacagtgaagtcatcctatacccacaggccatattcaaggacccattccgaggaggcaacaacatactggttatctgtgacacctacacaccacaaggggaacccatccctactaacaaacgacacatggctgcacaaatcttcagtgaccccaaggtcacttcacaagtgccatggtttggaatcgaacaggagtacactctgatgcagagggatgtgaactggcctcttggctggcctgttggagggtaccctggcccccagggtccatactactgcgccgtaggatcagacaagtcatttggccgtgacatttcagatgctcactacaaggcatgcctttacgccggaattgaaatcagtggaacaaacggggaggtcatgcctggtcagtgggagtaccaggttggacccagcgttggtattgatgcaggagatcacatatgggcttcaagatacattctcgagagaatcacggagcaagctggtgtcgtgctcacccttgacccaaaaccaatccagggtgactggaatggagctggctgccacacaaattacagcacattgagcatgcgtgaggatggaggtttcgacgtgatcaagaaggcaatcctgaacctttcacttcgccatgacttgcacatagccgcatatggtgaaggaaacgaacggaggttgacagggctacatgagacagctagcatatcagacttctcatggggtgtcgcgaatcgtggctgctctattcgtgtggggcgagagactgaggcaaagggcaaaggatacctggaggaccgtcgcccggcctcgaacatggacccatacaccgtgacggcgctgctggccgagaccacgatcctgtgggagccgaccctcgaggcagaggccctcgctgccaagaagctggcgctgaaggtatga

SEQ ID NO: 2356 - protein, 427 aa, Triticum aestivum
MAQAVVPAMQCQVGVRGRSAVPARQPAGRVWGVRRTARAASGFKVLALGPETTGVIQRMQQLLDMDTTPFTDKIIAEYIWVGGSGIDLRSKSRTISKPVEDPSELPKWNYDGSSTGQAPGEDSEVILYPQAIFKDPFRGGNNILVICDTYTPQGEPIPTNKRHMAAQIFSDPKVTSQVPWFGIEQEYTLMQRDVNWPLGWPVGGYPGPQGPYYCAVGSDKSFGRDISDAHYKACLYAGIEISGTNGEVMPGQWEYQVGPSVGIDAGDHIWASRYILERITEQAGVVLTLDPKPIQGDWNGAGCHTNYSTLSMREDGGFDVIKKAILNLSLRHDLHIAAYGEGNERRLTGLHETASISDFSWGVANRGCSIRVGRETEAKGKGYLEDRRPASNMDPYTVTALLAETTILWEPTLEAEALAAKKLALKV

SEQ ID NO: 2357 - DNA, 1110 bp, Linum usitatissimum
  CDS (1)..(1110)
atgtcgtccagtaatcttctctccgatctcatcaacctcaaccttcccgaggacaaggttattgcagagtacatatgggttggcgggtctgggatggatatccggagcaaagccaggacactgtctggagccgtgaccgacccttcaaagctacccaagtggacgtacgatggttccagcactggccaagctgcaggggatgacagcgaagtcctactatttccacaggcaattttcaaggacccattcaggaggggaaacaacatcctggtgatgtgcgatgcttacactcccgccggagacccaattcagaccaacaagagatttccggcagcgaagatattgagccgtcctgaagtggaagctgaggagccatggtttggcatagagcaggaatacactctgcttcagaaacacgtcgattggcctctcggctggcccatcggtggttaccctgcccctcaggggaaatactactgcggtgtgggggctgacaaggcgtacggaagggatatagtggaagcacatttcaaagcttgcctttatgcggggatcaatatcagtggcatcaatggcgaagtcatgcctggccagtgggaattccaaatagggccttcagttggcatttcagcagcagatgagctatgggtggctcgctatatcctccagaggattggggagattgatggagtggtggtttcattcgatccaaagcctgttcaggggaattggaatggagctggtgcacacacaaattacagcaccaagtcgatgaggaaggagggaggatacgagaaggtgatgaaggaagcaatagagaagctgagaatgaggcatgaagaacatgtggcatcatacggggaagggaacgtacgtaggctaacaggaagccacgagacagcggacataaacagcttctcgtggggagtggggacacgaggagcgtcgatacgagtggggaagaagacggagaaggaagggaaaggatatttagaagatagaaggccgtcttctaacatggacccttacctcgtcatttccatgatcgctggaactactcttctctgggaaccacctcttactactcctccccctccatcatcttcttaa

SEQ ID NO: 2358 - protein, 369 aa, Linum usitatissimum
MSSSNLLSDLINLNLPEDKVIAEYIWVGGSGMDIRSKARTLSGAVTDPSKLPKWTYDGSSTGQAAGDDSEVLLFPQAIFKDPFRRGNNILVMCDAYTPAGDPIQTNKRFPAAKILSRPEVEAEEPWFGIEQEYTLLQKHVDWPLGWPIGGYPAPQGKYYCGVGADKAYGRDIVEAHFKACLYAGINISGINGEVMPGQWEFQIGPSVGISAADELWVARYILQRIGEIDGVVVSFDPKPVQGNWNGAGAHTNYSTKSMRKEGGYEKVMKEAIEKLRMRHEEHVASYGEGNVRRLTGSHETADINSFSWGVGTRGASIRVGKKTEKEGKGYLEDRRPSSNMDPYLVISMIAGTTLLWEPPLTTPPPPSSS

SEQ ID NO: 2359 - DNA, 1272 bp, Zea mays
  CDS (1)..(1272)
atggcgcaggcggtggtgccggcgatgcagtgccgggtcggagtgaaggcggcggcggggagggtgtggagcgccggcaggactaggaccggccgcggcggcgcctcgccggggttcaaggtcatggccgtcagcacgggcagcaccggggtggtgccgcgcctcgagcagctgctcaacatggacaccacgccctacaccgacaaggtcatcgccgagtacatctgggtcggaggatctggaatcgacatccgaagcaaatcaaggacgatttcgaaacccgtggaggatccctcggaactaccaaaatggaactacgatggatctagcacaggacaagccccgggagaagacagtgaagtcattctatacccccaggctatcttcaaggacccattccgaggtggcaacaacgttttggttatctgtgacacctacacgccacaggaggaaccccttccaactaacaaacgccacagggctgcgcaaattttcagtgacccaaaggtcgctgaacaagtgccatggtttggcatagagcaagagtacactttgctccagaaagatgtaaattggcctcttggttggcctgttggaggcttccctggtccccagggtccatactactgtgccgtaggagccgacaaatcatttggccgtgacatatcagatgctcactacaaggcatgcctctacgctggaatcaacattagtggaacaaacggggaggtcatgcctggtcagtgggagtaccaagttggacctagtgttggtattgaagcaggagatcacatatggatttcgagatacattctcgagagaatcacagagcaagctggggttgtccttacccttgatccaaaaccaattcagggtgactggaacggagctggctgccacacaaattacagcacaaagaccatgcgcgaagacggcgggtttgaagagatcaagagagcaatcctgaacctttctctgcgccatgatctgcatattagtgcatacggagaaggaaatgaaagaagactgactgggaaacatgagactgcgagcatcggaacgttctcatggggtgtggcaaaccgcggctgctctatccgtgtggggcgggataccgaggcaaaagggaaaggttacctggaagaccgtcggccggcatcaaacatggacccgtacattgtgacggggctactggccgagaccacgatcctctggcagccatccctcgaggcggaggctcttgccgccaagaagctggcgctgaaggtgtga

SEQ ID NO: 2360 - protein, 423 aa, Zea mays
MAQAVVPAMQCRVGVKAAAGRVWSAGRTRTGRGGASPGFKVMAVSTGSTGVVPRLEQLLNMDTTPYTDKVIAEYIWVGGSGIDIRSKSRTISKPVEDPSELPKWNYDGSSTGQAPGEDSEVILYPQAIFKDPFRGGNNVLVICDTYTPQEEPLPTNKRHRAAQIFSDPKVAEQVPWFGIEQEYTLLQKDVNWPLGWPVGGFPGPQGPYYCAVGADKSFGRDISDAHYKACLYAGINISGTNGEVMPGQWEYQVGPSVGIEAGDHIWISRYILERITEQAGVVLTLDPKPIQGDWNGAGCHTNYSTKTMREDGGFEEIKRAILNLSLRHDLHISAYGEGNERRLTGKHETASIGTFSWGVANRGCSIRVGRDTEAKGKGYLEDRRPASNMDPYIVTGLLAETTILWQPSLEAEALAAKKLALKV

SEQ ID NO: 2361 - DNA, 1071 bp, Zea mays
  CDS (1)..(1071)
atggcctgcctcaccgacctcgtcaacctcaacctctcggacaccacagagaagatcatcgccgagtacatatggatcggtggatctggcatggatctcaggagcaaagccaggaccctcccgggcccggtaaccgatcccagcaagctgcccaagtggaactacgacggctccagcaccggccaggcccccggcgaggacagcgaggtcatcctgtacccgcaggccatcttcaaggacccattcaggaggggcaacaacatccttgtcatgtgcgattgctacaccccagctggcgagccaattcccaccaacaagaggtacagcgccgccaagatcttcagcagccctgaggtcgctgccgaggagccctggtatggtatcgagcaggagtacaccctccttcagaaggacaccaactggcccctcgggtggcctattggcggcttccctggccctcagggtccttactactgtggaatcggcgcggagaaatcgttcgggcgtgacatagtcgacgcccactacaaggcatgcctgtacgcaggcatcaacatcagtggcatcaacggggaggtcatgccggggcagtgggagttccaggtcggaccgtccgtcggcatctcttcgggcgatcaggtgtgggttgctcgctacattcttgagaggatcaccgagatcgccggcgtggtggtgacgttcgacccgaagccgatcccgggcgactggaacggcgcgggcgcccacaccaactacagcaccgagtccatgaggaaggagggcgggtacgaggtgatcaaggcggccatcgagaagctgaagctgcggcacaaggagcacatcgcggcctacggcgagggcaacgagcgccggctcaccggcaggcacgagaccgccgacatcaacaccttcagctggggagtcgccaaccgtggcgcgtcggtgcgcgtgggtcgcgagacggagcagaacggcaagggctacttcgaggaccgccggccggcgtccaacatggatccctacgtggtcacctccatgatcgccgagaccaccatcgtctggaagccctga

SEQ ID NO: 2362 - protein, 356 aa, Zea mays
MACLTDLVNLNLSDTTEKIIAEYIWIGGSGMDLRSKARTLPGPVTDPSKLPKWNYDGSSTGQAPGEDSEVILYPQAIFKDPFRRGNNILVMCDCYTPAGEPIPTNKRYSAAKIFSSPEVAAEEPWYGIEQEYTLLQKDTNWPLGWPIGGFPGPQGPYYCGIGAEKSFGRDIVDAHYKACLYAGINISGINGEVMPGQWEFQVGPSVGISSGDQVWVARYILERITEIAGVVVTFDPKPIPGDWNGAGAHTNYSTESMRKEGGYEVIKAAIEKLKLRHKEHIAAYGEGNERRLTGRHETADINTFSWGVANRGASVRVGRETEQNGKGYFEDRRPASNMDPYVVTSMIAETTIVWKP

SEQ ID NO: 2363 - DNA, 1071 bp, Brassica napus
  CDS (1)..(1071)
atgagtcttcttacagatctcgttaaccttaacctctcagagaccactgacaaaatcattgcggaatacatatgggttggaggttcaggaatggatatgagaagcaaagccaggactcttcctggaccagtgagtgacccttcggagctaccaaagtggaactatgatggctcaagcacaggccaagctcctggtgaagacagtgaagtcatcttataccctcaagccatattcaaagatcctttccgtagaggcaacaacattcttgtcatgtgcgatgcttacactccagcgggcgaaccaatcccaacaaacaaaagacacgctgcggctaaggtctttagccaccctgatgttgtagctgaagtgccatggtatggtattgagcaagagtacactttacttcagaaagatgtgaagtggcctcttggttggcctattggtggcttccccggtcctcagggaccatactattgtagtgttggagcagataaatcttttggtagagacattgttgatgctcattacaaggcctgcttatacgctggcatcaccattagtggcatcaatggagaagtcatgccgggtcagtgggagttccaagttggtccagctgttggtatctcggccggtgatgaaatttgggtcgcacgttacattttggagaggatcacagaggttgctggtgtggtggtatcttttgacccaaaacctattcccggtgactggaatggtgctggtgctcactgcaactatagtaccaagtcaatgagggaagatggtggttacgagattatcaagaaggcaatcgataaactgggaatgagacacaaggaacacattgctgcttatggtgaaggcaatgagcgtcgtctcacgggtcatcacgagactgctgacatcaacactttcctctggggtgttgcgaatcgtggagcatcaatccgtgtaggacgcgacacagagaaagaagggaaaggatactttgaggataggaggccagcttcgaacatggatccttacattgtgacttccatgattgcagagaccacaatcctctggaaaccttga

SEQ ID NO: 2364 - protein, 356 aa, Brassica napus
MSLLTDLVNLNLSETTDKIIAEYIWVGGSGMDMRSKARTLPGPVSDPSELPKWNYDGSSTGQAPGEDSEVILYPQAIFKDPFRRGNNILVMCDAYTPAGEPIPTNKRHAAAKVFSHPDVVAEVPWYGIEQEYTLLQKDVKWPLGWPIGGFPGPQGPYYCSVGADKSFGRDIVDAHYKACLYAGITISGINGEVMPGQWEFQVGPAVGISAGDEIWVARYILERITEVAGVVVSFDPKPIPGDWNGAGAHCNYSTKSMREDGGYEIIKKAIDKLGMRHKEHIAAYGEGNERRLTGHHETADINTFLWGVANRGASIRVGRDTEKEGKGYFEDRRPASNMDPYIVTSMIAETTILWKP

SEQ ID NO: 2365 - DNA, 1074 bp, Brassica napus
  CDS (1)..(1074)
atggaaacagaaaaaatgtctccactctccgatctcctaaacctcaatctcgacaccaagcaaatcatcgctgaatacatatggatcggtgggtctggaatggacattagaagcaaaggcaggacattaccaggaccagtaagtgatccatcaaagcttccgaaatggaactacgatggatccagcaccaatcaagccgccggagatgacagtgaagtcattctatatcctcaggcgatttttaaagacccattcaggaaagggaataacattctcgtgatgtgtgatgcttacacaccgaaaggagatccaatcccgaccaacaataggcacaaagccgtgaaaatcttcgatcatcccaatgtgaaggctgaagagccttggtttgggatagagcaagaatacacattacttaagaaagacgtcaagtggccattgggttggccccttggtggctttcctggtcctcagggaccgtactattgtgcggtgggtgcagacaaagcctttgggcgtgacattgtggatggtcactacaaagcttgtctttacgctggtttaagcataggtggtgccaatggtgaagtcatgcctggtcaatgggagtttcaaatcagccctactgttggtattggtgcaggtgatcagttatgggttgctcgctacatactcgagaggattactgagatatgcggcgtaattgtctcatttgatcccaaaccaatcgagggtgattggaacggagcagctgctcatacaaacttcagtacaaaatcaatgaggaaagaaggaggattggacttgatcaagaaagcaatagggaagcttgaagtgaagcataaacaacacattgctgcttatggtgaaggcaatgagaggcgtctcactgggaagcatgaaaccgcagacatcaacaagttctcttggggagttgcggatcgtggagcatcggtgagagtgggaagagatacggagaaagaagggaaaggttattttgaagatcgaagaccttcgtctaatatggatccttatcttgttacctccatgatagctgaaaccaccatcctcggctaa

SEQ ID NO: 2366 - protein, 357 aa, Brassica napus
METEKMSPLSDLLNLNLDTKQIIAEYIWIGGSGMDIRSKGRTLPGPVSDPSKLPKWNYDGSSTNQAAGDDSEVILYPQAIFKDPFRKGNNILVMCDAYTPKGDPIPTNNRHKAVKIFDHPNVKAEEPWFGIEQEYTLLKKDVKWPLGWPLGGFPGPQGPYYCAVGADKAFGRDIVDGHYKACLYAGLSIGGANGEVMPGQWEFQISPTVGIGAGDQLWVARYILERITEICGVIVSFDPKPIEGDWNGAAAHTNFSTKSMRKEGGLDLIKKAIGKLEVKHKQHIAAYGEGNERRLTGKHETADINKFSWGVADRGASVRVGRDTEKEGKGYFEDRRPSSNMDPYLVTSMIAETTILG

SEQ ID NO: 2367 - DNA, 1071 bp, Brassica napus
  CDS (1)..(1071)
atgagtcttctgaccgatctcgttaaccttgacctctcagacaacactgagaaaatcatcgctgaatacatatgggttggtggttcaggaatggatatgagaagcaaagccaggactctccctggacctgtgaccgatccatcaaagctcccaaaatggaattatgatggttcaagcactggccaagctcctggtgaagacagtgaagtgatcttataccctcaagcgattttcaaagatccgttccgtagaggcaacaacattcttgtcatgtgtgatacttacacccctgcgggtgaaccaatccctacgaacaagagacatgctgcagctcagatctttagcaaccctgatgttgttgctgaagtgccatggtatggaatcgaacaagaatacactctgttgcagaaagatgtgaattggcctgtcggatggcccattggtggattccccggccctcagggaccatactactgcagtgttggagctgacaaatcttttggaagagacattgttgatgctcactacaaggcttgtttgtatgctggaattaacatcagtggaatcaatggagaagtcatgcctggtcagtgggagttccaagtcggaccatcggttggtatctcagctgctgatgaagtgtggattgctcgttacattttggagaggatcacagagattgctggtgtggttgtatcttttgacccaaaaccaattccgggtgactggaacggagctggtgctcacaccaattacagtactaaatcgatgagggaggaaggaggatacgagataatcaagaaggcaattgataagctcggactgagacacaaggagcacatttctgcttacggtgaaggcaacgagcgtcgtctcactggacaccatgaaactgctgatatcaacactttcaaatggggtgttgcaaaccgtggagcatcaatccgtgtaggacgtgacacggagaaggaagggaaaggatactttgaggataggaggccagcttccaacatggacccttacactgtaacttccatgattgcagagactacacttctttggaatccttga

SEQ ID NO: 2368 - protein, 356 aa, Brassica napus
MSLLTDLVNLDLSDNTEKIIAEYIWVGGSGMDMRSKARTLPGPVTDPSKLPKWNYDGSSTGQAPGEDSEVILYPQAIFKDPFRRGNNILVMCDTYTPAGEPIPTNKRHAAAQIFSNPDVVAEVPWYGIEQEYTLLQKDVNWPVGWPIGGFPGPQGPYYCSVGADKSFGRDIVDAHYKACLYAGINISGINGEVMPGQWEFQVGPSVGISAADEVWIARYILERITEIAGVVVSFDPKPIPGDWNGAGAHTNYSTKSMREEGGYEIIKKAIDKLGLRHKEHISAYGEGNERRLTGHHETADINTFKWGVANRGASIRVGRDTEKEGKGYFEDRRPASNMDPYTVTSMIAETTLLWNP

SEQ ID NO: 2369 - DNA, 1071 bp, Brassica napus
  CDS (1)..(1071)
atgtcggctcttgcagatttaatcaatctcgatctctccgactcctctgagaagatcattgccgagtacatatggattggtggatcaggcttggatatgagaagcaaagcaaggactttgccgggaccagtgaaggatccatcggagttaccgaaatggaactatgacggttcaagcaccggccaagctcccggcgatgacagtgaagtcatcatctaccctcaagctatcttcaaagatccattcagaagaggcaacaacatccttgtgatgtgtgacgcttatacaccggctggcgaaccgatcccaaccaacaaaaggcatgcggcggccaagatctttagcgacccaaccgttgccgccgaagaaacatggtatggaattgagcaagagtatactttgctccaaaaggatactaagtggccagttggttggcccgtcggtggcttcccaggtcctcagggaccatactactgtggagttggagcagacaaagcctttggaagagacatcgtagatgctcattacaaagcatgtctttacgccggaatcaatgtcagtggcactaacggagaagtcatgcccggacagtgggagttccaagtcggtccaaccgttggaatagctgccgctgatcaggtctgggtcgctcgttacatcctcgagaggatcacagaattggctggagtggttttatctcttgaccctaaaccaattccgggagattggaatggtgcaggagcacacacaaattacagcaccaagtcgatgagagaagatggagggtacgagatcataaagaaagcgatagagaagcttggactgcgtcacaaggaacacatcgctgcttatggtgaaggcaacgagcgtcgtctcactggaaaacacgagactgctgatatcaacactttcttatggggtgttgcaaaccgtggggcatcgattagggttggtcgtgacactgagaaagatgggaaaggatactttgaagatcgtaggccagcgtcgaacatggatccatacactgtgacctccatggttgctgaaaccacaatcctctggaaaccatga

SEQ ID NO: 2370 - protein, 356 aa, Brassica napus
MSALADLINLDLSDSSEKIIAEYIWIGGSGLDMRSKARTLPGPVKDPSELPKWNYDGSSTGQAPGDDSEVIIYPQAIFKDPFRRGNNILVMCDAYTPAGEPIPTNKRHAAAKIFSDPTVAAEETWYGIEQEYTLLQKDTKWPVGWPVGGFPGPQGPYYCGVGADKAFGRDIVDAHYKACLYAGINVSGTNGEVMPGQWEFQVGPTVGIAAADQVWVARYILERITELAGVVLSLDPKPIPGDWNGAGAHTNYSTKSMREDGGYEIIKKAIEKLGLRHKEHIAAYGEGNERRLTGKHETADINTFLWGVANRGASIRVGRDTEKDGKGYFEDRRPASNMDPYTVTSMVAETTILWKP

SEQ ID NO: 2371 - DNA, 1287 bp, Brassica napus
  CDS (1)..(1287)
atggcgcaaatcttggcagcttctccaacatgtcaaatgaaattgactaaaccgagccccattgcatcttcaaagttatggaactcggttgtgttgaaacagaagaaacagagcagcagcaaagtcagaagcttcaaagtgatggctctccaatctgataacagcacaatcaacagagttgagagtcttctcaatctagacaccaaacctttcactgaccggatcatcgctgagtacatctggattggcggatctggaattgaccttaggagcaagtcaaggacgcttgaaaagcccgtggaagatccttctgaacttcccaagtggaactatgatggttcgagtaccggacaagcacctggtgaagatagtgaagtgattctctatccgcaagctatcttcagagatcctttccgtggaggcaataacatattggttatctgtgatacctacacaccagctggtgagccaattccaacaaacaaacgtgcccgagctgctgagattttcagcaacaagaaggtcaatgaagagattccatggtttggcattgaacaagagtacactttacttcagccaaacgtaaactggcctttgggttggcccgttggagcgtatcctggtccccagggtccttactactgtggagttggagctgaaaagtcttggggacgtgacatttcagatgctcattacaaagcttgtttatatgcgggaattaacatcagtggtactaatggtgaagttatgccaggacagtgggaattccaagttggcccgagtgtaggaatcgaagcaggtgatcatgtttggtgtgcaagataccttcttgagagaatcacagaacaagctggtgttgtcttaacacttgatcccaaacccatagagggtgactggaacggtgctggttgccataccaattacagtactaaaagcatgagagaggaaggaggatttgatgtgattaaaaaggccatcttgaacctctcgcttcgtcacatggagcacatcagtgcatacggtgaaggcaatgagagaaggttgaccggaaagcacgagacagctagtatcgaccaattctcatggggcgtggctaaccgtggatgctcaattcgtgtgggacgtgataccgagaagaaaggaaaaggttacttggaagatcgacgtccagcatcaaacatggacccatacattgtgacttcactcttggcagagaccacacttctctgggagccgacccttgaggctgaagcacttgcagctcaaaagctttctttgaaggtttaa

SEQ ID NO: 2372 - protein, 428 aa, Brassica napus
MAQILAASPTCQMKLTKPSPIASSKLWNSVVLKQKKQSSSKVRSFKVMALQSDNSTINRVESLLNLDTKPFTDRIIAEYIWIGGSGIDLRSKSRTLEKPVEDPSELPKWNYDGSSTGQAPGEDSEVILYPQAIFRDPFRGGNNILVICDTYTPAGEPIPTNKRARAAEIFSNKKVNEEIPWFGIEQEYTLLQPNVNWPLGWPVGAYPGPQGPYYCGVGAEKSWGRDISDAHYKACLYAGINISGTNGEVMPGQWEFQVGPSVGIEAGDHVWCARYLLERITEQAGVVLTLDPKPIEGDWNGAGCHTNYSTKSMREEGGFDVIKKAILNLSLRHMEHISAYGEGNERRLTGKHETASIDQFSWGVANRGCSIRVGRDTEKKGKGYLEDRRPASNMDPYIVTSLLAETTLLWEPTLEAEALAAQKLSLKV

SEQ ID NO: 2373 - DNA, 1071 bp, Glycine max
  CDS (1)..(1071)
atgtcgctgctctcagatctcatcaaccttaacctctcagacactactgagaaggtgatcgcagagtacatatggatcggtggatcaggaatggacctgaggagcaaagcaaggactctcccaggaccagttagcgacccttcaaagcttcccaagtggaactatgatggttccagcacaggccaagctcctggagaagacagtgaagtgattatatacccacaagccattttcagggatccattcagaaggggcaacaatatcttggttatctgtgatacttacactccagctggagaacccattcccactaacaagaggcacgatgctgccaaggttttcagccatcctgatgttgttgctgaagagacatggtatggtattgagcaggaatacaccttgttgcagaaagatatccaatggcctcttgggtggcctgttggtggtttccctggaccacagggtccatactactgtggtgttggcgctgacaaggcttttggccgtgacattgttgacgcacattacaaagcctgtctttatgctggcatcaacatcagtggaattaatggagaagtgatgcccggtcagtgggaattccaagttggaccttcagttggaatctcagctggtgacgaggtgtgggcagctcgttacatcttggagaggatcactgagattgctggtgtggtggtttcctttgatcccaagccaattcagggtgattggaatggtgctggtgctcacacaaactacagcactaagtccatgagaaatgatggtggctatgaagtgatcaaaaccgccattgagaagttggggaagagacacaaggagcacattgctgcttatggagaaggcaacgagcgtcgtttgacagggcgccacgaaaccgctgacatcaacaccttcttatggggagttgcaaaccgtggagcttcagttagggttgggagggacacagagaaagcagggaagggatattttgaggacagaaggccagcttctaacatggacccatatgtggttacttccatgattgcagacacaaccattctgtggaagccatga

SEQ ID NO: 2374 - protein, 356 aa, Glycine max
MSLLSDLINLNLSDTTEKVIAEYIWIGGSGMDLRSKARTLPGPVSDPSKLPKWNYDGSSTGQAPGEDSEVIIYPQAIFRDPFRRGNNILVICDTYTPAGEPIPTNKRHDAAKVFSHPDVVAEETWYGIEQEYTLLQKDIQWPLGWPVGGFPGPQGPYYCGVGADKAFGRDIVDAHYKACLYAGINISGINGEVMPGQWEFQVGPSVGISAGDEVWAARYILERITEIAGVVVSFDPKPIQGDWNGAGAHTNYSTKSMRNDGGYEVIKTAIEKLGKRHKEHIAAYGEGNERRLTGRHETADINTFLWGVANRGASVRVGRDTEKAGKGYFEDRRPASNMDPYVVTSMIADTTILWKP

SEQ ID NO: 2375 - DNA, 1071 bp, Glycine max
  CDS (1)..(1071)
atgtcgttactctccgatcttatcaaccttaacctctccgacatcaccgataaggtgatcgccgagtacatatgggttggtggatctggcatggatatgaggagcaaagcaaggactctctcgggactggttaatgacccttccaagcttcccaagtggaactatgatggttccagcactggtcaagctcctggacaagatagtgaagtgatcttatatccacaagcaatttttcgggatccattcaggaggggtaacaatatcctggttatgtgtgatgcttacactcctgctggggaacccattcctaccaacaagagaaataaagctgcaaagatattcagtaatccggatgttgctgctgaagaaccctggtatggtcttgagcaggaatatacattattgcagaaagatgtccaatggcctcttggatggcctcttggtgggtttcctgggccccagggaccatactattgtggaactggtgctaacaaggcttttgggcgtgatattgttgactcacattacaaagcatgtatttatgcgggaattaacataagtggaatcaatggagaagtgatgcccggtcagtgggaattccaagttggtccatcggttggcatctctgctgctgacgagttgtgggttgctcgttacattttggagaggatcaccgagattgctggagtggtgctttcctttgaccctaaaccaattcagggtgattggaatggtgctggtgctcacacaaattacagtaccaagttgatgagaaacgatggtggctatgaaatcatcaaaaaagcaattgctaagttggaaaagaggcacaaagagcacattgctgcttacggagaaggcaatgaacgtcgtttgaccggacgacacgagacggctgacatgaacacctttttatggggtgttgcaaaccgtggtgcttctattagggtagggagagacactgaaaaggcagggaagggatactttgaagataggaggcctgcctctaacatggacccttatgtggtcacttccatgattgctgagacaactattctttggaaaccataa

SEQ ID NO: 2376 - protein, 356 aa, Glycine max
MSLLSDLINLNLSDITDKVIAEYIWVGGSGMDMRSKARTLSGLVNDPSKLPKWNYDGSSTGQAPGQDSEVILYPQAIFRDPFRRGNNILVMCDAYTPAGEPIPTNKRNKAAKIFSNPDVAAEEPWYGLEQEYTLLQKDVQWPLGWPLGGFPGPQGPYYCGTGANKAFGRDIVDSHYKACIYAGINISGINGEVMPGQWEFQVGPSVGISAADELWVARYILERITEIAGVVLSFDPKPIQGDWNGAGAHTNYSTKLMRNDGGYEIIKKAIAKLEKRHKEHIAAYGEGNERRLTGRHETADMNTFLWGVANRGASIRVGRDTEKAGKGYFEDRRPASNMDPYVVTSMIAETTILWKP

SEQ ID NO: 2377 - DNA, 1071 bp, Glycine max
  CDS (1)..(1071)
atgtctttactttcagacctcatcaacctcaatctctcagaatccacagaaaagatcattgctgagtacatatgggttggtggatctggtatggacctcagaagcaaagccaggactcttcctgggccagtgagtgaccctgcaaaacttccgaagtggaactatgatgggtctagcacagatcaagctccaggggatgacagtgaagtcattctatacccacaagctattttcaaggacccctttaggagaggaaacaatattcttgtcatttgtgatgtgtacaccccagctggtgagccacttccaaccaacaagaggtatggtgctgccaaaattttcagtcaccctgatgttgctgctgaggaaccatggtatggtattgagcaagagtataccttattgcagaaagatgtaaattggccacttgggtggccccttggtgggtttcctggaccacagggcccatactactgtggaattggtgctgataaagcctatggccgtgatattgtagatgcacattacaaagcttgtatttatgctggcattaacattagtggcatcaatggagaggttatgcctggccagtgggaatttcaagttggtccttctgttggtatctctgctggagatgaggtgtgggctgctcgctacattttggagaggattacagagatagctggagcaattgtttcatttgatcccaagcctattccgggagattggaatggagctggagctcactcaaactacagcaccaagtccatgagagaagagggtggttatgaggtgatcaagaaggccattgaaaagcttggattgaggcacaaggagcacatcgcagcatatggagaaggcaacgagagacgtctcacgggaagacatgaaactgcagacatcaacaccttctcttggggtgtggcaaaccgtggaagctccattagagttggaagagacacagagaaaaatggcaaaggttacttcgaggacagaaggcctgcttctaatatggatccctatgtagtcacctccatgatcgcagagactaccatcctctggaaaccatga

SEQ ID NO: 2378 - protein, 356 aa, Glycine max
MSLLSDLINLNLSESTEKIIAEYIWVGGSGMDLRSKARTLPGPVSDPAKLPKWNYDGSSTDQAPGDDSEVILYPQAIFKDPFRRGNNILVICDVYTPAGEPLPTNKRYGAAKIFSHPDVAAEEPWYGIEQEYTLLQKDVNWPLGWPLGGFPGPQGPYYCGIGADKAYGRDIVDAHYKACIYAGINISGINGEVMPGQWEFQVGPSVGISAGDEVWAARYILERITEIAGAIVSFDPKPIPGDWNGAGAHSNYSTKSMREEGGYEVIKKAIEKLGLRHKEHIAAYGEGNERRLTGRHETADINTFSWGVANRGSSIRVGRDTEKNGKGYFEDRRPASNMDPYVVTSMIAETTILWKP

SEQ ID NO: 2379 - DNA, 1071 bp, Glycine max
  CDS (1)..(1071)
atgtctttgctttcggatctcatcaacctcaatctctcagaatccacagaaaagatcgttgctgagtacatatgggttggtggatctggtatggacctcagaagcaaagccaggactcttcctgggccagtgagtgaccctgcaaagcttccaaagtggaactacgatggctctagcacagaccaagctccaggggatgacagtgaagtcatcctatacccacaagctattttcaaggacccctttaggagaggcaacaatattcttgtgatttgtgatgtttacacccccgctggtgagccacttccaaccaacaagaggtatgatgctgccaaaattttcagccaccctgacgttgctgctgaggaaccatggtatggtattgagcaagaatataccttgttgcagaaagatgtaaattggccacttgggtggccacttggtgggtttcctggaccacagggcccatactactgtggaactggtgctgataaagcatatggccgtgatattgtagatgcacattacaaagcttgtatttatgctggcatcaatattagtggcatcaatggagaggttatgcctggtcagtgggaatttcaagttggtccttctgttggtatatctgctggagatgaggtgtgggcagctcggtacattttggagaggattacagagatggccggagtaattgtttcatttgatcccaagcctattccgggagattggaatggagctggagctcactcaaactacagcaccaagtccatgagagatgagggtggttatgaggtgattaagaaggccattgaaaagcttggattgaggcacaaggagcacattgcagcatatggagaaggcaacgagagacgtctcactggaagacatgaaactgcagacatcaacaccttctcttggggtgtggcaaaccgtggaagctccattagagttggaagagacacagagaaaaatggcaaaggttactttgaggacagaaggcctgcttctaatatggatccatatgtagtcacctccatgatcgcagagactaccatcctctggaaaccatga

SEQ ID NO: 2380 - protein, 356 aa, Glycine max
MSLLSDLINLNLSESTEKIVAEYIWVGGSGMDLRSKARTLPGPVSDPAKLPKWNYDGSSTDQAPGDDSEVILYPQAIFKDPFRRGNNILVICDVYTPAGEPLPTNKRYDAAKIFSHPDVAAEEPWYGIEQEYTLLQKDVNWPLGWPLGGFPGPQGPYYCGTGADKAYGRDIVDAHYKACIYAGINISGINGEVMPGQWEFQVGPSVGISAGDEVWAARYILERITEMAGVIVSFDPKPIPGDWNGAGAHSNYSTKSMRDEGGYEVIKKAIEKLGLRHKEHIAAYGEGNERRLTGRHETADINTFSWGVANRGSSIRVGRDTEKNGKGYFEDRRPASNMDPYVVTSMIAETTILWKP

SEQ ID NO: 2381 - DNA, 1299 bp, Glycine max
  CDS (1)..(1299)
atggcacagattttggctccctctacgcaatggcagatgagaatctcaaaatcctctcccaatgcaagtcccattacatcaaacatgtggagttctttattgtggaaacaaaataagaaagtttcacccacaagttctgctaaatttagagtgatggcaattaagtctgacaatagcatcatcaacaggctagagggtctacttaatttggatatcactccattcactgacaagataattgctgagtacatttggattggggggacaggaattgatgtgcgcagtaaatcaagaacaatatcaaagcctgttgaagatccctctgagctccctaaatggaactatgatggatctagcactggacaggcacctggtgatgatagtgaagtaatcctatatcctcaagcaattttcaaagatcctttccgtggcggtaacaatattttggtcatttgcgattcttacaccccacaaggtgagcctatccctacaaacaagagacacagagctgctgaaattttcagtaacccaaaggtccaagctgaagttccatggtatggaatagaacaagagtacaccttacttcaaacaaatgtgaaatggccattaggttggcccgttggtggctatcccggtcctcagggtccttattattgcagcgctggggcagataagtcatttggacgtgacatatctgatgctcattacaaggcttgcttatatgctggaattaacatcagtggcaccaatggggaggttatgcctgggcagtgggagtaccaagttggtcctagtgtaggtattgaggctggtgatcatatctgggcttcaaggtacatcctcgagagaattaccgagcaagctggtgttgtgctctctcttgatccaaaaccaatagagggtgactggaatggagcaggatgccacaccaattacagtacaaagagcatgagggaagatggaggctttgaggtaataaagaaggcaatattgaatctatcgcttcgccacaaagatcacatcagtgcatatggagaaggaaatgagagaaggttgactggaaagcatgagacagcaagcatcaacacattttcttggggagtggctaaccgtggttgctcaatccgtgtgggaagagacactgagaagaatggcaaaggttacttggaagataggcgaccggcttcaaacatggatccatatgttgtgacatcattacttgcagagactacactattgtgggagccaactctggaggctgaagctcttgcagctcagaagttagcattgaaggtctaa

SEQ ID NO: 2382 - protein, 432 aa, Glycine max
MAQILAPSTQWQMRISKSSPNASPITSNMWSSLLWKQNKKVSPTSSAKFRVMAIKSDNSIINRLEGLLNLDITPFTDKIIAEYIWIGGTGIDVRSKSRTISKPVEDPSELPKWNYDGSSTGQAPGDDSEVILYPQAIFKDPFRGGNNILVICDSYTPQGEPIPTNKRHRAAEIFSNPKVQAEVPWYGIEQEYTLLQTNVKWPLGWPVGGYPGPQGPYYCSAGADKSFGRDISDAHYKACLYAGINISGTNGEVMPGQWEYQVGPSVGIEAGDHIWASRYILERITEQAGVVLSLDPKPIEGDWNGAGCHTNYSTKSMREDGGFEVIKKAILNLSLRHKDHISAYGEGNERRLTGKHETASINTFSWGVANRGCSIRVGRDTEKNGKGYLEDRRPASNMDPYVVTSLLAETTLLWEPTLEAEALAAQKLALKV

SEQ ID NO: 2383 - DNA, 1074 bp, Glycine max
  CDS (1)..(1074)
atgtctttgctttcggatctcatcaacctcaatctctcagaatccacagaaaagatcgttgctgagtacatatgggttggtggatctggtatggacctcagaagcaaagccaggactcttcctgggccagtgagtgaccctgcaaagcttccaaagtggaactacgatggctctagcacagaccaagctccaggggatgacagtgaagtcattctatacccacaagctattttcaaggacccctttaggagaggcaacaatattcttgtgatttgtgatgtgtacacccccgctggtgagccacttccaaccaacaagaggtatgatgctgccaaaattttcagccaccctgacgttgctgctgaggaaccatggtatggtattgagcaagaatataccttgttgcagaaagatgtaaattggccacttgggtggccacttggtgggtttcctggaccacagggcccatactactgtggaactggtgctgataaagcatatggccgtgatattgtagatgcacattacaaagcttgtatttatgctggcatcaatattagtggcatcaatggagaggttatgcctggtcagtgggaatttcaagttggtccttctgttggtatatctgctggagatgaggtgtgggcagctcggtacattttggagaggattacagagatggccggagtaattgtttcatttgatcccaagcctattccgggagattggaatggagctggagctcactcaaactacagcaccaagtccatgagagatgagggtggttatgaggtgattaagaaggccattgaaaagcttggattgaggcacaaggagcacattgcagcatatggagaaggcaacgagagacgtctcactggaagacatgaaactgcagacatcaacaccttctcttggggtgtggcaaaccgtggaagctccattagagttggaagagacacagagaaaaatggcaaaggttactttgaggacagaaggcctgcttctaatatggatccatactatgtagtcacctccatgatcgcagagactaccatcctctggaaaccatga

SEQ ID NO: 2384 - protein, 357 aa, Glycine max
MSLLSDLINLNLSESTEKIVAEYIWVGGSGMDLRSKARTLPGPVSDPAKLPKWNYDGSSTDQAPGDDSEVILYPQAIFKDPFRRGNNILVICDVYTPAGEPLPTNKRYDAAKIFSHPDVAAEEPWYGIEQEYTLLQKDVNWPLGWPLGGFPGPQGPYYCGTGADKAYGRDIVDAHYKACIYAGINISGINGEVMPGQWEFQVGPSVGISAGDEVWAARYILERITEMAGVIVSFDPKPIPGDWNGAGAHSNYSTKSMRDEGGYEVIKKAIEKLGLRHKEHIAAYGEGNERRLTGRHETADINTFSWGVANRGSSIRVGRDTEKNGKGYFEDRRPASNMDPYYVVTSMIAETTILWKP

SEQ ID NO: 2385 - DNA, 1071 bp, Zea mays
  CDS (1)..(1071)
atggcctgcctcaccgacctcgtcaacctcaacctctcggacaccaccgagaagatcatcgcggaatacatatggatcggtggatctggcatggatctcaggagcaaagcaaggaccctctccggcccggtgaccgatcccagcaagctgcccaagtggaactacgacggctccagcacgggccaggcccccggcgaggacagcgaggtcatcctgtacccgcaggccatcttcaaggacccattcaggaggggcaacaacatccttgtgatgtgcgattgctacaccccagccggcgagccaatccccaccaacaagaggtacaacgccgccaagatcttcagcagccctgaggtcgccgccgaggagccgtggtatggtattgagcaggagttcaccctccttcagaaggacaccaactggccccttgggtggcccatcggtggcttccccggccctcagggtccttactactgtggaatcggcgccgaaaagtcgttcggccgcgacatcgtggacgcccactacaaggcctgcttgtatgcgggcatcaacatcagtggcatcaacggggaggtgatgccagggcagtgggagttccaagtcgggccttccgtgggtatttcttcaggcgaccaggtctgggtcgctcgctacattcttgagaggatcacggagatcgccggtgtggtggtgacgttcgacccgaagccgatcccgggcgactggaacggcgccggcgcgcacaccaactacagcacggagtcgatgaggaaggagggcgggtacgaggtgatcaaggcggccatcgagaagctgaagctgcggcacagggagcacatcgcggcctacggcgagggcaacgagcgccggctcaccggcaggcacgagaccgccgacatcaacacgttcagctggggcgtggccaaccgcggcgcgtcggtgcgcgtgggccgggagacggagcagaacggcaagggctacttcgaggaccgccgcccggcgtccaacatggacccctacgtggtcacctccatgatcgccgagaccaccatcatctggaagccctga

SEQ ID NO: 2386 - protein, 356 aa, Zea mays
MACLTDLVNLNLSDTTEKIIAEYIWIGGSGMDLRSKARTLSGPVTDPSKLPKWNYDGSSTGQAPGEDSEVILYPQAIFKDPFRRGNNILVMCDCYTPAGEPIPTNKRYNAAKIFSSPEVAAEEPWYGIEQEFTLLQKDTNWPLGWPIGGFPGPQGPYYCGIGAEKSFGRDIVDAHYKACLYAGINISGINGEVMPGQWEFQVGPSVGISSGDQVWVARYILERITEIAGVVVTFDPKPIPGDWNGAGAHTNYSTESMRKEGGYEVIKAAIEKLKLRHREHIAAYGEGNERRLTGRHETADINTFSWGVANRGASVRVGRETEQNGKGYFEDRRPASNMDPYVVTSMIAETTIIWKP

SEQ ID NO: 2387 - DNA, 1110 bp, Zea mays
  CDS (1)..(1110)
atggctctgctctccgacctcatcaacctcgacctctcggaccgcaccgggaagatcatcgccgagtacatctgggttggcggttccgggatggacgtcaggagcaaagccaggacgctgtccggacctgttgatgaccccagcaagcttccgaagtggaacttcgacggctccagcaccggccaagctccgggcgacgacagcgaagtcatcctttgccctcgggccatcttcagggacccgttcaggaaggggcagaacatactggtcatgtgcgactgctacgagccgaacggggagccgatcccgagcaacaagcggcacggggccgcgaagatctttagccaccctgacgtcaaggctgaggaaccatggttcgggattgagcaggagtacacccttctccagaaggacaccaagtggcctctcggttggccgctgggcggctaccctggccctcagggaccttactactgcgccgtcggagcggacaagtcctacgggcgggacatcgtggacgcgcactacaaggcctgcctctacgccggcatcgacatcagtggcatcaacggggaggtcatgccggggcagtgggagttccaggtcggccctgccgtcggcgtctcggccggcgaccagctctgggtggctcgctacattcttgagaggatcaccgagatcgccggcgtggttgtctccttcgaccccaagccaattccgggggactggaatggcgctggtgcacacaccaactacagcaccaagtcgatgaggagcgacggcgggtacgaggtgatcaagaaggcgatcggcaagctgggcctccggcaccgggagcacatcgccgcgtacggggacggcaacgagcgccgcctcaccggccgccacgagaccgccgacatcaacaccttcgtctggggcgtcgcgaaccgcggggcgtcggtgcgggtgggccgcgacaccgagaaggaaggcaaaggctacttcgaggaccggaggccggcgtccaacatggacccgtacgtggtgacctcgctgatcgcggagacaaccatgctgtgggagcccagccactccaacggcgacggcaagggcgccgcggctccttga

SEQ ID NO: 2388 - protein, 369 aa, Zea mays
MALLSDLINLDLSDRTGKIIAEYIWVGGSGMDVRSKARTLSGPVDDPSKLPKWNFDGSSTGQAPGDDSEVILCPRAIFRDPFRKGQNILVMCDCYEPNGEPIPSNKRHGAAKIFSHPDVKAEEPWFGIEQEYTLLQKDTKWPLGWPLGGYPGPQGPYYCAVGADKSYGRDIVDAHYKACLYAGIDISGINGEVMPGQWEFQVGPAVGVSAGDQLWVARYILERITEIAGVVVSFDPKPIPGDWNGAGAHTNYSTKSMRSDGGYEVIKKAIGKLGLRHREHIAAYGDGNERRLTGRHETADINTFVWGVANRGASVRVGRDTEKEGKGYFEDRRPASNMDPYVVTSLIAETTMLWEPSHSNGDGKGAAAP

SEQ ID NO: 2389 - DNA, 1074 bp, Zea mays
  CDS (1)..(1074)
atggccagcctcaccgacctcgtcaacctcgacctgagtgactgcaccgacaggatcatcgccgagtacatctggattggaggaaccggcatagacctcaggagcaaagcgaggacggtgaaaggccccatcaccgacccgagccagctgccgaaatggaactacgacggctccagcaccgggcaagctcccggagaggacagcgaagtcatcctctaccctcaagccattttcaaggacccgttcaggaagggtaaccacatccttgtgatgtgtgactgctacacgccacaaggcgagccaatccccaccaacaagaggtacagcgccgccaaggttttcagccaccccgacgtcgcagctgaggtgccgtggtacggtattgagcaggagtacaccctccttcagaaggacgtgagctggcccctcggctggcctgttggtggataccctggtccccagggaccatactactgcgccgccggtgccgacaaggcctttgggcgcgacgtggttgacgcccactacaaggcctgcctctacgccggcatcaacatcagcggcatcaacggcgaagtcatgcctggacagtgggagttccaagtggggccgtccgttgggatctctgccggcgacgagatatgggtcgcccgctacattctcgagaggatcaccgagatggccggaatcgtcctctccctcgacccgaagccgatcaagggcgactggaacggcgccggcgcccacaccaactacagcaccaagtcgatgagggaggccgggggatacgaggtgatcaaggcggcgatcgacaagctggggaagaggcacaaggagcacatcgccgcgtacggcgagggcaacgagcgccgcctcacgggccgccacgagaccgccgacatcaacaccttcaaatggggcgtggcgaaccgcggcgcatccatccgcgtcggccgcgacaccgagagggagggcaagggctacttcgaggaccgcaggccggcgtccaacatggacccctacgtcgtcaccggcatgatcgccgagaccaccatcctgtggaatggaaactga

SEQ ID NO: 2390 - protein, 357 aa, Zea mays
MASLTDLVNLDLSDCTDRIIAEYIWIGGTGIDLRSKARTVKGPITDPSQLPKWNYDGSSTGQAPGEDSEVILYPQAIFKDPFRKGNHILVMCDCYTPQGEPIPTNKRYSAAKVFSHPDVAAEVPWYGIEQEYTLLQKDVSWPLGWPVGGYPGPQGPYYCAAGADKAFGRDVVDAHYKACLYAGINISGINGEVMPGQWEFQVGPSVGISAGDEIWVARYILERITEMAGIVLSLDPKPIKGDWNGAGAHTNYSTKSMREAGGYEVIKAAIDKLGKRHKEHIAAYGEGNERRLTGRHETADINTFKWGVANRGASIRVGRDTEREGKGYFEDRRPASNMDPYVVTGMIAETTILWNGN

SEQ ID NO: 2391 - DNA, 1110 bp, Zea mays
  CDS (1)..(1110)
atggctctgctctccgacctcatcaacctcgacctctcgggccgcaccgggaagatcatcgccgagtacatctgggttggcggttccgggatggacgtcaggagcaaagccaggacgctgtccggacctgttgatgaccccagcaagcttccgaagtggaacttcgacggctccagcaccggccaagctccgggcgacgacagcgaagtcatcctttgccctcgggccatcttcagggacccgttcaggaaggggcagaacatactggtcatgtgcgactgctacgagccgaacggggagccgatcccgagcaacaagcggcacggggccgcgaagatctttagccaccctgacgtcaaggctgaggaaccatggttcgggattgagcaggagtacacccttctccagaaggacaccaagtggcctctcggttggccgctgggcggctaccctggccctcagggaccttactactgcgccgtcggagcggacaagtcctacgggcgggacatcgtggacgcgcactacaaggcctgcctctacgccggcatcgacatcagtggcatcaacggggaggtcatgccggggcagtgggagttccaggtcggtcctgccgtcggcgtctcggccggcgaccagctctgggtggctcgctacattcttgagaggatcaccgagatcgccggcgtggttgtctccttcgaccccaagccaattccgggggactggaatggcgctggtgcacacaccaactacagcaccaagtcgatgaggagcgacggcgggtacgaggtgatcaagaaggcgatcggcaagctgggcctccggcaccgggagcacatcgccgcgtacggggacggcaacgagcgccgcctcaccggccgccacgagaccgccgacatcaacaccttcgtctggggcgtcgcgaaccgcggggcgtcggtgcgggtgggccgcgacaccgagaaggaaggcaaaggctacttcgaggaccggaggccggcgtccaacatggacccgtacgtggtgacctcgctgatcgcggagacaaccatgctgtgggagcccagccactccaacggcgacggcaagggcgccgcggctccttga

SEQ ID NO: 2392 - protein, 369 aa, Zea mays
MALLSDLINLDLSGRTGKIIAEYIWVGGSGMDVRSKARTLSGPVDDPSKLPKWNFDGSSTGQAPGDDSEVILCPRAIFRDPFRKGQNILVMCDCYEPNGEPIPSNKRHGAAKIFSHPDVKAEEPWFGIEQEYTLLQKDTKWPLGWPLGGYPGPQGPYYCAVGADKSYGRDIVDAHYKACLYAGIDISGINGEVMPGQWEFQVGPAVGVSAGDQLWVARYILERITEIAGVVVSFDPKPIPGDWNGAGAHTNYSTKSMRSDGGYEVIKKAIGKLGLRHREHIAAYGDGNERRLTGRHETADINTFVWGVANRGASVRVGRDTEKEGKGYFEDRRPASNMDPYVVTSLIAETTMLWEPSHSNGDGKGAAAP

SEQ ID NO: 2393 - DNA, 1071 bp, Zea mays
  CDS (1)..(1071)
atggcctgcctcaccgacctcgtcaacctcaacctctcggacaacaccgagaagatcatcgcggaatacatatggatcggtggatctggcatggatctcaggagcaaagcaaggaccctctccggcccggtgaccgatcccagcaagctgcccaagtggaactacgacggctccagcacgggccaggcccccggcgaggacagcgaggtcatcctgtacccgcaggccatcttcaaggacccattcaggaggggcaacaacatccttgtgatgtgcgattgctacaccccagccggcgagccaatccccaccaacaagaggtacaacgccgccaagatcttcagcagccctgaggtcgccgccgaggagccgtggtatggtattgagcaggagtacaccctcctccagaaggacaccaactggccccttgggtggcccatcggtggcttccccggccctcagggtccttactactgtggaatcggcgccgaaaagtcgttcggccgcgacatcgtggacgcccactacaaggcctgcttgtatgcgggcatcaacatcagtggcatcaacggggaggtgatgccagggcagtgggagttccaagtcgggccttccgtgggtatttcttcaggcgaccaggtctgggtcgctcgctacattcttgagaggatcacggagatcgccggtgtggtggtgacgttcgacccgaagccgatcccgggcgactggaacggcgccggcgcgcacaccaactacagcacggagtcgatgaggaaggagggcgggtacgaggtgatcaaggcggccatcgagaagctgaagctgcggcacagggagcacatcgcggcctacggcgagggcaacgagcgccggctcaccggcaggcacgagaccgccgacatcaacacgttcagctggggcgtggccaaccgcggcgcgtcggtgcgcgtgggccgggagacggagcagaacggcaagggctacttcgaggaccgccgcccggcgtccaacatggacccctacgtggtcacctccatgatcgccgagaccaccatcatctggaagccctga

SEQ ID NO: 2394 - protein, 356 aa, Zea mays
MACLTDLVNLNLSDNTEKIIAEYIWIGGSGMDLRSKARTLSGPVTDPSKLPKWNYDGSSTGQAPGEDSEVILYPQAIFKDPFRRGNNILVMCDCYTPAGEPIPTNKRYNAAKIFSSPEVAAEEPWYGIEQEYTLLQKDTNWPLGWPIGGFPGPQGPYYCGIGAEKSFGRDIVDAHYKACLYAGINISGINGEVMPGQWEFQVGPSVGISSGDQVWVARYILERITEIAGVVVTFDPKPIPGDWNGAGAHTNYSTESMRKEGGYEVIKAAIEKLKLRHREHIAAYGEGNERRLTGRHETADINTFSWGVANRGASVRVGRETEQNGKGYFEDRRPASNMDPYVVTSMIAETTIIWKP

SEQ ID NO: 2395 - DNA, 24 bp, Artificial sequence
  primer
atggctgaagcaagcatcgaaaag

SEQ ID NO: 2396 - DNA, 27 bp, Artificial sequence
  primer
ttatgaagattctctttcaaattcctt

SEQ ID NO: 2397 - protein, 377 aa, Artificial sequence
  consensus sequence
  Variant (2)..(5): Xaa in position 2 to 5 is any amino acid
  Variant (6)..(16): Xaa in position 6 to 16 is any or no amino acid
  Variant (18)..(19): Xaa in position 18 to 19 is any amino acid
  Variant (25)..(26): Xaa in position 25 to 26 is any amino acid
  Variant (28)..(28): Xaa in position 28 is any amino acid
  Variant (30)..(31): Xaa in position 30 to 31 is any amino acid
  Variant (32)..(34): Xaa in position 32 to 34 is any or no amino acid
  Variant (38)..(38): Xaa in position 38 is any amino acid
  Variant (41)..(47): Xaa in position 41 to 47 is any amino acid
  Variant (48)..(52): Xaa in position 48 to 52 is any or no amino acid
  Variant (55)..(55): Xaa in position 55 is any amino acid
  Variant (58)..(58): Xaa in position 58 is any amino acid
  Variant (64)..(64): Xaa in position 64 is any amino acid
  Variant (69)..(69): Xaa in position 69 is any amino acid
  Variant (72)..(72): Xaa in position 72 is any amino acid
  Variant (74)..(74): Xaa in position 74 is any amino acid
  Variant (76)..(76): Xaa in position 76 is any amino acid
  Variant (78)..(78): Xaa in position 78 is any amino acid
  Variant (80)..(82): Xaa in position 80 to 82 is any amino acid
  Variant (87)..(87): Xaa in position 87 is any amino acid
  Variant (89)..(89): Xaa in position 89 is any amino acid
  Variant (94)..(94): Xaa in position 94 is any amino acid
  Variant (96)..(97): Xaa in position 96 to 97 is any amino acid
  Variant (99)..(99): Xaa in position 99 is any amino acid
  Variant (101)..(101): Xaa in position 101 is any amino acid
  Variant (102)..(111): Xaa in position 102 to 111 is any or no amino acid
  Variant (113)..(113): Xaa in position 113 is any amino acid
  Variant (115)..(117): Xaa in position 115 to 117 is any amino acid
  Variant (119)..(119): Xaa in position 119 is any amino acid
  Variant (121)..(122): Xaa in position 121 to 122 is any amino acid
  Variant (125)..(129): Xaa in position 125 to 129 is any amino acid
  Variant (130)..(137): Xaa in position 130 to 137 is any or no amino acid
  Variant (139)..(139): Xaa in position 139 is any amino acid
  Variant (141)..(141): Xaa in position 141 is any amino acid
  Variant (148)..(152): Xaa in position 148 to 152 is any amino acid
  Variant (153)..(154): Xaa in position 153 to 154 is any or no amino acid
  Variant (156)..(156): Xaa in position 156 is any amino acid
  Variant (160)..(160): Xaa in position 160 is any amino acid
  Variant (163)..(163): Xaa in position 163 is any amino acid
  Variant (173)..(174): Xaa in position 173 to 174 is any amino acid
  Variant (176)..(177): Xaa in position 176 to 177 is any amino acid
  Variant (179)..(180): Xaa in position 179 to 180 is any amino acid
  Variant (181)..(182): Xaa in position 181 to 182 is any or no amino acid
  Variant (187)..(189): Xaa in position 187 to 189 is any amino acid
  Variant (192)..(192): Xaa in position 192 is any amino acid
  Variant (204)..(204): Xaa in position 204 is any amino acid
  Variant (206)..(206): Xaa in position 206 is any amino acid
  Variant (215)..(215): Xaa in position 215 is any amino acid
  Variant (220)..(221): Xaa in position 220 to 221 is any amino acid
  Variant (223)..(229): Xaa in position 223 to 229 is any amino acid
  Variant (231)..(233): Xaa in position 231 to 233 is any amino acid
  Variant (235)..(236): Xaa in position 235 to 236 is any amino acid
  Variant (238)..(239): Xaa in position 238 to 239 is any amino acid
  Variant (242)..(242): Xaa in position 242 is any amino acid
  Variant (244)..(244): Xaa in position 244 is any amino acid
  Variant (246)..(247): Xaa in position 246 to 247 is any amino acid
  Variant (249)..(250): Xaa in position 249 to 250 is any amino acid
  Variant (253)..(256): Xaa in position 253 to 256 is any amino acid
  Variant (261)..(262): Xaa in position 261 to 262 is any amino acid
  Variant (264)..(264): Xaa in position 264 is any amino acid
  Variant (271)..(271): Xaa in position 271 is any amino acid
  Variant (273)..(273): Xaa in position 273 is any amino acid
  Variant (275)..(275): Xaa in position 275 is any amino acid
  Variant (278)..(279): Xaa in position 278 to 279 is any amino acid
  Variant (282)..(283): Xaa in position 282 to 283 is any amino acid
  Variant (284)..(284): Xaa in position 284 is any or no amino acid
  Variant (287)..(289): Xaa in position 287 to 289 is any amino acid
  Variant (290)..(290): Xaa in position 290 is any or no amino acid
  Variant (292)..(293): Xaa in position 292 to 293 is any amino acid
  Variant (296)..(297): Xaa in position 296 to 297 is any amino acid
  Variant (299)..(300): Xaa in position 299 to 300 is any amino acid
  Variant (301)..(301): Xaa in position 301 is any or no amino acid
  Variant (303)..(304): Xaa in position 303 to 304 is any amino acid
  Variant (307)..(308): Xaa in position 307 to 308 is any amino acid
  Variant (311)..(311): Xaa in position 311 is any amino acid
  Variant (315)..(315): Xaa in position 315 is any amino acid
  Variant (320)..(320): Xaa in position 320 is any amino acid
  Variant (325)..(325): Xaa in position 325 is any amino acid
  Variant (327)..(328): Xaa in position 327 to 328 is any amino acid
  Variant (330)..(331): Xaa in position 330 to 331 is any amino acid
  Variant (338)..(338): Xaa in position 338 is any amino acid
  Variant (340)..(340): Xaa in position 340 is any amino acid
  Variant (343)..(343): Xaa in position 343 is any amino acid
  Variant (345)..(349): Xaa in position 345 to 349 is any amino acid
  Variant (351)..(351): Xaa in position 351 is any amino acid
  Variant (355)..(355): Xaa in position 355 is any amino acid
  Variant (364)..(364): Xaa in position 364 is any amino acid
  Variant (367)..(367): Xaa in position 367 is any amino acid
  Variant (369)..(369): Xaa in position 369 is any amino acid
  Variant (372)..(376): Xaa in position 372 to 376 is any amino acid
LXXXXXXXXXXXXXXXKXXAEYIWXXGXGXXXXXRSKXRTXXXXXXXXXXXXLPXWNXDGSSTXQAPGXDSXVXLXPXAXXXDPFRXGXNILVXCXXYXPXXXXXXXXXXXGXPXXXNXRXXAAXXXXXXXXXXXXXWXGXEQEYTLXXXXXXXPXGWPXGGXPGPQGPYYCXXGXXKXXXXGRDIXXXHYXACLYAGINISGXNXEVMPGQWEXQVGPXXGXXXXXXXIXXXDXXWXXRYXLXRXXEXXGVXXXXDPKPXXGXDWNGAGXHXNXSTXXMRXXXGGXXXXIXXAIXXLXXXHXXHIXXYGXGNEXRLTGXHETAXIXXFXXGVANRGXSXRVXRXXXXXGXKGYXEDRRPASNXDPXYXVTXXXXXT

SEQ ID NO: 2398 - protein, 41 aa, Artificial sequence
  protein pattern
  Variant (2)..(5): Xaa in position 2 to 5 is any or no amino acid
  Variant (8)..(8): Xaa in position 8 is Phe, Ile, Leu, Met or Val
  Variant (9)..(9): Xaa in position 9 is any amino acid
  Variant (10)..(10): Xaa in position 10 is Asp or Glu
  Variant (11)..(11): Xaa in position 11 is Ala, Gly or Ser
  Variant (14)..(14): Xaa in position 14 is Lys or Arg
  Variant (17)..(17): Xaa in position 17 is Ile, Leu or Val
  Variant (18)..(18): Xaa in position 18 is Phe, His or Tyr
  Variant (19)..(19): Xaa in position 19 is Ala or Ser
  Variant (21)..(21): Xaa in position 21 is Phe, Ile, Leu or Val
  Variant (22)..(22): Xaa in position 22 is any amino acid
  Variant (23)..(23): Xaa in position 23 is Ile or Val
  Variant (24)..(24): Xaa in position 24 is Gly or Ser
  Variant (26)..(27): Xaa in position 26 to 27 is any amino acid
  Variant (28)..(28): Xaa in position 28 is Ala, Gly or Pro
  Variant (31)..(31): Xaa in position 31 is Leu or Met
  Variant (33)..(33): Xaa in position 33 is Ala, Gly or Ser
  Variant (36)..(36): Xaa in position 36 is Glu or Gly
  Variant (37)..(37): Xaa in position 37 is Phe or Tyr
  Variant (39)..(39): Xaa in position 39 is Ile or Val
  Variant (40)..(40): Xaa in position 40 is Gly or Ser
  Variant (41)..(41): Xaa in position 41 is Pro or Ser
GXXXXRDXXXXHYXACXXXGXXXXGXXXEVXPXQWXXQXXX

SEQ ID NO: 2399 - protein, 27 aa, Artificial sequence
  protein pattern
  Variant (4)..(4): Xaa in position 4 is His, Lys or Arg
  Variant (8)..(8): Xaa in position 8 is Ala or Gly
  Variant (9)..(10): Xaa in position 9 to 10 is any amino acid
  Variant (11)..(11): Xaa in position 11 is Asp, Gly, Asn, Ser or Thr
  Variant (12)..(12): Xaa in position 12 is any amino acid
  Variant (14)..(15): Xaa in position 14 to 15 is any amino acid
  Variant (19)..(19): Xaa in position 19 is Asp or Asn
  Variant (22)..(22): Xaa in position 22 is Ala, Cys, Gly or Ser
  Variant (24)..(24): Xaa in position 24 is Ile or Val
  Variant (26)..(26): Xaa in position 26 is Ile or Val
  Variant (27)..(27): Xaa in position 27 is Gly or Pro
LTGXHETXXXXXFXXGVAXRGXSXRXX

SEQ ID NO: 2400 - protein, 20 aa, Artificial sequence
  protein pattern
  Variant (3)..(3): Xaa in position 3 is any amino acid
  Variant (12)..(13): Xaa in position 12 to 13 is any amino acid
  Variant (15)..(16): Xaa in position 15 to 16 is any amino acid
  Variant (17)..(17): Xaa in position 17 is Ile or Val
  Variant (19)..(19): Xaa in position 19 is any amino acid
  Variant (20)..(20): Xaa in position 20 is Ile, Leu, Met or Val
GYXEDRRPASNXXPXXXTXX

SEQ ID NO: 2401 - protein, 20 aa, Artificial sequence
  protein pattern
  Variant (3)..(3): Xaa in position 3 is Glu, His or Lys
  Variant (6)..(6): Xaa in position 6 is Phe or Tyr
  Variant (12)..(15): Xaa in position 12 to 15 is any or no amino acid
  Variant (17)..(17): Xaa in position 17 is any amino acid
  Variant (18)..(18): Xaa in position 18 is Ala, Asp or Asn
  Variant (20)..(20): Xaa in position 20 is Asp or Glu
LPXWNXDGSSTXXXXGXXSX

SEQ ID NO: 2402 - protein, 11 aa, Artificial sequence
  protein pattern
  Variant (2)..(2): Xaa in position 2 is Phe or Tyr
  Variant (4)..(4): Xaa in position 4 is Ala or Gly
  Variant (11)..(11): Xaa in position 11 is Cys or Thr
GXPXPQGPYYX

SEQ ID NO: 2403 - protein, 12 aa, Artificial sequence
  protein pattern
  Variant (2)..(2): Xaa in position 2 is Phe or Tyr
  Variant (4)..(4): Xaa in position 4 is Ile or Leu
  Variant (11)..(11): Xaa in position 11 is Phe, Leu or Met
  Variant (12)..(12): Xaa in position 12 is Asp or Gln
WXGXEQEYTLXX

SEQ ID NO: 2404 - protein, 27 aa, Artificial sequence
  protein pattern
  Variant (2)..(2): Xaa in position 2 is any amino acid
  Variant (3)..(3): Xaa in position 3 is Ile, Leu or Val
  Variant (5)..(5): Xaa in position 5 is any or no amino acid
  Variant (7)..(7): Xaa in position 7 is any or no amino acid
  Variant (9)..(9): Xaa in position 9 is Phe, Trp or Tyr
  Variant (10)..(10): Xaa in position 10 is Phe, Ile, Leu or Val
  Variant (12)..(12): Xaa in position 12 is any amino acid
  Variant (14)..(14): Xaa in position 14 is any amino acid
  Variant (15)..(15): Xaa in position 15 is Ala, Cys, Gly, Ser or Thr
  Variant (17)..(18): Xaa in position 17 to 18 is any amino acid
  Variant (19)..(19): Xaa in position 19 is Ala, Asp, Glu or Gly
  Variant (20)..(21): Xaa in position 20 to 21 is any amino acid
  Variant (22)..(22): Xaa in position 22 is Ala, Ile, Leu, Pro or Val
  Variant (23)..(23): Xaa in position 23 is Glu, Asn, Ser or Thr
  Variant (24)..(25): Xaa in position 24 to 25 is any amino acid
  Variant (26)..(26): Xaa in position 26 is Cys or Pro
DXXWXAXRXXLXRXXEXXXXXXXXXXK

SEQ ID NO: 2405 - protein, 13 aa, Artificial sequence
  protein pattern
  Variant (2)..(2): Xaa in position 2 is any or no amino acid
  Variant (6)..(6): Xaa in position 6 is Ile or Val
  Variant (8)..(8): Xaa in position 8 is any amino acid
  Variant (9)..(11): Xaa in position 9 to 11 is any or no amino acid
  Variant (13)..(13): Xaa in position 13 is Gly, Asn, Ser, Thr or Val
IXAEYXWXXXXGX

SEQ ID NO: 2406 - DNA, 2283 bp, Escherichia coli
  CDS (1)..(2283): transl_table=11
atgtccgagcttaatgaaaagttagccacagcctgggaaggttttaccaaaggtgactggcagaatgaagtaaacgtccgtgacttcattcagaaaaactacactccgtacgagggtgacgagtccttcctggctggcgctactgaagcgaccaccaccctgtgggacaaagtaatggaaggcgttaaactggaaaaccgcactcacgcgccagttgactttgacaccgctgttgcttccaccatcacctctcacgacgctggctacatcaacaagcagcttgagaaaatcgttggtctgcagactgaagctccgctgaaacgtgctcttatcccgttcggtggtatcaaaatgatcgaaggttcctgcaaagcgtacaaccgcgaactggatccgatgatcaaaaaaatcttcactgaataccgtaaaactcacaaccagggcgtgttcgacgtttacactccggacatcctgcgttgccgtaaatctggtgttctgaccggtctgccagatgcatatggccgtggccgtatcatcggtgactaccgtcgcgttgcgctgtacggtatcgactacctgatgaaagacaaactggcacagttcacttctctgcaggctgatctggaaaacggcgtaaacctggaacagactatccgtctgcgcgaagaaatcgctgaacagcaccgcgctctgggtcagatgaaagaaatggctgcgaaatacggctacgacatctctggtccggctaccaacgctcaggaagctatccagtggacttacttcggctacctggctgctgttaagtctcagaacggtgctgcaatgtccttcggtcgtacctccaccttcctggatgtgtacatcgaacgtgacctgaaagctggcaagatcaccgaacaagaagcgcaggaaatggttgaccacctggtcatgaaactgcgtatggttcgcttcctgcgtactccggaatacgatgaactgttctctggcgacccgatctgggcaaccgaatctatcggtggtatgggcctcgacggtcgtaccctggttaccaaaaacagcttccgtttcctgaacaccctgtacaccatgggtccgtctccggaaccgaacatgaccattctgtggtctgaaaaactgccgctgaacttcaagaaattcgccgctaaagtgtccatcgacacctcttctctgcagtatgagaacgatgacctgatgcgtccggacttcaacaacgatgactacgctattgcttgctgcgtaagcccgatgatcgttggtaaacaaatgcagttcttcggtgcgcgtgcaaacctggcgaaaaccatgctgtacgcaatcaacggcggcgttgacgaaaaactgaaaatgcaggttggtccgaagtctgaaccgatcaaaggcgatgtcctgaactatgatgaagtgatggagcgcatggatcacttcatggactggctggctaaacagtacatcactgcactgaacatcatccactacatgcacgacaagtacagctacgaagcctctctgatggcgctgcacgaccgtgacgttatccgcaccatggcgtgtggtatcgctggtctgtccgttgctgctgactccctgtctgcaatcaaatatgcgaaagttaaaccgattcgtgacgaagacggtctggctatcgacttcgaaatcgaaggcgaatacccgcagtttggtaacaatgatccgcgtgtagatgacctggctgttgacctggtagaacgtttcatgaagaaaattcagaaactgcacacctaccgtgacgctatcccgactcagtctgttctgaccatcacttctaacgttgtgtatggtaagaaaacgggtaacaccccagacggtcgtcgtgctggcgcgccgttcggaccgggtgctaacccgatgcacggtcgtgaccagaaaggtgcagtagcctctctgacttccgttgctaaactgccgtttgcttacgctaaagatggtatctcctacaccttctctatcgttccgaacgcactgggtaaagacgacgaagttcgtaagaccaacctggctggtctgatggatggttacttccaccacgaagcatccatcgaaggtggtcagcacctgaacgttaacgtgatgaaccgtgaaatgctgctcgacgcgatggaaaacccggaaaaatatccgcagctgaccatccgtgtatctggctacgcagtacgtttcaactcgctgactaaagaacagcagcaggacgttattactcgtaccttcactcaatctatgtaa

SEQ ID NO: 2407 - protein, 760 aa, Escherichia coli
MSELNEKLATAWEGFTKGDWQNEVNVRDFIQKNYTPYEGDESFLAGATEATTTLWDKVMEGVKLENRTHAPVDFDTAVASTITSHDAGYINKQLEKIVGLQTEAPLKRALIPFGGIKMIEGSCKAYNRELDPMIKKIFTEYRKTHNQGVFDVYTPDILRCRKSGVLTGLPDAYGRGRIIGDYRRVALYGIDYLMKDKLAQFTSLQADLENGVNLEQTIRLREEIAEQHRALGQMKEMAAKYGYDISGPATNAQEAIQWTYFGYLAAVKSQNGAAMSFGRTSTFLDVYIERDLKAGKITEQEAQEMVDHLVMKLRMVRFLRTPEYDELFSGDPIWATESIGGMGLDGRTLVTKNSFRFLNTLYTMGPSPEPNMTILWSEKLPLNFKKFAAKVSIDTSSLQYENDDLMRPDFNNDDYAIACCVSPMIVGKQMQFFGARANLAKTMLYAINGGVDEKLKMQVGPKSEPIKGDVLNYDEVMERMDHFMDWLAKQYITALNIIHYMHDKYSYEASLMALHDRDVIRTMACGIAGLSVAADSLSAIKYAKVKPIRDEDGLAIDFEIEGEYPQFGNNDPRVDDLAVDLVERFMKKIQKLHTYRDAIPTQSVLTITSNVVYGKKTGNTPDGRRAGAPFGPGANPMHGRDQKGAVASLTSVAKLPFAYAKDGISYTFSIVPNALGKDDEVRKTNLAGLMDGYFHHEASIEGGQHLNVNVMNREMLLDAMENPEKYPQLTIRVSGYAVRFNSLTKEQQQDVITRTFTQSM

SEQ ID NO: 2408 - DNA, 2232 bp, Clostridium difficile 630
  CDS (1)..(2232): transl_table=11
atgaatgcatggcaaggatttaaaacaggaagatggactaaagaaataaatgttagagagtttatacaattaaactattctccatatgagggaaatgactctttcttagctggtgccactgaaaatactaaaaaattatgggacgaagcaatggtcctatttaaaaaagaaagagaaaatggtggtactttagatgttgatacaaaaactgtttctggaatagctgcatatgctccaggatatttagataaagaattagaaacaatagttgggttacaaacggatgcccctttaaaaagagctgtcatgccatatggtggtataaagatggttgaaaattcatgcgaagcttttggatatgaattagacccagaaataaaagatatatttactaaatacagaaaaacacacaaccaaggagtttttgacgtttatactccagaaatgagagctgctagaaaatctggtataataacaggtcttccagatgcttatggtagaggtagaataattggtgactacagaagagttgctctatacggtgttgatgctttaatagaagataaaaatgagcaaaaaaaatcattagaagtttcttgcatggatgaggaagttatcagattaagagaagaaataactgagcaaatatcagctttaaatgaacttaaaaaaatggctgaatcttatggatttgatatctcaaaaccagcaactaactcaaaagaagctgtacaatggttatactttggttatttaggtgctgttaaagaccaaaatggtgctgcaatgtctttaggtagaacatctactttcttagatatatactttgaaagagatttaaaagctggaatcgtaacagaagaagaattacaagagtatatggaccattttgttatgaaattaagaatggttaagttcctaagaactcctgattacaataacctattctctggagacccaacttgggtaactgagtgtataggaggtatgggaatagatggtagaacattagttactaaaaactcatttagaatgttaaatactctatatacattaggaccttctccagaaccaaacttaacagttctatggtcaactaaattacctcaaggattcaaagatttctgttctaaagtatctatagatacaagttcagtacagtatgaaaatgatgatttaatgagagcatactggggagatgactatggtatagcttgttgtgtatctgcaatgagaattggtaaacaaatgcagttctttggagctagagttaacttagctaaaactttattatacgctataaatggtggtgtagatgagaaatctggtgttcaagttggaccaagatttgaacctataacttctgagtacttagattatgatgaagttatgagtaaatttgaaccattcactgattggttagcaacattatatgtaaatactttaaatgtaatacattatatgcatgataaatattcttatgaagcattagaaatggcattacatgatagagatatatttagaactatggcttgtggtatggctggattatcagtttgtgcagactcattatctgctataaaacatgctaaggttaaaactattagaaatgaacaaggaatagctgttgattttgaaatagaaggagattatccaaaatacggaaataatgatgatagagttgatagtatagctgtagagttagttgaaagctttatgaataaaataagaaagaataaaacttatagaaattcttatccaactcaatctatacttacaataacttcaaatgttgtttatggtaagaaaactggtaatacaccagatggtagaagagctggtgctccatttgctcctggtgctaacccaatgcatggtagagatactaatggtgctttagcttcattatcttcagttgctaaattaccatatgaacatgctcaagatggtatatctaatactttctctatagtacctgctgctttaggaaaagatatgactgaaagaataaacaatctttctgcaatgatggatggatacttcgctcaaaatgctcatcacttaaatgtaaatgtatttgatagagctactttagaagatgctatggaacatccagaagaatatccacaattaactataagagtatctggatatgcagttaacttcataaaattaactaaagagcaacaattagatgttataaacagaacattccacggtaaaatggcttag

SEQ ID NO: 2409 - protein, 743 aa, Clostridium difficile 630
MNAWQGFKTGRWTKEINVREFIQLNYSPYEGNDSFLAGATENTKKLWDEAMVLFKKERENGGTLDVDTKTVSGIAAYAPGYLDKELETIVGLQTDAPLKRAVMPYGGIKMVENSCEAFGYELDPEIKDIFTKYRKTHNQGVFDVYTPEMRAARKSGIITGLPDAYGRGRIIGDYRRVALYGVDALIEDKNEQKKSLEVSCMDEEVIRLREEITEQISALNELKKMAESYGFDISKPATNSKEAVQWLYFGYLGAVKDQNGAAMSLGRTSTFLDIYFERDLKAGIVTEEELQEYMDHFVMKLRMVKFLRTPDYNNLFSGDPTWVTECIGGMGIDGRTLVTKNSFRMLNTLYTLGPSPEPNLTVLWSTKLPQGFKDFCSKVSIDTSSVQYENDDLMRAYWGDDYGIACCVSAMRIGKQMQFFGARVNLAKTLLYAINGGVDEKSGVQVGPRFEPITSEYLDYDEVMSKFEPFTDWLATLYVNTLNVIHYMHDKYSYEALEMALHDRDIFRTMACGMAGLSVCADSLSAIKHAKVKTIRNEQGIAVDFEIEGDYPKYGNNDDRVDSIAVELVESFMNKIRKNKTYRNSYPTQSILTITSNVVYGKKTGNTPDGRRAGAPFAPGANPMHGRDTNGALASLSSVAKLPYEHAQDGISNTFSIVPAALGKDMTERINNLSAMMDGYFAQNAHHLNVNVFDRATLEDAMEHPEEYPQLTIRVSGYAVNFIKLTKEQQLDVINRTFHGKMA

SEQ ID NO: 2410 - DNA, 2364 bp, Vibrio cholerae O1 biovar eltor str. N16961
  CDS (1)..(2364): transl_table=11
ttgaagagtgtactgctcccttcggggatagctggctcaacggcgaaaacagtacgtgttttttctactcataaaggtaggtatgtcatggcagagcaatttgctaaagcttgggaaggttttgcggcaggtgactggcaaaacgaagttaacgttcgtgattttattcaaaagaactacacaccgtacgaaggcgacgaatctttcctagtctcagaaggtactgaagcgaccaacaagctttgggctaaagtaatggaaggtatcagacaggaaaactcaactcacgctcctgttgacttcgacacttctcttatctctaccatcacagctcacgacgctggctacatcaacaaagatcttgaaaagatcgttggtctacaaaccgatgctccactgaaacgtgcaatcatccctaatggtggtatccgtatggtggaaggttcatgcaaagcatacggtcgtgaactggatccacaagtttcaaaaatctactctgaataccgcaaaacgcacaacgccggtgtattcgacatctacactccagaaattctggcttgtcgtaaatctggcgttctgactggtcttccagatgcttacggccgtggtcgtatcatcggtgactaccgtcgtgtagcgttgtacggtatcgacttcctgatgaaagacaaactggctcagttcaagtctctgcaggaaaaatttgaaaacggcgaagatctgcaaatgaccatgcaactgcgtgaagaaattgcagaacaacaccgtgcgcttggccaaatgaaacagatggctgcgaaatacggttacgatatttctcgccctgctgaaacggcacaagaagcaatccaatggacttacttcggctacctagcggcagtgaaatctcaaaacggtgctgcaatgtctcttggccgtacctctactttcttggacgtgtacattgagcgcgacatgaaagccggcaagatcactgaagtagaagctcaggaaatgatcgaccacttcgtcatgaagctgcgtatggttcgtttcctacgtactcctgagtacgatgagctgttttctggtgacccaatttgggcaaccgaatctatgggtggtatgggtctagacggtcgtacgctggtaacacgtactaacttccgcttcctgaactcactgtacaccatgggtccatctccagagccaaacatcactgtcctgtggtcagagcaactgcctgaaggcttcaagaagttctgtgcgaaagtgtctatcgatacctcgtctatccagtacgaaaacgatgacttgatgcgtcctgacttcaacaatgatgactacgctatcgcatgttgtgtatcaccaatggttattggtaaacacatgcagttcttcggtgctcgcgctaaccttgctaaaacgctgctgtatgtaatcaacggtggtgtggatgagaaactgaaaatccaagtgggtccaaaaatgcctaagatcaccgacgaagtgctcgacttcgacgatgtatggggcaagctggatcacttcatgggttggctggcaacacaatacgtcactgcactgaatgccatccactacatgcatgacaagtacagctacgaagcggctctaatggcgctgcatgaccgtgatgtacgtcgtactatggcgtgtggtatcgcaggtctgtctgtagcggctgactcactgtctgctatcaagtacgcgaaagtaaaaccaattcgtgacgaagatggtgtagctatcgattttgaaattgaaggcgactatccaaaattcggtaacaacgattcacgcgttgatgacatcgcctgtgaactggttgagcgtttcatgaacaagatccgttcactgaaaacttaccgtaacgcagtaccaactcagtctatcctgactatcacgtcaaacgtggtatacggcaagaagacaggtaacacgccagacggtcgccgtgcaggtgcgccatttgcaccgggtgcaaacccaatgcacggccgtgacgagaaaggggcggtagcgtctctgacttccgtcggtaaactgccatttgctcacgcgaaagacggtatctcttataccttctctatcgtgccaaatgcactgggtaaagatgagaactcacagcgtgcgaacctagctggcttgatggacggttacttccaccacgaagcaggcatcgagggtggtcaacacctgaacgttaacgttctgaaccgtgacactctgcttgatgcagttaagcatccagagaagtacccacaactgactatccgtgtatctggatatgcagtgcgctttaactctctgactgctgaacaacaacaagacgttattgctcgtactttcactgaatctctataa

SEQ ID NO: 2411 - protein, 787 aa, Vibrio cholerae O1 biovar eltor str. N16961
MKSVLLPSGIAGSTAKTVRVFSTHKGRYVMAEQFAKAWEGFAAGDWQNEVNVRDFIQKNYTPYEGDESFLVSEGTEATNKLWAKVMEGIRQENSTHAPVDFDTSLISTITAHDAGYINKDLEKIVGLQTDAPLKRAIIPNGGIRMVEGSCKAYGRELDPQVSKIYSEYRKTHNAGVFDIYTPEILACRKSGVLTGLPDAYGRGRIIGDYRRVALYGIDFLMKDKLAQFKSLQEKFENGEDLQMTMQLREEIAEQHRALGQMKQMAAKYGYDISRPAETAQEAIQWTYFGYLAAVKSQNGAAMSLGRTSTFLDVYIERDMKAGKITEVEAQEMIDHFVMKLRMVRFLRTPEYDELFSGDPIWATESMGGMGLDGRTLVTRTNFRFLNSLYTMGPSPEPNITVLWSEQLPEGFKKFCAKVSIDTSSIQYENDDLMRPDFNNDDYAIACCVSPMVIGKHMQFFGARANLAKTLLYVINGGVDEKLKIQVGPKMPKITDEVLDFDDVWGKLDHFMGWLATQYVTALNAIHYMHDKYSYEAALMALHDRDVRRTMACGIAGLSVAADSLSAIKYAKVKPIRDEDGVAIDFEIEGDYPKFGNNDSRVDDIACELVERFMNKIRSLKTYRNAVPTQSILTITSNVVYGKKTGNTPDGRRAGAPFAPGANPMHGRDEKGAVASLTSVGKLPFAHAKDGISYTFSIVPNALGKDENSQRANLAGLMDGYFHHEAGIEGGQHLNVNVLNRDTLLDAVKHPEKYPQLTIRVSGYAVRFNSLTAEQQQDVIARTFTESL

SEQ ID NO: 2412 - DNA, 2331 bp, Pasteurella multocida subsp. multocida str. Pm70
  CDS (1)..(2331): transl_table=11
ttgagtatgagtcaattaaatgaaactcaacaaaaggcttgggaagggtttaccggtggagactggcaaacagaagtgaatgtacgcgattttattcaaaaaaactatacaccttatgaaggggatgagtctttcttagccgatgccacagaagccacaacaaaattgtggaatgatgtgatggaaaaaatcaaagtggaaaataaaacccacgagccgtatgacattgattgcgatacgccgtcaacaatcacttcacatgcgccgggttatattgataaaagcttagagaaaattgttggcttgcaaacagatgcacctttaaaacgtgcgattatgccgtttggtggtatcaacatggtgaaaggttcttgtaaagtttatcgccgtgaactaaaaccagaagtcgagcaaatctttactgaataccgtaaaacccacaaccaaggtgtatttgatgtttatactcccgatattttacgttgccgtaaatctggggtaatcacagggcttccggatgcttatggtcgtggtcgtattattggtgactatcgtcgtatggctctgtatggtgcagacttcttaatgaaagataaatttaaccaatttacgtcattacaagacaaactagagcgtggcgaagatatccaagcaacgattcaattacgtgaagaaattgcggaacaacaccgtgctttaggcaaaatgaaagaaatggcggcttcttacggttacgatatttcgggtccagcgactaacgcacatgaagcggtacaatggacttactttgcttatcttgctgcagtgaaatcgcaaaacggtgccgccatgtcatttggtcgtgtatcgactttcttggatatttatattgagcgtgatttaaaagcaggcaaaattacagaacaagaagcacaagaattaattgaccacttagtcatgaaattacgtatggtgcgtttcttacgtaccccagagtacgatcaattattctcgggcgacccaatgtgggcaacggaaaccttagcgggtatgggcttagatggtcgtactttagtaaccaaaaacagcttccgtatcttacacaccctttatacgatgggaccgtcaccagagccaaacttaacgattctttggtctgaaaaattaccagaaggtttcaaacgttatgcggcaaaagtgtctatcgatacgtcttctgttcagtatgaaaacgatgacttaatgcgtcctgacttccaaaacgatgactatgcgattgcatgctgcgtgtcgccaatgatcgtgggtaaaatgatgcaattcttcggtgcacgtgcaaacttagcgaaaaccttgttatacgcaatcaatggcggtgtggatgagaaatcaggtgaccaagtaggaccgaaaaccgatccaattaccagcgaatacttagattatgatgatgtcatgacgcgcttagacagctttatggattggttagcgaaacaatatgttactgcattgaacatcattcactttatgcacgataaatacgcgtatgaagccgcactaatggcgcttcatgatcgtgatgtattccgtactatggcttgtggtatcgcagggctttctgtcgcagcggactctttatctgccattaaatatgcgaaagtgaaaccagttcgtggtgatatcgaaatcaaaaataaagcgggtgaagtggttggtattgcaaaagatgtggcaatcgactttgaaattgaaggcgaatatccacaattcggtaacaacgataaccgtgttgatgaaatcgcttgtgatttagttgaacgctttatgaagaaaatccaaaaattgggtacttatcgtaatgcgacaccgacacaatctgtacttactattacatctaacgtggtttatggtaagaaaacaggtaataccccagatggtcgtcgttctggtgcaccatttggaccgggtgcgaacccaatgcacggtcgtgaccaaaaaggtgcggtggcatcgttaacttctgttgcgaaattgccatttgcttatgcgaaagatggtatttcttataccttctcaatcgtaccaaatgccttaggtaaagattacgaagcacaaaaacgtaaccttgcaggtctaatggatggttacttccaccatgaagcaacgattgaaggcggacaacacttaaacgtgaacgtcatgaaccgtgaaatgttgttagatgcaatggaaaatccggagaaatatccacaattaaccattcgtgtttcgggttatgcagtacgctttaactcgttaaccaaagaacaacaacaagacgtgattacgcgtacctttactcaagcgatgtaa

SEQ ID NO: 2413 - protein, 776 aa, Pasteurella multocida subsp. multocida str. Pm70
MSMSQLNETQQKAWEGFTGGDWQTEVNVRDFIQKNYTPYEGDESFLADATEATTKLWNDVMEKIKVENKTHEPYDIDCDTPSTITSHAPGYIDKSLEKIVGLQTDAPLKRAIMPFGGINMVKGSCKVYRRELKPEVEQIFTEYRKTHNQGVFDVYTPDILRCRKSGVITGLPDAYGRGRIIGDYRRMALYGADFLMKDKFNQFTSLQDKLERGEDIQATIQLREEIAEQHRALGKMKEMAASYGYDISGPATNAHEAVQWTYFAYLAAVKSQNGAAMSFGRVSTFLDIYIERDLKAGKITEQEAQELIDHLVMKLRMVRFLRTPEYDQLFSGDPMWATETLAGMGLDGRTLVTKNSFRILHTLYTMGPSPEPNLTILWSEKLPEGFKRYAAKVSIDTSSVQYENDDLMRPDFQNDDYAIACCVSPMIVGKMMQFFGARANLAKTLLYAINGGVDEKSGDQVGPKTDPITSEYLDYDDVMTRLDSFMDWLAKQYVTALNIIHFMHDKYAYEAALMALHDRDVFRTMACGIAGLSVAADSLSAIKYAKVKPVRGDIEIKNKAGEVVGIAKDVAIDFEIEGEYPQFGNNDNRVDEIACDLVERFMKKIQKLGTYRNATPTQSVLTITSNVVYGKKTGNTPDGRRSGAPFGPGANPMHGRDQKGAVASLTSVAKLPFAYAKDGISYTFSIVPNALGKDYEAQKRNLAGLMDGYFHHEATIEGGQHLNVNVMNREMLLDAMENPEKYPQLTIRVSGYAVRFNSLTKEQQQDVITRTFTQAM

SEQ ID NO: 2414 - DNA, 2325 bp, Streptococcus pneumoniae TIGR4
  CDS (1)..(2325): transl_table=11
atggttgttaagacagttgttgaagcacaagatatttttgacaaagcttgggaaggcttcaaaggcgtagattggaaagaaaaagcaagtgtatcacgatttgtacaagctaactacacaccttatgatggagacgaaagcttccttgcaggaccaacagagcgttcacttcacatcaagaaaattgtagaagaaactaaagcacactacgaagaaactcgtttcccaatggacactcgtccaacatctatcgctgatatccctgctggatttatcgacaaagaaaatgaagttatcttcggtatccaaaacgatgaactcttcaaattgaacttcatgccaaaaggtggtatccgtatggctgaaactactttgaaagaaaatggatacgaaccagacccagctgttcacgaaatcttcactaaatatgtaacaacagttaacgacggtattttccgtgcctacacttcaaatattcgtcgcgctcgtcacgcacacactgtaactggtcttccagatgcatactcacgcggacgtatcatcggtgtttacgcacgtcttgctctttacggtgcagactacttgatgcaagaaaaagtaaatgactggaatgcaatcaaagaaatcgatgaagaaacaatccgtcttcgtgaagaagtaaaccttcaataccaagcattgcaacaagttgttcgcctgggtgacctttacggggttgatgttcgcaaaccagcgatgaacgtgaaagaagcaatccaatgggttaacattgctttcatggctgtctgccgtgtgattaacggtgctgctacatctctaggtcgtgtaccaatcgtattggacatctttgcagaacgtgaccttgctcgtggtacatttactgaatcagaaatccaagaattcgttgatgatttcgttatgaaacttcgtacagttaaatttgctcgtacaaaagcttatgaccaattgtactcaggtgacccaacctttatcacaacttctatggctggtatgggtaacgacggtcgtcaccgtgttactaagatggactaccgtttcttgaacactcttgacaacatcggtaactcaccagaaccaaacttgacagttctttggactgacaaattgccatacaacttccgtcgctactgtatgcacatgagccacaaacactcttctatccaatacgaaggtgtaacaacaatggctaaagacggatatggtgaaatgagctgtatctcatgctgtgtgtctccacttgatccagaaaatgaagaacaacgccacaacatccagtacttcggtgctcgtgtaaacgttcttaaagcccttcttactggtttgaatggtggttacgacgatgttcacaaagactacaaagtatttgatatcgaaccaatccgtgacgaagttcttgaatttgaatcagttaaagcgaactttgaaaaatctcttgactggttgactgacacttacgtagatgccttgaacatcatccactacatgactgataggtacaactacgaagctgttcaaatggccttcttgccaactaaacaacgtgccaacatgggattcggtatctgtggatttgctaacactgttgatacattgtcagctatcaaatacgctacagttaaaccaatccgtgacgaagatggctacatctacgattacgaaacaatcggtgactacccacgctggggtgaagatgacccacgttcaaacgaattggcagaatggttgatcgaagcttacacaactcgtctacgtagccacaaactatacaaagacgcagaagctacagtatcacttttgacaatcacatctaacgttgcttactctaaacaaactggtaactcaccagttcacaaaggtgtatacctcaacgaagatggttctgtgaacttgtctaaacttgaattcttctcaccaggtgctaacccatctaacaaagctaaaggtggttggttgcaaaacttgaactcactttctagccttgactttagttatgcagctgacggtatctcattgactacacaagtatcacctcgcgctcttggtaagactcgtgatgaacaagttgataacttggtaacaattcttgatggttacttcgaaaacggtggacaacacgttaacttgaacgttatggacttgaacgatgtttacgaaaaaatcatgtcaggcgaagacgttatcgtacgtatctctggatactgtgtaaacactaaatacctcactccagaacaaaaaactgaattgacacaacgtgtcttccacgaagttctttcaatggatgacgccttggatgcattgagctaa

SEQ ID NO: 2415 - protein, 774 aa, Streptococcus pneumoniae TIGR4
MVVKTVVEAQDIFDKAWEGFKGVDWKEKASVSRFVQANYTPYDGDESFLAGPTERSLHIKKIVEETKAHYEETRFPMDTRPTSIADIPAGFIDKENEVIFGIQNDELFKLNFMPKGGIRMAETTLKENGYEPDPAVHEIFTKYVTTVNDGIFRAYTSNIRRARHAHTVTGLPDAYSRGRIIGVYARLALYGADYLMQEKVNDWNAIKEIDEETIRLREEVNLQYQALQQVVRLGDLYGVDVRKPAMNVKEAIQWVNIAFMAVCRVINGAATSLGRVPIVLDIFAERDLARGTFTESEIQEFVDDFVMKLRTVKFARTKAYDQLYSGDPTFITTSMAGMGNDGRHRVTKMDYRFLNTLDNIGNSPEPNLTVLWTDKLPYNFRRYCMHMSHKHSSIQYEGVTTMAKDGYGEMSCISCCVSPLDPENEEQRHNIQYFGARVNVLKALLTGLNGGYDDVHKDYKVFDIEPIRDEVLEFESVKANFEKSLDWLTDTYVDALNIIHYMTDRYNYEAVQMAFLPTKQRANMGFGICGFANTVDTLSAIKYATVKPIRDEDGYIYDYETIGDYPRWGEDDPRSNELAEWLIEAYTTRLRSHKLYKDAEATVSLLTITSNVAYSKQTGNSPVHKGVYLNEDGSVNLSKLEFFSPGANPSNKAKGGWLQNLNSLSSLDFSYAADGISLTTQVSPRALGKTRDEQVDNLVTILDGYFENGGQHVNLNVMDLNDVYEKIMSGEDVIVRISGYCVNTKYLTPEQKTELTQRVFHEVLSMDDALDALS

SEQ ID NO: 2416 - DNA, 2232 bp, Clostridium acetobutylicum ATCC 824
  CDS (1)..(2232): transl_table=11
atgattaaagaatggaacgattttaaagaaggtacatgggttaataatattgatgtaagaaattttatacaaaaaaattatacaccatacttaggaaacgaggattttttacaaggtgttactgatagaacaaagggtctttggaacaagtgcgagaaacttctcttagatgaaataaaaaatcaaggtatattaaaagcagataacaaaactgtatcaggaataaatagctttgaagctggatatatagataaagaaaatgagattatttatggacttcaaacagatgaaccacttaaaagaatggtaaatccttttggtggtataagaatggccaagcaagcattagaagcatatggatacgaaattgatgaggatgtatacaatatatttacaaagtataggaaaactcacaatgaaggtgtttttgatgcttacactgaagaaatgaaaacagctagacatgtaggattattaacaggacttcctgatgcgtatggaagaggtaggataataggagattttagaagagtagcactatatggtattgattgcttaattgaaaacaaaaaagctgatttaaaagaattaaaaggcgacatgactgaagatttaataagaagaagagaagaagtttctgaacagataaaggcgttaaaagaaatgaaagcaatggcattaaaatatggaatagatatatcaaaaccagcagctaattcaagacaagcagttcagtttacttaccttggatatcttgctggaataaaagaaaataatggagcagcgatgtctcttggaagagtttcaacatttttggacatatatatagaaagagatttaaaaaatggagtaataacagaaaaggaagctcaagaaattatagatcaatttataataaagttaagacttgaaagacatctaagaactccagagtacaatgaactatttgcaggtgatcctaattgggttactgagtctataggtggaatgggtatgaatggagaaaccttggttacaaaaaattcttttagatttcttcattcattaacaaatcttggacctgcacctgaacctaatatgactgttttgtggtcaaataatcttccagagccatttaagaaatactgttctaagatgtccataaaaacagatgcaattcaatatgaaaatgatgatataatgagacctatatatggtgatgattatggaatagcctgctgtgtatctgcaatgaagataggaaagcaaatgcaattctttggagctagatgtaaccttgcaaaatcattattgtatgctataaatggtggagtagatgaaaagaaatttgatttagtagttcctcacattaaaagaatagatgatgaagtgctagactatgataaggttaaggaaaactactttaaggttatgaaatatgtagctaaactatatgtaaatactcttaatttaatacactatatgcatgataaatatgcttatgagaaaggacttatggcgcttcatgatacagatgttcatagatttttggcttgtggagcagcaggactttctgtagcagttgattctttaagtgcaataaaatatgcaaaagtaaagcctattagaaatgaagatggaatagctgtagattttgaagtagaaggagatttccctaagtatggaaatgacgatgacagagttgatgatattgcagttgagatagtcaataaatttatgtcagagttaagaaagaccgctgcttatagaaatgcagaacatacattatcaatgttaactataacttcaaatgtaatgtatggtaagaaaacaggagcaacacctgatggaagaaagtctggagaggcatttgcaccaggagcaaatcctatgcatggaagagataaaaatggagcattggcatctttaaatagtgttgctaagattccatatagaagtgtatgtcaagatggagtttcaaatacattttcaattattccagatgcacttggaaagaatgaagaaacaagagcaaataatttatcagctattttagatggatattttgaaaagggagctcatcacttaaatgtaaatgtgcttaatcgtgaaactcttctagatgcaatggaaaatccagagaaatatcctacacttacaataagagtatcaggatatgcagttaactttgtaaaacttacaaaagaacagcaaatggaagttgttaagagaacattccacggaagaatgtag

SEQ ID NO: 2417 - protein, 743 aa, Clostridium acetobutylicum ATCC 824
MIKEWNDFKEGTWVNNIDVRNFIQKNYTPYLGNEDFLQGVTDRTKGLWNKCEKLLLDEIKNQGILKADNKTVSGINSFEAGYIDKENEIIYGLQTDEPLKRMVNPFGGIRMAKQALEAYGYEIDEDVYNIFTKYRKTHNEGVFDAYTEEMKTARHVGLLTGLPDAYGRGRIIGDFRRVALYGIDCLIENKKADLKELKGDMTEDLIRRREEVSEQIKALKEMKAMALKYGIDISKPAANSRQAVQFTYLGYLAGIKENNGAAMSLGRVSTFLDIYIERDLKNGVITEKEAQEIIDQFIIKLRLERHLRTPEYNELFAGDPNWVTESIGGMGMNGETLVTKNSFRFLHSLTNLGPAPEPNMTVLWSNNLPEPFKKYCSKMSIKTDAIQYENDDIMRPIYGDDYGIACCVSAMKIGKQMQFFGARCNLAKSLLYAINGGVDEKKFDLVVPHIKRIDDEVLDYDKVKENYFKVMKYVAKLYVNTLNLIHYMHDKYAYEKGLMALHDTDVHRFLACGAAGLSVAVDSLSAIKYAKVKPIRNEDGIAVDFEVEGDFPKYGNDDDRVDDIAVEIVNKFMSELRKTAAYRNAEHTLSMLTITSNVMYGKKTGATPDGRKSGEAFAPGANPMHGRDKNGALASLNSVAKIPYRSVCQDGVSNTFSIIPDALGKNEETRANNLSAILDGYFEKGAHHLNVNVLNRETLLDAMENPEKYPTLTIRVSGYAVNFVKLTKEQQMEVVKRTFHGRM

SEQ ID NO: 2418 - DNA, 2319 bp, Haemophilus influenzae Rd KW20
  CDS (1)..(2319): transl_table=11
atgactatgtcagaacttaatgaaatgcaaaaattggcgtgggctggttttgctggtggcgattggcaagaaaatgtcaatgtacgtgactttatccaaaaaaactataccccttatgaaggcgatgactctttcttagcaggtccaaccgaagcaacaaccaagctttgggaatctgtgatggaaggtattaaaattgaaaaccgtactcacgcgccattagattttgatgaacatacaccatctaccattatctctcacgcacctggttacattaacaaagatttagaaaaaatcgttggtcttcaaactgatgaacctttaaaacgtgccattatgccattcggtggtatcaaaatggtggaaggttcttgtaaagtttatggtcgtgaacttgatccaaaagtgaaaaaaatcttcactgaataccgtaaaacacataaccaaggtgtattcgatgtttacacgccagatattttacgttgccgtaaatctggggtattaactggtcttccagatgcttatggtcgtggtcgtatcatcggtgactaccgtcgtgtagcactttatggtgtagatttcttaatgaaagataaatacgcacaattctcttctttacaaaaagatttagaagatggcgtaaatcttgaagcaacaattcgtttacgtgaagaaatcgcagaacaacaccgtgcattaggtcaattaaaacaaatggcagcaagctatggttatgatatttctaacccagcaactaatgctcaagaagccattcaatggatgtactttgcttatcttgctgcaataaaatcacaaaatggtgctgcaatgtcattcggtcgtaccgcaacctttattgacgtgtacatcgaacgtgatttaaaagcaggaaaaattactgaaactgaagcgcaagaattagttgaccacttagttatgaaacttcgtatggttcgtttcttacgtacacctgaatacgatcaattattctctggtgacccaatgtgggcaactgaaaccatcgcaggtatgggtttagatggtcgtacattagtaaccaaaaatacattccgtattttacacaccctttacaacatgggtacttctccagagccaaacttaaccattctttggtctgaacaattacctgaaaacttcaaacgtttctgtgcaaaagtatcgattgatacctcatcagttcaatacgaaaacgatgatttaatgcgtccagacttcaacaacgatgactacgcaatcgcatgttgtgtatcaccaatgattgtgggtaaacaaatgcaattcttcggtgcacgtgcaaacttagcgaaaacattgttatacgcaatcaacggcggtatcgatgaaaaattaggtatgcaagtaggtccgaaaactgcaccaattactgatgaagtattagatttcgatacagtaatgactcgtatggatagctttatggattggttggcaaaacaatatgtgactgccttaaacgtaatccactatatgcacgataaatattcatacgaagccgcattaatggcattacatgatcgtgatgtataccgtactatggcttgtggtatcgcaggtctttctgttgcggctgactcactttcagcaatcaaatatgcgaaagttaaaccagttcgtggcgacatcaaagataaagatggcaatgttgttgcaactaacgtagcaatcgactttgaaatcgaaggtgaatatccacaatatggtaacaatgataaccgtgttgatgacatcgcttgtgacttagttgaacgttttatgaagaaaattcaaaaacttaaaacttaccgcaatgcagtgcctacacaatctgtattaaccattacttctaacgtagtttatggtaagaaaacgggtaacacccctgatggtcgtcgtgctggtgcaccattcggaccaggtgcgaacccaatgcacggtcgtgaccaaaaaggtgcggtagcatcattaacttctgtagctaaacttccatttgcttacgcgaaagatggtatttcttataccttctcaatcgtaccaaatgccttaggtaaagatgcagaagcacaacgtcgcaaccttgctggcttaatggatggttacttccaccacgaagcaacggttgaaggtggccaacacttaaatgtgaacgtgttaaaccgtgaaatgttattagatgcaatggaaaatccggataaatatccacaattgactatccgtgtatcaggttacgcagtacgttttaactctttaactaaagagcaacaacaagacgtaattactagaactttcacagagtcaatgtaa

SEQ ID NO: 2419 - protein, 772 aa, Haemophilus influenzae Rd KW20
MTMSELNEMQKLAWAGFAGGDWQENVNVRDFIQKNYTPYEGDDSFLAGPTEATTKLWESVMEGIKIENRTHAPLDFDEHTPSTIISHAPGYINKDLEKIVGLQTDEPLKRAIMPFGGIKMVEGSCKVYGRELDPKVKKIFTEYRKTHNQGVFDVYTPDILRCRKSGVLTGLPDAYGRGRIIGDYRRVALYGVDFLMKDKYAQFSSLQKDLEDGVNLEATIRLREEIAEQHRALGQLKQMAASYGYDISNPATNAQEAIQWMYFAYLAAIKSQNGAAMSFGRTATFIDVYIERDLKAGKITETEAQELVDHLVMKLRMVRFLRTPEYDQLFSGDPMWATETIAGMGLDGRTLVTKNTFRILHTLYNMGTSPEPNLTILWSEQLPENFKRFCAKVSIDTSSVQYENDDLMRPDFNNDDYAIACCVSPMIVGKQMQFFGARANLAKTLLYAINGGIDEKLGMQVGPKTAPITDEVLDFDTVMTRMDSFMDWLAKQYVTALNVIHYMHDKYSYEAALMALHDRDVYRTMACGIAGLSVAADSLSAIKYAKVKPVRGDIKDKDGNVVATNVAIDFEIEGEYPQYGNNDNRVDDIACDLVERFMKKIQKLKTYRNAVPTQSVLTITSNVVYGKKTGNTPDGRRAGAPFGPGANPMHGRDQKGAVASLTSVAKLPFAYAKDGISYTFSIVPNALGKDAEAQRRNLAGLMDGYFHHEATVEGGQHLNVNVLNREMLLDAMENPDKYPQLTIRVSGYAVRFNSLTKEQQQDVITRTFTESM

SEQ ID NO: 2420 - DNA, 2295 bp, Salmonella enterica subsp. enterica serovar Typhi str. CT18
  CDS (1)..(2295): transl_table=11
atgaaggtaaatatcgataccagcgatatgctgtatgccgaagcatggcgtgattttaaaggtacggactggaaagaagaaattaatgtctgtgattttattcagcataactatacgccctatgagggggatgaatcttttctcgccgacgcgacgccagcgaccacagcgttgtgggaaaaggtgatggcgggaatacgtatcgagaacgcgacccatgcgccggtggatttcgataccaacatcgcgacgacgattaccgcgcacgatgcggggtatattgaaaaagagctggaaaaaatcgtcggtttacaaacggataagccgcttaaacgcgctttgcatccgtttggcggcgttaacatgatcaaaagttcattccacgcttatggccgggaaatggacgccgattttgaatatacctttaccgacctgcggaaaacccataatcagggcgtattcgatgtttactcgccggatatgctgcgctgccgtaaatccagcgtattaaccggtttgccggatggttatggtcgcgggcgcattattggcgattatcgccgcgtcgcgctgtatggcatccgttatctggtgcgcgaacgcgagctgcaattcgccgacctgcagtcgaatctggagcggggacagaatcttgaggcgacgattcgcctgcgtgaggagttggcggagcaccgtcgcgcgctgctgcaaatgcaggagatggcggcgaaatacggctatgatatctcccgcccggcgcggaacgcgcaggaagcggtacagtggctctacttcgcttatctggcggcggtaaaatcgcaaaatggcggtgcaatgtcgctgggaagaaccgcctcgttccttgatatctacattgagcgcgatttcaacgcgggtcttctgacagagcagcaggcgcaggagctgatcgaccatttcatcatgaagatccgcatggtgcgcttcctgcgcacgccggaatttgattcgctcttttccggcgatccgatctgggccaccgaagttattggcgggatggggcttgatggccgcacgctggtgacgaagaactctttccgttatctgcataccctgcacacgatggggccagcgccggagccgaacctgaccatactgtggtcagaagcgttgccggtggcattcaagaaatatgctgcgcaggtctccatcgtgacctcatctttgcagtatgaaaacgacgatttaatgcgtaccgactttaacagcgacgattacgccatcgcttgttgcgtcagcccgatggtcatcggtaagcagatgcagttcttcggcgcgcgcgccaaccttgccaaaacgttgctgtacgctatcaatggcggcgttgacgagaaactgaaaatccaggttgggccgaaaaccgcgccgttaacggatgaggtgctggattatgacgcagtaatggagagcctcgaccattttatggactggctggcggtgcagtacattagcgcgctgaacatcattcactatatgcacgataagtacagctatgaagcttcgctgatggcgctgcacgaccgtgatgtgtatcggacgatggcgtgcggcatcgccggactgtcggtggcggcggattccctatccgccatcaggtacgctcaggtgaagccgattcgcgacgaaaatggccttgccatcgactttgctattgaaggcgagtatccgcagtacggcaacaacgatgagcgcgtggacagcatcgcctgcgacctggtgaaacgctttatgcaaaaaattagcgtgttgccgacgtatcgcaatgcggtgccgacgcagtccattttgaccatcacctcgaacgtcgtgtacgggcagaagaccggcaatacgccggatggacgccgcgccggaacgccgttcgcgccgggggcgaacccgatgcacggtcgtgaccgcaaaggggcggtggcctcgctgacgtcggtggcgaaactgccgtttacctacgccaaagacggtatttcgtacaccttctcgattgtgcctgcggcgctcgggaaagaagatgcggtgcggaaaaccaatcttgtcggcctgctggacggctatttccatcatgaagcacaggtagaaggcgggcagcatctgaacgtcaatgtcatgaaccgtgaaatgttgctggatgcgattgaacatccggaaaactacccgaacctgacgatccgcgtttccggctatgccgtgcgcttcaatgcgctgactcgtgagcagcaacaggacgttatttcgcgcacctttactcaggcgatgtaa

SEQ ID NO: 2421 - protein, 764 aa, Salmonella enterica subsp. enterica serovar Typhi str. CT18
MKVNIDTSDMLYAEAWRDFKGTDWKEEINVCDFIQHNYTPYEGDESFLADATPATTALWEKVMAGIRIENATHAPVDFDTNIATTITAHDAGYIEKELEKIVGLQTDKPLKRALHPFGGVNMIKSSFHAYGREMDADFEYTFTDLRKTHNQGVFDVYSPDMLRCRKSSVLTGLPDGYGRGRIIGDYRRVALYGIRYLVRERELQFADLQSNLERGQNLEATIRLREELAEHRRALLQMQEMAAKYGYDISRPARNAQEAVQWLYFAYLAAVKSQNGGAMSLGRTASFLDIYIERDFNAGLLTEQQAQELIDHFIMKIRMVRFLRTPEFDSLFSGDPIWATEVIGGMGLDGRTLVTKNSFRYLHTLHTMGPAPEPNLTILWSEALPVAFKKYAAQVSIVTSSLQYENDDLMRTDFNSDDYAIACCVSPMVIGKQMQFFGARANLAKTLLYAINGGVDEKLKIQVGPKTAPLTDEVLDYDAVMESLDHFMDWLAVQYISALNIIHYMHDKYSYEASLMALHDRDVYRTMACGIAGLSVAADSLSAIRYAQVKPIRDENGLAIDFAIEGEYPQYGNNDERVDSIACDLVKRFMQKISVLPTYRNAVPTQSILTITSNVVYGQKTGNTPDGRRAGTPFAPGANPMHGRDRKGAVASLTSVAKLPFTYAKDGISYTFSIVPAALGKEDAVRKTNLVGLLDGYFHHEAQVEGGQHLNVNVMNREMLLDAIEHPENYPNLTIRVSGYAVRFNALTREQQQDVISRTFTQAM

SEQ ID NO: 2422 - DNA, 2283 bp, Salmonella typhimurium LT2
  CDS (1)..(2283): transl_table=11
atgtccgagcttaatgaaaagttagccacagcctgggaaggttttaccaaaggtgactggcagaatgaagtaaacgtccgtgacttcattcagaaaaactacactccgtatgagggtgacgagtccttcctggctggcgctactgacgcgaccaccaagctgtgggacagcgtaatggaaggcgttaaacaggaaaaccgcactcacgcgcctgttgactttgacacctccgttgcttccaccatcacttctcacgacgctggctacatcaacaaagcgcttgagaaaattgttggtctgcagactgaagctccgctgaagcgtgcgattatcccgttcggcggcatcaaaatggttgaaggttcctgcaaagcgtacaatcgcgagctggacccaatgatcaaaaaaatcttcaccgaataccgtaagactcacaaccagggcgtgttcgacgtttatactccggacatcttgcgttgccgtaaatccggcgttctgaccggtctgccggatgcgtatggccgtggccgtatcatcggtgactaccgtcgcgtagcgctgtacggtatcgactacctgatgaaagacaaattcgcacagtttacgtctctgcaatccgatctggaaaacggcgtaaatctggaagcgactatccgtctgcgtgaagaaatcgctgaacagcaccgcgctctgggtcagatcaaagaaatggcagctaaatacggctgcgatatctctggtccggcgactaacgctcaggaagcaatccagtggacttacttcggttacctggctgcggttaaatctcagaacggcgcagcaatgtccttcggtcgtgtatccaccttcctggatgcgtacatcgaacgtgacctgaaagcaggcaaaatcaccgagcaagacgcacaggaaatgattgaccacctggtcatgaaactgcgtatggttcgcttcctgcgtactcctgaatatgatgaactgttctccggcgacccgatttgggcaaccgaatctatcggcggtatgggcgttgatggccgtactctggtcaccaaaaacagcttccgtttcctgaacaccctgtacaccatggggccgtctccggagccgaacatcaccgttctgtggtctgaaaaactgccgctgaacttcaagaaattcgccgctaaagtctccatcgacacttcttctctgcagtacgagaacgatgacctgatgcgtccggacttcaacaacgatgactacgctatcgcatgctgcgtaagcccgatgatcgttggtaaacaaatgcagttcttcggcgcgcgtgcaaacctggcgaaaaccatgctgtacgctatcaacggcggcgttgatgaaaaactgaaaatgcaggttggtccgaaatccgaaccgatcaaaggcgatgttctgaacttcgacgaagtgatggaccgcatggatcacttcatggactggctggctaaacagtatgtcaccgcgctgaacgttatccactacatgcacgacaagtacagctacgaagcctctctgatggcgctgcacgaccgtgacgttatccgcaccatggcgtgtggtatcgcaggtctgtccgttgctgctgactccctgtctgccatcaaatatgcgaaagttaaaccgattcgtgacgaagatggtctggctatcgacttcgaaatcgaaggcgaatacccgcagtttggtaacaacgacgctcgtgtagatgacatggcggttgacctggtagaacgtttcatgaagaaaattcagaaactgaccacctaccgtggcgctatcccgacacagtctgttctgaccattacttctaacgttgtgtatggtaagaaaaccggtaacaccccggatggtcgtcgcgctggcgcgccgttcggaccaggtgctaacccgatgcacggtcgtgaccagaaaggcgctgtcgcttctctgacctccgttgctaaactgccatttgcttacgcgaaagatggtatttcttataccttctctatcgttccgaacgcactgggtaaagacgacgaagttcgtaagactaacctggcaggtctgatggatggttacttccaccacgaagcgtccatcgaaggcggtcagcacctgaacgtcaacgtcatgaaccgtgaaatgctgctggacgcgatggaacatccggaaaaatatccgcagctgaccatccgtgtatctggttacgcagtacgttttaactccctgacgaaagaacagcagcaggacgttattactcgtaccttcacgcagaccatgtaa

SEQ ID NO: 2423 - protein, 760 aa, Salmonella typhimurium LT2
MSELNEKLATAWEGFTKGDWQNEVNVRDFIQKNYTPYEGDESFLAGATDATTKLWDSVMEGVKQENRTHAPVDFDTSVASTITSHDAGYINKALEKIVGLQTEAPLKRAIIPFGGIKMVEGSCKAYNRELDPMIKKIFTEYRKTHNQGVFDVYTPDILRCRKSGVLTGLPDAYGRGRIIGDYRRVALYGIDYLMKDKFAQFTSLQSDLENGVNLEATIRLREEIAEQHRALGQIKEMAAKYGCDISGPATNAQEAIQWTYFGYLAAVKSQNGAAMSFGRVSTFLDAYIERDLKAGKITEQDAQEMIDHLVMKLRMVRFLRTPEYDELFSGDPIWATESIGGMGVDGRTLVTKNSFRFLNTLYTMGPSPEPNITVLWSEKLPLNFKKFAAKVSIDTSSLQYENDDLMRPDFNNDDYAIACCVSPMIVGKQMQFFGARANLAKTMLYAINGGVDEKLKMQVGPKSEPIKGDVLNFDEVMDRMDHFMDWLAKQYVTALNVIHYMHDKYSYEASLMALHDRDVIRTMACGIAGLSVAADSLSAIKYAKVKPIRDEDGLAIDFEIEGEYPQFGNNDARVDDMAVDLVERFMKKIQKLTTYRGAIPTQSVLTITSNVVYGKKTGNTPDGRRAGAPFGPGANPMHGRDQKGAVASLTSVAKLPFAYAKDGISYTFSIVPNALGKDDEVRKTNLAGLMDGYFHHEASIEGGQHLNVNVMNREMLLDAMEHPEKYPQLTIRVSGYAVRFNSLTKEQQQDVITRTFTQTM

SEQ ID NO: 2424 - DNA, 2295 bp, Salmonella typhimurium LT2
  CDS (1)..(2295): transl_table=11
atgaaggtaaatatcgataccagcgatatgctgtatgccgaagcatggcgtgattttaaaggtacggactggaaagaagaaattaatgtccgtgattttattcagcataactatacgccctatgagggggatgaatcttttctcgccgacgcgacgccagcgaccacggcgctgtgggaaaaggtgatggcgggaatacgtatcgagaacgcgacccatgcgccggtggatttcgataccaacatcgcgacgacgattaccgcgcacgatgcggggtatattgaaaaagagctggaaaaaatcgtcggtttacaaacggataagccgcttaaacgcgctttgcatccgtttggcggcgttaacatgatcaaaagttcattccacgcttatggccgcgaaatggacgccgattttgaatatacctttaccgacctgcggaaaacccataatcagggcgtattcgatgtttactcgccggatatgctgcgctgccgtaaatccggcgtattaaccggtttgccggatggttatggtcgcgggcgcattattggcgattatcgccgcgtcgcgctgtatggcatccgttatctggtgcgcgaacgcgagctgcaattcgccgacctgcagtcgaatctggagcagggacagaatcttgaggcgacgattcgcctgcgtgaggagttggcggagcatcgtcgcgcgctgctgcaaatgcaggagatggcggcgaaatacggctacgatatctcccgcccggcgcggaacgcgcaggaagcggtacagtggctctacttcgcttatctggcggcggtaaaatcgcaaaatggcggtgcaatgtcgctgggaagaaccgcctcgttccttgatatctacattgagcgcgatttcaacgcgggccttctgacagagcagcaggcgcaggaactgatcgaccatttcatcatgaagatccgcatggtgcgtttcctgcgcacgccggaatttgattcgctcttttccggcgatccgatctgggccaccgaagttattggcgggatggggcttgatggccgcacgctggtgacgaagaactccttccgttatctgcataccctgcacacgatggggccagcgccggagccgaacctgaccatactgtggtcagaagcgttgccggtggcattcaagaaatatgctgcgcaggtctccatcgtgacctcatctttgcagtatgaaaacgacgatttaatgcgtaccgactttaacagcgacgattacgccatcgcttgttgcgtcagcccgatggtcatcggtaagcagatgcagttcttcggcgcgcgcgccaaccttgccaaaacgttgctgtacgctatcaatggcggcgttgatgagaaactgaaaatccaggtcgggccgaaaaccgcgccgttaacggatgaggtgctggattatgacgcggtaatggagagtctcgaccattttatggactggctggcggtgcagtacattagcgcgctgaacatcattcactacatgcacgataagtacagctatgaagcttcgctgatggcgctgcacgaccgtgatgtgtatcggacgatggcgtgcggcatcgccggactgtcggtggcggcggattccctgtccgccatcaggtacgctcaggtgaagccgatccgcgacgaaaacggccttgccatcgactttgctattgaaggcgagtatccgcagtacggcaacaacgatgagcgcgtggacagcatcgcctgcgacctggtgaaacgctttatgcaaaaaattagcgtgttgccgacgtatcgcaatgcggtgccgacgcagtccattttgaccatcacctcgaacgtcgtgtacgggcagaagaccggcaatacgccggatggacgccgcgccggaacgccgttcgcgccgggggcgaacccgatgcatggtcgtgaccgcaaaggggcggtggcctcgctgacgtcggtggcgaaactgccgtttacctacgccaaagacggtatttcgtacaccttctcgattgtgcctgcggcgctcgggaaagaagatgcggtgcggaaaaccaatcttgtcggcctgctggacggctatttccatcatgaagcacaggtagaaggcgggcagcatctgaacgtcaatgtcatgaaccgtgaaatgttgctggatgcgattgaacatccggaaaactacccgaacctgacgatccgcgtttccggctatgccgtgcgcttcaatgcgctgacgcgtgaacagcaacaggacgttatttcgcgcacctttactcaggcgatgtaa

SEQ ID NO: 2425 - protein, 764 aa, Salmonella typhimurium LT2
MKVNIDTSDMLYAEAWRDFKGTDWKEEINVRDFIQHNYTPYEGDESFLADATPATTALWEKVMAGIRIENATHAPVDFDTNIATTITAHDAGYIEKELEKIVGLQTDKPLKRALHPFGGVNMIKSSFHAYGREMDADFEYTFTDLRKTHNQGVFDVYSPDMLRCRKSGVLTGLPDGYGRGRIIGDYRRVALYGIRYLVRERELQFADLQSNLEQGQNLEATIRLREELAEHRRALLQMQEMAAKYGYDISRPARNAQEAVQWLYFAYLAAVKSQNGGAMSLGRTASFLDIYIERDFNAGLLTEQQAQELIDHFIMKIRMVRFLRTPEFDSLFSGDPIWATEVIGGMGLDGRTLVTKNSFRYLHTLHTMGPAPEPNLTILWSEALPVAFKKYAAQVSIVTSSLQYENDDLMRTDFNSDDYAIACCVSPMVIGKQMQFFGARANLAKTLLYAINGGVDEKLKIQVGPKTAPLTDEVLDYDAVMESLDHFMDWLAVQYISALNIIHYMHDKYSYEASLMALHDRDVYRTMACGIAGLSVAADSLSAIRYAQVKPIRDENGLAIDFAIEGEYPQYGNNDERVDSIACDLVKRFMQKISVLPTYRNAVPTQSILTITSNVVYGQKTGNTPDGRRAGTPFAPGANPMHGRDRKGAVASLTSVAKLPFTYAKDGISYTFSIVPAALGKEDAVRKTNLVGLLDGYFHHEAQVEGGQHLNVNVMNREMLLDAIEHPENYPNLTIRVSGYAVRFNALTREQQQDVISRTFTQAM

SEQ ID NO: 2426 - DNA, 2232 bp, Listeria monocytogenes EGD-e
  CDS (1)..(2232): transl_table=11
atgactgaacaatggtatgaattcgcaggtggtaactggcaacaagaagtagatgtacgtgactttatcttaaaaaactatcgcttatatgacggtgacgacactttcctagttggcccaaccgaagcaactacaaaactttgggatcaagtaatggacttaactaaaaaagaacgtgaaaacggtggcgtactggatatggataccaaaatcgtttcaaccatcacttcacatgacccaggatacttaaataaagatttagaaaaagttgtcggcgttcaaactgacgtacctttcaaacgcgctttacaaccattcggcggaatccgtatggcagaagttgcagctgaatcttatggatttaaagtagacgaagaaattagccatattttctctgaataccgtaaaacacataaccaaggtgtatttgatgcttacacagcagaaatgcgcgcagctcgtaaatcaggcgtaattactggtcttccagatgcttatggccgtggacgcattatcggtgactaccgtcgtgtagcactttacggtgtagacttcttaattaaacaaaagaaacaagatttaaacaatacaggtttgcgtacaatgagcgatgacgttatccgtcaacgtgaagaacttaacgaacaaattcgtgctttaggtgaattaaaagttctaggtgaaaaacatggtttcgaccttggtcgtccagctaaaacagcacaagaagctttccaatggttataccttggttacctagctgcaattaaagaacaaaatggtgctgcaatgagtttaggacgtacatctacattccttgatatttatgtagaacgtgatcttcgtaatggcctaattactgaagaagaagcacaagaaatcgttgaccactttatcatgaaattacgtcttgtaaaatttgctcgtacaccagattacaacgaattattctctggagatccaacttgggttactgaatccatcggtggtattacggaagaaggcgttccacttgtaacgaaaaactcattccgtttcttacacactttagataacttaggacctgctccagaaccaaacttaacagtactttggtccactcatttaccatcaggattcaagaaattctgtgctaaaatgtctatcaaaacatcagctattcaatacgaaaatgatgatgttatgcgccctaaatggggagacgactatgcgattgcatgttgtgtatccgcaatgcgcgttggtaaacaaatgcaattctttggtgctcgtgccaaccttgctaaaacactactttacgcaatcaatggtggtatcgatgaaaaatctaaagcacaagttggaccagcttatcgtccaattgaaggtgatgtattagattacaaagaagtaatggaaaaatatgatgcaatgatggaatggattgcagaactttatcttaatacactaaatgtaattcattacatgcatgataaatacgcttacgaacgtatcgaaatggctttacatgatacagaagtattacgtactatggcaactggtatcgctggactttctgttgcagctgactccttatccgctattaaatatgcaactgttcgtccaattcgtgacgaagatggcatcgtagttgattatgaaatcgaaggcgactatcctaaatacggaaataatgatgaccgtgtagatgaaatcgcagttgagcttctaaaaacattcatgactaaagtaagaaaacataaaacttaccgtgatgcagttcacacaacttctgttcttacaatcacttctaacgtggtttatggtaagaaaactggtaatacaccagacggacgtcgtgcaggcgaaccatttgcaccaggtgcgaatccaatgcatggccgtgatacaaaaggtgctctagcttctctatcttcagttgctaaacttccttacgaatatggtcaagatggtatctctaacacattctctatcgtaccaaaagctttaggtcgcgaagatgaatctcaaattaataacttagttgcaatgcttgatggttattccacaaaaatgggacatcacttaaacatcaacgtattcaatcgtgatacgttactagatgctatggatcacccagaagaatatccacaattaactatccgcgtttccggatatgcagttaacttcatcaaactaactcgtgaacaacaattagatgttattcaccgtacaatgcacgaatccatgtaa

SEQ ID NO: 2427 - protein, 743 aa, Listeria monocytogenes EGD-e
MTEQWYEFAGGNWQQEVDVRDFILKNYRLYDGDDTFLVGPTEATTKLWDQVMDLTKKERENGGVLDMDTKIVSTITSHDPGYLNKDLEKVVGVQTDVPFKRALQPFGGIRMAEVAAESYGFKVDEEISHIFSEYRKTHNQGVFDAYTAEMRAARKSGVITGLPDAYGRGRIIGDYRRVALYGVDFLIKQKKQDLNNTGLRTMSDDVIRQREELNEQIRALGELKVLGEKHGFDLGRPAKTAQEAFQWLYLGYLAAIKEQNGAAMSLGRTSTFLDIYVERDLRNGLITEEEAQEIVDHFIMKLRLVKFARTPDYNELFSGDPTWVTESIGGITEEGVPLVTKNSFRFLHTLDNLGPAPEPNLTVLWSTHLPSGFKKFCAKMSIKTSAIQYENDDVMRPKWGDDYAIACCVSAMRVGKQMQFFGARANLAKTLLYAINGGIDEKSKAQVGPAYRPIEGDVLDYKEVMEKYDAMMEWIAELYLNTLNVIHYMHDKYAYERIEMALHDTEVLRTMATGIAGLSVAADSLSAIKYATVRPIRDEDGIVVDYEIEGDYPKYGNNDDRVDEIAVELLKTFMTKVRKHKTYRDAVHTTSVLTITSNVVYGKKTGNTPDGRRAGEPFAPGANPMHGRDTKGALASLSSVAKLPYEYGQDGISNTFSIVPKALGREDESQINNLVAMLDGYSTKMGHHLNINVFNRDTLLDAMDHPEEYPQLTIRVSGYAVNFIKLTREQQLDVIHRTMHESM

SEQ ID NO: 2428 - DNA, 2280 bp, Listeria monocytogenes EGD-e
  CDS (1)..(2280): transl_table=11
atgacaaaagcatgggatggttttaaaggaaccgcatggcaagaaaacattagtgtaggacagttcgttcaagacaactacactccttacgatggcgatgaaagcttcttagaaaaaagcacaccaagaacaacgaaactaaatgaaaaaataaataaactggtagaagaaatggatgcaaaaggcggcgtacttgatatggataacgctatcgtatccaatgttgcgtctcacaaagctggttacgtagaccaagaaaatgaagttatcgttggtctacaaacagataaaccattcaaattagcgtttatgccaaatggtggccttagaacagcagaacaatgtttaacagacaacggctactccatcgaccaagaattacatgacttctacgtaaaaaatcgttctacagcaaatgatggtattttcagagcatatacagacgatatcaaacgtgcgcgtcactcgcatatcgttagtggtcttccagatgcatactcacgcggaagaatcatcggcttataccaaaaaccagctttatacggcgtagatcgtttaatcgctgaaaaacaacaagacttgaaaaaaattgccatttcttctgatgaaaatattcgtctacgtgaagaaatttggttacaaatcaaagcacttaaagacttaatcgttttaggtaatgaatatggtctagaacttggccgtccagctgaaaatgcaacagaagctgtacaatggacttacatgggctaccttgcttctatcaaacaagcaaacggtgctgcaagctcattcggtcgtattccgattttccttgatatctacatccaacgcgatttagaaaaaggcattatcaccgaattcgatgcgcaagaattaatcgaacaattaacccttaaattaagaatggttcgttttgcaagaacagatggttataacgaactttacgcttctaaccctactttcgttacaacatctatggctggtatgggtgcagacggtcgtcatcgtgtgactaaaacagattatcgtttcttacactgcttagataacctaggaaactccgcggaaccaaacttaactgtcctttgggatgctcgtttgcctgaaagctttaaagaatattgtatgaaaatgagcgtaaaacattcctccattcaatacgaaaatgataaattaatgcaagaagaaggctatggcgatatgcaatgtatcagctgttgtgttagcccacttaacccagaagcagacaaagacaaaggcgaaacacataacctgcaatattttggtgctcgtgtcaacgtacttaaatgtcttcttggtgctatcaacggtggtaaagatgatcttcacaaaaaccaagtattcgatgtagtagaaccaattacaaccgaataccttgaatacgaagaagtactagaaaaattcgataaatcaatggactggttaacagacacatatgtagatgcgatgaatatcattcactttatgacagacaaatataactatgaaagcatgcaaatggccttcttaccatctaaagtaacagccaacatgggattcggtatttgtggattcgctaacgtagtagatagcctaagtgccatcaaacacgccaaagtaaaaactatccgcgacgaagacggttttgtatatgactatgaagtagaaggcgacttccctcgttacggtgaaaatgatgaccgtgccgatgatatcgctgtaatggttcttaagatgttcaaagacaaattagattcccataaactttacaaagatagcgaagcaactgtttctgttctaacaatcacttctaatgttgcttactctaaacaatgtggtaactccccagtgcataaaggacctgtatttgatgaaaacggtaaaatcgttaaagaaccagaattcttcagcccaggagctaacccttctaacaaagcaaaaggtggattcttagataaccttgcaagcctttctaaattaccattccactatgctaatgacggaatctccttaaccatccaaggagctccaaaaatgttcggtaaaacaaccgaagaacaacatcataacctagttggtattcttgacggttactttacaaaaggcggtcaacatatcaacttgaacgttcttaaccacgacgaagtaatcgaaaaaatcaaagctggtatccctgtaatcttacgtatcagcggctactgcttaaatacgaaagatctaaatgaagaacaaaaaatggaactttgtcaaagaatgttccacgaaaaattaatcggttaa

SEQ ID NO: 2429 - protein, 759 aa, Listeria monocytogenes EGD-e
MTKAWDGFKGTAWQENISVGQFVQDNYTPYDGDESFLEKSTPRTTKLNEKINKLVEEMDAKGGVLDMDNAIVSNVASHKAGYVDQENEVIVGLQTDKPFKLAFMPNGGLRTAEQCLTDNGYSIDQELHDFYVKNRSTANDGIFRAYTDDIKRARHSHIVSGLPDAYSRGRIIGLYQKPALYGVDRLIAEKQQDLKKIAISSDENIRLREEIWLQIKALKDLIVLGNEYGLELGRPAENATEAVQWTYMGYLASIKQANGAASSFGRIPIFLDIYIQRDLEKGIITEFDAQELIEQLTLKLRMVRFARTDGYNELYASNPTFVTTSMAGMGADGRHRVTKTDYRFLHCLDNLGNSAEPNLTVLWDARLPESFKEYCMKMSVKHSSIQYENDKLMQEEGYGDMQCISCCVSPLNPEADKDKGETHNLQYFGARVNVLKCLLGAINGGKDDLHKNQVFDVVEPITTEYLEYEEVLEKFDKSMDWLTDTYVDAMNIIHFMTDKYNYESMQMAFLPSKVTANMGFGICGFANVVDSLSAIKHAKVKTIRDEDGFVYDYEVEGDFPRYGENDDRADDIAVMVLKMFKDKLDSHKLYKDSEATVSVLTITSNVAYSKQCGNSPVHKGPVFDENGKIVKEPEFFSPGANPSNKAKGGFLDNLASLSKLPFHYANDGISLTIQGAPKMFGKTTEEQHHNLVGILDGYFTKGGQHINLNVLNHDEVIEKIKAGIPVILRISGYCLNTKDLNEEQKMELCQRMFHEKLIG

SEQ ID NO: 2430 - DNA, 2232 bp, Listeria innocua Clip11262
  CDS (1)..(2232): transl_table=11
atgactgaacaatggtatgaattcgcaggtggtaactggcaacaagaagtagatgtacgtgactttatcttaaaaaactatcgcttatatgacggtgacgacacattcttagttggcccaaccgaagcaacaacaaaactttgggatcaagtaatggacttaactaaacaagaacgtgaaaacggtggcgtactagatatggataccaaaatcgtttcaaccattacttcacatgacccaggttacttaaacaaagacttagaaaaagttgtcggtgttcaaactgacgtacctttcaaacgcgctttacaaccattcggtggaatccgtatggcagaagtagcagctgaatcttatggttttaaagtagacgaagaaattagtcatattttttctgaataccgtaaaacacataaccaaggtgtatttgatgcttatactgctgaaatgcgcgcagctcgtaaatcaggcgtaatcactggtcttccagatgcttatggccgtggacgtattattggtgactaccgtcgtgttgcactatacggagttgacttcttaattaaacaaaagaaacaagatttaaacaatacaggtttacgtacaatgagcgatgacgttatccgtcaacgtgaagaacttaacgaacaaattcgtgctcttggcgaattaaaagtactaggcgaaaaacatggtttcgatcttggtcgcccagctaaaactgctcaagaagctttccaatggttataccttggttacctagctgctattaaagaacaaaatggtgctgcaatgagcttaggacgtacatctacattccttgatatttatgtagaacgtgaccttcgcaatggtctaattactgaagaagaagcacaagaaattgttgaccacttcatcatgaaattacgtcttgtaaaatttgctcgtacaccagattacaatgaattattctctggagatccaacttgggttactgaatccatcggtggtattacggaagaaggcgttccacttgtaacgaaaaactcattccgtttcttacacacattagataacttaggaccagctccagaaccaaacttaactgtactttggtccactcatttaccatcaggattcaagaaattctgtgctaaaatgtctatcaaaacatctgctattcaatacgaaaatgacgatgttatgcgccctaaatggggagacgactatgcgatcgcatgttgtgtatccgcaatgcgcgttggtaaacaaatgcaattctttggtgctcgtgccaaccttgctaaaacacttctttatgcaatcaatggtggtgtcgatgaaaaatctaaagcacaagttggacctgcttatcgtccagttgaaggcgacgtattagactacaaagaagtaatggaaaaatatgatgcaatgatggaatggattgcagaactttaccttaatacattaaatgttattcactatatgcatgataaatatgcttacgaacgtatcgaaatggctttacacgatacagaagtattacgtacaatggcaactggtatcgctggactttctgttgcagctgactccttatctgctattaaatatgctactgttcgtccaatccgtgacgaagacggcatcgtggttgattatgaaatcgaaggcgactatcctaaatacggaaacaatgatgaccgtgtagacgaaattgctgtagaacttctaaaaacattcatgactaaagttagaaaacataaaacttaccgtgatgcagttcacacaacttctgttcttacaatcacttctaacgtggtttatggtaagaaaactggtaacacaccagacggacgtcgtgctggcgaaccatttgcaccaggtgcgaacccaatgcatggccgtgatactaaaggtgctttagcttctctatcttccgtagctaaacttccttacgaatatggccaagatggtatttctaacacattctctatcgtaccaaaagctttaggtcgcgaagatgaatcgcaaatcaataacttagttgctatgcttgatggttattccacaaaaatgggacatcacttaaacatcaacgtattcaatcgtgatacattacttgatgcgatggatcatccagaagaatatcctcagctaactatccgtgtttctggatatgcagttaacttcatcaaattaactcgtgaacaacaattagatgttattcaccgtacaatgcacgaatctatgtaa

SEQ ID NO: 2431 - protein, 743 aa, Listeria innocua Clip11262
MTEQWYEFAGGNWQQEVDVRDFILKNYRLYDGDDTFLVGPTEATTKLWDQVMDLTKQERENGGVLDMDTKIVSTITSHDPGYLNKDLEKVVGVQTDVPFKRALQPFGGIRMAEVAAESYGFKVDEEISHIFSEYRKTHNQGVFDAYTAEMRAARKSGVITGLPDAYGRGRIIGDYRRVALYGVDFLIKQKKQDLNNTGLRTMSDDVIRQREELNEQIRALGELKVLGEKHGFDLGRPAKTAQEAFQWLYLGYLAAIKEQNGAAMSLGRTSTFLDIYVERDLRNGLITEEEAQEIVDHFIMKLRLVKFARTPDYNELFSGDPTWVTESIGGITEEGVPLVTKNSFRFLHTLDNLGPAPEPNLTVLWSTHLPSGFKKFCAKMSIKTSAIQYENDDVMRPKWGDDYAIACCVSAMRVGKQMQFFGARANLAKTLLYAINGGVDEKSKAQVGPAYRPVEGDVLDYKEVMEKYDAMMEWIAELYLNTLNVIHYMHDKYAYERIEMALHDTEVLRTMATGIAGLSVAADSLSAIKYATVRPIRDEDGIVVDYEIEGDYPKYGNNDDRVDEIAVELLKTFMTKVRKHKTYRDAVHTTSVLTITSNVVYGKKTGNTPDGRRAGEPFAPGANPMHGRDTKGALASLSSVAKLPYEYGQDGISNTFSIVPKALGREDESQINNLVAMLDGYSTKMGHHLNINVFNRDTLLDAMDHPEEYPQLTIRVSGYAVNFIKLTREQQLDVIHRTMHESM

SEQ ID NO: 2432 - DNA, 2280 bp, Listeria innocua Clip11262
  CDS (1)..(2280): transl_table=11
atgacaaaagcatgggatggttttaaaggaaccgcatggcaagaaaacattagtgtaggacaatttgttcaagacaactacactccttatgatggcgatgaaagctttttagaaaagagcacaccaagaacaactaaacttaatgaaaaaataaataaacttgtagaagaaatggacgcaaaaggtggcgttcttgatatggataacgcaatcgtatcaaacgttgcctctcacaaagctggttacgtggacaaagaaaatgaagtaatcgttggtttacaaacagacaaacctttcaaattagcatttatgccaaatggcggtcttagaactgcagaacaatgtttaacagacaatggttattctatcgaccaagaattacatgacttttacgtaaaaaaccgttccactgcaaatgatggtatttttagagcatatacagatgatattaaacgtgcgcgtcactcgcatatcgttagtggtcttccagatgcatactctcgcggaagaatcatcggcttataccaaaaaccagcactttacggagtggatcgtttaatcgctgaaaaacaacaagatttgaaaaaaatcgcgatttcttctgatgaaaatattcgtctacgtgaagaaatctggttacaaatcaaagcacttaaagacttaatcgttttaggtaacgaatatggcttagaactcggccgtcccgctgaaaacgcaaccgaagctgtacaatggacatacatgggctaccttgcttcaatcaaacaagcaaacggtgctgcaagctcatttggtcgtattccgattttccttgatatttacatccaacgtgatttagaaaaaggaattatcacagaattcgatgcacaagaattaatcgaacaattaactttaaaattaagaatggtccgttttgcaagaacagatggttacaacgagctttacgcttccaacccaacattcgtaacaacttctatggctggtatgggggcagatggtcgtcaccgcgttacaaaaacagattatcgtttcttacactgcttagataacctaggaaactcagcagaaccaaacttaactgtcctatgggatgctcgtttaccagaaagctttaaagaatattgtatgaaaatgagtgtaaaacattcctccattcaatatgaaaatgataaattaatgcaagaagaaggctacggcgatatgcaatgtatcagctgttgtgtgagcccacttaacccagaagcagacaaagacaaaggtgaaactcataacctgcaatatttcggagctcgtgtcaacgtactaaaatgtcttctaggcgctatcaacggtggtaaagatgatcttcataaaaaccaagtattcgacgttgtagaaccaattacaacagaataccttgaatacgacgaagttctagataaattcgataaatcaatggactggttaacagacacttatgtagatgcaatgaacatcattcactttatgacagacaaatacaactacgaaagcatgcaaatggccttcctaccatcaaaagtaactgccaacatgggattcggtatttgtggattcgcgaatgtagtagatagcttaagtgcgattaaatatgccaaagtaaaaaccatccgcgatgaagatggctttgtatatgactatgaagtagaaggcgacttccctcgttacggtgaaaatgatgaccgtgctgatgacattgccgtaatggttctaaaaatgttcaaagacaaattagactcccataaactttacaaagatagtgaagcaactgtttctgttttaacaatcacttcaaacgttgcttattctaaacaatgtggtaactccccagtgcataaaggacctgtattcgatgaaaatggtaaaatcatcaaagaaccagaattcttcagcccaggagctaacccttctaacaaagcaaaaggtggtttcttagataaccttgccagtctttctaaattaccattccactatgcaaatgatggaatttccttaacaatccaaggagctccaaaaatgttcggtaaaacaaccgaagaacaataccataaccttgttggtattcttgatggttactttacaaaaggtggtcaacacatcaacttaaacgttcttaaccacgacgaagtaatcgaaaaaattaaagctggtatcccagtaatcttacgtatcagcggctactgcttaaatacaaaagatctaaacgaagaacaaaaaatggaactttgccaaagaatgttccacgaaaaattaatcggttaa

SEQ ID NO: 2433 - protein, 759 aa, Listeria innocua Clip11262
MTKAWDGFKGTAWQENISVGQFVQDNYTPYDGDESFLEKSTPRTTKLNEKINKLVEEMDAKGGVLDMDNAIVSNVASHKAGYVDKENEVIVGLQTDKPFKLAFMPNGGLRTAEQCLTDNGYSIDQELHDFYVKNRSTANDGIFRAYTDDIKRARHSHIVSGLPDAYSRGRIIGLYQKPALYGVDRLIAEKQQDLKKIAISSDENIRLREEIWLQIKALKDLIVLGNEYGLELGRPAENATEAVQWTYMGYLASIKQANGAASSFGRIPIFLDIYIQRDLEKGIITEFDAQELIEQLTLKLRMVRFARTDGYNELYASNPTFVTTSMAGMGADGRHRVTKTDYRFLHCLDNLGNSAEPNLTVLWDARLPESFKEYCMKMSVKHSSIQYENDKLMQEEGYGDMQCISCCVSPLNPEADKDKGETHNLQYFGARVNVLKCLLGAINGGKDDLHKNQVFDVVEPITTEYLEYDEVLDKFDKSMDWLTDTYVDAMNIIHFMTDKYNYESMQMAFLPSKVTANMGFGICGFANVVDSLSAIKYAKVKTIRDEDGFVYDYEVEGDFPRYGENDDRADDIAVMVLKMFKDKLDSHKLYKDSEATVSVLTITSNVAYSKQCGNSPVHKGPVFDENGKIIKEPEFFSPGANPSNKAKGGFLDNLASLSKLPFHYANDGISLTIQGAPKMFGKTTEEQYHNLVGILDGYFTKGGQHINLNVLNHDEVIEKIKAGIPVILRISGYCLNTKDLNEEQKMELCQRMFHEKLIG

SEQ ID NO: 2434 - DNA, 2235 bp, Clostridium perfringens str. 13
  CDS (1)..(2235): transl_table=11
atgtttaaacaatgggaaggctttaaagaaggagtatggcaaaatggaatagatgttagaaacttcatacaaaagaactatactgcatatgagggagacaagagtttcttagaaggaacaacaaaaagaactgatgcagttttagaaaaagctcaaaagttaattatagaagaaatagaaaaaggcattatagatgttgctacagatagagtatctggaatagacaattatgagcctggatatttagataaagataacgaagttatcgttggtttccaaacagatgcaccacttaaaagaatagttaatcctttcggtggaatgagaatggttgaaagttctttaaaagaatacggctatgaattagatagcagtataagagaacactttaatgcttatagaaaaactcataaccaaggtgtattcgatgcatactcagctgaaacaagagctgcaagatctgctggtcttttaactggtcttccagatgcttatggtaggggaagaattataggtgactatagaagaattgccctttacggtatagattatctaatagaagaaaagaaaaaagattatgctaatatatcatttgaaagcgaaggctcagtagaggaatatattcaattaagagagaatgtttcagagcaaataagagctttagaagcaataaaatcaatggctgcaagatatggctttgatatatctaaaccagctgcaaacgctaaggaagcagttcaattcttatactttggatacttagctgcagttaaagaaaataatggagcagcaatgtctctaggaagaacttctactttcttagatattttcatagaaagagatcttaaggcaggaactttaactgagttagaagctcaagaattaatagatcaatttataataaaattaagattagttagacacttaagaactcctgagtataatgatttatttgctggagacccaacttgggtaacagaaggtattggaggtatgggtgtaaatggtaaaccattagtaactaaaaactcatttagatatcttcaaactttaataaacttaggacctgctccagaaccaaatatgactgttttatggtcagatagattaccagaaggattcaaaaaattctgtgctgaggtatcaattaaaactgactcaattcaatatgaaaatgatgagttaatgagacctatatacggagatgattactcaatagcttgttgtgtatcagcaatgcaaattggtaagcaaatgcaattcttcggagctagaactaacttagctaaagctttactttacactataaatggtggtattgatgaaaaatcaggtaaagttgttattaaaggtttagagccaataacagacgaagttttagattatgataaattaagagctaactatgataaagttttagagtacgttgctaagctttatgtagatacaatgaatgttatccactacatgcatgataaatatgcttatgaagctggacaaatggctttacatgatactcatgtaggaagattaatggcatttggtatagctggtttatcagttgtagctgactcattaagcgcagttaaattcgctaaagttaaacctataagagaaaatggaatagctgtagactttgaaatcgaaggtgacttccctaaatacggaaatgatgatgatagagttgacgatttagctgtagaaatagttagaaagttctcaagtgagcttaagaaacatccattatatagaggtgctaagcacacattatcaatcctaactattacttcaaacgtagtttatggtaagaaaacaggttcaactccagatggaagaaaagctggtgaagcatttgctccaggagctaacccaatgcatggaagagataacagtggagctttagctagcttaaactcagttgctaaaattccatactgtgaagtttgtgaagatggtgtatcaaacacattctcaatcgttccagatgctttaggaaaagaagaagattctagaatagataacttagttgctattatggatggttacttcaaacaaggagctcaccatctaaatgttaatgtatttaacagagaaactttaatggacgctatggagcatcctgaaaagtatccaacattaacaatcagagtatcaggttatgctgttaatttcaatagattaactagaaatcaacaattagaggttataagcagaacattccacgattctctataa

SEQ ID NO: 2435 - protein, 744 aa, Clostridium perfringens str. 13
MFKQWEGFKEGVWQNGIDVRNFIQKNYTAYEGDKSFLEGTTKRTDAVLEKAQKLIIEEIEKGIIDVATDRVSGIDNYEPGYLDKDNEVIVGFQTDAPLKRIVNPFGGMRMVESSLKEYGYELDSSIREHFNAYRKTHNQGVFDAYSAETRAARSAGLLTGLPDAYGRGRIIGDYRRIALYGIDYLIEEKKKDYANISFESEGSVEEYIQLRENVSEQIRALEAIKSMAARYGFDISKPAANAKEAVQFLYFGYLAAVKENNGAAMSLGRTSTFLDIFIERDLKAGTLTELEAQELIDQFIIKLRLVRHLRTPEYNDLFAGDPTWVTEGIGGMGVNGKPLVTKNSFRYLQTLINLGPAPEPNMTVLWSDRLPEGFKKFCAEVSIKTDSIQYENDELMRPIYGDDYSIACCVSAMQIGKQMQFFGARTNLAKALLYTINGGIDEKSGKVVIKGLEPITDEVLDYDKLRANYDKVLEYVAKLYVDTMNVIHYMHDKYAYEAGQMALHDTHVGRLMAFGIAGLSVVADSLSAVKFAKVKPIRENGIAVDFEIEGDFPKYGNDDDRVDDLAVEIVRKFSSELKKHPLYRGAKHTLSILTITSNVVYGKKTGSTPDGRKAGEAFAPGANPMHGRDNSGALASLNSVAKIPYCEVCEDGVSNTFSIVPDALGKEEDSRIDNLVAIMDGYFKQGAHHLNVNVFNRETLMDAMEHPEKYPTLTIRVSGYAVNFNRLTRNQQLEVISRTFHDSL

SEQ ID NO: 2436 - DNA, 2232 bp, Fusobacterium nucleatum subsp. nucleatum ATCC 25586
  CDS (1)..(2232): transl_table=11
atggaagcttggagaggttttaaaagtggtgaatggcaaaatagtattaatgtaagtgattttataaaacataactatacagaatatttaggggacgaatcattcttagaaggtcctactgaaaatactaaaaaattatgggatattttaagtggaatgttaaagatagaaagagaaaaaggtatatatgatgctgaaactaaaactccttctaaaatagatgcttatggagcaggatatatttctaaagatttagaaacaatagtaggtttacaaactgatgctcctttaaaaagagctatattcccaaatggtggattaagaatggttgaaagttcattagaagcttttggttacaagttagatcccacaacaaaagaaatctatgaaaaatatagaaaaagtcataatgctggagttttctcagcttatacacctgcaataaaagctgcaagacatactggagttattactggacttcctgatgcttatggtagaggaagaatcataggagattatagaagagttgctctttatggtgttgatagacttattgaagaaagaaaaagagaatttgatgcttatgatcctgaagaaatgacagaagatgttatcagagatagagaagaaatgtttgaacaattagaagcattaaaagcattaaaaagaatggctgctgcttatggttttgatataggaagacctgctgaaactgctcaagaagctattcaatggacttattttggatacttaggagctattaaagaccaaaatggtgctgcaatgagtttaggtaaaactgctggtttcttagatgtatatatagaaagagacttaaaagaaggaagaatcactgaaaaacaagcacaagaatttatagaccatttcatcatgaaacttagaattgtaagattcttaagaactcctgaatatgaccaattattctctggagatccagtatgggtaactgaatcaataggtggtatgaataatgatggtaaatcttgggtaacaaaaaatgcttatagatatttaaatactttatataatttaggaacagctcctgaacctaacttaacaattttatggagtgaaagattaccagaaaattggaaaaaattctgttcaaaagtttcaatagatacatcttcattacaatatgaaaatgatgatattatgagaccacaatttggtgaagactatggaatagcttgttgtgtatctcctatggctataggaaaacaaatgcaattctttggagcaagagctaacttacctaaagcattactttatgctataaatggtggtaaggatgaattaaagaaagaccaagtaacacctgctggtcaatttgaaagaattactagtgactacttagattttgatgaagtttgggaaaaatatgataaaatgcttacttggcttgcttcaacttatataaaagcactaaatattattcactatatgcatgataaatattcttacgaagcattagaaatggctttacactcattagatattaagagaacagaagcttgtggtatagctggactttcaatagttgctgactcacttgctgctattaaatatggtaaagtaagagtaataagagatgaagctggagatgctgttgattatgttgttgaacaaccttatgttccatttggaaataacgatgatagaacagatgaattagcagttaaagtcgttagaacatttatgaataaaattagaagtcataaaatgtatagagatgctgaacctactcaatcagttcttacaataacttcaaatgttgtttatggtaagaaaacaggaaatactcctgatggaagaagagcaggagctccatttggaccaggagcaaaccctatgcatggaagagatactaagggagcagttgcttctctagcatcagttgctaaattaccatttgaagatgcaaatgatggaatttcttatacattcgctataactcctgaaacattaggaaaaacagacgatgaaaagaaaaataacctagttggacttcttgatggatactttaaacaaactggacatcacttaaatgtaaatgtatttggtagagagctattagaagatgctatggaacatcctgaaaattatccacaacttacaataagagtttctggatatgcagtaaactttatcaaattaacaagagaacaacaattagatgttataaacagaactataagtaacaaaatgtaa

SEQ ID NO: 2437 - protein, 743 aa, Fusobacterium nucleatum subsp. nucleatum ATCC 25586
MEAWRGFKSGEWQNSINVSDFIKHNYTEYLGDESFLEGPTENTKKLWDILSGMLKIEREKGIYDAETKTPSKIDAYGAGYISKDLETIVGLQTDAPLKRAIFPNGGLRMVESSLEAFGYKLDPTTKEIYEKYRKSHNAGVFSAYTPAIKAARHTGVITGLPDAYGRGRIIGDYRRVALYGVDRLIEERKREFDAYDPEEMTEDVIRDREEMFEQLEALKALKRMAAAYGFDIGRPAETAQEAIQWTYFGYLGAIKDQNGAAMSLGKTAGFLDVYIERDLKEGRITEKQAQEFIDHFIMKLRIVRFLRTPEYDQLFSGDPVWVTESIGGMNNDGKSWVTKNAYRYLNTLYNLGTAPEPNLTILWSERLPENWKKFCSKVSIDTSSLQYENDDIMRPQFGEDYGIACCVSPMAIGKQMQFFGARANLPKALLYAINGGKDELKKDQVTPAGQFERITSDYLDFDEVWEKYDKMLTWLASTYIKALNIIHYMHDKYSYEALEMALHSLDIKRTEACGIAGLSIVADSLAAIKYGKVRVIRDEAGDAVDYVVEQPYVPFGNNDDRTDELAVKVVRTFMNKIRSHKMYRDAEPTQSVLTITSNVVYGKKTGNTPDGRRAGAPFGPGANPMHGRDTKGAVASLASVAKLPFEDANDGISYTFAITPETLGKTDDEKKNNLVGLLDGYFKQTGHHLNVNVFGRELLEDAMEHPENYPQLTIRVSGYAVNFIKLTREQQLDVINRTISNKM

SEQ ID NO: 2438 - DNA, 2355 bp, Yersinia pestis KIM
  CDS (1)..(2355): transl_table=11
gtgaccagcaacattaacgtgtggccgctacgtctggttttcgagaaattaacattaaaaggtagatgcattatgaccgaacttaatgagaaattggccaaagcatggcacggttttaccaagggtgattggcagaatgaagtcaacgttcgtgactttatccagaaaaactacaccccttatgaaggtgatgaatccttccttgccggctctaccgaagcgaccgacaagctgtgggcgcaagttatggaaggtatcaaactggaaaaccgcactcatgcgccagtggatttcgataccgacgtagcatcaaccattatctcccacgatgcaggctacattaataaagatctggaaactatcgttggtttacagactgaagcgccattgaaacgtgctctgatcccattcggcggcatcaaaatggtcgaaggctcttgtaaagtttatggtcgtgagcttgatccacaactgaaaaaagtcttcaccgaataccgtaaaacacataaccaaggtgtgtttgacgtttataccaaagacatcctgaactgccgtaaatcgggtgtgctgactggcctgccagatgcgtatggccgtggccgtatcatcggtgattaccgtcgcgttgcggtatacggtatcgacttcctgatgaaagacaaactggctcagttcaattcactgcaggctgatttagaaaacggtaaagacctggaaatgactatccagttgcgcgaagaaattgctgaacagcatcgcgctctggctcaaatcaaagagatggcagctaaatacggctgtgatatttcaggtccggcaactaacgcccgcgaagcagttcagtggacttacttcggctatttggctgcagttaaatcccagaacggcgcagcaatgtccttcggtcgtgtttctaccttcctcgatgtgtacatcgaacgtgatatgaaagaaggtaaactgactgaaatcgaagcgcaggaactgattgaccatttggttatgaaactgcgtatggttcgtttcctgcgtacgcctgaatatgatgagctgttctctggtgacccaatctgggcaaccgagtctttggcaggtatgggcgttgatgggcgtactctggtcactaaaaccagcttccgcttcctgaataccctgtataccatggggccatccccagagccgaacatgaccattctgtggtctgagaagctgccactgaacttcaaaaaatatgctgctaaagtgtctatcgatacttcatctgtacagtatgaaaacgatgacctgatgcgtcctgacttcaacaacgatgactacgctatcgcatgttgtgtcagcccaatgattgtgggtaaacaaatgcagttcttcggcgcccgtgccaacctggctaaaaccatgttgtacgcaatcaacggcggcgttgacgaaaaaatgaagatccaggtgggtccgaaagaagcgccaatgatggatgaagtgctggactatgacaaagtcatggaacgcatggatcactttatggattggctggctaaacaatacattactgcgttgaacatcattcactacatgcatgacaagtacagctatgaagctgccctgatggcgctgcatgaccgtgatgtttaccgtactatggcatgtggtatcgcaggtctgtctgttgccgctgactccctgtctgctatcaaatatgccaaagtaaccactatccgtgatgctgatggcctagctgttgacttcaacattgaaggtgaatatccacagtttggtaacaacgactcacgtgttgatgatattgcctgtgatctggttgagcgcttcatgaagaaaattcagaagctgcgtacctaccgcaatgcggttccaactcagtccgtactgaccatcacatctaacgttgtttatggtaagaaaacaggtaacaccccagatggccgccgcgctggtgctccatttggcccaggtgccaacccaatgcacggtcgtgaccaaaaaggtgcggttgcctctctgacttccgtggctaaactgccgtttgcttacgctaaagatggtatctcttacaccttctctatcgtgccaaacgcactgggtaaagacgatgaagtccgtaaagctaacctcgccggtctgatggatggctacttccaccacgaagcgtccatcgaaggtggtcaacacctgaacgtgaacgtaatgaaccgtgagatgctgttagacgcgatggagaacccggaaaaatatccgcagttgaccattcgtgtatctggttatgctgttcgcttcaacgcgctgaccaaagaacagcagcaggatgtgattacccgtacctttacacagtcaatctaa

SEQ ID NO: 2439 - protein, 784 aa, Yersinia pestis KIM
MTSNINVWPLRLVFEKLTLKGRCIMTELNEKLAKAWHGFTKGDWQNEVNVRDFIQKNYTPYEGDESFLAGSTEATDKLWAQVMEGIKLENRTHAPVDFDTDVASTIISHDAGYINKDLETIVGLQTEAPLKRALIPFGGIKMVEGSCKVYGRELDPQLKKVFTEYRKTHNQGVFDVYTKDILNCRKSGVLTGLPDAYGRGRIIGDYRRVAVYGIDFLMKDKLAQFNSLQADLENGKDLEMTIQLREEIAEQHRALAQIKEMAAKYGCDISGPATNAREAVQWTYFGYLAAVKSQNGAAMSFGRVSTFLDVYIERDMKEGKLTEIEAQELIDHLVMKLRMVRFLRTPEYDELFSGDPIWATESLAGMGVDGRTLVTKTSFRFLNTLYTMGPSPEPNMTILWSEKLPLNFKKYAAKVSIDTSSVQYENDDLMRPDFNNDDYAIACCVSPMIVGKQMQFFGARANLAKTMLYAINGGVDEKMKIQVGPKEAPMMDEVLDYDKVMERMDHFMDWLAKQYITALNIIHYMHDKYSYEAALMALHDRDVYRTMACGIAGLSVAADSLSAIKYAKVTTIRDADGLAVDFNIEGEYPQFGNNDSRVDDIACDLVERFMKKIQKLRTYRNAVPTQSVLTITSNVVYGKKTGNTPDGRRAGAPFGPGANPMHGRDQKGAVASLTSVAKLPFAYAKDGISYTFSIVPNALGKDDEVRKANLAGLMDGYFHHEASIEGGQHLNVNVMNREMLLDAMENPEKYPQLTIRVSGYAVRFNALTKEQQQDVITRTFTQSI

SEQ ID NO: 2440 - DNA, 2268 bp, Thermosynechococcus elongatus BP-1
  CDS (1)..(2268): transl_table=11
atgaactgtacacgctacactacacgctacacagaattgcccgaagcggcatggcaagaatttacagggggtgactgggttgagcgcattgatgtgcgtgacttcattcagcgcaactataccccctacacgggagatggctccttcctcgtaggcgccagcgatcgcacccagcaactatgggcaaaagtgcgtgacctaatggctttagagcgcgaaaaaggcgtccttgatgccgataccagcctgccttcctcaattacagcccacccaccgggttacatcgatcgggagctggagcaaatcgttggcctgcaaaccgataagcccttgaaacgggcgattatgccctttggtggcattcgcgtggtggaaaccgccctcaaggcctacggctacgaactggatccgcgcacgaaggaaatctttaccaaatatcgcaaaacccacaatgatggcgtctttgatgcctacacacccgaaatgcgccgctgccgtaaatcggggatcattacaggactgccagatgcctacggtcggggtcggattattggtgactatcgccgcgtgcccctctacggggtagatcgcttgattgccgacaaacaggcgcagcaggcctcccttgaagtggacgtcatggatgaagaaaccatccgcctgcgggaagagctctcagagcaaatcaaagccctcaatgaactcaaggacatggccgccagctatggctttgatatttcgcggccagcggccaatggcaaagaggctattcagtggctctactttggctacctggcggcggtcaaagaacaaaacggcgctgccatgtcccttgggcgagtctcgacctttcttgacatttactttgaacgggatttgcgtcacggcacagccacagaagccgacattcaagagtggattgaccactttgtcatgaaactgcggatggtgcgtttcctgcggacgccggaatacaatgaactcttctctggggatcccacctgggtcacggagtccattggcggtatgggtcttgatggtcgcccgttggtgacaaaaaccagcttccgtattctgaatacactctataccctggggcctgcccccgaacccaacctgacggtgctgtggtcggaaaacttgccagaggccttcaagcgtttctgtgcccaagtgtccattgacaccagttcgatccaatacgaaaacgatgacttgatgcgtccctactggggggatgactacgcgatcgcctgctgcgtttcggcgatgcgagtcggcaaacaaatgcaattctttggcgcacgggtgaacttggccaaagccctcctctacgcaatcaacgggggtcgggatgaagtctctggtcagcaggtggcacccatgtttgcgccgattaccggcgacacactgaagtgggaagaggtgctgccgcgctttgagcagatgatggcttggttggcgaaggtgtatgtcaataccctcaacgtcatccactacatgcacgataagtactgctatgagcggctggagatggcactccacgatcgcgatgtcttccgcaccatggcctgtggtgtggcgggtctgtcggtggtggcggatgccctctcggccattaaatacgccgaggtgaaagtcatccgcaatgccgacgggttggccgtggactacgagatcaagggcgactttccgaagtacggtaacaatgacgatcgcgtggatagtctggcggtgtgggtcgtggaaaccttcatgaatgaagtccgcaaacacaaaacctaccgcaatgcagtgcccacgcagtcaatcctgacgattacctccaacgtcgtctatggcaagaaaaccggcagtactcccgatggccgcaaggcgggtgaacctttcgcaccaggggccaaccccatgcacggtcgcgataccaaaggggcgatcgcctcactagcgtccgtggccaagttgccctatgtccatgcccaagatggcatctccaacaccttctccatcgtgcctagtgccctcggcaagacacgggaagatcaaattagcaacctggtgaatatgttggatgggtacatccatgatcagggcttccacatcaacgtcaacgtgctcaatcgcgaaatgttgctggatgcgatggatcaccctgaactgtacccacaactcaccattcgggtgtccgggtatgcggtgaatttcattaaactcacccgcgaacaacagttggatgtcattaaccgtacgttccacgaacgcttttag

SEQ ID NO: 2441 - protein, 755 aa, Thermosynechococcus elongatus BP-1
MNCTRYTTRYTELPEAAWQEFTGGDWVERIDVRDFIQRNYTPYTGDGSFLVGASDRTQQLWAKVRDLMALEREKGVLDADTSLPSSITAHPPGYIDRELEQIVGLQTDKPLKRAIMPFGGIRVVETALKAYGYELDPRTKEIFTKYRKTHNDGVFDAYTPEMRRCRKSGIITGLPDAYGRGRIIGDYRRVPLYGVDRLIADKQAQQASLEVDVMDEETIRLREELSEQIKALNELKDMAASYGFDISRPAANGKEAIQWLYFGYLAAVKEQNGAAMSLGRVSTFLDIYFERDLRHGTATEADIQEWIDHFVMKLRMVRFLRTPEYNELFSGDPTWVTESIGGMGLDGRPLVTKTSFRILNTLYTLGPAPEPNLTVLWSENLPEAFKRFCAQVSIDTSSIQYENDDLMRPYWGDDYAIACCVSAMRVGKQMQFFGARVNLAKALLYAINGGRDEVSGQQVAPMFAPITGDTLKWEEVLPRFEQMMAWLAKVYVNTLNVIHYMHDKYCYERLEMALHDRDVFRTMACGVAGLSVVADALSAIKYAEVKVIRNADGLAVDYEIKGDFPKYGNNDDRVDSLAVWVVETFMNEVRKHKTYRNAVPTQSILTITSNVVYGKKTGSTPDGRKAGEPFAPGANPMHGRDTKGAIASLASVAKLPYVHAQDGISNTFSIVPSALGKTREDQISNLVNMLDGYIHDQGFHINVNVLNREMLLDAMDHPELYPQLTIRVSGYAVNFIKLTREQQLDVINRTFHERF

SEQ ID NO: 2442 - DNA, 2415 bp, Bifidobacterium longum NCC2705
  CDS (1)..(2415): transl_table=11
gtgaagatgcgaaacctacaaccccatttaaggagtgacatgaccgcagtggaaaatgcagctgtctcccaggaggagctcgacgccaaggcgtgggccggcttcaccgagggcaactggcagaaggatattgacgtccgcgacttcatccagaagaactacaccccgtacgagggcgacgagacattcctggctcctgccaccgagaagaccaagcacctgtggaagtacctcgacgacaactacctggccgtggagcgcaagcagcgcgtctacgacgtggacacccataccccggccgacgtcgacgccttcccggccggctacatcgactccccggaagtcgataacgtggtcgttggcctccagaccgacgttccctgcaagcgcgcgatgatgccgaacggtggctggcgcatggtcgagcaggccatcaaggaagccggcaaggaaccggatccggagatcaagaagatcttcaccaagtaccgcaagacccacaacgacggcgtcttcggcgtgtacaccaagcagatcaaggtcgcccgccacaacaagatcctcaccggtctgccggacgcctacggccgtggccgcatcatcggcgactaccgccgcgtcgccctgtacggcgtgaacaagctcatcgccttcaagaagcgcgacaaggactccgtgccgtaccgcaacgacttcaccgagccggagatcgagcactggatccgcttccgtgaggagcacgacgagcagatcaaggccctgaagaagctcatcaacctcggcaacgagtacggcctcgacctgtcccgcccggcccagaccgcgcaggaagccgtgcagtggacctacatgggctacctggcctccatcaagtcccaggacggcgccgccatgtccttcggccgcaactccgccttcctcgactgctacatcgagcgcgacctccaggccggcaagatcaccgagaccgacgcccaggagctcatcgacaacatcgtcatgaagctgcgcatcgtgcgcttcctgcgtaccaaggactacgattcgatcttctccggcgacccgtactgggcgacctggtccgacgccggcttcggcgatgacggccgttcgatggtcaccaagacctcgttccgtctgctcaacaccctgaccctcgagcacctcggacctggccccgagccgaacatcaccatcttctgggatccgaagctgcctgaggcctacaagcgcttctgcgccaagatctccatcgacacctcggccatccagtacgagtccgacaaggagattcgtagccactggggcgacgacgcggctatcgcatgctgcgtgtccccgatgcgtgtcggcaagcagatgcagttcttcgccgcccgcgtgaactccgccaaggccctgctgtacgccatcaacggcggccgcgacgagatgaccggcatgcaggtcatcgacaagggcgtgatcgagccgattaccccggaggccgacggcaccctggactacgagaaggtcaagaacaactacgagaaggctctcgagtggctgtccgagacctacgtcatggccctgaacatcatccactacatgcacgataagtacgcgtacgagtccatcgagatggccctgcacgacaaggaagtgtaccgcaccctcggctgcggcatgtccggtctgtccatcgccgccgactccctcgccgccgtcaagtacgccaaggtctacccgatctacaacaaggacgcgaagaccctggaaggccacgagtacgagtacgttgagggcgccgacgacgacctgatcgtcggctaccgcaccgagggcgagttcccggtctacggcaacgacgacgaccgcgccgacgacatcgccaagtgggtcgtctccacggtcatgggccaggtcaagaggctcccggtctaccgcggcgccgtcccgacccagtccatcctgacgatcacctccaacgtcgagtacggcaagaacaccggttccttcccgtccggccacgccaagggcaccccgtacgctccgggcgccaacccggagaacggcatggactcccacggcatgctgccgtccatgttctccgtcggcaagatcgactacaacgacgctcttgacggcatctcgctgaccaacaccatcacccctgatggcctgggccgcgacgaggacgagcgcatcggcaacctggtcggcatcctggacgccggcaacggccacggcctctaccacgcgaacatcaacgttctgcgcaaggagaccatggaggacgccgtcgagcaccccgaaaagtacccgcacctgaccgtgcgtgtctccggctacgcggtgaacttcgtcaagctcaccaaggagcagcagctcgacgtcatctcccgtaccttccaccagggtgccgtcgtcgactga

SEQ ID NO: 2443 - protein, 804 aa, Bifidobacterium longum NCC2705
MKMRNLQPHLRSDMTAVENAAVSQEELDAKAWAGFTEGNWQKDIDVRDFIQKNYTPYEGDETFLAPATEKTKHLWKYLDDNYLAVERKQRVYDVDTHTPADVDAFPAGYIDSPEVDNVVVGLQTDVPCKRAMMPNGGWRMVEQAIKEAGKEPDPEIKKIFTKYRKTHNDGVFGVYTKQIKVARHNKILTGLPDAYGRGRIIGDYRRVALYGVNKLIAFKKRDKDSVPYRNDFTEPEIEHWIRFREEHDEQIKALKKLINLGNEYGLDLSRPAQTAQEAVQWTYMGYLASIKSQDGAAMSFGRNSAFLDCYIERDLQAGKITETDAQELIDNIVMKLRIVRFLRTKDYDSIFSGDPYWATWSDAGFGDDGRSMVTKTSFRLLNTLTLEHLGPGPEPNITIFWDPKLPEAYKRFCAKISIDTSAIQYESDKEIRSHWGDDAAIACCVSPMRVGKQMQFFAARVNSAKALLYAINGGRDEMTGMQVIDKGVIEPITPEADGTLDYEKVKNNYEKALEWLSETYVMALNIIHYMHDKYAYESIEMALHDKEVYRTLGCGMSGLSIAADSLAAVKYAKVYPIYNKDAKTLEGHEYEYVEGADDDLIVGYRTEGEFPVYGNDDDRADDIAKWVVSTVMGQVKRLPVYRGAVPTQSILTITSNVEYGKNTGSFPSGHAKGTPYAPGANPENGMDSHGMLPSMFSVGKIDYNDALDGISLTNTITPDGLGRDEDERIGNLVGILDAGNGHGLYHANINVLRKETMEDAVEHPEKYPHLTVRVSGYAVNFVKLTKEQQLDVISRTFHQGAVVD

SEQ ID NO: 2444 - DNA, 2283 bp, Shewanella oneidensis MR-1
  CDS (1)..(2283): transl_table=11
atgaccgacaaaactgaactgtttgccaacgcatgggaaggttttacccctggtgattggaaatctgaagtcaatgtacgtgactttattcaacaaaactacgctccctatgaaggtgacgagtcattcctagccggtgccaccgacgccacaacccagttgtgggataaagtgatggaaggcatcaagcaagaaaaccgtacccatgcgccagttgatttcgatactaagatggtttctaccatcacttcccacgacgcgggttatatcaataaagatttagaaactatcgttggtttacaaactgatgcgccgctcaaacgcgctatgttacctaacggtggtattcgtatggtggaaagctcatgcgccgcctacgatcgcgtgctagatgaagatgttaaatacatttattcagaactgcgtaaaacccacaaccaaggcgtattcgacgtctataccccagaaatcatggcctgccgtaaatccggtgtattaaccggtttacccgatgcctatggccgtggccgtatcattggtgactatcgccgtgtagcactttacggtatcgacttcttaatgaaggacaaattcgctcaattcagctcactgcaagcgcagttcgaagcgggtgaagatttgtctaacgttatccaactacgtgaagaaattgctgagcagcaccgtgcattgggccaaatgaagaaaatggccgctaaatatggtttcgatatttctcgcccagcatccaatgctaaagaagcaatccagtggacttacttcggctacttagccgcagtgaagagccaaaacggcgccgcaatgtctttaggccgtacttcttcattccttgatatctatatcgaacgcgatctgaaaaacggcgtcatcactgagcaacaagctcaagaaatgattgaccattttgtaatgaaactgcgtatggtgcgtttcctacgtactccagaatacgatgagttattctcaggcgatccaatttgggcaactgaatctatcggcggtatgggcttagatggccgtacactggtgactaaatcaagcttccgtttcttgaacacgctgtacaccatgggcccaagccctgagccaaacatcactgtgctctggtctgaaaaactgccagtaggctttaaaaagtactgcgcaaaagtatctatcgacaccagctcaatccagtacgaaaacgatgacttaatgcgtccagatttccaatctgacgattacgctatcgcttgctgcgtgagcccaatggttgtgggtaaacacatgcagttcttcggtgcccgtgccaacctcgccaaaaccatgttgtacgcgattaacggcggtgtggacgaaaaactgaagatccaaatcgcccccaaagcagacccaatcactgacaaagtactgaactttgatgatgtgatgaatcgcttagacggtttaatggattggttagcaacgcaatatgtcacttctctgaacgctattcactacatgcacgacaagtactcctatgaagctgcgctaatggcgctgcacgacagagacgtacgtcgtactatggcttgcggtattgctggactttcaatcgcagccgactcactgtctgctatcaagtacgctcaagttaaacctgtacgtgatgaaaacggcatcgccgttgactttgagatcagtggtgactatccaaaatttggtaacaacgacccacgcgttgacgatatcgcctgtgacttagttgaacgttttatggcgaaaattcgcgaccgtaaaatgtaccgcaacgcgattccaactcagtcaattctcaccatcacctcaaacgtggtttatggtaagaaaacgggtaatacaccagatggtcgtcgttcaggtgcaccatttgcaccgggcgcaaacccaatgcatggccgtgatgaaaaaggtgcaatcgcctcattaacctctgtggctaagctgcctttcgcccacgcacaggacggtatctcttacaccttctccatcgtgccaaatgcattaggtaaagatgaagatggtcgccgcactaacttagcggcactgatggacggatattttgcccataacgaaggacacgaaggcggtcaacacttgaacgtcaacgtgatgaaccgtgaaatgcttgaggatgcggtagtcaacccagacaagtatccacaactgaccatccgtgtttctggttatgcagtgcgcttcaactcgctgactccagaacagcagcaagatgtgatcacgcgtacattcacaaaaggtctgtaa

SEQ ID NO: 2445 - protein, 760 aa, Shewanella oneidensis MR-1
MTDKTELFANAWEGFTPGDWKSEVNVRDFIQQNYAPYEGDESFLAGATDATTQLWDKVMEGIKQENRTHAPVDFDTKMVSTITSHDAGYINKDLETIVGLQTDAPLKRAMLPNGGIRMVESSCAAYDRVLDEDVKYIYSELRKTHNQGVFDVYTPEIMACRKSGVLTGLPDAYGRGRIIGDYRRVALYGIDFLMKDKFAQFSSLQAQFEAGEDLSNVIQLREEIAEQHRALGQMKKMAAKYGFDISRPASNAKEAIQWTYFGYLAAVKSQNGAAMSLGRTSSFLDIYIERDLKNGVITEQQAQEMIDHFVMKLRMVRFLRTPEYDELFSGDPIWATESIGGMGLDGRTLVTKSSFRFLNTLYTMGPSPEPNITVLWSEKLPVGFKKYCAKVSIDTSSIQYENDDLMRPDFQSDDYAIACCVSPMVVGKHMQFFGARANLAKTMLYAINGGVDEKLKIQIAPKADPITDKVLNFDDVMNRLDGLMDWLATQYVTSLNAIHYMHDKYSYEAALMALHDRDVRRTMACGIAGLSIAADSLSAIKYAQVKPVRDENGIAVDFEISGDYPKFGNNDPRVDDIACDLVERFMAKIRDRKMYRNAIPTQSILTITSNVVYGKKTGNTPDGRRSGAPFAPGANPMHGRDEKGAIASLTSVAKLPFAHAQDGISYTFSIVPNALGKDEDGRRTNLAALMDGYFAHNEGHEGGQHLNVNVMNREMLEDAVVNPDKYPQLTIRVSGYAVRFNSLTPEQQQDVITRTFTKGL

SEQ ID NO: 2446 - DNA, 2313 bp, Streptococcus agalactiae NEM316
  CDS (1)..(2313): transl_table=11
atggcaacagttaaaacaaacacagatatctttgaacaagcttgggaaggctttaaaggtgttgattggaaagaaaaagcaagtattgctcgcttcgttcaagcaaactatgcaccttacgatggagatgaaagcttcttagctggagcaactgaacgttcacttcacatcaaaaaagtgattgaagaaacaaaagctcactatgaagaaactcgcttcccaatggatactcgtgttgcttcaatttctgaattaccagctggttttatcgacaaagatagcgaactcatctttggtattcaaaacgacgagcttttcaaattgaacttcatgcctaaaggtggtatccgtatggcggaaactacacttaaagaaaatggttatgaacctgatccagctgttcacgaaatcttcactaagtacgctacaacagtaaatgatggtatcttccgcgcttatacttctaacattcgtcgtgctcgccatgcacacactgttactggtcttccagacgcttattcacgcggacgtatcattggtgtatatgctcgtctagctgtttacggtgctgactacttgatgcaagaaaaagttaatgactggaatgcattgaatgatattgatgaagagtcaattcgtcttcgtgaagaaatcaaccttcaataccaagctcttggtgaagttgtaaaacttggtgacctttacggcgtagatgttcgtaaaccagccatgaacactaaagaagccattcaatgggtgaacattgctttcatggctgtatgtcgtgttatcaatggtgctgcaacatcacttggacgtgttcctattgtccttgatatctttgcagaacgtgacctcgctcgcggtacattcacagaatcagaaatccaagaatttgttgatgattttgtccttaaactccgtactgtaaaatttgctcgtactaaagcttatgatgccctttactcaggtgacccaacctttatcacaacttcaatggcaggtatgggagctgatggacgtcatcgtgttaccaaaatggactatcgtttcttaaatacacttgacaatatcggtaactcaccagaaccaaacttaactgttctttggtcagaccaattaccatatgctttccgtcgctactgtatgtcaatgagtcataaacactcttcaatccaatatgaaggtgtatcaacaatggctaaagaaggctacggtgaaatgtcatgtatttcatgttgtgtatctccacttgatccagaaaacgaagacaaacgtcacaaccttcaatattttggtgctcgtgttaacgttatgaaagcacttcttactggtcttaacggtggttatgatgatgttcataaagattacaaagtatttgacatcgacccaattcgtgacgaagtactcaactttgacactgtaaaagctaactttgaaaaatctcttgactggttgactgatacttatgttgatgcgatgaatatcatccactacatgactgataaatacaactatgaagctgtacaaatggcattcttaccttcacatgtacgtgctaatatgggatttggtatctgtggttttgcaaatactgtcgattcattatctgcgattaaatacgctactgttaaaccaatccgtgacgaagatggttacatctacgactacgaaacagttggtgacttcccacgttatggtgaagatgatgatcgtgttgactcaatcgctgaatggttacttgaagccttccatggacgccttgctaaacacaaactttataaagatgctgaagcaactgtttctcttcttacaatcacatcaaacgttgcttactctaaacaaactggtaactcaccggtacataaaggagtatatctcaatgaagatggtagtgtaaacctttctaaagtagaattcttctcaccaggcgctaacccttctaacaaagctaaaggtggctggttacaaaacttgaattcactttctaaacttgatttcgctcatgcaaatgatggtatttcattgacaactcaagtttctccacgcgctcttggtaaaacatttgatgaacaagttgataacttggtaacagtccttgatggttactttgaaaacggtggtcaacacgttaacttgaatgtcatggaccttaaagatgtctatgacaagattatgaatggtgaagatgttatcgttcgtatctcaggttactgtgtcaatactaaatatctaactcctgagcaaaaaactgagttaacacaacgtgtcttccatgaagtactttcaatggacgatgcattaactaactag

SEQ ID NO: 2447 - protein, 770 aa, Streptococcus agalactiae NEM316
MATVKTNTDIFEQAWEGFKGVDWKEKASIARFVQANYAPYDGDESFLAGATERSLHIKKVIEETKAHYEETRFPMDTRVASISELPAGFIDKDSELIFGIQNDELFKLNFMPKGGIRMAETTLKENGYEPDPAVHEIFTKYATTVNDGIFRAYTSNIRRARHAHTVTGLPDAYSRGRIIGVYARLAVYGADYLMQEKVNDWNALNDIDEESIRLREEINLQYQALGEVVKLGDLYGVDVRKPAMNTKEAIQWVNIAFMAVCRVINGAATSLGRVPIVLDIFAERDLARGTFTESEIQEFVDDFVLKLRTVKFARTKAYDALYSGDPTFITTSMAGMGADGRHRVTKMDYRFLNTLDNIGNSPEPNLTVLWSDQLPYAFRRYCMSMSHKHSSIQYEGVSTMAKEGYGEMSCISCCVSPLDPENEDKRHNLQYFGARVNVMKALLTGLNGGYDDVHKDYKVFDIDPIRDEVLNFDTVKANFEKSLDWLTDTYVDAMNIIHYMTDKYNYEAVQMAFLPSHVRANMGFGICGFANTVDSLSAIKYATVKPIRDEDGYIYDYETVGDFPRYGEDDDRVDSIAEWLLEAFHGRLAKHKLYKDAEATVSLLTITSNVAYSKQTGNSPVHKGVYLNEDGSVNLSKVEFFSPGANPSNKAKGGWLQNLNSLSKLDFAHANDGISLTTQVSPRALGKTFDEQVDNLVTVLDGYFENGGQHVNLNVMDLKDVYDKIMNGEDVIVRISGYCVNTKYLTPEQKTELTQRVFHEVLSMDDALTN

SEQ ID NO: 2448 - DNA, 2295 bp, Escherichia coli CFT073
  CDS (1)..(2295): transl_table=11
atgaaggtagatattgataccagcgataagctgtacgccgacgcatggcttggctttaaaggtacggactggaaaaacgaaattaatgtccgcgattttattcaacataactatacaccttatgaaggcgatgaatcttttctcgccgaagcgacgcctgccaccacggaattgtgggaaaaagtcatggaaggcatccgtatcgaaaatgcgactcacgcgccattggatttcgataccaatattgccaccacaattaccgctcatgatgcaggatatattgaccagccgctggaaaaaatagtgggtctgcaaacggatgcgccattaaagcgtgcactgcatccgttcggcggcattaatatgattagaagttcattccacgcgtatggtcgtgaaatggatagcgaatttgaatacatctttaccgatctgcgtaaaacccataaccagggcgtatttgatgtttactcaccggatatgctgcgctgccgtaaatctggtgtactgaccggtttaccagatggttatggtcgtgggcgtatcatcggtgactaccgccgcgtggcgctttacggcatcagttatctggtacgtgaacgcgaactgcagtttgccgatctccagtcccgtctggaaaaaggcgaagatctcgaagctacgctccgtctgcgtgaggagctggcggaacatcgtcgtgcgctgttgcagattcaagaaatggcggcgaaatacggttttgacatctcccgtccggcgcagaatgcacaggaagcggtgcagtggctctacttcgcttacctggcggcagtgaaatcgcaaaatggcggcgcgatgtcgctggggcgcacggcatcgttcctcgatatctacattgagcgcgactttaaagcaggcgtactcaatgagcagcaggcacaggaactgatcgaccacttcatcatgaagatccgtatggtgcgcttcttgcgtacgccggaatttgattcgctgttctccggcgacccgatctgggcgacggaagtgatcggcgggatggggctggacggtcgaaccctggtgaccaaaaactccttccgctatttgcacaccctgcacactatggggcctgcaccggaacctaacctgactattctgtggtcggaagccttgccgattgccttcaaaaaatatgccgcgcaggtgtctatcgtcacatcctctttgcagtatgaaaacgacgatctgatgcgtactgacttcaatagcgacgattacgcgattgcctgttgcgtcagcccaatggtgattggtaagcaaatgcagttctttggagcacgcgctaacctggcgaaaacgctactgtacgcaatcaacggcggaatggacgagaagctgaagattcaggttggcccgaaaacggctccgttgatggatgacgtgctggactacgacaaagtgatggatagcctcgaccacttcatggactggctggcggtacagtacatcagcgcgctgaatatcattcactacatgcacgacaagtacagctacgaagcttcgctgatggcgctacatgatcgtgatgtctatcgcaccatggcgtgcggcatcgcgggcctgtcggtggcaacggactccctgtctgccatcaaatatgctcgtgtgaaaccaatccgtgatgaaaacggcctggcggtggatttcgagattgacggcgaatatccgcagtatggcaacaacgacgagcgcgtagacagcattgcctgcgatctggttgaacgctttatgaagaaaattaaagctttgccaacctatcgcaatgctgtgccgacccaatcgattctgactatcacctctaacgtggtgtacggtcagaaaaccgggaacacgccggacggtcgccgcgccggaacaccgttcgcgccgggcgctaacccgatgcacggtcgtgatcgcaaaggcgccgtagcctcattgacgtcggtggcgaaactgccattcacctacgccaaagatgggatctcgtacaccttctccatcgtccctgcggcgctgggcaaagaagatccgatacgtaaaacgaaccttgtcggcctgctggatgggtatttccaccacgaagcggatgtcgaaggcggtcaacacctcaacgtcaacgtaatgaatcgggaaatgctgctggatgccatcgagcacccggaaaaatatcctaacctgacaatccgtgtctctggctacgccgtgcgcttcaacgcactgacccgtgaacagcaacaggatgttatttcacgtacctttacccaggcgctctga

SEQ ID NO: 2449 - protein, 764 aa, Escherichia coli CFT073
MKVDIDTSDKLYADAWLGFKGTDWKNEINVRDFIQHNYTPYEGDESFLAEATPATTELWEKVMEGIRIENATHAPLDFDTNIATTITAHDAGYIDQPLEKIVGLQTDAPLKRALHPFGGINMIRSSFHAYGREMDSEFEYIFTDLRKTHNQGVFDVYSPDMLRCRKSGVLTGLPDGYGRGRIIGDYRRVALYGISYLVRERELQFADLQSRLEKGEDLEATLRLREELAEHRRALLQIQEMAAKYGFDISRPAQNAQEAVQWLYFAYLAAVKSQNGGAMSLGRTASFLDIYIERDFKAGVLNEQQAQELIDHFIMKIRMVRFLRTPEFDSLFSGDPIWATEVIGGMGLDGRTLVTKNSFRYLHTLHTMGPAPEPNLTILWSEALPIAFKKYAAQVSIVTSSLQYENDDLMRTDFNSDDYAIACCVSPMVIGKQMQFFGARANLAKTLLYAINGGMDEKLKIQVGPKTAPLMDDVLDYDKVMDSLDHFMDWLAVQYISALNIIHYMHDKYSYEASLMALHDRDVYRTMACGIAGLSVATDSLSAIKYARVKPIRDENGLAVDFEIDGEYPQYGNNDERVDSIACDLVERFMKKIKALPTYRNAVPTQSILTITSNVVYGQKTGNTPDGRRAGTPFAPGANPMHGRDRKGAVASLTSVAKLPFTYAKDGISYTFSIVPAALGKEDPIRKTNLVGLLDGYFHHEADVEGGQHLNVNVMNREMLLDAIEHPEKYPNLTIRVSGYAVRFNALTREQQQDVISRTFTQAL

SEQ ID NO: 2450 - DNA, 2277 bp, Vibrio vulnificus CMCP6
  CDS (1)..(2277): transl_table=11
atggcagagcaatttgctaaagcttgggaaggttttgcagcaggtgactggcaaaacgaagtaaacgttcgtgatttcattcagaagaactacactccgtacgaaggcgacgaatctttcctagtttctgaaggtactgaagcaaccaacaagctttgggctaaggtaatggaaggtatcaaaattgagaactcaactcacgctccagttgatttcgatactgacctaatctctaccatcactgctcacgatgcaggctacattgaaaaagatctagagactatcgttggtctacaaactgacgcacctctaaaacgcgctatcatccctaacggtggtatccgcatggttgagggttcttgtaaagtttacggtcgtgaactcgatcctcaaatctctaaaatctactctgaataccgcaaaacacacaacgctggcgtattcgatatctacactccagatatcctagcttgtcgtaagtctggtgttctaactggtcttccagacgcttacggccgtggtcgtatcatcggtgactaccgtcgtgttgcactttacggtatcgacttcctaatgaaggacaaactggctcaattcaagtctctacaagagcgttttgagaacggtgaagatcttcaaatgactatgcaacttcgtgaagagattgctgagcaacaccgcgctctaggtcaaatgaaagtgatggcagcgaaatacggttacgatatttctcgcccagctgaaactgcacaagaagctatccaatggacttacttcggctacctagcggctgttaagtctcaaaacggtgctgcaatgtctctaggccgtacttctacgttcctagacgtgtacatcgagcgtgatatcgctgctggtaagatcactgaagttgaagctcaggaaatgatcgaccacttcgtaatgaaactacgtatggttcgtttcctacgtactcctgagtacgatgatctattctctggcgacccaatctgggcaacagaatctatgggtggtatgggtcttgacggtcgtacgctagtaacgcgttcaaacttccgtttcctaaacagcctatacacaatgggtccttctccagagccaaacatcactgtactttggtctgagcaactacctgaaggcttcaagaagttctgtgcgaaagtatctatcgatacttcttcaatccagtacgaaaacgacgacctaatgcgtccagacatgaactctgacgactacgcaatcgcatgttgtgtatctccaatggttgttggtaagcaaatgcagttcttcggcgctcgtgcaaaccttgcaaaaacgatgctttacgcaatcaacggtggtgttgatgagaagctgaaaatgcaagttggcccagtaatgcctaagatcacttcagaagtcctaagcttcgacgaagtgtggaacaacctagaccacttcatggactggctagcgaagcaatacgttgctgcactaaacgcaatccacttcatgcacgacaagtacagctatgagtctgcactaatggcactacacgatcgtgatgtttaccgcacaatggcttgtggtatcgctggtctatctatcgcagctgactcactatctgcaatcaagtacgcgaaagtgaaaccaatccgtgacgaagatggcgtagctatcgacttcgaaatcgaaggcgactaccctaaattcggtaacaacgatgctcgcgtagatgacatcgcttgtgaacttgttgaagtgttcatgaacaagatccgtaagcttaagacttaccgtgatgctgttcctactcagtctatcctaactatcacatcaaacgtggtatacggtaagaagacaggtaatacgccagacggtcgtcgcgcaggtgctccatttgcaccaggtgcaaacccaatgcacggtcgtgatgagaaaggtgctgtagcgtctctaacttcagtaggtaaactaccatttgctcacgcgaaagacggtatctcttacaccttctctatcgtacctaacgcacttggtaaagatgagaacgctcaacgcgctaaccttgctggtctgatggatggttacttccaccacgaagctggcatcgaaggcggtcaacacttgaacgtaaacgttctaaaccgtgacacgcttctagacgcagttaagcacccagagaagtaccctcagctaactatccgtgtatctggatacgcagttcgctttaactctctaactgcagagcaacaagctgacgttatcgcacgtactttcactgaatctctataa

SEQ ID NO: 2451 - protein, 758 aa, Vibrio vulnificus CMCP6
MAEQFAKAWEGFAAGDWQNEVNVRDFIQKNYTPYEGDESFLVSEGTEATNKLWAKVMEGIKIENSTHAPVDFDTDLISTITAHDAGYIEKDLETIVGLQTDAPLKRAIIPNGGIRMVEGSCKVYGRELDPQISKIYSEYRKTHNAGVFDIYTPDILACRKSGVLTGLPDAYGRGRIIGDYRRVALYGIDFLMKDKLAQFKSLQERFENGEDLQMTMQLREEIAEQHRALGQMKVMAAKYGYDISRPAETAQEAIQWTYFGYLAAVKSQNGAAMSLGRTSTFLDVYIERDIAAGKITEVEAQEMIDHFVMKLRMVRFLRTPEYDDLFSGDPIWATESMGGMGLDGRTLVTRSNFRFLNSLYTMGPSPEPNITVLWSEQLPEGFKKFCAKVSIDTSSIQYENDDLMRPDMNSDDYAIACCVSPMVVGKQMQFFGARANLAKTMLYAINGGVDEKLKMQVGPVMPKITSEVLSFDEVWNNLDHFMDWLAKQYVAALNAIHFMHDKYSYESALMALHDRDVYRTMACGIAGLSIAADSLSAIKYAKVKPIRDEDGVAIDFEIEGDYPKFGNNDARVDDIACELVEVFMNKIRKLKTYRDAVPTQSILTITSNVVYGKKTGNTPDGRRAGAPFAPGANPMHGRDEKGAVASLTSVGKLPFAHAKDGISYTFSIVPNALGKDENAQRANLAGLMDGYFHHEAGIEGGQHLNVNVLNRDTLLDAVKHPEKYPQLTIRVSGYAVRFNSLTAEQQADVIARTFTESL

SEQ ID NO: 2452 - DNA, 2259 bp, Lactobacillus plantarum WCFS1
  CDS (1)..(2259): transl_table=11
atgattacatcagaaaagacaacaaaaccagcagcttggaaaggtttcaaaggcgggcactggcaggaagaaatcaacattcgtgattttattcaaaataacttcacacagtacaatggcgacgaaagcttcctggccggaccaacagccgctactaagaccttgaatgacaaagtcttagaattaaagaaacaagaacgtgccgctggtggtgtgttggatgctgatactaaagtcgttgcaacgattacttcacacggccctggttatattcaaaaagatctcgaaaagattgttggtctccagactgacaagcctttgaagcgggccttcatgccatttggtggtattcgaatggctgatgacgctttgaaatcatacggttatacccctgatgaagaaaacgacaagattttcactgaatatcgcaagactcataaccaaggcgtcttcgatgtttatactcctgacatgcggaaagcacgtcactacaagatcatcaccggactaccagatgcatacgcacgtggccgtctcattcctgatcttccacgggtcgctgtttatgggatcgatcgtttaatggaagacaaagctaatgactttgcccacattggtgatggtgaattgactgatgatgttattcgcctccgtgaagaagttcaagatcaataccgtgctttagcagatatgaagaagatggctgccagttatggctacgatattagcaagcctgcaactaatgctcaagaagctattcaatggatgtacttcgcttacttagctgctatcaagacccaaaacggcgctgcaatgtccgttggccggattgatacaacgatggacatcttcatccaacgtgacttggacaatggtgttctggacgaaagccaagctcaagaattaattgatcaattcgtcatgaaactacggatggttcggttcatccgtactgaagaatacaattctctcttctctggtgacccaatctgggcaaccttatcaatgtgtggtttaggcgtcgacggtcaacaccatgtgactaagactgctttccggattttaaagactttggacaacatgggcgccgcaccagaaccaaacatcacgattttatggtcagaccgcttaccagaagacttcaaacgttacgcaactgaagtttcaatcgacagttcaaccattcagtatgaaaatgatgacttgatgcgggtacaatggggtaccgattattatggcattgcttgctgtgtttccgcacaaccaattgctgatggaatccagtacttcggtgcccgggcaaacttagccaaagcgattctttatgccatcaatggtggccgcgacgaaattgctggagatcaagttggccctgcttacgaaccaattacttcagaatacatcgattacgacgaattcatgaagaaattagacaagcaaatggattggttagctgacacttacgttaactcactgaatgcaattcattatatgcatgataagtactactatgaagctgcccaattagctttgaagaatactgatcttgatcggacctttgcaactgggatttctggcttatcacatgccgcggattcaatctcagctatcaagtatggtcacgttaaagtaattcgtgacgaacgtggtatcgccgttgacttcaaagccgacaatgactacccacgttatgggaacaatgacgatcgcgctgatgacattgctaaatggttagtcaaagaattatacagcaagatgaacacgcatcacctctatcggaatgccaaactttcaacttctgttttgacgattacctccaacgttgtttatggtaagaacactggtaccacgccaaatggccgtcaaaaaggcgaaccattctcaccaggtgctaaccctgcatacggtgctgaaaagagtggtgcattagcttcacttctttcaactgccaaattaccataccgttacgcaactgacgggatttccaacacgttcggcgttacccctaacacgttaggccatgacctcgaatcacggaaagacacgttagtaaacatgttagacggttacatgaagaacgatgggatgcacttgaacatcaacgtcttcaataaagacactttgattgatgctcagaaacaccctgaagaatacccaacattaacggttcgggtttctggctattgtgtctacttcgcagatttaaccaaggaacaacaagatgacgttatttcacggacattcttcgaatcaatgtaa

SEQ ID NO: 2453 - protein, 752 aa, Lactobacillus plantarum WCFS1
MITSEKTTKPAAWKGFKGGHWQEEINIRDFIQNNFTQYNGDESFLAGPTAATKTLNDKVLELKKQERAAGGVLDADTKVVATITSHGPGYIQKDLEKIVGLQTDKPLKRAFMPFGGIRMADDALKSYGYTPDEENDKIFTEYRKTHNQGVFDVYTPDMRKARHYKIITGLPDAYARGRLIPDLPRVAVYGIDRLMEDKANDFAHIGDGELTDDVIRLREEVQDQYRALADMKKMAASYGYDISKPATNAQEAIQWMYFAYLAAIKTQNGAAMSVGRIDTTMDIFIQRDLDNGVLDESQAQELIDQFVMKLRMVRFIRTEEYNSLFSGDPIWATLSMCGLGVDGQHHVTKTAFRILKTLDNMGAAPEPNITILWSDRLPEDFKRYATEVSIDSSTIQYENDDLMRVQWGTDYYGIACCVSAQPIADGIQYFGARANLAKAILYAINGGRDEIAGDQVGPAYEPITSEYIDYDEFMKKLDKQMDWLADTYVNSLNAIHYMHDKYYYEAAQLALKNTDLDRTFATGISGLSHAADSISAIKYGHVKVIRDERGIAVDFKADNDYPRYGNNDDRADDIAKWLVKELYSKMNTHHLYRNAKLSTSVLTITSNVVYGKNTGTTPNGRQKGEPFSPGANPAYGAEKSGALASLLSTAKLPYRYATDGISNTFGVTPNTLGHDLESRKDTLVNMLDGYMKNDGMHLNINVFNKDTLIDAQKHPEEYPTLTVRVSGYCVYFADLTKEQQDDVISRTFFESM

SEQ ID NO: 2454 - DNA, 2277 bp, Vibrio parahaemolyticus RIMD 2210633
  CDS (1)..(2277): transl_table=11
atggcagagcaatttgctaaagcttgggaaggttttgttgcaggtgactggcaaaacgaagtaaacgttcgtgatttcattcaaaagaactacactccgtacgaaggcgacgaatctttcctagtttctgaaggtactgaagcaactaacaagctttgggctaaggtaatggaaggtatcaagcaagagaactcaactcacgctcctgttgatttcgatacttctatcatctctaccatcactgctcacgatgcaggctacatcgagaaagatcttgagactatcgttggtcttcaaactgacgctcctctaaaacgcgctatcatccctaacggtggtatccgcatggttgaaggttcgtgcaaagcatacgatcgcgaactagacccacaagttaaaaaaatctttacagaataccgtaaaactcacaacgctggtgttttcgacatctacactccagaaatcctagcttgtcgtaaatctggtgttctaactggtcttccagatgcttacggtcgtggccgtatcatcggtgactaccgccgtgttgctctatacggtatcgacttcctaatgaaggacaaactggctcaattcaaatctctacaagagcgttttgagaacggtgaagatcttcaaatgactatgcagcttcgcgaagagatcgctgagcaacaccgtgcacttggccaaatgaaagttatggcagcgaaatacggttgtgacatctctcgccctgctgaaactgcacaagaagctatccaatggacttacttcggctacctagcggctgttaagtctcaaaacggtgctgcaatgtctctaggtcgtacttctacgttcctagacgtgttcatcgagcgtgatatcgctgctggtaagcttactgaagaacaagctcaggaaatgatcgaccacttcgtaatgaaactacgtatggttcgtttcctacgtactcctgagtacgatgatctattctctggcgacccaatctgggcaactgagtctatgggtggtatgggtcttgacggtcgtacgctagttactcgtactaacttccgtttcctaaactcactatacacaatgggtccttctccagagccaaacatcactgtactttggtctgagcaactacctgaaggcttcaagaagttctgtgcgaaagtatctatcgacacttcttcaatccagtacgaaaacgacgacctaatgcgtccagacatgaactctgacgactacgcaatcgcatgttgtgtatctccaatggttgttggtaagcaaatgcagttcttcggcgctcgtgctaaccttgcgaaaactatgctttacaccatcaacggtggtgtggatgagaagctaaaaatccaagttggtccgaaaatgcctaagatcgaaggcgacgtactaagctatgacgagttgtgggaaaaaatggaccacttcatggattggctagcgaagcagtacgtgactgcactaaacgcaatccacttcatgcacgacaagtacagctacgaagctgcactaatggctctgcacgaccgtgacgttaaacgtactatggcttgtggtattgctggtctatctgttgctgctgactctctgtctgcaattaaatacgcaactgttaaacctatccgtgatgaagacggtctagcaatcgacttcgaaatcgaaggcgattaccctaaatttggtaacaacgacccacgcgttgatgacatcgcatgtgaacttgtttctgtatttatgggcaaaattcgtaagcttaagacttaccgtgatgcaatccctactcagtcaattcttactatcacttcaaacgtggtatacggtaagaaaactggtaacacacctgacggtcgtcgtgctggtgctccatttgctccaggtgcaaacccaatgcacggtcgcgatgagaaaggtgctgtagcatcactaacttcagtagctaaactgccgtttgctgacgcacaagatggtatctcttacacattctctatcgtacctaacgcactaggtaaagatgagggttcacaacgcgctaaccttgctggtctgatggatggttacttccaccacgaagctggtatcgaaggtggtcaacacctaaacgtgaacgttcttaaccgcgaaactctagaagacgcagttaagcacccagagaaataccctcagctaacaattcgtgtatctggttacgctgttcgcttcaactctctaactgcagagcaacaagctgacgtaatcgcacgtacattcactgagtctctataa

SEQ ID NO: 2455 - protein, 758 aa, Vibrio parahaemolyticus RIMD 2210633
MAEQFAKAWEGFVAGDWQNEVNVRDFIQKNYTPYEGDESFLVSEGTEATNKLWAKVMEGIKQENSTHAPVDFDTSIISTITAHDAGYIEKDLETIVGLQTDAPLKRAIIPNGGIRMVEGSCKAYDRELDPQVKKIFTEYRKTHNAGVFDIYTPEILACRKSGVLTGLPDAYGRGRIIGDYRRVALYGIDFLMKDKLAQFKSLQERFENGEDLQMTMQLREEIAEQHRALGQMKVMAAKYGCDISRPAETAQEAIQWTYFGYLAAVKSQNGAAMSLGRTSTFLDVFIERDIAAGKLTEEQAQEMIDHFVMKLRMVRFLRTPEYDDLFSGDPIWATESMGGMGLDGRTLVTRTNFRFLNSLYTMGPSPEPNITVLWSEQLPEGFKKFCAKVSIDTSSIQYENDDLMRPDMNSDDYAIACCVSPMVVGKQMQFFGARANLAKTMLYTINGGVDEKLKIQVGPKMPKIEGDVLSYDELWEKMDHFMDWLAKQYVTALNAIHFMHDKYSYEAALMALHDRDVKRTMACGIAGLSVAADSLSAIKYATVKPIRDEDGLAIDFEIEGDYPKFGNNDPRVDDIACELVSVFMGKIRKLKTYRDAIPTQSILTITSNVVYGKKTGNTPDGRRAGAPFAPGANPMHGRDEKGAVASLTSVAKLPFADAQDGISYTFSIVPNALGKDEGSQRANLAGLMDGYFHHEAGIEGGQHLNVNVLNRETLEDAVKHPEKYPQLTIRVSGYAVRFNSLTAEQQADVIARTFTESL

SEQ ID NO: 2456 - DNA, 2328 bp, Streptococcus pyogenes SSI-1
  CDS (1)..(2328): transl_table=11
atggcaactgttaaaaccaatacagatgttttcgaaaaagcttgggaaggctttaaaggaactgactggaaagaaaaagcaagtgtctcacgttttgtacaagctaactacaccccatacgatggcgatgaatctttcttggctggtgctactgaacgttcacttcacatcaaaaaagttatcgaagaaacaaaagcacactatgaagctacacgtttcccatacgatactcgtccaacttcaattgctgacattcctgctggtttcatcgataaagaaaatgaattaatttatggtattcaaaacgatgaattgttcaaattgaacttcatgccaaaaggtggtatccgtatggcggaaacgacccttaaagaaaacggctatgaaccagacccagcagtacatgaaatctttactaagtatgtgacaactgttaacgacggtatcttccgcgcttatacttcaaatattcgtcgcgctcgtcatgcccacactgtaactggtcttccagatgcttactcacgtggacgtatcatcggtgtttacgctcgtcttgctctttacggtgctgactacttgatgcaagaaaaagtcaatgactggaatgctatcactgaaatcgatgaagaatccattcgtcttcgcgaagaagttaaccttcaataccaagctcttggtgaagtggttaaacttggtgacctttacggagttgatgttcgtcgcccagcacaaaacgttaaagaagctatccaatgggtaaacatcgctttcatggctgtatgtcgtgtgatcaacggtgctgctacttctcttggacgtgtgccaatcgttcttgatatctttgcagaacgtgaccttgctcgcggtacctttacagaatcagaaatccaagaatttgttgatgattttgtccttaaactccgtaccgtaaaatttggtcgtacgaaagcttacgatgcgctttactcaggtgacccaacattcatcacaacttctatggctggtatgggtaacgatggtcgtcaccgtgtaactaagatggactaccgtttcttgaacacgcttgataatattggtaactctccagaaccaaacttgactgttctttggactgaccaactgccagaaacattccgtcgctactgtatgaaaatgagccacaagcactcttctatccaatatgaaggtgtgacaacaatggctaaagaaggttatggtgaaatgtcatgtatttcatgttgtgtgtcaccacttgacccagaaaatgaagaacaacgtcataacatccaatacttcggtgctcgtgtaaacgttcttaaagcccttcttactggtcttaacggtggttacgatgatgttcacagaaactacaaagtgtttaacgttgttgaaccaatcacatcagaagttcttgagtacgacgaagttatggctaactttgagaaatctcttgactggttgacagatacttatgtagatgcgcttaacatcatccactacatgactgataaatacaactacgaagcagttcaaatggccttcttgccaacacaccaacgtgctaacatgggattcggtatctgtggtttcgctaacacagttgataccttgtcagctattaaatacgcaactgttaaaactatccgcgatgaaaatggctacatctatgactacgaagtaacaggtgacttccctcgttacggtgaagatgacgaccgtgttgatgacatcgcgaaatggttgatggaagcttaccacacacgtcttgcaagccacaaactttacaagaatgctgaggcttcagtatcacttcttaccatcacttcaaacgttgcttactctaaacaaactggtaactctccagttcaccgcggcgtcttcttaaacgaagatggtacagttaacactagccaagtggaattcttctcaccaggtgctaacccatctaacaaagcaaaaggtggctggttacaaaaccttaactcacttgctaaactggaattctcacatgctaacgatggtatctcattgactactcaagtatcacctcgtgctcttggtaaaacatttgacgaacaagttgacaacttggtaacagtgcttgacggttactttgaaaatggtggtcagcacgttaacttgaacgttatggaccttaacgatgtttatgacaaaatcatgaacggcgaagacgttatcgtacgtatctctggttactgtgtcaacaccaaataccttacaccagaacaaaaaactgaattgacacaacgtgtcttccacgaagtgctttccatggacgatgctgctgaagctatttcaagtaaatag

SEQ ID NO: 2457 - protein, 775 aa, Streptococcus pyogenes SSI-1
MATVKTNTDVFEKAWEGFKGTDWKEKASVSRFVQANYTPYDGDESFLAGATERSLHIKKVIEETKAHYEATRFPYDTRPTSIADIPAGFIDKENELIYGIQNDELFKLNFMPKGGIRMAETTLKENGYEPDPAVHEIFTKYVTTVNDGIFRAYTSNIRRARHAHTVTGLPDAYSRGRIIGVYARLALYGADYLMQEKVNDWNAITEIDEESIRLREEVNLQYQALGEVVKLGDLYGVDVRRPAQNVKEAIQWVNIAFMAVCRVINGAATSLGRVPIVLDIFAERDLARGTFTESEIQEFVDDFVLKLRTVKFGRTKAYDALYSGDPTFITTSMAGMGNDGRHRVTKMDYRFLNTLDNIGNSPEPNLTVLWTDQLPETFRRYCMKMSHKHSSIQYEGVTTMAKEGYGEMSCISCCVSPLDPENEEQRHNIQYFGARVNVLKALLTGLNGGYDDVHRNYKVFNVVEPITSEVLEYDEVMANFEKSLDWLTDTYVDALNIIHYMTDKYNYEAVQMAFLPTHQRANMGFGICGFANTVDTLSAIKYATVKTIRDENGYIYDYEVTGDFPRYGEDDDRVDDIAKWLMEAYHTRLASHKLYKNAEASVSLLTITSNVAYSKQTGNSPVHRGVFLNEDGTVNTSQVEFFSPGANPSNKAKGGWLQNLNSLAKLEFSHANDGISLTTQVSPRALGKTFDEQVDNLVTVLDGYFENGGQHVNLNVMDLNDVYDKIMNGEDVIVRISGYCVNTKYLTPEQKTELTQRVFHEVLSMDDAAEAISSK

SEQ ID NO: 2458 - DNA, 2229 bp, Bacteroides thetaiotaomicron VPI-5482
  CDS (1)..(2229): transl_table=11
atggaattaaacaagatctttaaagacggtctttggagcagcgaaatcaacgtcagagatttcgtaagtcataacatcactccgtattacggagatgcttcattcctcgaaggacctacagaacgtaccaaagccgtatggaaccgctgcctcgaagcgttggcagaagaaagagaaaacaacggtgtccgctcattagataatgttaccgtatcaaccatcacttcccacaaggccggatatatcgacaaggaaaacgaactgatcgtcggcctgcagacagacgaacttctgaaacgtgccatcaagcctttcggaggtatcaacgtagtcagcaaagcctgtcacgaaaacggcgtggaagtggacgaccgcgtaaaagatattttcactcactaccgcaagacgcacaacgacggagtattcgacgtatatacggaagaaatccgttccttccgttcgctgggattccttaccggacttcccgacaactatgcacgcggacgcatcatcggtgactaccgccgtatggctctttacggcatcgaccgtctgatcgaagcaaagaaggaagatttgcacaacctcaccggtccgatgacagatgcccgtatccgtctgcgcgaagaagtggcagaacagatcaaggcactgaaagacatgaaagtgatgggcgaatactacggtctcgacctgagccgtcccgcttacacggcacaagaagccgtacagtgggtatatatggcttaccttgccgccgtcaaagaacaagacggtgccgccatgtcactgggtaacgtttcttctttcctcgatatctatctggaatatgaactgagcaaaggaaccatcaccgaatcgttcgcgcaagagctgatcgaccagtttgtcatcaaactgcgtatggtccgccacctgcgtatgcaatcatacaacgacatctttgcaggcgacccgacctgggtaaccgaatctctgggcggacgtctcaacgacggacgtaccaaagtgacaaagacctccttccgtttcctgcagacattgtacaacctcggcccttcaccggaaccgaacctgaccgtactctggagcccggaacttcccgaaggattcaaagaattctgtgcaaaggtttctatcgacacttcttctatccagtacgaaaacgacgacctgatgcgtgaagtacgtcagtccgacgactacggaatcgcctgctgcgtatcataccaggaaataggcaagcagattcagttcttcggtgcccgttgcaacctggccaaagccctgttgcttgccatcaacggcggacgttgcgagaataccggtacagtcatggtgaagaacatccccgtactgaccagtgacacgctgaagttcgaagaagtaatggacaactacaagaaagtactgatcgaaatcgcccgcgtatacaacgaagcgatgaacatcatccactatatgcacgacaagtattattacgagaaagcccagatggctcttgtagatacgaacccgcgcataaaccttgcttacggtgtagccggactttccatcgcactcgattcactgtctgccatcaaatatgcgaaagtaactgcccgccgcaacgatatcggtctgacagaaggcttcgacatcgaaggagaattcccttgcttcggtaacgacaacgacaaggtagaccaccttggcgtagacctggtatacttcttcagcgaagaattgaagaaattgcctgtttacaagaatgcccgtcctaccctctccttgctgactatcacttccaatgtgatgtacggcaaaaagaccggtgctactcccgacggacgtgccaaaggtgttgccttcgctccgggtgccaacccgatgcacggacgcgacaagaatggtgcgatcgcttctctgagctctgtagcgaaacttcgttaccgtgactcacaggacggtatcagcaacaccttctctatcgttccgaaatcactgggtgctacggacgaagaccgtatcgagaacctcgtaacgatgatggacggttacttcaccaaaggtgcccaccacctgaacgtaaacgtactgaaccgtgatatgctatacgatgccatggagcatccggagaactatccgcagctgaccatccgcgtttccggttatgccgtaaacttcgtgaagttgagccgcgaacaccaactggaagttatcagccgtagcttccacgaacgtatgtaa

SEQ ID NO: 2459 - protein, 742 aa, Bacteroides thetaiotaomicron VPI-5482
MELNKIFKDGLWSSEINVRDFVSHNITPYYGDASFLEGPTERTKAVWNRCLEALAEERENNGVRSLDNVTVSTITSHKAGYIDKENELIVGLQTDELLKRAIKPFGGINVVSKACHENGVEVDDRVKDIFTHYRKTHNDGVFDVYTEEIRSFRSLGFLTGLPDNYARGRIIGDYRRMALYGIDRLIEAKKEDLHNLTGPMTDARIRLREEVAEQIKALKDMKVMGEYYGLDLSRPAYTAQEAVQWVYMAYLAAVKEQDGAAMSLGNVSSFLDIYLEYELSKGTITESFAQELIDQFVIKLRMVRHLRMQSYNDIFAGDPTWVTESLGGRLNDGRTKVTKTSFRFLQTLYNLGPSPEPNLTVLWSPELPEGFKEFCAKVSIDTSSIQYENDDLMREVRQSDDYGIACCVSYQEIGKQIQFFGARCNLAKALLLAINGGRCENTGTVMVKNIPVLTSDTLKFEEVMDNYKKVLIEIARVYNEAMNIIHYMHDKYYYEKAQMALVDTNPRINLAYGVAGLSIALDSLSAIKYAKVTARRNDIGLTEGFDIEGEFPCFGNDNDKVDHLGVDLVYFFSEELKKLPVYKNARPTLSLLTITSNVMYGKKTGATPDGRAKGVAFAPGANPMHGRDKNGAIASLSSVAKLRYRDSQDGISNTFSIVPKSLGATDEDRIENLVTMMDGYFTKGAHHLNVNVLNRDMLYDAMEHPENYPQLTIRVSGYAVNFVKLSREHQLEVISRSFHERM

SEQ ID NO: 2460 - DNA, 2247 bp, Enterococcus faecalis V583
  CDS (1)..(2247): transl_table=11
atgaaacaatgggaaggctttaaaggcgacaaatggagaacaagcgttgacactcgtgattttattcaaaacaactacacagagtacaaaggcgacgacagtttcttagaaccaatcgctccgagcactgacaaattatggacaaaactacaagaattatttgaaatccaacatgaaaaaaatggcgtttatgacatggatagcgatatcccagcaactattacgtcacatgaacctggttacttaatcaaagaagaagaaaaaattgtcggtttacaaacagatgtaccattaaaacaagcatttatgccattcggtggtattaaaatggcgaacaatgccttagtttcaaatggttatgaaactgacgaagaaatgacaaaaatcttcacagaatacagaaaaacacataaccaaggtgtttttgatgcctacacagctgaaatgcgtttagcacgtaaaaacaaaatcattactggtcttccagatgcttatggccgtggccgtattatcggtgactatcgtcgtatcgcattatatggtatcgactacttaatggaacaaaagaaaaaagatcatgataacactggtaacaaagaaatgacagacgatgttattcgcttacgtgaagaaatttctgaacaataccgtgcgttaaatgacttaaaacaaatggctgcttcttatggtttcgatatttctcgtcctgctgcaaatgcgcaagaagcaatccaatggttatactttggttacctaggtgccattaaatctcaaaatggtgcggcaatgtcaattggtcgtatctcagcattcttagatatctatatccaacgtgacttagaagcaggtttaatcactgaatttgaagcacaagaaatgattgaccatttaatcatgaaattacgtatggttaaatttgcacgtacaccagaatacaaccaattattctctggttatccaatttgggcaacattatctattgctggtatgggtattgacggtcgttcattagttaccaaaaatgacttccgtatcttacacaccttaacaaacatgggaccatctccagaacctaacttaactgtattgtattcttctcacttaccagaaggtttcagaacatatgcagctaaaatcgcgaaagaaagctcatctatccaatttgaaaacgatgacttattacgtgaaaactggggctctgacgactgtgcaatcgcatgttgtgtttctgcaacagttatgggtaaagatatgcaattcttcggcgctcgtgcgaacttagcgaaagctgttctttatgcaattaacggcggggtcgacgaaaaaactaaaatgcaagtagcaccaaaatatcgtccaatgactggtgacaaattagattaccatgaattcatggaacgctataaagacatcttagactggttagctgaattgtacgttaacacattaaacattattcattacatgcatgataaatatgcatatgaagcaccacaattagctttaatggatactgatttacaacggacattcgcaactggtattgccggaatctctcatgcgactgatagtatcatggcaattaaacacggtgaagtagaagtaatccgtgacgaagatggtatggcaattgattatgtaccaacaaaagaattcccaacatacggaaacgataacgaagaagccgatgcaatggctaactggattttagattactttatgacacaaattaaacgtcaacacacataccgtaactctaaaccaacgacttcattattaacaatcacttcaaacgttgtttatggtaaagcaacagggaacacgcctgacggacgtcgtgctggcaaacctcttgcaccaggtgcgaacccaagttatcaagacggtaaattcttaggtgagaaaaatggcttattagcttcattaaactcaacagctcgtttagaatatacaatcgctttagatggtatttctaatacacaaaccatcaaccctaatggtttaggtaaagacgacgacacaagaattaacaacttacgtaacgtattagatggctacttcgataaaggtggttaccacttaaacgtaaacgtatttacaaacgaattattattagatgcacaagcacatccagaaaaatatccaaacttaactatccgtgtatctggatatgccgtgaaattccgtgacttaactcctgaacaacaagcagacgttatttcaagaacttcacacgacagactataa

SEQ ID NO: 2461 - protein, 748 aa, Enterococcus faecalis V583
MKQWEGFKGDKWRTSVDTRDFIQNNYTEYKGDDSFLEPIAPSTDKLWTKLQELFEIQHEKNGVYDMDSDIPATITSHEPGYLIKEEEKIVGLQTDVPLKQAFMPFGGIKMANNALVSNGYETDEEMTKIFTEYRKTHNQGVFDAYTAEMRLARKNKIITGLPDAYGRGRIIGDYRRIALYGIDYLMEQKKKDHDNTGNKEMTDDVIRLREEISEQYRALNDLKQMAASYGFDISRPAANAQEAIQWLYFGYLGAIKSQNGAAMSIGRISAFLDIYIQRDLEAGLITEFEAQEMIDHLIMKLRMVKFARTPEYNQLFSGYPIWATLSIAGMGIDGRSLVTKNDFRILHTLTNMGPSPEPNLTVLYSSHLPEGFRTYAAKIAKESSSIQFENDDLLRENWGSDDCAIACCVSATVMGKDMQFFGARANLAKAVLYAINGGVDEKTKMQVAPKYRPMTGDKLDYHEFMERYKDILDWLAELYVNTLNIIHYMHDKYAYEAPQLALMDTDLQRTFATGIAGISHATDSIMAIKHGEVEVIRDEDGMAIDYVPTKEFPTYGNDNEEADAMANWILDYFMTQIKRQHTYRNSKPTTSLLTITSNVVYGKATGNTPDGRRAGKPLAPGANPSYQDGKFLGEKNGLLASLNSTARLEYTIALDGISNTQTINPNGLGKDDDTRINNLRNVLDGYFDKGGYHLNVNVFTNELLLDAQAHPEKYPNLTIRVSGYAVKFRDLTPEQQADVISRTSHDRL

SEQ ID NO: 2462 - DNA, 2250 bp, Bacillus cereus ATCC 14579
  CDS (1)..(2250): transl_table=11
atgactcaagtattagaaaatgttaaaaacgcatgggaaaactttaaaggtgaaaaatggaaagcagagattgatgttcgcgatttcattttaaataatgtaaacgttttcgaaggggacgaatctttcttagcagaagcaactgaagcaacgaaacaactttgggatcaagtaatggatttaacaacgaaagaacgtgaaaacggtggcgttcttgatatggatacaaaaattgtttcttctattacatcacatgacccaggatacttaaataaagatattgaaaaagtagtcggtttccaaactgataaaccatttaaacgttctttacaaccatatggtggtattcgtatggcagaacaagcttgtgaatcttatggatacgaaatggataaagaacttagtcgtatttttagagagtggagaaaaactcataaccaaggtgtatttgatgcatacacaccagaaatgagaaatgcacgtaaatcaggtgttattactggtcttccagatgcatacggacgtggacgtattatcggtgactatcgccgagtagcgttatatggtattgatcatttaattgaagcgaaaaaagctgatttgaatttaactggtggtgtaatgagcgaagatacaatgcgtttacgcgaagagttatctgagcaaatgcgtgcacttcaagagttaaaagaaatggctgcttctcatggcttcgatatttctaagccagcaacaaatgcacaagaagcattccaatggttatacttcgcataccttgcagcgattaaagaacaaaacggagctgcaatgagtcttggacgtacttctacattcttagatatttacattgaaagagatttagcaaatggtactttaacagaagaagaagtacaagaaattgtcgatcacttcattatgaaattacgtcttgtgaaattcgcaagaacacctgattataatgaattattctctggtgacccaacttgggtaactgaatctatcggtggtatggcattagatggtcgtccattagtaacaaagaactcattccgtttcttgcatacattagataatttaggaccagctccagaaccaaacttaactgttctttggtctaaacaattaccagagaactttaaaaactactgtgcgaaaatgtctattaaaacatcagcaattcaatatgagaatgatgacattatgcgtcctgaatacggcgatgattacggtattgcatgttgcgtatctgcaatgagaatcggtaaacaaatgcagttcttcggagctcgtgcaaacttagccaaagcattattatatgcgattaacggtggcaaagatgaaaagtcaaaagcacaagttggtcctgagtacgcaccaattacttctgaagtattaaattatgaagaagttatgcataagtttgatatgacaatggaatggttagcgggtctatatttaaacacattaaatgttatccattacatgcatgataaatatagctatgaacgtattgaaatggcacttcatgatacaaacgttcttcgtacaatggcaacaggtatcgctggtctatctgtagtagcagattcattaagtgcaattaagtacgcaaaagtaaaaccaattcgtgatgaaaatggtattgcagttgacttcgagattgaaggagatttccctaaatacggtaacaatgatgatcgtgtagatgagattgctgtaaatcttgtaaaaacatttatgaataaacttcgtaaacatacaacatacagaaactctgttcatacaatgtcaatcttaacaatcacatctaacgttgtttacggtaagaaaactggtaatactccagatggccgccgtactggagaaccatttgcaccaggtgcgaacccaatgcatggacgcgatacaaaaggtgcattagcttcattattatctgtggctaaattaccatatgaagatgcacaagatggtatttctaatacattctctattattccgaaagcacttggtaaagaagatgatgtacaagtacgtaatttagtatcaatgcttgatggctatgcagtaaaagaagggcaccacttaaatattaacgtatttaaccgtgaaacattaatggatgcaatggaacatcctgagaagtatccacaattaacaattcgtgtatctggttatgctgtaaactttattaaattaactcgtgaacaacaaattgatgtaattaaccgtacaatgcatgaaagcatgtaa

SEQ ID NO: 2463 - protein, 749 aa, Bacillus cereus ATCC 14579
MTQVLENVKNAWENFKGEKWKAEIDVRDFILNNVNVFEGDESFLAEATEATKQLWDQVMDLTTKERENGGVLDMDTKIVSSITSHDPGYLNKDIEKVVGFQTDKPFKRSLQPYGGIRMAEQACESYGYEMDKELSRIFREWRKTHNQGVFDAYTPEMRNARKSGVITGLPDAYGRGRIIGDYRRVALYGIDHLIEAKKADLNLTGGVMSEDTMRLREELSEQMRALQELKEMAASHGFDISKPATNAQEAFQWLYFAYLAAIKEQNGAAMSLGRTSTFLDIYIERDLANGTLTEEEVQEIVDHFIMKLRLVKFARTPDYNELFSGDPTWVTESIGGMALDGRPLVTKNSFRFLHTLDNLGPAPEPNLTVLWSKQLPENFKNYCAKMSIKTSAIQYENDDIMRPEYGDDYGIACCVSAMRIGKQMQFFGARANLAKALLYAINGGKDEKSKAQVGPEYAPITSEVLNYEEVMHKFDMTMEWLAGLYLNTLNVIHYMHDKYSYERIEMALHDTNVLRTMATGIAGLSVVADSLSAIKYAKVKPIRDENGIAVDFEIEGDFPKYGNNDDRVDEIAVNLVKTFMNKLRKHTTYRNSVHTMSILTITSNVVYGKKTGNTPDGRRTGEPFAPGANPMHGRDTKGALASLLSVAKLPYEDAQDGISNTFSIIPKALGKEDDVQVRNLVSMLDGYAVKEGHHLNINVFNRETLMDAMEHPEKYPQLTIRVSGYAVNFIKLTREQQIDVINRTMHESM

SEQ ID NO: 2464 - DNA, 2283 bp, Shigella flexneri 2a str. 2457T
  CDS (1)..(2283): transl_table=11
atgtccgagcttaatgaaaagttagccacagcctgggaaggttttaccaaaggtgactggcagaatgaagtaaacgtccgtgacttcattcagaaaaactacactccgtacgagggtgacgagtccttcctggctggcgctactgaagcgaccaccaccctgtgggacaaagtaatggaaggtgttaaactggaaaaccgcactcacgcgccagttgattttgacaccgctgttgcttccaccatcacctctcacgacgctggctacatcaataaagcgttggaaaaagttgttggtctgcagactgaagctccgctgaaacgtgctcttatcccgttcggtggtatcaaaatgatcgaaggttcctgcaaagcgtacaaccgcgaactggacccgatgatcaaaaaaatcttcactgaataccgtaaaactcacaaccagggcgtgttcgacgtttacactccggacatcctgcgttgccgtaaatccggtgttctgaccggtctgccagatgcttatggccgtggccgtatcatcggtgactaccgtcgcgttgcgctgtacggtatcgactacctgatgaaagacaaatacgctcagttcacctctctacaggctgatctggaaaacggcgtaaacctggaacagactatccgtctgcgcgaagaaatcgctgaacagcaccgcgctctgggtcagatgaaagaaatggctgcgaaatacggctacgacatctctggtccggctaccaacgctcaggaagctatccagtggacttacttcggctacctggctgctgttaagtctcagaacggtgctgcaatgtccttcggtcgtacctccaccttcctggatgtgtacatcgaacgtgacctgaaagctggcaagatcaccgaacaagaagcgcaggaaatggttgaccacctggtcatgaaactgcgtatggttcgcttcctgcgtactccggaatacgatgaactgttctctggcgacccaatctgggcaaccgaatctatcggtggtatgggcctcgatggtcgtaccctggttaccaaaaacagcttccgtttcctgaacaccctgtacactatggggccgtctccggaaccgaacatgaccattctgtggtctgaaaaactgccgctgaacttcaagaaattcgccgctaaagtgtccatcgacacctcttctctgcagtatgagaacgatgacctgatgcgtccggacttcaacaacgatgactacgctatcgcttgctgcgtaagcccgatgatcgttggtaaacaaatgcagttcttcggtgcgcgtgcaaacctggcgaaaaccatgctgtacgcaatcaacggcggcgttgacgaaaaactgaaaatgcaggttggtccgaagtctgaaccgatcaaaggcgatctcctgagctacgatgaagtgatggagcgcatggatcacttcatggactggctggctaaacagtacatcactgcactgaacatcatccactacatgcacgacaagtacagctacgaagcctctctgatggcgctgcacgaccgtgacgttatccgcaccatggcgtgtggtatcgctggtctgtccgttgctgctgactccctgtctgcaatcaaatatgcgaaagttaaaccgattcgtgacgaagacggtctggctatcgacttcgaaatcgaaggcgaatacccgcagtttggtaacaatgatccgcgtgtagatgacctggctgttgacctggtagaacgtttcatgaagaaaattcagaaactgcacacctaccgtgacgctatcccgactcagtctgttctgaccatcacttctaacgttgtgtatggtaagaaaactggtaacaccccagacggtcgtcgtgctggcgcgccgttcggaccgggtgctaacccgatgcacggtcgtgaccagaaaggtgctgtagcgtctctgacttccgttgctaaactgccgtttgcttacgctaaagatggtatctcctacaccttctctatcgttccgaacgcactgggtaaagacgacgaagttcgtaagaccaacctggctggtctgatggatggttacttccaccacgaagcatccatcgaaggtggtcagcacctgaacgttaacgtgatgaaccgtgaaatgctgctcgacgcgatggaaaacccggaaaaatatccgcagctgaccatccgtgtatctggctacgcagtacgtttcaactcgctgactaaagaacagcagcaggacgttattactcgtaccttcactcaatctatgtaa

SEQ ID NO: 2465 - protein, 760 aa, Shigella flexneri 2a str. 2457T
MSELNEKLATAWEGFTKGDWQNEVNVRDFIQKNYTPYEGDESFLAGATEATTTLWDKVMEGVKLENRTHAPVDFDTAVASTITSHDAGYINKALEKVVGLQTEAPLKRALIPFGGIKMIEGSCKAYNRELDPMIKKIFTEYRKTHNQGVFDVYTPDILRCRKSGVLTGLPDAYGRGRIIGDYRRVALYGIDYLMKDKYAQFTSLQADLENGVNLEQTIRLREEIAEQHRALGQMKEMAAKYGYDISGPATNAQEAIQWTYFGYLAAVKSQNGAAMSFGRTSTFLDVYIERDLKAGKITEQEAQEMVDHLVMKLRMVRFLRTPEYDELFSGDPIWATESIGGMGLDGRTLVTKNSFRFLNTLYTMGPSPEPNMTILWSEKLPLNFKKFAAKVSIDTSSLQYENDDLMRPDFNNDDYAIACCVSPMIVGKQMQFFGARANLAKTMLYAINGGVDEKLKMQVGPKSEPIKGDLLSYDEVMERMDHFMDWLAKQYITALNIIHYMHDKYSYEASLMALHDRDVIRTMACGIAGLSVAADSLSAIKYAKVKPIRDEDGLAIDFEIEGEYPQFGNNDPRVDDLAVDLVERFMKKIQKLHTYRDAIPTQSVLTITSNVVYGKKTGNTPDGRRAGAPFGPGANPMHGRDQKGAVASLTSVAKLPFAYAKDGISYTFSIVPNALGKDDEVRKTNLAGLMDGYFHHEASIEGGQHLNVNVMNREMLLDAMENPEKYPQLTIRVSGYAVRFNSLTKEQQQDVITRTFTQSM

SEQ ID NO: 2466 - DNA, 2295 bp, Shigella flexneri 2a str. 2457T
  CDS (1)..(2295): transl_table=11
atgaaggtagatattgataccagcgataagctgtacgctgacgcatggcttggctttaaaggtacggactggaaaagcgaaattaatgtccgcgattttattcaacataactatacaccgtatgaaggcgatgaatcttttctcgccgaagcgacgcctgccaccacggaattgtgggaaaaggtaatggaaggcatccgtatcgaaaacgcaacccacgcgccggttgatttcgataccaatattgccaccacaattaccgctcatgatgcgggatatattaaccagccgctggaaaaaattgttggcctgcaaacggatgcgccgttgaaacgtgcgctacacccgttcggtggcattaatatgattaaaagttcattccacgcctatggccgtgaaatggacagtgaatttgaatatctgtttaccgatctgcgtaaaacccataaccagggcgtatttgatgtttactcaccggatatgctgcgctgccgtaaatctggcgtgctgaccggtttaccagatggctatggtcgtgggcgcattatcggtgactatcgccgcgtagcgctgtatggcatcagttatctggtgcgtgaacgcgaactgcaatttgccgatctccagtctcgtctggaaaaaggcgaggatctggaagccaccatccgtctgcgtgaggagctggcagagcatcgtcatgcgctgttgcagattcaggaaatggcggcgaaatatggctttgatatctctcgcccggcgcagaatgcacaggaagcggtgcagtggctctacttcgcttatctggcggcagtgaaatcgcaaaatggcggcgcgatgtcgctggggcgcacggcatcgttcctggatatctacattgagcgcgactttaaagctggcgtcctcaatgagcagcaggcacaggaactgatcgatcacttcatcatgaagatccgtatggtacgcttcctgcgtacaccggaatttgattcgctgttctccggcgacccaatctgggcgacggaagtgatcggcgggatggggctggacggtcgtacgctggtgaccaaaaactccttccgctatttgcacaccctgcacactatggggccggcaccggaacctaacctgaccattctttggtcggaagaattaccgattgccttcaaaaaatatgccgcgcaggtgtcgatcgtcacctcttccttgcagtatgaaaatgacgatctgatgcgtactgacttcaacagcgacgattacgcgattgcctgctgcgtcagcccaatggtgattggtaagcaaatgcagttctttggtgcacgcgctaacctggcgaaaacgctgctctacgcaattaacggcggggtggacgagaagctgaagattcaggtcgggccgaaaacagcaccgctgatggacgacgtgctggattacgacaaagtgatggacagcctcgatcacttcatggactggctggcggtgcagtacatcagcgcgctgaatatcattcactacatgcacgacaagtacagctacgaagcttcgctgatggcgctgcacgatcgtgatgtctatcgcactatggcatgcggcatcgcgggcctgtcggtggcgacggactccctgtctgccatcaaatatgcccgcgtgaaaccaatccgtgacgaaaacggcctggcggtggactttgaaatcgacggtgaatatccgcagtacggcaacaacgacgagcgcgtagacagcattgcctgcgacctggttgaacgctttatgaagaaaattaaagcgctgccaacctatcgcaacgccgtccctacccagtcgattctgactatcacttctaacgtggtgtacggccagaaaaccggtaatacgccggacggtcgtcgcgccggaacaccgttcgcgccgggcgctaacccgatgcatggtcgtgaccgcaaaggtgccgtggcctcattgacgtcggtggcgaaactgccgttcacctacgccaaagatgggatctcgtacaccttctcaatcgttcctgcggcgctgggcaaagaagatccagtacgtaaaaccaaccttgtcggcctgctggatgggtatttccaccacgaagcggatgtcgaaggcggtcaacacctcaacgtcaacgtaatgaatcgggaaatgctgctggatgccatcgagcacccggaaaaatatcctaacctgacaatccgtgtctctggctacgccgtgcgcttcaacgcactgacccgtgaacagcaacaggatgttatttcacgtacttttacccaggcgctctga

SEQ ID NO: 2467 - protein, 764 aa, Shigella flexneri 2a str. 2457T
MKVDIDTSDKLYADAWLGFKGTDWKSEINVRDFIQHNYTPYEGDESFLAEATPATTELWEKVMEGIRIENATHAPVDFDTNIATTITAHDAGYINQPLEKIVGLQTDAPLKRALHPFGGINMIKSSFHAYGREMDSEFEYLFTDLRKTHNQGVFDVYSPDMLRCRKSGVLTGLPDGYGRGRIIGDYRRVALYGISYLVRERELQFADLQSRLEKGEDLEATIRLREELAEHRHALLQIQEMAAKYGFDISRPAQNAQEAVQWLYFAYLAAVKSQNGGAMSLGRTASFLDIYIERDFKAGVLNEQQAQELIDHFIMKIRMVRFLRTPEFDSLFSGDPIWATEVIGGMGLDGRTLVTKNSFRYLHTLHTMGPAPEPNLTILWSEELPIAFKKYAAQVSIVTSSLQYENDDLMRTDFNSDDYAIACCVSPMVIGKQMQFFGARANLAKTLLYAINGGVDEKLKIQVGPKTAPLMDDVLDYDKVMDSLDHFMDWLAVQYISALNIIHYMHDKYSYEASLMALHDRDVYRTMACGIAGLSVATDSLSAIKYARVKPIRDENGLAVDFEIDGEYPQYGNNDERVDSIACDLVERFMKKIKALPTYRNAVPTQSILTITSNVVYGQKTGNTPDGRRAGTPFAPGANPMHGRDRKGAVASLTSVAKLPFTYAKDGISYTFSIVPAALGKEDPVRKTNLVGLLDGYFHHEADVEGGQHLNVNVMNREMLLDAIEHPEKYPNLTIRVSGYAVRFNALTREQQQDVISRTFTQAL

SEQ ID NO: 2468 - DNA, 2250 bp, Bacillus anthracis str. Ames
  CDS (1)..(2250): transl_table=11
atgactcaagtattagaaaatgttaaaaacgcatgggaaaactttaaaggtgaaaaatggaaagcagagattgatgttcgcgatttcattttaaataatgtaaacgtttacgagggagatgaatctttcttagcgggagcaactgaagcaacgaaacaactttgggatcaagtaatggatttaacaacgaaagaacgtgaaaacggtggcgttcttgatatggatacaaaaattgtttcttctattacatcacatgaaccaggatatttaaataaagagactgaaaaagtagtcggtttccaaactgataaaccatttaaacgttctttacagccatatggtggtattcgtatggcggaacaagcttgtgaatcttatggatacgaaatggataaagaacttagtcgtatttttagagattggagaaaaactcataaccaaggtgtatttgatgcttatacaccagaaatgagagctgctcgtaaatcaggtgttattactggtcttccagatgcatacggacgtggacgtattatcggtgactaccgccgcgtagcattatatggagtagatcatttaattgaagcgaagaaagcagatttaaatttaactggcggtgtaatgagtgaagatacaatgcgtttacgcgaagaattatctgagcaaatacgtgcacttcaagagttaaaacaaatggctgcttctcatggatttgatatttctaagccagcaacaaatgctcaagaagcattccaatggttatactttgcatatcttgcagcaattaaagagcaaaacggagctgcaatgagtcttggacgtacttctacattcttagatatttatattgaaagagatttagcaaatggtactttaacagaagaagacgtacaagaaattgtggatcacttcattatgaaattacgtcttgtgaaatttgccagaacacctgattataatgagttattctctggtgacccaacttgggtaactgagtctatcggtggtatggcattagatggtcgtccattagtaacaaagaactcattccgtttcttgcatacattagataatttaggaccagctccagaaccaaacttaacagttctttggtctaaacaattaccacagaactttaaaaactactgtgcgaaaatgtctattaaaacatcagcaattcaatatgaaaatgatgacattatgcgtgctgactacggcgatgactacggaattgcttgttgtgtatctgcaatgagaatcggtaaacaaatgcaattctttggcgcacgtgcaaacttagcaaaagcattgctatatgcgattaacggtggtaaagatgaaaaatctaaagcgcaagttggtcctgagtatgcaccgattacttctgaagtattagattatgaagaagttatgcataagtttgatatgacaatggaatggttagcgggtctatatttaaacacattaaatgttattcactacatgcacgataaatatagctacgaacgtattgaaatggcacttcatgatacaaatgttcttcgtacaatggcaacaggtatcgcgggtctatctgtagtagcagattctttaagtgcaattaaatatgcaaaagtaaaaccaattcgcgatgaaaacggaatcgcagttgactttgaaattgaaggagatttccctaaatacggtaacaatgatgaccgtgtagatgaaattgctgtaaatcttgtgaaaacatttatgaataaacttcgtaaacataaaacatacagaaattctgttcatacaatgtcaatcttaacaatcacatctaacgttgtatacggtaagaaaactggtaacactccagatggtcgccgtactggagaaccatttgcaccaggtgcgaacccaatgcatggacgtgatacaaaaggtgcgctagcttcattattatctgtagctaaattaccatatgaagatgcacaagatggtatttctaatacattctctattattccaaaagcacttggtaaagaggatgaagtacaagtacgtaacttagtatcaatgcttgatggttatgcagtaaaagaaggacatcacttaaatattaacgtatttaaccgtgaaacattaatggatgcaatggaacatcctgagaaatatccacaattaacaattcgcgtatctggttacgctgtaaactttattaaattaactcgtgaacaacaaatcgatgtaattaaccgtacaatgcatgaaagcatgtaa

SEQ ID NO: 2469 - protein, 749 aa, Bacillus anthracis str. Ames
MTQVLENVKNAWENFKGEKWKAEIDVRDFILNNVNVYEGDESFLAGATEATKQLWDQVMDLTTKERENGGVLDMDTKIVSSITSHEPGYLNKETEKVVGFQTDKPFKRSLQPYGGIRMAEQACESYGYEMDKELSRIFRDWRKTHNQGVFDAYTPEMRAARKSGVITGLPDAYGRGRIIGDYRRVALYGVDHLIEAKKADLNLTGGVMSEDTMRLREELSEQIRALQELKQMAASHGFDISKPATNAQEAFQWLYFAYLAAIKEQNGAAMSLGRTSTFLDIYIERDLANGTLTEEDVQEIVDHFIMKLRLVKFARTPDYNELFSGDPTWVTESIGGMALDGRPLVTKNSFRFLHTLDNLGPAPEPNLTVLWSKQLPQNFKNYCAKMSIKTSAIQYENDDIMRADYGDDYGIACCVSAMRIGKQMQFFGARANLAKALLYAINGGKDEKSKAQVGPEYAPITSEVLDYEEVMHKFDMTMEWLAGLYLNTLNVIHYMHDKYSYERIEMALHDTNVLRTMATGIAGLSVVADSLSAIKYAKVKPIRDENGIAVDFEIEGDFPKYGNNDDRVDEIAVNLVKTFMNKLRKHKTYRNSVHTMSILTITSNVVYGKKTGNTPDGRRTGEPFAPGANPMHGRDTKGALASLLSVAKLPYEDAQDGISNTFSIIPKALGKEDEVQVRNLVSMLDGYAVKEGHHLNINVFNRETLMDAMEHPEKYPQLTIRVSGYAVNFIKLTREQQIDVINRTMHESM

SEQ ID NO: 2470 - DNA, 2313 bp, Haemophilus ducreyi 35000HP
  CDS (1)..(2313): transl_table=11
atgattcaactcgatgaagctcaacaaaaagcctgggcaggctttgtagcaggcacatggcaaactgaagtaaacgtacgtgattttatccaaaaaaattatacgccatatgaaggagatgaatctttcctagcgggagctacccccgcaacgactaaactatggcaagaggtcatggaaaaaatcaaagttgagaataaaacgcacgagccttatgatattgactgtgatattccgtccacgattacctcgcacaaaccgggctatattgatcaatccttagaaaaaattgttggccttcaaacagatgcaccattaaaacgagcaattcttccatttggtggcattaaaatggtaaaaggctcttgtgatgtttatcgccgtaaacttaatcctgaagttgaaaaaatctttactgaatatcgtaaaacacataaccaaggcgtttttgatgtttatacgcctgatattttacgttgccgtaaatcaggcgtaatcacaggtttacctgatgcctatggtcgtggccgtattattggtgactatcgccgtttagccgtatatggtgcagacttcttaatgaaagataaacagcgtcaatttgcctcattacagcctaatttagaagcaggtgaagacattcaagcaaccattcaattacgtgaagaaatcaccgaacaattccgtgctttaggacaaatcaaagaaatggctgcctcctatggctttgatgtttcacgtcccgctgaaaatgcacaagaagcagtacaatggacctattttgcttatttagcggcagttaaatcacaaaatggcgcagcaatgtcatttgggcgtgtttcatcattcttagatatctacattgaacgtgatctaaaagcgggcaaaattacagaagaagaagcacaagaattaattgaccacttagtgatgaaattacggatggttcgtttcttacgtacaccagaatatgatcaattattctctggcgatcctatgtgggcgactgagactttagcaggaatgggcttagatgaccgtacgttggtgactaaaaacagtttccgtattctgaacacactctatacaatggggccttcaccagagccgaatttaacgatcctttggtctgaacaattaccagagggtttcaaacgttattgtgcaaaagtgtctattgatacatcatcagttcaatatgaaaatgatgatttaatgcgcccagatttcgataatgatgactatgccatcgcgtgttgtgtatcaccaatggtgatcggtaaacaaatgcaattcttcggggcacgtgcaaacttagccaaaacaatgttatatgcaatcaatggcggtattgacgaaaaatcaggcttacaagttggtccaaaatcaacacctattaccgatgaagtattaaactttgatgatgtaatgacacgtatggatcactttatggattggttagccacacaatatgtgaccgcattaaatatcattcactttatgcacgataaatacagctatgaagccgcattaatggcattccacgatcgtgatgtattccgcacaatggcgtgtggtattgcgggcctttctgtcgcagcagactcgttatctgcaattaaatatgccaaagtaaaacctgtacgtggtgatatcaaagacaaagatggcaatattgtcgcaaccaacgtggcacttgattttgaaattgaaggtgaatacccacaattcgggaataatgatagtcgtgttgatgatattgcgtgtgacttagttgaacgctttatgaaaaaaattcaaacacacaaaacatatcgcaatgcaacaccaactcaatcagtgttaacaattacatctaacgttgtatatggtaaaaaaaccgggaatacccccgatggtcgccgtgctggagccccatttggacctggcgctaacccgatgcatggtcgtgaccaaaaaggtgcggtagcatcattaacatccgttgctaaacttccatttgcatacgccaaagatggtatctcatacacattctcaattgtgcctaatgccttaggtaaagattacgaagcacaaaaacgtaacttagcaggcctaatggatggttatttccaccacgaaacaagcgttgaaggtggtcagcatctaaatgtcaatgtcctaaatcgtgaaacattattagatgcagtggagcacccagaaaaatatccacaattaaccattcgtgtctctggttatgctgtacgttttaacgctttaactaaagagcaacaaatggacgttatcacgcgtacatttacagaatcgatgtaa

SEQ ID NO: 2471 - protein, 770 aa, Haemophilus ducreyi 35000HP
MIQLDEAQQKAWAGFVAGTWQTEVNVRDFIQKNYTPYEGDESFLAGATPATTKLWQEVMEKIKVENKTHEPYDIDCDIPSTITSHKPGYIDQSLEKIVGLQTDAPLKRAILPFGGIKMVKGSCDVYRRKLNPEVEKIFTEYRKTHNQGVFDVYTPDILRCRKSGVITGLPDAYGRGRIIGDYRRLAVYGADFLMKDKQRQFASLQPNLEAGEDIQATIQLREEITEQFRALGQIKEMAASYGFDVSRPAENAQEAVQWTYFAYLAAVKSQNGAAMSFGRVSSFLDIYIERDLKAGKITEEEAQELIDHLVMKLRMVRFLRTPEYDQLFSGDPMWATETLAGMGLDDRTLVTKNSFRILNTLYTMGPSPEPNLTILWSEQLPEGFKRYCAKVSIDTSSVQYENDDLMRPDFDNDDYAIACCVSPMVIGKQMQFFGARANLAKTMLYAINGGIDEKSGLQVGPKSTPITDEVLNFDDVMTRMDHFMDWLATQYVTALNIIHFMHDKYSYEAALMAFHDRDVFRTMACGIAGLSVAADSLSAIKYAKVKPVRGDIKDKDGNIVATNVALDFEIEGEYPQFGNNDSRVDDIACDLVERFMKKIQTHKTYRNATPTQSVLTITSNVVYGKKTGNTPDGRRAGAPFGPGANPMHGRDQKGAVASLTSVAKLPFAYAKDGISYTFSIVPNALGKDYEAQKRNLAGLMDGYFHHETSVEGGQHLNVNVLNRETLLDAVEHPEKYPQLTIRVSGYAVRFNALTKEQQMDVITRTFTESM

SEQ ID NO: 2472 - DNA, 2328 bp, Chromobacterium violaceum ATCC 12472
  CDS (1)..(2328): transl_table=11
atggacgccatcactcagaatgctacccaagccaacccgtggcgcgatttcgtcgccggcgactggcagagcaaggtcgatgtccgcaacttcatccagctgaactatcagccgtacgaaggcgacgacagcttcctggctggcgccaccgagcgcaccaagaagctgtgggataccctgggcgaactgctgaagcaggaacgcgccaagggcgtgctggacgtgtccgccgaccgcggctcctccatcaccgcgcatgacgccggctacatagaccaggccaacgaagtgatcgtcggcctgcaaaccgacgccccgctgaagcgcgccatcatgccgaacggcggcctgcgcatggtcgagaacggcctggaagccttcggcttcaagctggacccgatgatcaaggaagtgtgggaaaagtatcgcaagagccacaaccagggcgtgttcgacgtctacaccccggaaatcatggcttgccgcaagtccggcgtgatcaccggcctgcccgacgcctacggccgcggccgcatcatcggcgactaccgccgcgtggccctgtacggcaccgacttcctgcgcgccgagcgccagcaagtgttccatgaactggacaacgctaccttcaccgacgacgtgatgcgtctgcgcgaagagctgtccgaacaattccgcgcgctggacgaactgaagcagatggccgccaagtacggctacgacatcagccgtccggccgccaacgcccgcgaagcggtgcaatgggtgtacttcgcctacctggccgccgtcaaggaacagaatggcgccgccatgtccttcggccgcgtgtccaccttcctggacatctacatcgagcgcgacatcgccgccggcgtgctgaccgaagagcaagcccaggaaatgatcgacgacctggtgatcaagctgcgcatcgtccgcttcctgcgcacgccggaatacgatcagctgttctccggcgacccgacctgggtgaccgaatccatcggcggcatgggccaggacggccgcaccctggtgaccaagaacagcttccgcttcctgaacaccctgtacaacctgggcccggcgccggagccgaacctgaccgtgctgtggtccacccgcttcccgcagggcttcaagaacttctgcgccaaggtgtccatcgataccagcgccatccagtacgaaaacgacgatctgatgctgccttactggggcgacgactacggcatcgcctgctgcgtgtcggcgatgaagatcggcaagcagatgcagttcttcggcgcccgcgccaacctggccaaggccctgctgtacgcgatcaacggcggccgcgacgagaagtccggcgcgctggtggccaagggtttcgagccgatcaccagcgacgtgctgacctacgacgagctgatgcccaagttcgagaagatgatggactggctggccgccacctacgtcaaggcgctgaactgcatccactacatgcacgacaagtacgcctacgagcgcatcgaaatggcgctgcacgaccgcgacatcgtccgcaccatggcttgcggcatcgccggcctgtccgtggccgccgactcgctgtccgccgtcaagttcgccaaggtgcacatcatccgcaatgaggaaggcctggccgtcgactacaagatcgaaggcgactacccggcttacggcaacaacgacgaccgcgtcgacgacatcgccgtgtggctgacccagaccttcatggatcgcatcaaggcccagccgtacttctaccgcgactccaagccgacccagtcggtgctgaccatcacctccaacgtggtgtacggcaagaagaccggcaacacgccggacggccgccgcgccggcgaaccgttctccccgggcgccaacccgatgaacggccgcgacgtgaagggcttcgtcgccgcgggcgcctcggtggccaagctgccgtacgactccgcgctggacggcatcagctggaccgcttcggccacgccggacgcgctgggccacaccgctgaagagcgcatcctgaacctggccaactgcctggatggcttctgctccgcgcacccgaccgagttcagcagcgccaactgcacgccgttcgactgcgaaggcgagcgccacatcgccggcggcggcttccacgtcaacgtgaacgtgttcaagcgcgaaaccctgctggacgcgatggagcatccggaactgtacccgcagctgaccatccgcgtgtcgggctacgccgtgaacttcatcaagctgacccgcgaacagcaactggacgtgatcaaccgcaccttccacggcaagatgtaa

SEQ ID NO: 2473 - protein, 775 aa, Chromobacterium violaceum ATCC 12472
MDAITQNATQANPWRDFVAGDWQSKVDVRNFIQLNYQPYEGDDSFLAGATERTKKLWDTLGELLKQERAKGVLDVSADRGSSITAHDAGYIDQANEVIVGLQTDAPLKRAIMPNGGLRMVENGLEAFGFKLDPMIKEVWEKYRKSHNQGVFDVYTPEIMACRKSGVITGLPDAYGRGRIIGDYRRVALYGTDFLRAERQQVFHELDNATFTDDVMRLREELSEQFRALDELKQMAAKYGYDISRPAANAREAVQWVYFAYLAAVKEQNGAAMSFGRVSTFLDIYIERDIAAGVLTEEQAQEMIDDLVIKLRIVRFLRTPEYDQLFSGDPTWVTESIGGMGQDGRTLVTKNSFRFLNTLYNLGPAPEPNLTVLWSTRFPQGFKNFCAKVSIDTSAIQYENDDLMLPYWGDDYGIACCVSAMKIGKQMQFFGARANLAKALLYAINGGRDEKSGALVAKGFEPITSDVLTYDELMPKFEKMMDWLAATYVKALNCIHYMHDKYAYERIEMALHDRDIVRTMACGIAGLSVAADSLSAVKFAKVHIIRNEEGLAVDYKIEGDYPAYGNNDDRVDDIAVWLTQTFMDRIKAQPYFYRDSKPTQSVLTITSNVVYGKKTGNTPDGRRAGEPFSPGANPMNGRDVKGFVAAGASVAKLPYDSALDGISWTASATPDALGHTAEERILNLANCLDGFCSAHPTEFSSANCTPFDCEGERHIAGGGFHVNVNVFKRETLLDAMEHPELYPQLTIRVSGYAVNFIKLTREQQLDVINRTFHGKM

SEQ ID NO: 2474 - DNA, 2283 bp, Photorhabdus luminescens subsp. laumondii TTO1
  CDS (1)..(2283): transl_table=11
atgactgaattaaataaaaagttctctgtagcatggcaagattttaaccaaggtgattggcaaagcgaagtcaatgttcgtgacttcatccaaaaaaactatacgccatatgagggtgatgaatctttcctgtcaggtgcgacaaaagcgaccgataccttatgggaaaaagtcatggaaggtatcaaaatcgaaaaccgcactcatgcgccagttgattttgatactgatgttgctgctactattacctcccacgacgcaggttatatcgaaaaagatctggaaaccattgttggcctgcaaacggaagctccattaaaacgtgccctaatcccatttggtggcatcaaaatggtggaaggctcatgtaaagtttatggtcgtgaactcgatcctaaattgaaacagattttcactgaataccgcaaaacgcataatcaaggcgttttcgatgtttacacaccagatattcttaaatgccgaaaatctggtgttctgacaggtctgcctgatgcctatggccgtggtcgcattattggtgactaccgtcgtgttgcagtatacggtatcgatttcttgcgtgatgataaattagctcagttcaattcattgcaggaaaagctggaaaacggtgaagatctggcaatgactattcaattgcgtgaagaaatcgctgaacagcaccgcgctctgagccaaattaaagagatggcggctaaatacggctatgatatctctggccccgccactgacgctaaggaagcaatacagtggacttatttcgcttatctggcggcggttaagtctcaaaatggtgccgcaatgtccttcggtcgcgtttccagtttcctggatatctacatcgaacgtgacctgaaagcgggtaagctgacagaagttgaagctcaggaattaattgaccatctggtgatgaaattacgtatggttcgtttcctgcgtacccctgaatatgatgaactattttccggtgacccaatctgggcaacagaatcgctggcaggtatggggatagatggtcgcacgctggtgactaaaaatagtttccgtttcctgaacaccctatacacaatgggcccatcaccagaacccaatatgaccatcctatggtccgaaaaactgccgacaaatttcaaaaaattcgcggcaaaagtttccatcgatacctcatctttgcaatatgagaacgatgatttgatgcgccctgacttcaacaacgatgattacgctattgcttgttgcgtcagccctatgattgtgggtaaacagatgcaattcttcggtgctcgcgcaaatctggctaaaacgatgctgtacgccattaacggcggtgtagatgaaaagctgaaaatgcaggttggcccgaaagaagagccaataaaagatgaagtgctggattacgacaaggttatggcccgcatggatcactttatggattggctggcaaaacagtatgttactgcactaaacatcattcactatatgcatgataagtatagctatgaagcggcactgatggcactgcacgaccgtgatgtttaccgtactatggcctgtggcattgccggtctgtctgtcgctgctgactcattgtctgccatcaagtatgccaaagtgacaccgatccgtgatgaggatggtttagcggttgatttcaagattgaaggtgaatatccacaattcggtaacaacgactcgcgtgttgatgatatcgcctgtgatttggttgaacgtttcatgaaaaaaatccagaaactgaatacttatcgcaacgcggtaccgacacaatccgttctgaccatcacttctaacgtggtatatggtaagaaaaccggtaacacccctgacggacgtcgtgctggcgcaccatttggacccggtgccaatccaatgcatggtcgcgatcaaaaaggtgccgtcgcctcattgacttctgtggctaaattgcccttcgcctatgcaaaagatggtatctcttataccttctctatcgtaccaaacgcgttaggcaaagatgatgaaacacgcaaaactaatctggctggtttgctggatggttatttccaccatgaagcagaaattgaaggtggtcagcatttgaacgtcaatgtgatgaaccgtgacatgctgcttgatgccatggaagaccctgaaaaatatcctcaactcactatccgggtatcaggttatgccgtacgtttcaactcactgactaaagagcaacaacaggatgtaattacccgtactttcacccaatctatgtaa

SEQ ID NO: 2475 - protein, 760 aa, Photorhabdus luminescens subsp. laumondii TTO1
MTELNKKFSVAWQDFNQGDWQSEVNVRDFIQKNYTPYEGDESFLSGATKATDTLWEKVMEGIKIENRTHAPVDFDTDVAATITSHDAGYIEKDLETIVGLQTEAPLKRALIPFGGIKMVEGSCKVYGRELDPKLKQIFTEYRKTHNQGVFDVYTPDILKCRKSGVLTGLPDAYGRGRIIGDYRRVAVYGIDFLRDDKLAQFNSLQEKLENGEDLAMTIQLREEIAEQHRALSQIKEMAAKYGYDISGPATDAKEAIQWTYFAYLAAVKSQNGAAMSFGRVSSFLDIYIERDLKAGKLTEVEAQELIDHLVMKLRMVRFLRTPEYDELFSGDPIWATESLAGMGIDGRTLVTKNSFRFLNTLYTMGPSPEPNMTILWSEKLPTNFKKFAAKVSIDTSSLQYENDDLMRPDFNNDDYAIACCVSPMIVGKQMQFFGARANLAKTMLYAINGGVDEKLKMQVGPKEEPIKDEVLDYDKVMARMDHFMDWLAKQYVTALNIIHYMHDKYSYEAALMALHDRDVYRTMACGIAGLSVAADSLSAIKYAKVTPIRDEDGLAVDFKIEGEYPQFGNNDSRVDDIACDLVERFMKKIQKLNTYRNAVPTQSVLTITSNVVYGKKTGNTPDGRRAGAPFGPGANPMHGRDQKGAVASLTSVAKLPFAYAKDGISYTFSIVPNALGKDDETRKTNLAGLLDGYFHHEAEIEGGQHLNVNVMNRDMLLDAMEDPEKYPQLTIRVSGYAVRFNSLTKEQQQDVITRTFTQSM

SEQ ID NO: 2476 - DNA, 2250 bp, Bacillus cereus ATCC 10987
  CDS (1)..(2250): transl_table=11
atgactcaagtattagaaaatgttaaaaacgcatgggaaaactttaaaggtgaaaaatggaaagcagagattgatgttcgcgatttcattttaaataatgtaaacgtttacgagggagatgaatctttcttagcgggagcaactgaagcaacgaaacaactttgggatcaagtaatggatttaacaacgaaagaacgtgaaaacggtggcgttcttgatatggatacaaaaattgtttcttctattacatcacatgaaccaggatatttaaataaagagactgaaaaagtagtcggtttccaaactgataaaccatttaaacgttctttacaaccatatggtggtattcgtatggcggaacaagcttgtgaatcttatggatacgaaatggataaagagcttagtcgtattttcagagattggagaaaaactcataaccaaggcgtatttgatgcttatacaccagaaatgagagctgctcgtaaatcaggtgttattactggtcttccggatgcatacggacgtggacgtattatcggtgactaccgccgcgtagcattatatggagtagatcatttaattgaagcgaagaaagtagatttaaatttaactggcggtgtaatgagtgaagatataatgcgtttacgcgaagagttatctgagcaaatacgtgcacttcaagagttaaaacaaatggctgcttctcatggctttgatatttctaagccagcaacaactgctcaagaagcattccaatggctatacttcgcatatcttgcagcaattaaagagcaaaacggagctgcaatgagtcttggccgtacttctacattcttagatatttatattgaaagagatttagcaaatggtactttaacagaagaagacgtacaagaaattgtggatcacttcattatgaaattacgtcttgtgaaatttgcaagaacacctgattataatgaattattctctggtgacccaacttgggtaactgagtctatcggcggtatggcattagatggccgtccattagtaacaaagaactcattccgtttcttgcatacactagataatttaggaccagctccagaaccaaacttaacagttctttggtctaaacaattaccacagaactttaaaaactactgtgcgaaaatgtctattaaaacatcagcaattcaatatgaaaatgatgacattatgcgtgctgactacggcgatgattacggaattgcttgttgtgtatctgcaatgagaattggtaaacaaatgcagttcttcggcgcacgtgcaaacttagcaaaagcattactatatgcaattaacggtggtaaagatgaaaaatctaaagcacaagttggtcctgagtatgcaccgattacttctgaagtattagattatgaagaagttatgcataagtttgatatgacaatggaatggttagcgggtctatatttaaacacattaaatgttattcactacatgcacgataaatatagctacgagcgtattgagatggcacttcatgatacaaatgttcttcgtacaatggcaacaggtatcgcgggtctatctgtagtagcagactctttaagtgcaattaaatacgcaaaagtaaaaccaattcgcgatgaaaacggaattgcagttgactttgaaatcgaaggagatttccctaaatacggtaacaatgatgaccgtgtagatgaaattgctgtaaatcttgtgaaaacatttatgaataaacttcgtaaacacaaaacatatagaaattctgttcatacaatgtcaatcttaacaatcacatctaacgttgtatacggtaagaaaactggtaacactccagatggtcgccgtactggagaaccatttgcaccaggtgcgaacccaatgcatggacgtgatacaaaaggtgcgttagcttcattattatctgtagctaaattaccatatgaagatgcacaagatggcatttctaatacattctctattattccaaaagcacttggtaaagaggatgaagtacaagtacgtaacttagtatcaatgcttgatggttatgcagtaaaagaaggacatcacttaaatattaacgtatttaaccgtgaaacattaatggatgcaatggaacatcctgagaaatatccacaattaacaattcgcgtatctggttacgctgtaaactttattaaattaactcgtgaacaacaaatcgatgtaattaaccgtacaatgcatgaaagcatgtaa

SEQ ID NO: 2477 - protein, 749 aa, Bacillus cereus ATCC 10987
MTQVLENVKNAWENFKGEKWKAEIDVRDFILNNVNVYEGDESFLAGATEATKQLWDQVMDLTTKERENGGVLDMDTKIVSSITSHEPGYLNKETEKVVGFQTDKPFKRSLQPYGGIRMAEQACESYGYEMDKELSRIFRDWRKTHNQGVFDAYTPEMRAARKSGVITGLPDAYGRGRIIGDYRRVALYGVDHLIEAKKVDLNLTGGVMSEDIMRLREELSEQIRALQELKQMAASHGFDISKPATTAQEAFQWLYFAYLAAIKEQNGAAMSLGRTSTFLDIYIERDLANGTLTEEDVQEIVDHFIMKLRLVKFARTPDYNELFSGDPTWVTESIGGMALDGRPLVTKNSFRFLHTLDNLGPAPEPNLTVLWSKQLPQNFKNYCAKMSIKTSAIQYENDDIMRADYGDDYGIACCVSAMRIGKQMQFFGARANLAKALLYAINGGKDEKSKAQVGPEYAPITSEVLDYEEVMHKFDMTMEWLAGLYLNTLNVIHYMHDKYSYERIEMALHDTNVLRTMATGIAGLSVVADSLSAIKYAKVKPIRDENGIAVDFEIEGDFPKYGNNDDRVDEIAVNLVKTFMNKLRKHKTYRNSVHTMSILTITSNVVYGKKTGNTPDGRRTGEPFAPGANPMHGRDTKGALASLLSVAKLPYEDAQDGISNTFSIIPKALGKEDEVQVRNLVSMLDGYAVKEGHHLNINVFNRETLMDAMEHPEKYPQLTIRVSGYAVNFIKLTREQQIDVINRTMHESM

SEQ ID NO: 2478 - DNA, 2229 bp, Clostridium thermocellum ATCC 27405
  CDS (1)..(2229): transl_table=11
atggatgcatggcgcggatttaataaaggcaactggtgccaggaaattgacgttcgtgattttataattagaaattatactccttatgaaggcgatgaaagctttcttgtaggacctacggatagaacgcggaaactttgggagaaggtttccgaactgttaaagaaagaacgggagaacggcggggtattggatgttgatacccatacaatttcaacgattacgtctcataaacctggatatatagataaagaacttgaagttattgtcgggcttcagacggatgagcctttaaaaagagccataatgccgtttggcggtatacgtatggtgattaagggagccgaagcttatggccacagtgtggaccctcaggttgttgaaatattcacaaagtacagaaagactcataaccagggagtttatgatgtatatactcccgaaatgagaaaagccaaaaaagccgggattattacaggacttcccgacgcatacggcagaggaagaataattggcgattacagaagggttgcactttatggcgttgacaggctgattgctgaaaaagagaaagaaatggcaagtcttgaaagagattacattgactatgagactgttcgagacagagaagaaataagcgagcagattaaatctttaaaacaacttaaagaaatggctttaagttacggttttgacatatcttgtcctgcaaaggatgccagagaagcctttcaatggttgtattttgcatatcttgcagcagtcaaggaacagaacggcgcggcaatgagtattggaagaatttcgactttccttgacatatacattgaaagggatctcaaagaaggaaaactcacggaggagttggctcaggaactggttgaccagctggttataaagctgagaattgtgagatttttgagaactcctgagtatgaaaagctcttcagcggagaccccacttgggtaaccgaaagtatcggaggtatggcgctggatggaagaacgctggttacaaaatcttcgttcaggtttttgcacactcttttcaacctgggacatgcaccggagcccaaccttacagtactttggtccgtcaatcttcccgaaggctttaaaaagtactgtgcaaaggtatcaattcattcaagctccatccagtatgaaagcgacgacataatgaggaaacactggggagacgattatggaatagcatgctgtgtttctgctatgagaattggaaaacagatgcagttcttcggtgcaagatgcaatcttgcaaaagctcttctttacgctattaacggcggaaaggatgaaatgacgggagaacagattgctccgatgtttgcaccggtggaaaccgaataccttgattacgaggacgtaatgaagaggtttgacatggtgcttgactgggtggcaaggctttatatgaacaccctcaatataattcactacatgcatgacaaatatgcctatgaggcgctgcagatggcattgcatgacaaagacgtgttcaggacgatggcatgcggaatagccggtttgtctgtggtggcagactcccttagcgcgataaaatatgcaaaggttaaaccgatacgcaatgaaaacaacctcgttgttgactacgaagttgagggtgattatcctaaattcggaaataacgacgaacgtgttgatgaaattgcagtgcaagtagtaaaaatgttcatgaacaagcttagaaagcaaagggcttacagaagtgccactccgaccctttccatacttaccataacttcaaacgtggtatatggaaagaaaaccggaaacactcctgacggcagaaaagctggagaacctttggcgccgggagcaaatccgatgcatggaagggatataaacggagcattggctgtactgaacagtattgcgaagcttccctatgaatatgcccaggacggcatttcatatactttctccataattccaaaagctctgggaagagacgaggaaaccagaataaacaatcttaaatcaatgcttgacggatatttcaagcagggcggccaccacataaatgtaaatgtgtttgaaaaagagacactgttagatgccatggaacatccggaaaaatatccacaacttaccataagagtgtccgggtatgcagtgaactttataaagcttacacgggagcaacagctggatgttattaacagaacgattcacggaaagatttaa

SEQ ID NO: 2479 - protein, 742 aa, Clostridium thermocellum ATCC 27405
MDAWRGFNKGNWCQEIDVRDFIIRNYTPYEGDESFLVGPTDRTRKLWEKVSELLKKERENGGVLDVDTHTISTITSHKPGYIDKELEVIVGLQTDEPLKRAIMPFGGIRMVIKGAEAYGHSVDPQVVEIFTKYRKTHNQGVYDVYTPEMRKAKKAGIITGLPDAYGRGRIIGDYRRVALYGVDRLIAEKEKEMASLERDYIDYETVRDREEISEQIKSLKQLKEMALSYGFDISCPAKDAREAFQWLYFAYLAAVKEQNGAAMSIGRISTFLDIYIERDLKEGKLTEELAQELVDQLVIKLRIVRFLRTPEYEKLFSGDPTWVTESIGGMALDGRTLVTKSSFRFLHTLFNLGHAPEPNLTVLWSVNLPEGFKKYCAKVSIHSSSIQYESDDIMRKHWGDDYGIACCVSAMRIGKQMQFFGARCNLAKALLYAINGGKDEMTGEQIAPMFAPVETEYLDYEDVMKRFDMVLDWVARLYMNTLNIIHYMHDKYAYEALQMALHDKDVFRTMACGIAGLSVVADSLSAIKYAKVKPIRNENNLVVDYEVEGDYPKFGNNDERVDEIAVQVVKMFMNKLRKQRAYRSATPTLSILTITSNVVYGKKTGNTPDGRKAGEPLAPGANPMHGRDINGALAVLNSIAKLPYEYAQDGISYTFSIIPKALGRDEETRINNLKSMLDGYFKQGGHHINVNVFEKETLLDAMEHPEKYPQLTIRVSGYAVNFIKLTREQQLDVINRTIHGKI

SEQ ID NO: 2480 - DNA, 2232 bp, Listeria monocytogenes str. 4b F2365
  CDS (1)..(2232): transl_table=11
atgactgaacaatggtatgaattcgcaggtggtaactggcaacaagaagtagatgtacgtgactttatcttaaaaaactatcgcttatatgacggtgacgacacattcttagttggcccaaccgaagcaactacaaaactttgggatcaagtaatggacttaactaaaaaagaacgtgaaaacggtggcgtactggatatggataccaaaatcgtttcaaccatcacttcacatgacccaggttacttaaacaaagacttagaaaaagttgtcggtgttcaaactgacgtacctttcaaacgcgctttgcaaccattcggtggaatccgtatggcagaagttgcagctgaatcttatggctttaaagtagacgaagaaattagtcatattttttctgaataccgtaaaacgcataaccaaggtgtatttgatgcttatactgctgaaatgcgcgcagctcgtaaatcaggcgtaattactggtcttccagatgcttatggccgtggccgtattatcggtgactaccgtcgtgtagcactttacggagtagacttcttaattaaacaaaagaaacaagatttaaacaatacaggtttacgtacaatgagcgatgacgttatccgtcaacgtgaagaacttaacgaacaaattcgtgctcttggcgaattaaaagtactaggcgaaaaacatggtttcgatcttggtcgcccagctaaaactgcacaagaagctttccaatggttataccttggttacttagcagcaattaaagaacaaaatggtgctgcaatgagcttaggacgtacatctacattccttgatatttatgtagaacgtgatcttcgtaacggcttaattactgaagaagaagcgcaagaaatcgttgaccacttcatcatgaaattacgccttgtaaaatttgctcgtacaccagattacaatgaattattctctggagatccaacatgggttactgaatccatcggtggtattacagaagaaggcgttccacttgtaacgaaaaactcattccgtttcttacacactttagataacttaggacctgctccagaaccaaacttaactgtactttggtccactcatttaccatcaggattcaagaaattctgtgctaaaatgtctatcaaaacatctgctattcaatacgaaaatgacgatgttatgcgccctaaatggggagatgactatgcaatcgcatgttgtgtatctgcaatgcgcgttggtaaacaaatgcaattctttggtgctcgtgccaaccttgctaaaacacttctttacgcaatcaatggtggtatcgatgaaaaatctaaagcacaagttggacctgcttatcgtccagttgaaggcgacgtattagactacaaagaagtaatggaaaaatatgatgcaatgatggaatggattgcagaactttaccttaatacattaaatgttattcactatatgcatgataaatacgcttacgaacgtatcgaaatggctttacatgatacagaagtattacgtactatggcaactggtatcgctggactttctgttgcagctgactccttatctgctattaaatatgctactgttcgtccaattcgtgacgaagatggcatcgtggttgattatgaaatcgaaggcgactatcctaaatacggaaataatgatgaccgtgtagacgaaattgctgtagaacttctaaaaacattcatgactaaagttagaaaacataaaacttaccgtgatgcagttcacacaacttctgttcttacaatcacttctaacgtggtttatggtaagaaaactggtaacactccagacggacgtcgtgcaggagaaccatttgcaccaggtgcgaacccaatgcatggccgtgatacaaaaggtgctttagcttctctatcttctgttgctaaacttccttacgaatatggtcaagatggtatttctaacacattctctatcgtaccaaaagctttaggtcgcgaagacgaatctcaaatcaataacttagttgcaatgctagatggttattctacaaaaatgggacatcacttaaacatcaacgtattcaatcgtgatacattacttgatgcgatggatcatccagaagagtatccgcaattaactatccgtgtatctggatatgcagttaacttcatcaaattaacacgtgaacaacaattagatgttattcaccgtacaatgcacgaatccatgtaa

SEQ ID NO: 2481 - protein, 743 aa, Listeria monocytogenes str. 4b F2365
MTEQWYEFAGGNWQQEVDVRDFILKNYRLYDGDDTFLVGPTEATTKLWDQVMDLTKKERENGGVLDMDTKIVSTITSHDPGYLNKDLEKVVGVQTDVPFKRALQPFGGIRMAEVAAESYGFKVDEEISHIFSEYRKTHNQGVFDAYTAEMRAARKSGVITGLPDAYGRGRIIGDYRRVALYGVDFLIKQKKQDLNNTGLRTMSDDVIRQREELNEQIRALGELKVLGEKHGFDLGRPAKTAQEAFQWLYLGYLAAIKEQNGAAMSLGRTSTFLDIYVERDLRNGLITEEEAQEIVDHFIMKLRLVKFARTPDYNELFSGDPTWVTESIGGITEEGVPLVTKNSFRFLHTLDNLGPAPEPNLTVLWSTHLPSGFKKFCAKMSIKTSAIQYENDDVMRPKWGDDYAIACCVSAMRVGKQMQFFGARANLAKTLLYAINGGIDEKSKAQVGPAYRPVEGDVLDYKEVMEKYDAMMEWIAELYLNTLNVIHYMHDKYAYERIEMALHDTEVLRTMATGIAGLSVAADSLSAIKYATVRPIRDEDGIVVDYEIEGDYPKYGNNDDRVDEIAVELLKTFMTKVRKHKTYRDAVHTTSVLTITSNVVYGKKTGNTPDGRRAGEPFAPGANPMHGRDTKGALASLSSVAKLPYEYGQDGISNTFSIVPKALGREDESQINNLVAMLDGYSTKMGHHLNINVFNRDTLLDAMDHPEEYPQLTIRVSGYAVNFIKLTREQQLDVIHRTMHESM

SEQ ID NO: 2482 - DNA, 2298 bp, Listeria monocytogenes str. 4b F2365
  CDS (1)..(2298): transl_table=11
ttgaaggaggaaattataatgacaaaagcatgggatggttttaaaggaaccgcatggcaagaaaacattagtgtagggcaattcgttcaagacaactacactccttacgatggcgatgaaagctttttagaaaagagcacaccaagaacaacgaaactaaatgaaaaaataaataaactagtagaagaaatggatgcaaaaggcggcgtacttgatatggataacgctatcgtatccaatgttgcatctcacaaagctggttacgtggatcaagaaaatgaagttattgttggtttacaaacagacaaaccattcaaattagcatttatgccgaatggtggtcttagaacagccgaacaatgtttaacagacaacggctattccattgatcaagaattacatgacttctacgtaaaaaatcgttctacagcaaatgatggtattttcagagcatatacagacgatatcaaacgtgcgcgtcactcccatatcgttagtggtcttcctgatgcatactctcgcggaagaatcatcggcttgtaccaaaaaccagcactttacggtgtggatcgtttaatagcagaaaaacaacaagacttgaaaaaaattgcgatttcttctgatgaaaacattcgtttacgtgaagaaatttggttacaaatcaaagcacttaaagacttaatcgttttaggtaacgaatacggtttagaacttggacgtccagctgaaaatgcaacagaagcggtacaatggacttacatgggctaccttgcttctatcaaacaagcaaacggtgctgcaagctcattcggtcgtattccgattttccttgatatctatatccaacgcgatttagaaaaaggcattatcactgaattcgatgcacaagaattaatcgaacaattaacccttaaattaagaatggttcgttttgcaagaacagatggttacaacgaactttacgcttccaatccaacattcgttacaacttcaatggctggtatgggcgcagacggtcgtcatcgtgtgactaaaacagattatcgtttcttacactgcttagataacctaggaaactcagcagaaccaaacttaactgtcctatgggatgctcgtttaccagaaagctttaaagaatattgtatgaaaatgagtgtaaaacattcctccattcaatacgaaaatgataaattaatgcaagaagaaggctacggcgatatgcaatgtatcagctgttgcgttagcccacttaacccagaagcagacaaagacaaaggcgaaacacataacctgcaatatttcggtgctcgtgtcaacgtactgaaatgtcttcttggagctatcaacggcggtaaagatgatcttcacaaaaaccaagtattcgacgttgtagaaccaattacaaccgaataccttgaatacgaagaagtactagaaaaattcgataaatcaatggactggttaacagacacttatgtagatgcgatgaacatcattcactttatgacagataaatacaactatgaaagtatgcaaatggccttcttaccatctaaagtaacagccaacatgggcttcggtatttgtggattcgctaacgtagtagatagcctaagtgccatcaaacatgccaaagtaaaaactatccgtgacgaagatggttttgtatatgactatgaagtagaaggcgacttccctcgttacggtgaaaatgatgaccgtgccgacgatatcgctgtaatggttcttaaaatgttcaaagacaaattagactcccataaactatacaaagatagtgaagcaaccgtttctgttctaacaatcacttctaacgttgcttactcaaaacaatgtggtaactcccccgtgcacaaaggacctgtatttgatgaaaatggcaaaatcgtcaaagaaccagaattcttcagcccaggagctaacccttctaacaaagcaaaaggtggtttcttagataaccttgctagtctttctaaattaccattccactatgcaaatgacggaatctccttaacaatccaaggagctccaaaaatgttcggtaaaacaacggaagaacaacaccataaccttgttggtattctggatggttactttacaaaaggtggtcaacacatcaacttaaacgttcttaaccacgatgaagtaatcgaaaaaatcaaagctggtatcccagtaatcttacgtatcagcggttattgcttaaatacgaaagatctaaatgaagaacaaaaaatggaactttgccaaagaatgttccacgaaaaattaatcggttaa

SEQ ID NO: 2483 - protein, 765 aa, Listeria monocytogenes str. 4b F2365
MKEEIIMTKAWDGFKGTAWQENISVGQFVQDNYTPYDGDESFLEKSTPRTTKLNEKINKLVEEMDAKGGVLDMDNAIVSNVASHKAGYVDQENEVIVGLQTDKPFKLAFMPNGGLRTAEQCLTDNGYSIDQELHDFYVKNRSTANDGIFRAYTDDIKRARHSHIVSGLPDAYSRGRIIGLYQKPALYGVDRLIAEKQQDLKKIAISSDENIRLREEIWLQIKALKDLIVLGNEYGLELGRPAENATEAVQWTYMGYLASIKQANGAASSFGRIPIFLDIYIQRDLEKGIITEFDAQELIEQLTLKLRMVRFARTDGYNELYASNPTFVTTSMAGMGADGRHRVTKTDYRFLHCLDNLGNSAEPNLTVLWDARLPESFKEYCMKMSVKHSSIQYENDKLMQEEGYGDMQCISCCVSPLNPEADKDKGETHNLQYFGARVNVLKCLLGAINGGKDDLHKNQVFDVVEPITTEYLEYEEVLEKFDKSMDWLTDTYVDAMNIIHFMTDKYNYESMQMAFLPSKVTANMGFGICGFANVVDSLSAIKHAKVKTIRDEDGFVYDYEVEGDFPRYGENDDRADDIAVMVLKMFKDKLDSHKLYKDSEATVSVLTITSNVAYSKQCGNSPVHKGPVFDENGKIVKEPEFFSPGANPSNKAKGGFLDNLASLSKLPFHYANDGISLTIQGAPKMFGKTTEEQHHNLVGILDGYFTKGGQHINLNVLNHDEVIEKIKAGIPVILRISGYCLNTKDLNEEQKMELCQRMFHEKLIG

SEQ ID NO: 2484 - DNA, 2250 bp, Bacillus thuringiensis serovar konkukian str. 97-27
  CDS (1)..(2250): transl_table=11
atgactcaagtattagaaaatgttaaaaacgcatgggaaaactttaaaggtgaaaaatggaaagcagagattgatgttcgcgatttcattttaaataatgtaaacgtttacgaaggggacgaatctttcttagcgggagcaactgaagcaacgaaacaactttgggatcaagtaatggatttaacaacgaaagaacgtgaaaacggtggcgttcttgatatggatacaaaaattgtttcttctattacatcacatgaaccaggatatttaaataaagagactgaaaaagtagtcggtttccaaactgataaaccatttaaacgttctttacaaccatatggtggtattcgtatggcggaacaagcttgtgaatcttatggatacgaaatggataaagaacttagtcgtatttttagagattggagaaaaactcataaccaaggtgtatttgatgcttatacaccagaaatgagagctgctcgtaaatcaggtgttattactggtcttccagatgcatacggacgtggacgtattatcggtgactaccgccgcgtagcattatatggagtagatcatttaattgaagcgaagaaagcagatttaaatttaactggcggtgtaatgagtgaagatacaatgcgtttacgcgaagagttatctgagcaaatacgtgcccttcaagagttaaaacaaatggctgcttctcatggctttgatatttctaagccagcaacaactgctcaagaagcattccaatggttatactttgcatatcttgcagcaattaaagagcaaaacggagctgcaatgagtcttggacgtacttctacattcttagatatttatattgaaagagatttagcaaatggcactttaacagaagaagacgtacaagaaattgtggatcacttcattatgaaattacgtcttgtaaaatttgcaagaacacctgattataatgagttattctctggcgacccaacttgggtaactgagtctatcggtggtatggcattggatggtcgtccattagtaacaaagaactcattccgtttcttgcatacattagataatttaggaccagctccagaaccaaacttaacagttctttggtctaaacaattaccacagaactttaaaaactactgtgcaaaaatgtctattaaaacatcagcaattcaatatgaaaatgatgacattatgcgtgctgactacggtgatgactatggaattgcttgttgtgtatctgcaatgagaattggtaaacaaatgcagttcttcggtgcacgtgcaaacttagcaaaagcattattatatgcgattaacggtggtaaagatgaaaaatctaaagcacaagttggccctgagtacgcaccaattacttctgaagtattagattatgaagaagttatgcataagtttgatatgacaatggaatggttagcgggtctatatttaaacacattaaatgttattcactacatgcacgataaatatagttacgaacgtattgaaatggcacttcatgatacaaatgttcttcgtacaatggcaacaggtatcgcgggtctatctgtagtagcagactctttaagtgcaattaaacatgcaaaagtaaaaccaattcgcgatgaaaatggaattgcggttgactttgaaattgaaggagatttccctaaatacggtaacaatgatgaccgtgtagatgaaattgctgtaaatcttgtgaaaacatttatgaataagcttcgtaaacataaaacatacagaaattctgttcatacaatgtcaattttaacaatcacatctaacgttgtatatggtaagaaaactggtaacactccagatggtcgccgtactggagaaccatttgcaccaggtgcgaacccaatgcatggacgtgatacaaaaggtgcgttagcttcattattatctgtagctaaattaccatatgaagatgcacaagatggtatttctaatacattctctattattccaaaagcacttggtaaagaggatgaagtacaagtacgtaacttagtatcaatgcttgatggttatgcagtaaaagaaggacatcacttaaatattaacgtatttaaccgtgaaacattaatggatgcaatggaacatcctgagaaatatccacaattaacaattcgcgtatctggttacgctgtaaactttattaaattaactcgtgaacaacaaatcgatgtaattaaccgtacaatgcatgaaagcatgtaa

SEQ ID NO: 2485 - protein, 749 aa, Bacillus thuringiensis serovar konkukian str. 97-27
MTQVLENVKNAWENFKGEKWKAEIDVRDFILNNVNVYEGDESFLAGATEATKQLWDQVMDLTTKERENGGVLDMDTKIVSSITSHEPGYLNKETEKVVGFQTDKPFKRSLQPYGGIRMAEQACESYGYEMDKELSRIFRDWRKTHNQGVFDAYTPEMRAARKSGVITGLPDAYGRGRIIGDYRRVALYGVDHLIEAKKADLNLTGGVMSEDTMRLREELSEQIRALQELKQMAASHGFDISKPATTAQEAFQWLYFAYLAAIKEQNGAAMSLGRTSTFLDIYIERDLANGTLTEEDVQEIVDHFIMKLRLVKFARTPDYNELFSGDPTWVTESIGGMALDGRPLVTKNSFRFLHTLDNLGPAPEPNLTVLWSKQLPQNFKNYCAKMSIKTSAIQYENDDIMRADYGDDYGIACCVSAMRIGKQMQFFGARANLAKALLYAINGGKDEKSKAQVGPEYAPITSEVLDYEEVMHKFDMTMEWLAGLYLNTLNVIHYMHDKYSYERIEMALHDTNVLRTMATGIAGLSVVADSLSAIKHAKVKPIRDENGIAVDFEIEGDFPKYGNNDDRVDEIAVNLVKTFMNKLRKHKTYRNSVHTMSILTITSNVVYGKKTGNTPDGRRTGEPFAPGANPMHGRDTKGALASLLSVAKLPYEDAQDGISNTFSIIPKALGKEDEVQVRNLVSMLDGYAVKEGHHLNINVFNRETLMDAMEHPEKYPQLTIRVSGYAVNFIKLTREQQIDVINRTMHESM

SEQ ID NO: 2486 - DNA, 2283 bp, Erwinia carotovora subsp. atroseptica SCRI1043
  CDS (1)..(2283): transl_table=11
atgaccgagctgaatgaaaaattggccaatgcatggcaaggctttagcaaaggtgaatggcaggataacgtcaatgttcgtgactttatccagaaaaactacacgccgtatgaaggtgatgagtctttcctagctggcgcaaccaaagcgacctcagcgctgtgggacagcgtcatggaaggcatcaaacaggaaaaccgcactcatgcgcctgttgattttgataccaatgttgctgcaactatcacgtctcacgacgcgggatacatcaacaaaggcctggaaaaaatcgttggtcttcagactgacgctccgttgaaacgtgcgttaattccgttcggcggcatcaaaatggttgaaggttcatgcaaagtttacggtcgtgaacttgatcctcaactgaaaaaaatcttcactgaataccgtaaaacgcacaatcagggcgtgttcgatgtttacaccccagacatcatgcgttgccgtaaatctggtgttctgactggtctgccggatgcttatggccgtggccgtatcatcggcgactaccgtcgcgttgcgctgtacggcatcgactacttgatgaaagacaagtttgctcagttcacttctctgcaatccaaactggaaaacggcgaagacctggaagcaacgatccgtctgcgtgaagaaattgccgatcagcatcatgcactgagccaaattaaagaaatggcagctaaatatggctgtgatatttctagtccggcaacgacagctcaggaagccgttcagtggacttacttcggctatctggctgcagttaaatcacagaatggtgcagcaatgtccttcggacgtgtctccactttcctggatatctacctcgatcgcgatctgaaagccggaaaaatcacggaagaagaagctcaggaaatgattgaccatctggtcatgaaactgcgtatggtgcgtttcctgcgtacacctgagtatgatgagctgttctctggtgacccgatctgggcaacagaatctctggctggtatgggtctggatggtcgcacactggtgagcaaaaccagcttccgcttcctgaacaccctgtacacaatggggccttctccagagccgaacatgaccattctgtggtctgaaaaactgccacaaagctttaaaaactatgctgctaaagtctccatcgatacctcttctctgcaatacgagaatgacgatctgatgcgtcctgactttaacaacgatgactacgcgattgcttgttgcgtaagcccgatgatcgttggcaaacaaatgcagttcttcggtgcccgtgcaaacctggcaaaaaccatgctgtacgcaatcaatggcggcgtggacgaaaaactgaaaatgcaggttggtccgaaatcagaaccgatcaaaggtgatgttctgaacttcgacgaagtgatggaacgtatggatcacttcatggattggctggctaagcagtacgtcacctctctgaacatcattcactacatgcatgacaaatacagctacgaagcggcgctgatggcactgcatgatcgtgacgtgttccgtaccatggcgtgtggtatcgctggtctgtctgttgctgctgactccttgtctgctatcaaatatgccaaagttaaaccaattcgtgatgaagatggtctggctatcgactttgatatcgaaggcgaatatccgcaattcggtaacaacgactctcgcgtagatgaactggcttgtgacctggttgaacgtttcatgaagaaaattcagaaactgaatacctaccgtggcgcaacaccaactcagtctgttctgaccatcacctctaacgtggtatatggtaagaaaacaggtaacacgccagacggccgccgtgcaggcgcaccgttcggaccaggtgctaacccaatgcacggtcgtgatcagaaaggtgcggttgcctctctgacttctgttgccaaactgccgtttgcgtacgcgaaagatggtatttcttataccttctccatcgtacctaacgcgttaggtaaagacgacaacgtacgtaaagctaaccttgcgggcctgatggatggttacttccaccacgaagccagcatcgaaggcggtcaacatctgaacgtcaacgtcatgaaccgtgaaatgctgcttgatgcgatggaaaacccggaaaaatatccgcagttgactatccgtgtatctggctacgcagtgcgtttcaactcactgactaaagaacagcagcaagacgtcattacccgtaccttcacacagtcaatctaa

SEQ ID NO: 2487 - protein, 760 aa, Erwinia carotovora subsp. atroseptica SCRI1043
MTELNEKLANAWQGFSKGEWQDNVNVRDFIQKNYTPYEGDESFLAGATKATSALWDSVMEGIKQENRTHAPVDFDTNVAATITSHDAGYINKGLEKIVGLQTDAPLKRALIPFGGIKMVEGSCKVYGRELDPQLKKIFTEYRKTHNQGVFDVYTPDIMRCRKSGVLTGLPDAYGRGRIIGDYRRVALYGIDYLMKDKFAQFTSLQSKLENGEDLEATIRLREEIADQHHALSQIKEMAAKYGCDISSPATTAQEAVQWTYFGYLAAVKSQNGAAMSFGRVSTFLDIYLDRDLKAGKITEEEAQEMIDHLVMKLRMVRFLRTPEYDELFSGDPIWATESLAGMGLDGRTLVSKTSFRFLNTLYTMGPSPEPNMTILWSEKLPQSFKNYAAKVSIDTSSLQYENDDLMRPDFNNDDYAIACCVSPMIVGKQMQFFGARANLAKTMLYAINGGVDEKLKMQVGPKSEPIKGDVLNFDEVMERMDHFMDWLAKQYVTSLNIIHYMHDKYSYEAALMALHDRDVFRTMACGIAGLSVAADSLSAIKYAKVKPIRDEDGLAIDFDIEGEYPQFGNNDSRVDELACDLVERFMKKIQKLNTYRGATPTQSVLTITSNVVYGKKTGNTPDGRRAGAPFGPGANPMHGRDQKGAVASLTSVAKLPFAYAKDGISYTFSIVPNALGKDDNVRKANLAGLMDGYFHHEASIEGGQHLNVNVMNREMLLDAMENPEKYPQLTIRVSGYAVRFNSLTKEQQQDVITRTFTQSI

SEQ ID NO: 2488 - DNA, 2229 bp, Symbiobacterium thermophilum IAM 14863
  CDS (1)..(2229): transl_table=11
atgaccgcgtggcgtggattccgtcccggccgctggcagcggcatatcgatacccgcgacttcatccagcagaactaccgcccttatgagggcgatgcttccttcctcagcggcccgacccaacggaccaaggccctatgggagaaggtgttcgccatcttcagggaggagcaggccaagcgggctccgctgaaggtggacacccagactcccgctgggatcctgtcgcacaggccggggtacgtggaccgggacctggagctgatcgtcggcctgcagaccgacgagcccggcaagcggacgttctaccctgccggcggctggcgcatggtcgagtcctcgatgaaggcctacggctacgaggccgacccccagtggaagaccatctacacccagtaccgcaagacccacaaccagggcgtgtttgacgcgtacacccccgagatgcgcgccgcccgctccaaccacatcatcaccggcctgcccgacgcctacggccgcggccgcatcatcggcgactaccgccgggtggcgctttacggcatcgaccggctcatcgaagagaaggagcgggagaaggccgccaccgagccctgggtcatggatgaacccaccatccggctccgggaggagctgacggagcagatcaacgcgctgcacgagttgaaggagctgggccgctggtacggcctggacctcggccgccccgcggagaacgcccgggaggcgatccagtggctctacatgggctacctgggcgcgatccgggaacagaacggcgccgccatgtccatcggccggatctccaccttcctcgacatctacatcgagcgggacctggagtcgggcctccttaccgaggcgcaggcccaggagctggtggaccagctcatcatcaagctgcgccaggtcgccttcctgcgcacgccggagtacaacgagctcttcagcggggatcccacctgggtgaccgagtccatcggcggcatggggctggacggccgcaccctggtcacccggacctcgttccggttcctgcagacgctctacaacctgggcccggcgccggagcccaacctgacggtgctctggtccacccggttgcccgaggggttcaagaagttctgcgcgcaggtctccatcgacacgtcggcgatccagtacgagaacgacgacatcatgcggccgctgtggggcgacgactacggcatcgcctgctgcgtctcggccatgcggatcggcaagcagaggcagttcttcggcgcccgggccaacctggccaagtgcctgctctacgccattaacggcggcgtcgacgagaagtcgggccagcaggtgggcccccggctgcagcccatcaccagcgacgtgctcgactacgaggaagtgcgggcccgcttcagcgagatgatggactggctggcgcggctgtacatcaacacgctcaacatcatccactacatgcacgacaagtacaactacgagtggctggagttcgccctgcacgaccgtgacatctaccgcaccatggcctgcggcatcgcggggctctcggtggtggcggactccctctcggcgatcaagcacgccagggtccggcccgtgcgcgacgagcggggcatcgcggtggacttcgagatcgagggcgagtacccggcctatggcaacaacgacgaccgggtggactccatcgcccgcgaggtggtggaagagttcaccgcgcggctgcggaagaacaaggcctaccgggatgccgatatcaccctgtccgtgctgacgatcacctccaacgtggtgtacggcaagcacaccggcaccaccccggacggccggaaggccggcgtgcctctggctcccggcgccaaccccatgcacgggcgcgaccggaagggggcgatcgcctcgctcacctccgtggccaagatcccctatgaggcggccaaggacggcatctccaacaccttctccatcgtgccgaaggctctgggccggacccgggaggatcagcggcgcaatctggtggccatcctggacgcctacaccagccagggcgcgcaccacctgaacgtcaactgcctcagccgtgagaccctgctggatgccatggagcatccggagctctacccgcagctcaccgtccgggtctcgggctacgccgtgaacttcgtgaagctgacgcgcgagcagcagctcgacgtgatcagccgcacgttccaccagagtctgtga

SEQ ID NO: 2489 - protein, 742 aa, Symbiobacterium thermophilum IAM 14863
MTAWRGFRPGRWQRHIDTRDFIQQNYRPYEGDASFLSGPTQRTKALWEKVFAIFREEQAKRAPLKVDTQTPAGILSHRPGYVDRDLELIVGLQTDEPGKRTFYPAGGWRMVESSMKAYGYEADPQWKTIYTQYRKTHNQGVFDAYTPEMRAARSNHIITGLPDAYGRGRIIGDYRRVALYGIDRLIEEKEREKAATEPWVMDEPTIRLREELTEQINALHELKELGRWYGLDLGRPAENAREAIQWLYMGYLGAIREQNGAAMSIGRISTFLDIYIERDLESGLLTEAQAQELVDQLIIKLRQVAFLRTPEYNELFSGDPTWVTESIGGMGLDGRTLVTRTSFRFLQTLYNLGPAPEPNLTVLWSTRLPEGFKKFCAQVSIDTSAIQYENDDIMRPLWGDDYGIACCVSAMRIGKQRQFFGARANLAKCLLYAINGGVDEKSGQQVGPRLQPITSDVLDYEEVRARFSEMMDWLARLYINTLNIIHYMHDKYNYEWLEFALHDRDIYRTMACGIAGLSVVADSLSAIKHARVRPVRDERGIAVDFEIEGEYPAYGNNDDRVDSIAREVVEEFTARLRKNKAYRDADITLSVLTITSNVVYGKHTGTTPDGRKAGVPLAPGANPMHGRDRKGAIASLTSVAKIPYEAAKDGISNTFSIVPKALGRTREDQRRNLVAILDAYTSQGAHHLNVNCLSRETLLDAMEHPELYPQLTVRVSGYAVNFVKLTREQQLDVISRTFHQSL

SEQ ID NO: 2490 - DNA, 2250 bp, Bacillus cereus E33L
  CDS (1)..(2250): transl_table=11
atgactcaagtattagaaaatgttaaaaacgcatgggaaaactttaaaggtgaaaaatggaaagcagagattgatgttcgcgatttcattttaaataatgtaaacgtttacgagggagacgaatctttcttagcgggagcaactgaagaaacgaaacaactttgggatcaagtaatggatttaacaacgaaagaacgtgaaaacggtggcgttcttgatatggatacaaaaattgtttcttctattacatcacatgaaccaggatatttaaataaagagactgaaaaagtagtcggtttccaaactgataaaccatttaaacgttctttacaaccatatggtggtattcgtatggcggaacaagcttgtgaatcttatggatacgaaatggataaagaacttagtcgtatttttagagattggagaaaaactcataaccaaggtgtatttgatgcttatacaccagaaatgagagctgctcgtaaatcaggtgttattactggtcttccagatgcatacggacgtggacgtattatcggtgactaccgccgcgtagcattatatggagtagatcatttaattgaagcgaagaaagcagatttaaatttaactggtggtgtaatgagtgaagatacaatgcgtttacgcgaagagttatctgaacaaatacgtgcacttcaagagttaaaacaaatggctgcttctcatggctttgatatttctaagccagcaacaactgctcaagaagcattccaatggttatactttgcatatcttgcagcgattaaagagcaaaacggagctgcaatgagtcttggacgtacttctacattcttagatatttatattgaaagagatttagcaaatggtactttaacagaagaagacgtacaagaaattgtggatcacttcattatgaaattacgtcttgtgaaatttgcaagaacacctgattataatgagttattctctggtgacccaacttgggtaactgagtctatcggtggtatggcattggatggtcgtccattagtaacaaagaactcattccgtttcttgcatacattagataatttaggaccagctccagaaccaaacttaacagttctttggtctaaacaattaccacagaactttaaaaactactgtgcgaaaatgtctattaaaacatcagcaattcaatatgaaaatgatgacattatgcgtgctgactatggcgatgactacggaattgcttgttgtgtatctgcaatgagaattggtaaacaaatgcagttcttcggcgcacgtgcaaacttagcaaaagcattgctatatgcgattaacggtggtaaagatgaaaaatctaaagcgcaagttggtcctgagtatgcaccgattacttctgaagtattagattatgaagaagttatgcataagtttgatatgacaatggaatggttagcgggtctatatttaaacacattaaatgttattcactacatgcacgataaatatagctacgaacgtattgaaatggcacttcatgatacaaatgttcttcgtacaatggcaacaggtatcgcgggtctatctgtagtagcagattctttaagtgcaattaaatatgcaaaagtaaaaccaattcgcgatgaaaacggaatcgcagttgactttgaaattgaaggagatttccctaaatacggtaacaatgatgaccgtgtagatgaaattgctgtaaatcttgtgaaaacatttatgaataaacttcgtaaacataaaacatacagaaattctgttcatacaatgtcaatcttaacaatcacatctaacgttgtatacggtaagaaaactggtaacactccagatggtcgccgtactggagaaccatttgcaccaggtgcgaacccaatgcatggacgtgatacaaaaggtgcgttagcttcattattatctgtagctaaattaccatatgaagatgcacaagatggtatttctaatacattctctattattccaaaagcgcttggtaaagaggatgaagtacaagtacgtaacttagtatcaatgcttgatggttatgcagtaaaagaaggccatcacttaaatattaacgtatttaatcgtgaaacattaatggatgcaatggaacatcctgagaaatatccacaattaacaattcgcgtatctggttacgctgtaaactttattaaattaactcgtgaacaacaaatcgatgtaattaaccgtacgatgcatgaaagcatgtaa

SEQ ID NO: 2491 - protein, 749 aa, Bacillus cereus E33L
MTQVLENVKNAWENFKGEKWKAEIDVRDFILNNVNVYEGDESFLAGATEETKQLWDQVMDLTTKERENGGVLDMDTKIVSSITSHEPGYLNKETEKVVGFQTDKPFKRSLQPYGGIRMAEQACESYGYEMDKELSRIFRDWRKTHNQGVFDAYTPEMRAARKSGVITGLPDAYGRGRIIGDYRRVALYGVDHLIEAKKADLNLTGGVMSEDTMRLREELSEQIRALQELKQMAASHGFDISKPATTAQEAFQWLYFAYLAAIKEQNGAAMSLGRTSTFLDIYIERDLANGTLTEEDVQEIVDHFIMKLRLVKFARTPDYNELFSGDPTWVTESIGGMALDGRPLVTKNSFRFLHTLDNLGPAPEPNLTVLWSKQLPQNFKNYCAKMSIKTSAIQYENDDIMRADYGDDYGIACCVSAMRIGKQMQFFGARANLAKALLYAINGGKDEKSKAQVGPEYAPITSEVLDYEEVMHKFDMTMEWLAGLYLNTLNVIHYMHDKYSYERIEMALHDTNVLRTMATGIAGLSVVADSLSAIKYAKVKPIRDENGIAVDFEIEGDFPKYGNNDDRVDEIAVNLVKTFMNKLRKHKTYRNSVHTMSILTITSNVVYGKKTGNTPDGRRTGEPFAPGANPMHGRDTKGALASLLSVAKLPYEDAQDGISNTFSIIPKALGKEDEVQVRNLVSMLDGYAVKEGHHLNINVFNRETLMDAMEHPEKYPQLTIRVSGYAVNFIKLTREQQIDVINRTMHESM

SEQ ID NO: 2492 - DNA, 2313 bp, Mannheimia succiniciproducens MBEL55E
  CDS (1)..(2313): transl_table=11
atggctgaattaactgaagctcaaaaaaaagcatgggaaggattcgttcccggtgaatggcaaaacggcgtaaatttacgtgactttatccaaaaaaactatactccgtatgaaggtgacgaatcattcttagctgatgcgactcctgcaaccagcgagttgtggaacagcgtgatggaaggcatcaaaatcgaaaacaaaactcacgcacctttagatttcgacgaacatactccgtcaactatcacttctcacaaaccaggttatatcaataaagatttagaaaaaatcgttggtcttcaaacagatgctccgttaaaacgtgcaattatgccgtacggcggtatcaaaatgatcaaaggttcttgcgaagtttacggtcgtaaattagatccgcaagtagaatttattttcaccgaatatcgtaaaacccataaccaaggcgtattcgacgtttatacgccggatattttacgctgccgtaaatcaggcgtgttaaccggtttaccggatgcttacggtcgtggtcgtattatcggtgactaccgtcgtttagcggtatacggtatcgattacctgatgaaagataaaaaagcccaattcgattcattacaaccgcgtttggaagcgggcgaagacattcaggcaactatccaattacgtgaagaaattgccgaacaacaccgcgctttaggcaaaatcaaagaaatggcggcatcttacggttacgacatttccggccctgcgacaaacgcacaggaagcaatccaatggacatattttgcttatctggctgcggttaaatcacaaaacggtgcggcaatgtcattcggtcgtacgtctacattcttagatatctatatcgaacgtgacttaaaacgcggtttaatcactgaacaacaggcgcaggaattaatggaccacttagtaatgaaattacgtatggttcgtttcttacgtacgccggaatacgatcaattattctcaggcgacccgatgtgggcaactgaaactatcgccggtatgggcttagacggtcgtccgttggtaactaaaaacagcttccgcgtattacatactttatacactatgggtacttctccggaaccaaacttaactattctttggtccgaacaattacctgaagcgttcaaacgtttctgtgcgaaagtatctattgatacttcctccgtacaatacgaaaacgatgacttaatgcgtcctgacttcaacaacgatgactacgcaatcgcatgttgcgtatcaccgatggtcgtaggtaaacaaatgcaattcttcggtgcgcgcgcaaacttagctaaaactatgttatacgcaattaacggcggtatcgatgagaaaaacggtatgcaagtcggtcctaaaactgcgccgattacagacgaagtattgaatttcgataccgtaatcgaacgtatggacagtttcatggactggttggcgactcaatatgtaaccgcattgaacatcatccacttcatgcacgataaatatgcatatgaagcggcattgatggcgttccacgatcgcgacgtattccgtacaatggcttgcggtatcgcgggtctttccgtggctgcggactcattatcagcaatcaaatatgcgaaagttaaaccgattcgcggcgacatcaaagataaagacggtaatgtcgtggcctcgaatgttgctatcgacttcgaaattgaaggcgaatatccgcaattcggtaacaatgatccgcgtgttgatgatttagcggtagacttagttgaacgtttcatgaaaaaagttcaaaaacacaaaacttaccgcaacgcaactccgacacaatctatcctgactatcacttctaacgtggtatacggtaagaaaaccggtaatactccggacggtcgtcgagcaggcgcgccattcggaccgggtgcaaacccaatgcacggtcgtgaccaaaaaggtgcggttgcttcacttacttctgtggctaaacttccgttcgcttacgcgaaagacggtatttcatataccttctctatcgtaccgaacgcattaggtaaagatgacgaagcgcaaaaacgcaaccttgccggtttaatggacggttatttccatcatgaagcgacagtggaaggcggtcaacacttgaacgttaacgttcttaaccgtgaaatgttgttagatgcgatggaaaatccggaaaaatacccgcaattaaccattcgtgtttcaggttatgcggttcgtttcaactcattgactaaagaacaacaacaagacgttatcactcgtacgtttacacaatcaatgtaa

SEQ ID NO: 2493 - protein, 770 aa, Mannheimia succiniciproducens MBEL55E
MAELTEAQKKAWEGFVPGEWQNGVNLRDFIQKNYTPYEGDESFLADATPATSELWNSVMEGIKIENKTHAPLDFDEHTPSTITSHKPGYINKDLEKIVGLQTDAPLKRAIMPYGGIKMIKGSCEVYGRKLDPQVEFIFTEYRKTHNQGVFDVYTPDILRCRKSGVLTGLPDAYGRGRIIGDYRRLAVYGIDYLMKDKKAQFDSLQPRLEAGEDIQATIQLREEIAEQHRALGKIKEMAASYGYDISGPATNAQEAIQWTYFAYLAAVKSQNGAAMSFGRTSTFLDIYIERDLKRGLITEQQAQELMDHLVMKLRMVRFLRTPEYDQLFSGDPMWATETIAGMGLDGRPLVTKNSFRVLHTLYTMGTSPEPNLTILWSEQLPEAFKRFCAKVSIDTSSVQYENDDLMRPDFNNDDYAIACCVSPMVVGKQMQFFGARANLAKTMLYAINGGIDEKNGMQVGPKTAPITDEVLNFDTVIERMDSFMDWLATQYVTALNIIHFMHDKYAYEAALMAFHDRDVFRTMACGIAGLSVAADSLSAIKYAKVKPIRGDIKDKDGNVVASNVAIDFEIEGEYPQFGNNDPRVDDLAVDLVERFMKKVQKHKTYRNATPTQSILTITSNVVYGKKTGNTPDGRRAGAPFGPGANPMHGRDQKGAVASLTSVAKLPFAYAKDGISYTFSIVPNALGKDDEAQKRNLAGLMDGYFHHEATVEGGQHLNVNVLNREMLLDAMENPEKYPQLTIRVSGYAVRFNSLTKEQQQDVITRTFTQSM

SEQ ID NO: 2494 - DNA, 2226 bp, Bacillus licheniformis ATCC 14580
  CDS (1)..(2226): transl_table=11
atggaacaatggaaaggtttcaccacaaacgtttggcaaaaagaagtcaatgtccgcgattttattctctcgaactttgagccatatcaaggtgacgaatcgtttctcgaacctccgacggaagctacatcggcattatgggatcatgtaatggatttgacaaaaaaagagcgtgaaaacggaggcgtccttgatatggatacagagatcgtctcaacgatcacctcgcacggtcccggatatttgaacaaagacctggaaaaagtcgtcggcgttcaaaccgatgagccgtttaaacggtcgcttcagcctttcggcggcatccgaatggcaaagcaggcatgcgaatcctatggttttaaactgaatgaagaagtggaaaggatctttaccgattaccgcaaaactcataaccaaggcgtgtttgacgcatatacggacgaaatgaagctcgcccgaaaagtcggaatcattaccggactgcctgatgcttacgggcgcgggcgcatcatcggtgattaccggagagtggcgctttacggcgtggatttcttgatcgatgaaaagaaaaaagatgcggccggcacctctcgggtgatgtctgaagaaaacatccgccttcgtgaagaactgtcagaacaaatccgagcattgaacgaacttaaagcgcttgcaaaaagctatgggtttgacatttccaagcctgcggcgaatgcaagagaagcatttcaatggctgtattttgcctatttggctgccattaaagagcaaaacggagcagcaatgagccttggccgcgtgtccacgttccttgatatttacatcgaaagagatttgaaaacgggcgtattaacagagcgtgaagcccaagagcttgtcgaccatttcgtcatgaagctgcgtttggtcaaattcgcgcgcacacctgactacaatgaactgttcagcggcgatccgacgtgggtgacagaatcaatcggcggaatggcgcacgacggacgcgccctggtgacgaaaaactcgttccgtttcctgcatacgcttgacaatttaggcccggcgcctgaaccgaatttaaccgttctttggtctgtcagactgccgcaaaagtttaaaaactactgtgccaaaatgtcgattaaaacaagctcgatccaatacgaaaatgacgatatcatgcgtccagaatacggtgatgactacggaatcgcctgctgtgtatcggcaatggcaatcggcaaacaaatgcagttcttcggagcacgcgccaacttggcgaaagctcttttatatgcgattaacggcggaaaagacgaaaagcataaaatgcaagtcggtccggaaatgccgccggttgcttccgacgtgctggactatgacgaagtgatgcataaattcgatcagacgatggaatggctcgcaggcttgtacatcaacacgctcaatgtcattcactacatgcatgataaatattgctatgaaagaattgaaatggccctgcacgacacggaaattttgcggacgatggccactgggatcgccggcttgagtgttgtcgccgattcattaagcgctgtcaaatatgccaaagtcagcgtggtccgcgatgaaaacggcattgcggtcgattttgaaacagaaggcgactttcctaagtacggaaataacgatgaccgcgtcgacgcgatcgccgttgacattgtcaagcgctttatgaaaaaactgcgcaagcatcagacatatcgccagtccgttcagaccatgtcaattttaacgatcacgtcaaacgtcgtttacggcaagaaaaccggaaatacgccggatggacgccgcgcgggagaaccgtttgctccaggtgcgaatccgatgcacggccgcgatactaaagggacgcttgcatcgctgtcttcagtggcaaagctgccttacagctatgcgctcgacggcatttccaacaccttttcaatcgtcccgaaagcgcttggcaaagacgaagagagccgcgccgccaatttgtcaagcatccttgacggatatgccgcaaaaacaggacatcacttaaatgtaaacgtatttaacagagagacactgctcgacgccatggaacatccagaggaatatccgcagttaacgattcgcgtctcaggctatgcggtcaactttattaagctgacgaaagaacagcagttagacgtcatcagcagaaccttccatgaatcgatgtag

SEQ ID NO: 2495 - protein, 741 aa, Bacillus licheniformis ATCC 14580
MEQWKGFTTNVWQKEVNVRDFILSNFEPYQGDESFLEPPTEATSALWDHVMDLTKKERENGGVLDMDTEIVSTITSHGPGYLNKDLEKVVGVQTDEPFKRSLQPFGGIRMAKQACESYGFKLNEEVERIFTDYRKTHNQGVFDAYTDEMKLARKVGIITGLPDAYGRGRIIGDYRRVALYGVDFLIDEKKKDAAGTSRVMSEENIRLREELSEQIRALNELKALAKSYGFDISKPAANAREAFQWLYFAYLAAIKEQNGAAMSLGRVSTFLDIYIERDLKTGVLTEREAQELVDHFVMKLRLVKFARTPDYNELFSGDPTWVTESIGGMAHDGRALVTKNSFRFLHTLDNLGPAPEPNLTVLWSVRLPQKFKNYCAKMSIKTSSIQYENDDIMRPEYGDDYGIACCVSAMAIGKQMQFFGARANLAKALLYAINGGKDEKHKMQVGPEMPPVASDVLDYDEVMHKFDQTMEWLAGLYINTLNVIHYMHDKYCYERIEMALHDTEILRTMATGIAGLSVVADSLSAVKYAKVSVVRDENGIAVDFETEGDFPKYGNNDDRVDAIAVDIVKRFMKKLRKHQTYRQSVQTMSILTITSNVVYGKKTGNTPDGRRAGEPFAPGANPMHGRDTKGTLASLSSVAKLPYSYALDGISNTFSIVPKALGKDEESRAANLSSILDGYAAKTGHHLNVNVFNRETLLDAMEHPEEYPQLTIRVSGYAVNFIKLTKEQQLDVISRTFHESM

SEQ ID NO: 2496 - DNA, 2229 bp, Bacteroides fragilis NCTC 9343
  CDS (1)..(2229): transl_table=11
atggaactgaataagacctttaaagatggactttggagcaaagaaatcaatgtaagggatttcgttagtaacaacatcactccttatgaaggggatgcttctttcctgcaaggacctaccgaacgcaccaaagctgtctggaatcactgtctcaaagctctcgaagaagagagaaacaataatggtattcgtgcactcgactacacaactgtatctactataacctctcaccctgccggctacatcgataaagagaacgaactgatcgtcggactacagaccgatcaggtgttaaaacgtgccatcaaaccgtttggcggaatcaatgtggttatgaaagcttgccgtgaaaacggagtggaagtagatgacagagttaaggatatcttcactcactatcgcaagactcacaatgatggggtattcgatgtgtataccgaagaaattcgttcgttccgttcattgggattccttaccggacttcccgacaactatgcacgcggacgtatcatcggtgattatcgccgcctggctctctatggtcttgaccgtctgatagaagctaaaaaagaagatctgcataatctgacaggtcctatgactgaagcccgcattcgtcttcgtgaagaagtagccgagcaaatcaaggccctgaaagagattaaagtattgggcgaatattatggtttggatctgagccgaccggcatataccgcacaggaagctgtacaatgggtgtatatggcttatctggctgccgtaaaagagcaggatggtgctgccatgtcactgggtaatgtatcttcattcctcgacatctatcttgaatatgaattaagccagggtacgataaccgaaacattcgctcaggaactgatcgaccaattcgttatcaaactccgtatggtacgccacttgcgtatgcagtcgtacaacgatatttttgcgggtgatcccacatgggtgaccgaatctatcggtggacgtttcaatgatggacgtaccaaagttactaaaacttctttccgcttcttgcagacactttataacttaggcccgtcaccggaacctaacatgactgtactatggagccctgagttacccgaaggtttcaaagcattctgtgcacaagtatctatcgacacttcttccgtacaatacgaaaacgacgacctgatgcgtgaagtccgtcaatcggatgactacggaatcgcttgttgtgtttcatatcaggaaatcggaaagcagattcagttcttcggcgcacgtgccaaccttgccaaagccctgctactggctatcaacggaggacgttgcgaaaatacaggtacagttatggtaaaagacatccctgtattgaccggtgaaacactgaagttcgaagaagtaatggccaactataagaaagtattgatacaaattgcacgtgtatacaacgaagcaatgaatatcatacattacatgcacgataagtattactacgaaaaggcgcagatggctttcgtggatactgatccccgcattaacctcgcttatggtgtagccggactctcaatcgccatcgattcactgtccgccatcaaatatgcacatgtgaaagcccgtcgcaacgacatcggactgacggagggattcgatatcgaaggtgctttcccttgtttcggtaatgacgatgaccgtgtagaccacctgggtgtggacctggtatatttctttagcgaagaattaaagaaactccccgtatataagaatgcccgtcctaccctttcgctgctgactatcacttcgaacgtaatgtatggcaagaagaccggtgccactcctgacggacgcgccaaaggcattgcctttgctcccggtgccaaccccatgcacggacgtgataaaaatggtgcaatcgcctcactgagttctgtagccaagttgcgttatcgcgactcacaggatggtatcagcaatacattctcaatcgttcccaaatcattgggagcaacacaagaagaccgtatcgacaatctggtgaccatgatggacggatattttacaaaaggcgcacaccacctgaacgtaaacgtgctgaaccgggaaatgttgcaggatgcgatggaacatcccgaaaagtatccgcaactgactatccgtgtctcaggatatgccgttaatttcgtgaaattgagccgcgaacatcagttggaagtaatcagccgcagttttcacgaaagaatgtaa

SEQ ID NO: 2497 - protein, 742 aa, Bacteroides fragilis NCTC 9343
MELNKTFKDGLWSKEINVRDFVSNNITPYEGDASFLQGPTERTKAVWNHCLKALEEERNNNGIRALDYTTVSTITSHPAGYIDKENELIVGLQTDQVLKRAIKPFGGINVVMKACRENGVEVDDRVKDIFTHYRKTHNDGVFDVYTEEIRSFRSLGFLTGLPDNYARGRIIGDYRRLALYGLDRLIEAKKEDLHNLTGPMTEARIRLREEVAEQIKALKEIKVLGEYYGLDLSRPAYTAQEAVQWVYMAYLAAVKEQDGAAMSLGNVSSFLDIYLEYELSQGTITETFAQELIDQFVIKLRMVRHLRMQSYNDIFAGDPTWVTESIGGRFNDGRTKVTKTSFRFLQTLYNLGPSPEPNMTVLWSPELPEGFKAFCAQVSIDTSSVQYENDDLMREVRQSDDYGIACCVSYQEIGKQIQFFGARANLAKALLLAINGGRCENTGTVMVKDIPVLTGETLKFEEVMANYKKVLIQIARVYNEAMNIIHYMHDKYYYEKAQMAFVDTDPRINLAYGVAGLSIAIDSLSAIKYAHVKARRNDIGLTEGFDIEGAFPCFGNDDDRVDHLGVDLVYFFSEELKKLPVYKNARPTLSLLTITSNVMYGKKTGATPDGRAKGIAFAPGANPMHGRDKNGAIASLSSVAKLRYRDSQDGISNTFSIVPKSLGATQEDRIDNLVTMMDGYFTKGAHHLNVNVLNREMLQDAMEHPEKYPQLTIRVSGYAVNFVKLSREHQLEVISRSFHERM

SEQ ID NO: 2498 - DNA, 2256 bp, Dechloromonas aromatica RCB
  CDS (1)..(2256): transl_table=11
atgaacaccatgaccaagatcaccagccgggccgatgcctgggaaggttttgtcggtaacgactggaagacctccgtcgatgtccgcggcttcatccaggccaacttcaccccttacgccggcaacagcgcctttctgcagggcccgacccagcgtaccactgccctctgggccaaactcgaagtgttgctcaagcaggaacaggccaagggcgttctcgatgtttccgccgaccgcccctcgaccatcaccgcccacgacgcaggctatatcgatcgcgacagtgaaatcatcgtcggcctgcaaaccgatgcgcccctgaagcgcgccatcatgccgaacggcggcgtgcgcatggtcgaaggcggcctcaaggcttacggtttcaggctcgacccgaccgtggccgagatctggagcaagtatcgcaaggatcacaacagcggcgtcttcgacgtctattcgccggaaatcgccaaggcccgcaaatcggccatcctgaccggcctgcccgatgcctatgggcgtggccgcatcattggtgactatcgccgtgtcgccctgtacggcgtcgatgcgctgcgcaagttcaagaaagcggaattccatgagctggatagcgccgaattcaccgaaagcgtcatccgcctgcgcgaggaagtcagcgaacaatatcgcgccctcgacgagctgaaacagatggccgccaagtatgggttcgacatcggtcgcccggcggccaatgcccaggaagccgtgcagtggacctacttcggctacctggcggcgatcaaggaacagaacggtgccgccatgtcgatcggccgcatctcgaccttcctcgacatctacatggaacgcgacatggccgccggcctgatcgacgaagcgcaggcccaggaaatgatggacgacctggtcatcaagctgcgcatcgtccgcttcctgcgcaccccggaatacgaccagctgttctcgggcgacccgacctgggtcaccgaatcgatcggcggtgtcggtgaggatggccggccgctcgtcaccaagaacagtttccgtatcctgcacaccctcaacaacctgggccccgccccggaacccaacctgacggtgctgtggtccgagaaattaccccagggcttcaaggatttctgcgccaagacctcgatcgagacctgctccctgcaatatgaaaacgacgacctgatgcgcccgcactggggcgacgactacggtatcgcctgctgcgtctcggccatgcgcatcggcaagcagatgcagttcttcggggcccgggccaatctggccaaagccatgctctacgcgatcaatggcggtcgcgacgaaatcagcggcgagcaggtcggcccgacctttgagcctatcgtcggcgaggtgctggattacgacgaggtcgtcgccaggttcctgcccatgatggaatggctgagcggcgtttatatgaaggcgctgaacaccatccacttcatgcacgacaaatacgcctacgagcgcattgaaatggcgctgcacgaccgcgacatcctgcgcaccatggcttgcggcattgctggcctgtcggtggtcgccgattcactctccgccatgcgtcacgccaaagtccatgtcgtgcgcgacgagcgtgggctggccagcgacttccgcatcgaaggcgactacccgtcctatggcaacaacgatgaccgcgtcgattcgattgccacctggctggtcgagaccttcatgggctatctgcgtcgcgagcggacctatcgcgatgccgtaccgaccatgtcggtgctgaccattacatccaacgtggtttatgggaagaagaccggcaacacgccggacggtcgcaaggccggccagcctttcgcgccgggcgccaacccgatgcacggccgggatcacaagggggcactggcctccatggcctcggtctgcaagctgccctacggctgctcgcaggacggtatttcctacaccttcaccatcgtgcccagtgcgcttggcccgacggagaaggaacgagtgggcaatctggcgaccatgctcgatggctatttcgcgagcaacggtcaccacgtcaatgtgaatgtcttcgatcgtgaaacgctgatgcacgccatggatcacccggagttgtacccgcaactcaccatccgggtatcaggttatgcggtgaacttcgtcaagctcacccgcgaacagcagctggacgtgatcagccgcaccttccatgtctcccactaa

SEQ ID NO: 2499 - protein, 751 aa, Dechloromonas aromatica RCB
MNTMTKITSRADAWEGFVGNDWKTSVDVRGFIQANFTPYAGNSAFLQGPTQRTTALWAKLEVLLKQEQAKGVLDVSADRPSTITAHDAGYIDRDSEIIVGLQTDAPLKRAIMPNGGVRMVEGGLKAYGFRLDPTVAEIWSKYRKDHNSGVFDVYSPEIAKARKSAILTGLPDAYGRGRIIGDYRRVALYGVDALRKFKKAEFHELDSAEFTESVIRLREEVSEQYRALDELKQMAAKYGFDIGRPAANAQEAVQWTYFGYLAAIKEQNGAAMSIGRISTFLDIYMERDMAAGLIDEAQAQEMMDDLVIKLRIVRFLRTPEYDQLFSGDPTWVTESIGGVGEDGRPLVTKNSFRILHTLNNLGPAPEPNLTVLWSEKLPQGFKDFCAKTSIETCSLQYENDDLMRPHWGDDYGIACCVSAMRIGKQMQFFGARANLAKAMLYAINGGRDEISGEQVGPTFEPIVGEVLDYDEVVARFLPMMEWLSGVYMKALNTIHFMHDKYAYERIEMALHDRDILRTMACGIAGLSVVADSLSAMRHAKVHVVRDERGLASDFRIEGDYPSYGNNDDRVDSIATWLVETFMGYLRRERTYRDAVPTMSVLTITSNVVYGKKTGNTPDGRKAGQPFAPGANPMHGRDHKGALASMASVCKLPYGCSQDGISYTFTIVPSALGPTEKERVGNLATMLDGYFASNGHHVNVNVFDRETLMHAMDHPELYPQLTIRVSGYAVNFVKLTREQQLDVISRTFHVSH

SEQ ID NO: 2500 - DNA, 2313 bp, Streptococcus agalactiae A909
  CDS (1)..(2313): transl_table=11
atggcaacagttaaaacaaacacagatatctttgaacaagcttgggaaggctttaaaggtgttgattggaaagaaaaagcaagtattgctcgcttcgttcaagcaaactatgcaccttacgatggagatgaaagcttcttagctggagcaactgaacgttcacttcacatcaaaaaagtgattgaagaaacaaaagctcactatgaagaaactcgcttcccaatggatactcgtgttgcttcaatttctgaattaccagctggttttatcgacaaagataacgagcttatctttggtattcaaaacgacgagcttttcaaattgaacttcatgcctaaaggtggtatccgtatggcggaaactacacttaaagaaaatggttatgaacctgatccagctgttcacgaaatcttcactaagtacgctacaacagtaaatgatggtatcttccgcgcttatacttctaacattcgtcgtgctcgccatgcacacactgttactggtcttccagacgcttattcacgcggacgtatcattggtgtatatgctcgtctagctgtttacggtgctgactacttgatgcaagaaaaagttaatgactggaatgcattgaatgatattgatgaagagtcaattcgtcttcgtgaagaaatcaaccttcaataccaagctcttggtgaagttgtaaaacttggtgacctttacggcgtagatgttcgtaaaccagccatgaacactaaagaagccattcaatgggtgaacattgctttcatggctgtatgtcgtgttatcaatggtgctgcaacatcacttggacgtgttcctattgtccttgatatctttgcagaacgtgacctcgctcgcggtacattcacagaatcagaaatccaagaatttgttgatgattttgtccttaaactccgtactgtaaaatttgctcgtactaaagcttatgatgccctttactcaggtgacccaacctttatcacaacttcaatggcaggtatgggagctgatggacgtcatcgtgttaccaaaatggactatcgtttcttaaatacacttgacaatatcggtaactcaccagaaccaaacttaactgttctttggtcagatcaattaccatatgctttccgtcgctactgtatgtcaatgagtcataaacactcttcaatccaatatgaaggtgtatcaacaatggctaaagaaggctacggtgaaatgtcatgtatttcatgttgtgtatctccacttgatccagaaaacgaagacaaacgtcacaaccttcaatattttggtgctcgtgttaacgttatgaaagcacttcttactggtcttaacggtggttatgatgatgttcataaagattacaaagtatttgacatcgacccaattcgtgacgaagtactcaactttgacactgtaaaagctaactttgaaaaatctcttgactggttgactgatacttatgttgatgcgatgaatatcatccactacatgactgataaatacaactatgaagctgtacaaatggcattcttaccttcacatgtacgtgctaatatgggatttggtatctgtggttttgcaaatactgtcgattcattatctgcgattaaatacgctactgttaaaccaatccgtgacgaagatggttacatctacgactacgaaacagttggtgacttcccacgttatggtgaagatgatgatcgtgttgactcaatcgctgaatggttacttgaagccttccatggacgccttgctaaacacaaactttataaagatgctgaagcaactgtttctcttcttacaatcacatcaaacgttgcttactctaaacaaactggtaactcaccggtacataaaggagtatatctcaatgaagatggtagtgtaaacctttctaaagtagaattcttctcaccaggtgctaacccttctaacaaagctaaaggtggctggttacaaaacttgaattcactttctaaacttgatttcgctcatgcaaatgatggtatttcattgacaactcaagtttctccacgcgctcttggtaaaacatttgatgaacaagttgataacttggtaacagtccttgatggttactttgaaaacggtggtcaacacgttaacttgaatgtcatggaccttaaagatgtctatgacaagattatgaatggtgaagatgttatcgttcgtatctcaggttactgtgtcaatactaaatatctaactcctgagcaaaaaactgagttgacacaacgtgtcttccatgaagtactttcaatggacgatgcattaactaactag

SEQ ID NO: 2501 - protein, 770 aa, Streptococcus agalactiae A909
MATVKTNTDIFEQAWEGFKGVDWKEKASIARFVQANYAPYDGDESFLAGATERSLHIKKVIEETKAHYEETRFPMDTRVASISELPAGFIDKDNELIFGIQNDELFKLNFMPKGGIRMAETTLKENGYEPDPAVHEIFTKYATTVNDGIFRAYTSNIRRARHAHTVTGLPDAYSRGRIIGVYARLAVYGADYLMQEKVNDWNALNDIDEESIRLREEINLQYQALGEVVKLGDLYGVDVRKPAMNTKEAIQWVNIAFMAVCRVINGAATSLGRVPIVLDIFAERDLARGTFTESEIQEFVDDFVLKLRTVKFARTKAYDALYSGDPTFITTSMAGMGADGRHRVTKMDYRFLNTLDNIGNSPEPNLTVLWSDQLPYAFRRYCMSMSHKHSSIQYEGVSTMAKEGYGEMSCISCCVSPLDPENEDKRHNLQYFGARVNVMKALLTGLNGGYDDVHKDYKVFDIDPIRDEVLNFDTVKANFEKSLDWLTDTYVDAMNIIHYMTDKYNYEAVQMAFLPSHVRANMGFGICGFANTVDSLSAIKYATVKPIRDEDGYIYDYETVGDFPRYGEDDDRVDSIAEWLLEAFHGRLAKHKLYKDAEATVSLLTITSNVAYSKQTGNSPVHKGVYLNEDGSVNLSKVEFFSPGANPSNKAKGGWLQNLNSLSKLDFAHANDGISLTTQVSPRALGKTFDEQVDNLVTVLDGYFENGGQHVNLNVMDLKDVYDKIMNGEDVIVRISGYCVNTKYLTPEQKTELTQRVFHEVLSMDDALTN

SEQ ID NO: 2502 - DNA, 2259 bp, Rhodospirillum rubrum ATCC 11170
  CDS (1)..(2259): transl_table=11
atgagtatcgtgcaaaaggacattcccgccaccaacccctggaaaggctttaccgagggcccgtggcagaccggcatcgatgtccgtgatttcatccagaaaaacgtgaccccctatcagggtgacggcgccttcctggccgggccgaccgaccgaacccgcctgttgtgggaaaaactgtccgcgctgttgctcaaggagcgcgagaagggggtgcttgacgtttcggccgaccgcgcctcgtcgatcaccgcccatgacgccggctatatcgaccgcgacgccgagatcatcgtcggcctgcagaccgacgccccgctcaagcgcgccatcatgcccaacggcggcctgcgcatggttcaaagcggcctggaggcctatggcttcgccagcgatcccaccgtcaacgaggtgtggaccaaataccgcaaaagccacaaccagggcatcttcgacgtttacagccccgatgttctggccgcccgcaaatcgggcgtgatcaccggcctgcccgacgcctatggccggggccgcatcatcggcgactatcgccgcgtcgccctctatggcgtcgatttcctgcgcgaccagaagcaaatggaattccacgagcttgatgacgcggtgttcagcgaggacgtcatccgcctgcgcgaggaactgtccgagcagtggcgggcgctcgatgagctcaagcagatggcggccaaatacggccatggcatcggtcgcccagcggccaatgcccgcgaagccatccagtggacctatttcgcctatctggcggcggtcaaggagcagaacggcgcggcgatgtcgctgggccgggtgtcgagcttccttgatatctacatccagcgcgatatcgaagccggccttctcagcgaagacggcgcccaggagatgatcgacgatctagtgatcaagctgcgcatcgtccgcttcctgcgcaccccggactacgatcagctgttctcgggcgatccgacctgggtcaccgaatgcgtcggcggcatggccgaggatggccgtaccctggtcacccgcaacagcttccgcttcctcaataccctttacaacctgggtccggcccccgagcccaatctgaccgtgctgtggagcacggccctgccgcagagcttcaagaccttctgcgccaaggtttcggccgataccagcgccattcaatacgagaatgacgacctgatgcgccggcgctggggcgatgattacggcatcgcctgctgcgtgtcggccatgcgcatcggcaagcagatgcagttcttcggcgcccgcgccaatctggccaaggccctgctctacgccatcaacggcggcgtcgatgaaaaatccggtcaggtggtggccaagggcttcgcgccgatcaccgccgatgtcctcgactatgacgaggtgatggccaagctcgacaagaccatggactggctggcccagacctatgtcaaggcgctcaacaccatccactacatgcacgacaaatacgcctatgagcggatcgagatggcgctgcatgaccgcgacatcctgcgcaccatggcctgcggcatcgccgggctgtcggtggcggccgattcgctttcggccatcaagttcgccaaggtccatgtcgtgcgcgacgacaaggggctggccgtcgattacacgatcgagggcgactatcccgcctatggcaacaacgacgaccgcgccgattccatcgccgtctggctgaccgaaaccttcatggaaaaggtccgcgcccagccgcgcttctaccgcgacgcgatgccgacccaatcggttctgaccatcacctcgaacgtggtttacggcaagaagaccggcaacacccccgacggccgccgcgccggcgagcccttcgcgccgggtgccaacccgatgaacggccgcgatgtcaaaggcttcgtcgcctcgggcgcctcggtcgccaagctgccctatgccgccgccctcgatggcatcagctggaccgcgtcggccaccccggattcgctcggacgcaccgacgaggagcgggcggtcaatctgtcgaattgcctggacgccttcgccaccgccggcggcttccacgtcaacgtcaacgtcttcaaccgcgacaccttgctccacgccatggaccacccggagctttacccgcagttgaccatccgcgtgtcgggctacgccgtgaatttcgtcaagctgacccgtgaacagcagctcgacgttatcggccgcaccttccaccagaccatgtga

SEQ ID NO: 2503 - protein, 752 aa, Rhodospirillum rubrum ATCC 11170
MSIVQKDIPATNPWKGFTEGPWQTGIDVRDFIQKNVTPYQGDGAFLAGPTDRTRLLWEKLSALLLKEREKGVLDVSADRASSITAHDAGYIDRDAEIIVGLQTDAPLKRAIMPNGGLRMVQSGLEAYGFASDPTVNEVWTKYRKSHNQGIFDVYSPDVLAARKSGVITGLPDAYGRGRIIGDYRRVALYGVDFLRDQKQMEFHELDDAVFSEDVIRLREELSEQWRALDELKQMAAKYGHGIGRPAANAREAIQWTYFAYLAAVKEQNGAAMSLGRVSSFLDIYIQRDIEAGLLSEDGAQEMIDDLVIKLRIVRFLRTPDYDQLFSGDPTWVTECVGGMAEDGRTLVTRNSFRFLNTLYNLGPAPEPNLTVLWSTALPQSFKTFCAKVSADTSAIQYENDDLMRRRWGDDYGIACCVSAMRIGKQMQFFGARANLAKALLYAINGGVDEKSGQVVAKGFAPITADVLDYDEVMAKLDKTMDWLAQTYVKALNTIHYMHDKYAYERIEMALHDRDILRTMACGIAGLSVAADSLSAIKFAKVHVVRDDKGLAVDYTIEGDYPAYGNNDDRADSIAVWLTETFMEKVRAQPRFYRDAMPTQSVLTITSNVVYGKKTGNTPDGRRAGEPFAPGANPMNGRDVKGFVASGASVAKLPYAAALDGISWTASATPDSLGRTDEERAVNLSNCLDAFATAGGFHVNVNVFNRDTLLHAMDHPELYPQLTIRVSGYAVNFVKLTREQQLDVIGRTFHQTM

SEQ ID NO: 2504 - DNA, 2325 bp, Haemophilus somnus 129PT
  CDS (1)..(2325): transl_table=11
atggctcaattaacagaaactcaacaaaaagcttgggaaggttttgtcggtggagattggcaaactgaagtcaatgttcgtgattttatccaaaaaaactatactccgtatgagggggatgaagcattcttagcggaagcaacagaagcaacatcaatcctgtgggctgatgtaatggaaaaaatcaaagtggagaacaaaactcacgaaccttatgatattgacacagatattccatccactatcacttctcataaagcgggctatatcaataaagatttagaaaaaattgtcggtttacaaacagacgctcccttaaaacgtgcaattatgccgtttggtgggatcaacatggttagaggctcatgtaaagtttaccgtcgtgaactcaatccagaagttgaaaaaatctttactgaatatcgcaaaactcacaatcaaggcgtattcgatgtttatacaccagatattttacgttgtcgtaaatcaggtgtaatcacaggtttacctgatgcttacggtcgtggtcgtatcatcggtgactatcgccgtatggcactttatggtgcagatttcttaatgaaagataaattcaaacaatttacttcattacaagagaaattagaaagcggcgaagatattcaagcaacgattcaattacgtgaggaaatcgctgaacagcaccgtgctttaggcaaaatgaaagaaatggctgcatcttatggctatgatatttccgctccagcaaaaaatgctcaagaagctgttcaatggacttacttcgcttaccttgccgccgttaaatcacaaaacggtgcggcaatgtcttttggtcgtgtatccacattcttagatattttcattgaacgtgatctcaaagcaggcaaaattacagaacaagaagctcaagaattaattgaccacttggtcatgaaacttcgtatggttcgcttcttacgaacccctgaatacgatcaattattctccggtgatccaatgtgggcaactgaaactttagccggtatggggttagatggtcgtactttagtcaccaaaacaagtttccgtatcttgcatacactttacacaatgggaccttcaccagaaccgaacttaactattctttggtctgaaagtttacctgatggtttcaaacgctatgctgcgaaagtatcaattgatacttcatctgtacagtacgaaaatgacgacctaatgcgtccggatttccaaaatgatgactatgcaatcgcctgctgcgtaagcccaatgatcgtgggtaaaatgatgcaattcttcggggctcgtgcgaacttagcaaaaacattactgtatgcaatcaacggcggtattgatgaaaaatccggtgaccaagttggtcctaaaaccgatcctattacaactgaatatttagattatgaagacgtcatgacccgtttagacagctttatggattggttagcaaaacaatacgtcactgcattgaacattattcattttatgcacgataaatatgcttatgaagcagcgttaatggcattgcatgatcgtgatgtattcagaacaatggcttgcggtattgccggtctttctgttgccgccgactcactttctgcaattaaatacgctaaagtaaaacctattcgtggtgatattgaagtgaaaaataaagctggcgacgtgatcggtatttcaaaaaatgttgcgattgactttgaaattgaaggtgaatatccacaatttggtaacaacgattcacgagtagatgatattgcagttgacttggttgaacgtttcatgaagaaaattcaaaaactcaaaacttaccgcaatgcaacaccaactcaatctgttttaacgattacttcaaatgtggtatatggcaagaaaacaggtaacacacctgatggtcgtcgttcaggtgcaccatttggaccgggagcaaacccaatgcacggacgtgatcaaaaaggtgcggtagcatcattaacttctgttgctaaacttccatttgcttatgctaaagacggtatttcttatacgttctctatcgtacctaatgcgttaggtaaagatattgatgcacaaaaacgcaatttggcaggtttaatggatggatatttccatcatgaaacaactattgaaggcggtcaacacttaaacgtgaatgtactaaatcgagaaatgttattagatgcggtagaaaatccagacaaatacccgcaattaaccattcgtgtatcaggttacgcagtacgtttcaactctttaaccaaagagcaacaacaagatgtaattacacgtacattcacaacgtcaatgtaa

SEQ ID NO: 2505 - protein, 774 aa, Haemophilus somnus 129PT
MAQLTETQQKAWEGFVGGDWQTEVNVRDFIQKNYTPYEGDEAFLAEATEATSILWADVMEKIKVENKTHEPYDIDTDIPSTITSHKAGYINKDLEKIVGLQTDAPLKRAIMPFGGINMVRGSCKVYRRELNPEVEKIFTEYRKTHNQGVFDVYTPDILRCRKSGVITGLPDAYGRGRIIGDYRRMALYGADFLMKDKFKQFTSLQEKLESGEDIQATIQLREEIAEQHRALGKMKEMAASYGYDISAPAKNAQEAVQWTYFAYLAAVKSQNGAAMSFGRVSTFLDIFIERDLKAGKITEQEAQELIDHLVMKLRMVRFLRTPEYDQLFSGDPMWATETLAGMGLDGRTLVTKTSFRILHTLYTMGPSPEPNLTILWSESLPDGFKRYAAKVSIDTSSVQYENDDLMRPDFQNDDYAIACCVSPMIVGKMMQFFGARANLAKTLLYAINGGIDEKSGDQVGPKTDPITTEYLDYEDVMTRLDSFMDWLAKQYVTALNIIHFMHDKYAYEAALMALHDRDVFRTMACGIAGLSVAADSLSAIKYAKVKPIRGDIEVKNKAGDVIGISKNVAIDFEIEGEYPQFGNNDSRVDDIAVDLVERFMKKIQKLKTYRNATPTQSVLTITSNVVYGKKTGNTPDGRRSGAPFGPGANPMHGRDQKGAVASLTSVAKLPFAYAKDGISYTFSIVPNALGKDIDAQKRNLAGLMDGYFHHETTIEGGQHLNVNVLNREMLLDAVENPDKYPQLTIRVSGYAVRFNSLTKEQQQDVITRTFTTSM

SEQ ID NO: 2506 - DNA, 2283 bp, Shewanella sp. MR-4
  CDS (1)..(2283): transl_table=11
atgaccgacaaaactgaactgtttgccaacgcatgggaaggttttacacctggcgattggaaatctgaagtcaatgtacgtgactttattcaacaaaactatgccccctatgaaggtgacgagtcattcctagccggtgccaccgaagccacaacccagttgtgggacaaagtgatggaaggcatcaagcaagaaaaccgtacccacgcgccagttgatttcgatactaagatggtttctaccatcacttcccatgacgcgggttatatcaataaagatttagaaactatcgttggtttacaaaccgatgcgccgcttaaacgcgctatgttacctaacggtggtattcgcatggttgaaggctcatgtgccgcctacaaccgcgaactcgatgccgatgtaaaatacatctactcagaactgcgtaagacccacaaccaaggcgtattcgacgtctacacgcctgaaatcatggcgtgtcgtaaatccggcgtattaaccggtttacccgatgcctatggtcgtggtcgtattatcggtgactatcgccgcgtggctctgtatggtatcgacttcttaatgaaggataaattcgcccagttcagctcactgcaagcgcagttcgaagccggtgaagatttatctaacgttatccaactgcgtgaagaaattgccgagcagcaccgcgctctaggtcaaatgaaacaaatggccgcgaaatacggtttcgatatttctcgcccagccactaacgcacaagaagcgatccagtggacttacttcggttatttagccgcagtgaagagccaaaacggcgcggcgatgtctttaggccgtacttcaaccttccttgatatctacattgaacgcgatctgaaaaacggcaccatcactgagcaacaagctcaagaaatgattgaccatttcgtgatgaaactgcgtatggtgcgtttcctacgtactccagaatacgatgagttgttctcaggcgacccaatttgggcaactgaatctatcggcggtatgggcttagatggccgtacactggtaaccaaatctagcttccgtttcttaaacactttatacactatgggcccaagccctgagccaaacatcactgtgctctggtcggacaaactgcctgtaggctttaaaaagtactgtgcgaaagtgtctatcgacaccagctctatccagtacgaaaacgatgacttaatgcgtccagatttccaatctgacgattacgctatcgcctgctgcgtgagtcctatggttgtgggtaaacacatgcagttcttcggcgcccgtgccaacttggcaaaaaccatgttgtatgcgatcaacggcggcgttgacgaaaaactgaaaatccaaatcgcgccaaaagccgacccaatcaccgacgaagtattaagcttcgatgacgtgatgaatcgcttagacggcctgatggattggttagcgacccaatatgtcacagcactgaactcaatccactacatgcacgacaagtactcctacgaagccgcgttaatggcgctgcacgacagagatgtacgtcgcaccatggcctgtggtatcgcagggctttcaatcgcggccgactcactgtctgccatcaagtacgctcaagtaaaacctgtacgtgatgaaaacggcattgccgtcgactttgagatcagcggtgattatccaaaatttggtaacaatgacccacgtgtcgacgatatcgcctgtgacttagttgaacgttttatgtcgaagatccgcgaccgtaaaatgtaccgcaacgcgatcccaactcagtcaattctgaccatcacctcgaacgtggtttatggtaagaaaaccggtaacacgccagacggtcgtcgttcaggtgcgccatttgcaccgggtgcaaacccaatgcatggccgtgatgaaaaaggcgcgattgcctcgttaacctcagtggcgaaactgccttttgcccacgcacaggacggtatctcttacaccttctccatcgtgcctaatgccttaggtaaagatgaagacggtcgccgtaccaacttagcggcgttgatggacggatatttcgcccacaacgaaggacacgaaggcggtcaacacttgaacgttaacgtgatgaaccgtgagatgctcgaggatgcggttgtcaatcctgacaagtatccgcagctaaccattcgtgtatcgggttacgcagtgcgctttaactcattgaccccagagcagcagcaagacgtgatcacacgtactttcacaaaaggtctgtaa

SEQ ID NO: 2507 - protein, 760 aa, Shewanella sp. MR-4
MTDKTELFANAWEGFTPGDWKSEVNVRDFIQQNYAPYEGDESFLAGATEATTQLWDKVMEGIKQENRTHAPVDFDTKMVSTITSHDAGYINKDLETIVGLQTDAPLKRAMLPNGGIRMVEGSCAAYNRELDADVKYIYSELRKTHNQGVFDVYTPEIMACRKSGVLTGLPDAYGRGRIIGDYRRVALYGIDFLMKDKFAQFSSLQAQFEAGEDLSNVIQLREEIAEQHRALGQMKQMAAKYGFDISRPATNAQEAIQWTYFGYLAAVKSQNGAAMSLGRTSTFLDIYIERDLKNGTITEQQAQEMIDHFVMKLRMVRFLRTPEYDELFSGDPIWATESIGGMGLDGRTLVTKSSFRFLNTLYTMGPSPEPNITVLWSDKLPVGFKKYCAKVSIDTSSIQYENDDLMRPDFQSDDYAIACCVSPMVVGKHMQFFGARANLAKTMLYAINGGVDEKLKIQIAPKADPITDEVLSFDDVMNRLDGLMDWLATQYVTALNSIHYMHDKYSYEAALMALHDRDVRRTMACGIAGLSIAADSLSAIKYAQVKPVRDENGIAVDFEISGDYPKFGNNDPRVDDIACDLVERFMSKIRDRKMYRNAIPTQSILTITSNVVYGKKTGNTPDGRRSGAPFAPGANPMHGRDEKGAIASLTSVAKLPFAHAQDGISYTFSIVPNALGKDEDGRRTNLAALMDGYFAHNEGHEGGQHLNVNVMNREMLEDAVVNPDKYPQLTIRVSGYAVRFNSLTPEQQQDVITRTFTKGL

SEQ ID NO: 2508 - DNA, 2283 bp, Shewanella sp. MR-7
  CDS (1)..(2283): transl_table=11
atgaccgacaaaactgaactgtttgccaacgcatgggaaggttttacacctggcgattggaaatctgaagtcaatgtacgtgactttattcaacaaaactatgctccctatgaaggtgacgagtcattcctagccggtgccaccgaagccacaacccagttgtgggacaaagtgatggaaggcatcaagcaagaaaaccgtacccacgcgccagttgatttcgatactaagatggtttctaccatcacttcccatgacgcgggttatatcaataaagatttagaaactatcgttggtttacaaaccgatgcgccgcttaaacgcgctatgttacctaacggtggtattcgcatggttgaaggctcatgtgccgcctacaaccgcgaactcgatgccgatgtaaaatacatctactcagaactgcgtaagacccacaaccaaggcgtattcgacgtctataccccagaaatcatggcatgtcgtaaatccggcgtgttaaccggtttacccgatgcctatggtcgtggtcgtatcatcggtgactatcgccgcgtggctctgtacggtatcgacttcttaatgaaggacaaattcgcccagttcagctcacttcaagcgcagttcgaagccggcgaagatttatctaacgttatccaactgcgtgaagaaattgccgagcagcaccgcgctctaggtcaaatgaaacaaatggccgcgaaatacggtttcgatatttctcgcccagccactaacgccaaagaagcgatccagtggacttacttcggttatttagccgcagtgaagagccaaaacggcgcggcgatgtctttaggccgtacttcaaccttccttgatatctacattgaacgcgatctgaaaaacggcaccatcactgagcaacaagctcaagaaatgattgaccatttcgtgatgaaactgcgtatggtgcgtttcctacgtactccagaatacgatgagttgttctcaggcgacccaatttgggcaactgaatctatcggcggtatgggcttagatggccgtacactggtaaccaaatctagcttccgtttcttaaacactttatacactatgggcccaagccctgagccaaacatcactgtgctctggtcggacaaactgcctgtaggctttaaaaagtactgtgcgaaagtgtctatcgacaccagctctatccagtacgaaaacgatgacttaatgcgtccagatttccaatctgacgattacgctatcgcctgctgcgtgagtcctatggttgtgggtaaacacatgcagttcttcggcgcccgtgcaaacttggcaaaaaccatgttgtatgcgatcaacggcggcgttgacgaaaaactgaaaatccaaatcgcgccaaaagccgacccaatcaccgacgaagtattaagcttcgatgacgtgatgaatcgcttagacggcctgatggattggttagcgacccaatatgtcacagcactgaactcaatccactacatgcacgacaagtactcctacgaagccgcgttaatggcgctgcacgacagagatgtacgtcgcaccatggcctgtggtatcgcagggctttcaatcgcggccgactcactgtctgccatcaagtacgctcaagtaaaacctgtacgtgatgaaaacggcattgccgtcgactttgagatcagcggtgattatccaaaatttggtaacaatgacccacgtgtcgacgatatcgcctgtgacttagttgaacgttttatgtcgaagatccgcgaccgtaaaatgtaccgcaacgcgatcccaactcagtcaattctgaccatcacctcgaacgtggtttatggtaagaaaaccggtaacacgccagacggtcgtcgttcaggtgcgccatttgcaccgggtgcaaacccaatgcatggccgtgatgaaaaaggcgcgattgcctcgttaacctcagtggcgaaactgccttttgcccacgcacaggacggtatctcttacaccttctccatcgtgcctaatgccttaggtaaagatgaagacggtcgccgtaccaacttagcggcgttgatggacggatatttcgcccacaacgaaggacacgaaggcggtcaacacttgaacgtgaacgtgatgaaccgtgagatgctcgaagatgcggttgtcaatcctgacaagtatccgcagctaaccattcgtgtatcgggttacgcagtgcgctttaactcattgaccccagagcagcagcaagacgtgatcacacgtactttcacaaaaggtctgtaa

SEQ ID NO: 2509 - protein, 760 aa, Shewanella sp. MR-7
MTDKTELFANAWEGFTPGDWKSEVNVRDFIQQNYAPYEGDESFLAGATEATTQLWDKVMEGIKQENRTHAPVDFDTKMVSTITSHDAGYINKDLETIVGLQTDAPLKRAMLPNGGIRMVEGSCAAYNRELDADVKYIYSELRKTHNQGVFDVYTPEIMACRKSGVLTGLPDAYGRGRIIGDYRRVALYGIDFLMKDKFAQFSSLQAQFEAGEDLSNVIQLREEIAEQHRALGQMKQMAAKYGFDISRPATNAKEAIQWTYFGYLAAVKSQNGAAMSLGRTSTFLDIYIERDLKNGTITEQQAQEMIDHFVMKLRMVRFLRTPEYDELFSGDPIWATESIGGMGLDGRTLVTKSSFRFLNTLYTMGPSPEPNITVLWSDKLPVGFKKYCAKVSIDTSSIQYENDDLMRPDFQSDDYAIACCVSPMVVGKHMQFFGARANLAKTMLYAINGGVDEKLKIQIAPKADPITDEVLSFDDVMNRLDGLMDWLATQYVTALNSIHYMHDKYSYEAALMALHDRDVRRTMACGIAGLSIAADSLSAIKYAQVKPVRDENGIAVDFEISGDYPKFGNNDPRVDDIACDLVERFMSKIRDRKMYRNAIPTQSILTITSNVVYGKKTGNTPDGRRSGAPFAPGANPMHGRDEKGAIASLTSVAKLPFAHAQDGISYTFSIVPNALGKDEDGRRTNLAALMDGYFAHNEGHEGGQHLNVNVMNREMLEDAVVNPDKYPQLTIRVSGYAVRFNSLTPEQQQDVITRTFTKGL

SEQ ID NO: 2510 - DNA, 2283 bp, Shewanella sp. ANA-3
  CDS (1)..(2283): transl_table=11
atgaccgacaaaactgaactgttttccaacgcatgggaaggttttacccctggcgattggaaatctgaagtcaatgtacgtgactttattcaacaaaactatgctccctatgaaggtgacgagtcattcctagccggtgccaccgaagccacaactcagttgtgggacaaagtgatggaaggcatcaagcaagaaaaccgcacccacgcgccagttgatttcgatactaagatggtctctaccatcacttcccatgacgcgggttatatcaataaagatttagaaactatcgttggtttacaaaccgatgcgccgctcaagcgcgctatgttacctaacggtggtattcgcatggttgaaggctcatgtgccgcttacaaccgcgaactcgacgccgatgtaaaatacatctactcagaactgcgtaaaacacacaaccaaggcgtattcgacgtctacaccccagaaatcatggcgtgccgtaaatccggcgtattaactggtttacccgatgcctatggtcgtggtcgtattatcggtgactatcgccgcgtagcgctctacggtatcgacttcttaatgaaggataaatttgcccagttcagctcactgcaagcgcagttcgaagccggcgaagatttatctaacgttatccaactgcgtgaagaaattgccgagcagcaccgcgctctaggtcaaatgaagaccatggcggctaaatacggtttcgatatttctcgcccagccgctaacgccaaagaagcgattcaatggacatattttggctacttagctgcggttaagagccaaaacggcgcagctatgtctttaggccgtacctcatctttcctcgatatctacatcgagcgcgatctgaaaaacggcaccatcacagagcaacaagctcaagaaatgattgaccatttcgtgatgaaactgcgtatggtgcgtttcctacgtactccagaatacgatgagttattctcaggcgatcctatttgggcaactgaatctatcggcggtatgggcttagatggccgtacactagtgaccaaatccagcttccgtttcttaaacaccttatacactatgggcccaagcccagagccaaacatcactgtgctctggtctgacaaactgcctgtaggctttaaaaagtactgcgcgaaagtgtctatcgacaccagctctatccagtacgaaaacgatgacttaatgcgcccagatttccaatctgacgattacgctatcgcttgctgcgtgagcccaatggttgtgggtaaacacatgcagttcttcggcgcccgtgcaaacttggcaaaaaccatgttgtatgcgatcaacggcggtgttgacgaaaaactgaaaatccaaatcgcgccaaaagccgccccaatcaccgacgaagtgttgaacttcgatgacgtgatgaatcgtttagacggcctgatggattggttagcgacgcaatatgtcactgcgctgaactctattcactacatgcacgacaagtactcctacgaagctgcgctaatggcgctgcacgacagagacgttcgtcgtaccatggcttgtggtatcgcagggctttcaatcgcggccgactcactgtctgccatcaagtacgctcaagttaaacctgtgcgtgatgaaaacggcattgccgtcgactttgagatcagcggtgattatccaaaatttggtaacaacgacccacgcgtcgacgatatcgcctgtgacttagttgaacgttttatgtcgaagatccgcgaccgtaaaatgtaccgcaacgctatcccaactcagtcaattctgaccattacctctaacgtggtttatggtaagaaaaccggtaacacgccagacggtcgccgttcaggtgcgccatttgcaccgggtgcaaacccaatgcacggccgtgatgagaaaggtgcgattgcctcgttaacctcagtggcaaaactgccttttgcccacgcacaggacggtatctcatacaccttctccatcgtgcctaatgccttaggtaaagatgaagacggtcgccgtactaacctcgcggcgttgatggacggatatttcgcccacaacgaaggacacgaaggcggtcaacacttgaacgttaacgtgatgaaccgtgaaatgcttgaggatgcggtcgttaaccctgacaagtatccgcaactgaccatccgggtatcgggttacgcagtgcgctttaactctttgaccccagagcagcagcaagacgtgatcacacgtactttcacaaaaggtctgtaa

SEQ ID NO: 2511 - protein, 760 aa, Shewanella sp. ANA-3
MTDKTELFSNAWEGFTPGDWKSEVNVRDFIQQNYAPYEGDESFLAGATEATTQLWDKVMEGIKQENRTHAPVDFDTKMVSTITSHDAGYINKDLETIVGLQTDAPLKRAMLPNGGIRMVEGSCAAYNRELDADVKYIYSELRKTHNQGVFDVYTPEIMACRKSGVLTGLPDAYGRGRIIGDYRRVALYGIDFLMKDKFAQFSSLQAQFEAGEDLSNVIQLREEIAEQHRALGQMKTMAAKYGFDISRPAANAKEAIQWTYFGYLAAVKSQNGAAMSLGRTSSFLDIYIERDLKNGTITEQQAQEMIDHFVMKLRMVRFLRTPEYDELFSGDPIWATESIGGMGLDGRTLVTKSSFRFLNTLYTMGPSPEPNITVLWSDKLPVGFKKYCAKVSIDTSSIQYENDDLMRPDFQSDDYAIACCVSPMVVGKHMQFFGARANLAKTMLYAINGGVDEKLKIQIAPKAAPITDEVLNFDDVMNRLDGLMDWLATQYVTALNSIHYMHDKYSYEAALMALHDRDVRRTMACGIAGLSIAADSLSAIKYAQVKPVRDENGIAVDFEISGDYPKFGNNDPRVDDIACDLVERFMSKIRDRKMYRNAIPTQSILTITSNVVYGKKTGNTPDGRRSGAPFAPGANPMHGRDEKGAIASLTSVAKLPFAHAQDGISYTFSIVPNALGKDEDGRRTNLAALMDGYFAHNEGHEGGQHLNVNVMNREMLEDAVVNPDKYPQLTIRVSGYAVRFNSLTPEQQQDVITRTFTKGL

SEQ ID NO: 2512 - DNA, 2376 bp, Bifidobacterium longum DJO10A
  CDS (1)..(2376): transl_table=11
atgaccgcagtggaaaatgcagctgtctcccaggaggagctcgacgccaaggcgtgggccggcttcaccgagggcaactggcagaaggatattgacgtccgcgacttcatccagaagaactacaccccgtacgagggcgacgagacattcctggctcctgccaccgagaagaccaagcacctgtggaagtacctcgacgacaactacctggccgtggagcgcaagcagcgcgtctacgacgtggacacccataccccggccgacgtcgacgccttcccggccggctacatcgactccccggaagtcgataacgtggtcgttggcctccagaccgacgttccctgcaagcgcgcgatgatgccgaacggtggctggcgcatggtcgagcaggccatcaaggaagccggcaaggaaccggatccggagatcaagaagatcttcaccaagtaccgcaagacccacaacgacggcgtcttcggcgtgtacaccaagcagatcaaggtcgcccgccacaacaagatcctcaccggtctgccggacgcctacggccgtggccgcatcatcggcgactaccgccgcgtcgccctgtacggcgtgaacaagctcatcgccttcaagaagcgcgacaaggactccgtgccgtaccgcaacgacttcaccgagccggagatcgagcactggatccgcttccgtgaggagcacgacgagcagatcaaggccctgaagaagctcatcaacctcggcaacgagtacggcctcgacctgtcccgcccggcccagaccgcgcaggaagccgtgcagtggacctacatgggctacctggcctccatcaagtcccaggacggcgccgccatgtccttcggccgcaactccgccttcctcgactgctacatcgagcgcgacctccaggccggcaagatcaccgagaccgacgcccaggagctcatcgacaacatcgtcatgaagctgcgcatcgtgcgcttcctgcgtaccaaggactacgattcgatcttctccggcgacccgtactgggcgacctggtccgacgccggcttcggcgatgacggccgttcgatggtcaccaagacctcgttccgtctgctcaacaccctgaccctcgagcacctcggacctggccccgagccgaacatcaccatcttctgggatccgaagctgcctgaggcctacaagcgcttctgcgccaagatctccatcgacacctcggccatccagtacgagtccgacaaggagattcgcagccactggggcgacgacgctgctatcgcctgctgcgtgtccccgatgcgtgtcggcaagcagatgcagttcttcgccgcccgcgtgaactccgccaaggccctgctgtacgccatcaacggcggccgcgacgagatgaccggcatgcaggtcatcgacaagggcgtgatcgagccgattaccccggaggccgacggcaccctggactacgagaaggtcaagaacaactacgagaaggctctcgagtggctgtccgagacctacgtcatggccctgaacatcatccactacatgcacgataagtacgcgtacgagtccatcgagatggccctgcacgacaaggaagtgtaccgcaccctcggctgcggcatgtccggtctgtccatcgccgccgactccctcgccgccgtcaagtacgccaaggtctacccgatctacaacaaggacgcgaagaccctggaaggccacgagtacgagtacgttgagggcgccgacgacgacctgatcgtcggctaccgcaccgagggcgagttcccggtctacggcaacgacgacgaccgcgccgacgacatcgccaagtgggtcgtctccacggtcatgggccaggtcaagaggctcccggtctaccgcggcgccgtcccgacccagtccatcctgacgatcacctccaacgtcgagtacggcaagaacaccggttccttcccgtccggccacgccaagggcaccccgtacgctccgggcgccaacccggagaacggcatggactcccacggcatgctgccgtccatgttctccgtcggcaagatcgactacaacgacgctcttgacggcatctcgctgaccaacaccatcacccctgatggcctgggccgcgacgaggacgagcgcatcggcaacctggtcggcatcctggacgccggcaacggccacggcctctaccacgcgaacatcaacgttctgcgcaaggagaccatggaggacgccgtcgagcaccccgaaaagtacccgcacctgaccgtgcgtgtctccggctacgcggtgaacttcgtcaagctcaccaaggagcagcagctcgacgtcatctcccgtaccttccaccagggtgccgtcgtcgactga

SEQ ID NO: 2513 - protein, 791 aa, Bifidobacterium longum DJO10A
MTAVENAAVSQEELDAKAWAGFTEGNWQKDIDVRDFIQKNYTPYEGDETFLAPATEKTKHLWKYLDDNYLAVERKQRVYDVDTHTPADVDAFPAGYIDSPEVDNVVVGLQTDVPCKRAMMPNGGWRMVEQAIKEAGKEPDPEIKKIFTKYRKTHNDGVFGVYTKQIKVARHNKILTGLPDAYGRGRIIGDYRRVALYGVNKLIAFKKRDKDSVPYRNDFTEPEIEHWIRFREEHDEQIKALKKLINLGNEYGLDLSRPAQTAQEAVQWTYMGYLASIKSQDGAAMSFGRNSAFLDCYIERDLQAGKITETDAQELIDNIVMKLRIVRFLRTKDYDSIFSGDPYWATWSDAGFGDDGRSMVTKTSFRLLNTLTLEHLGPGPEPNITIFWDPKLPEAYKRFCAKISIDTSAIQYESDKEIRSHWGDDAAIACCVSPMRVGKQMQFFAARVNSAKALLYAINGGRDEMTGMQVIDKGVIEPITPEADGTLDYEKVKNNYEKALEWLSETYVMALNIIHYMHDKYAYESIEMALHDKEVYRTLGCGMSGLSIAADSLAAVKYAKVYPIYNKDAKTLEGHEYEYVEGADDDLIVGYRTEGEFPVYGNDDDRADDIAKWVVSTVMGQVKRLPVYRGAVPTQSILTITSNVEYGKNTGSFPSGHAKGTPYAPGANPENGMDSHGMLPSMFSVGKIDYNDALDGISLTNTITPDGLGRDEDERIGNLVGILDAGNGHGLYHANINVLRKETMEDAVEHPEKYPHLTVRVSGYAVNFVKLTKEQQLDVISRTFHQGAVVD

SEQ ID NO: 2514 - DNA, 2325 bp, Haemophilus somnus 2336
  CDS (1)..(2325): transl_table=11
atggctcaattaacagaaactcaacaaaaagcttgggaaggttttgtcggtggagattggcaaactgaagtaaatgttcgtgattttatccaaaaaaactatacgccttacgagggtgatgaagcattcttagcggaagcaacagaagcaacatcaattctgtgggctgatgtaatggaaaaaatcaaagtggagaacaaaactcacgaaccttatgatattgacacagatattccatccactatcacttctcataaagcgggctatatcaataaagatttagaaaaaattgtcggtttacaaacagacgcccccttaaaacgtgcaattatgccgtttggtgggatcaacatggttagaggctcatgtaaagtttaccgtcgtgaactcaatccagaagttgaaaaaatctttactgaatatcgcaaaactcacaatcaaggcgtattcgatgtttatacaccagatattttacgttgtcgtaaatcaggtgtaatcacaggtttacctgatgcttacggtcgtggtcgtatcatcggtgactatcgccgtatggcactttatggtgcagatttcttaatgaaagataaattcaaacaatttacttcattacaagagaaattagaaagtggcgaagatattcaagcaacgattcaattacgtgaggaaatcgctgaacagcaccgtgctttaggcaaaatgaaagaaatggcagcatcttacggctatgatatttccgctccagcaaaaaatgctcaagaggcggttcaatggacttacttcgcttaccttgctgccgttaaatcacaaaacggtgcggcaatgtcttttggtcgtgtatccacattcttagatattttcattgaacgtgatctcaaagcaggcaaaattacagaacaagaagctcaagaattaattgaccacttggtcatgaaacttcgtatggttcgcttcttacgcacgcctgaatacgatcaattattctccggtgatccaatgtgggcaactgaaactttagccggtatggggttagatggtcgtactttagtcaccaaaacaagtttccgtatcttgcatacactttacacgatgggaccttcaccagaaccgaacttaactattctttggtctgaaagtttacctgatggtttcaaacgctatgctgcgaaagtatcaattgatacttcatctgtacagtacgaaaatgacgacctaatgcgtccggatttccaaaatgatgactatgcaatcgcctgctgcgtaagcccaatgatcgtgggtaaaatgatgcaattcttcggggctcgtgcgaacttagcaaaaacattactgtatgcgatcaacggcggtattgatgaaaaatccggtgaccaagttggccctaaaactgatcctattacaactgaatatttagattatgaagacgtcatgacccgtttagacagctttatggattggttagcaaaacaatacgtcactgcattgaacattattcattttatgcacgataaatatgcttatgaagcagcgttaatggcattgcatgatcgtgatgtattcagaacaatggcttgcggtattgccggtctttctgttgccgccgactcactttctgcaattaaatacgctaaagtaaaacctattcgtggtgatattgaagtgaaaaataaagctggcgacgtgatcggtatttcaaaaaatgttgcgattgactttgaaattgaaggtgaatatccacaatttggtaacaacgattcacgagtagatgatattgcagttgacttggttgaacgtttcatgaagaaaattcaaaaactcaaaacttaccgcaatgcaacaccaactcaatctgttttaacgattacttcaaatgtggtatatggcaagaaaacaggtaacacacctgatggtcgtcgttcaggtgcaccatttggaccgggagcaaacccaatgcacggacgtgatcaaaaaggtgcggtagcatcattaacttctgttgctaaacttccatttgcttatgctaaagacggtatttcttatacgttctctatcgtacctaatgcgttaggtaaagatattgatgcacaaaaacgcaatttggcaggtttaatggatggatatttccatcatgaaacaactattgaaggcggtcaacacttaaacgtgaatgtactaaatcgagaaatgttattagatgcggtagaaaatccagacaaatacccgcaattaaccattcgtgtatcaggttacgcagtacgtttcaactctttaactaaagaccaacaacaagatgtaattacacgtacattcacaacgtcaatgtaa

SEQ ID NO: 2515 - protein, 774 aa, Haemophilus somnus 2336
MAQLTETQQKAWEGFVGGDWQTEVNVRDFIQKNYTPYEGDEAFLAEATEATSILWADVMEKIKVENKTHEPYDIDTDIPSTITSHKAGYINKDLEKIVGLQTDAPLKRAIMPFGGINMVRGSCKVYRRELNPEVEKIFTEYRKTHNQGVFDVYTPDILRCRKSGVITGLPDAYGRGRIIGDYRRMALYGADFLMKDKFKQFTSLQEKLESGEDIQATIQLREEIAEQHRALGKMKEMAASYGYDISAPAKNAQEAVQWTYFAYLAAVKSQNGAAMSFGRVSTFLDIFIERDLKAGKITEQEAQELIDHLVMKLRMVRFLRTPEYDQLFSGDPMWATETLAGMGLDGRTLVTKTSFRILHTLYTMGPSPEPNLTILWSESLPDGFKRYAAKVSIDTSSVQYENDDLMRPDFQNDDYAIACCVSPMIVGKMMQFFGARANLAKTLLYAINGGIDEKSGDQVGPKTDPITTEYLDYEDVMTRLDSFMDWLAKQYVTALNIIHFMHDKYAYEAALMALHDRDVFRTMACGIAGLSVAADSLSAIKYAKVKPIRGDIEVKNKAGDVIGISKNVAIDFEIEGEYPQFGNNDSRVDDIAVDLVERFMKKIQKLKTYRNATPTQSVLTITSNVVYGKKTGNTPDGRRSGAPFGPGANPMHGRDQKGAVASLTSVAKLPFAYAKDGISYTFSIVPNALGKDIDAQKRNLAGLMDGYFHHETTIEGGQHLNVNVLNREMLLDAVENPDKYPQLTIRVSGYAVRFNSLTKDQQQDVITRTFTTSM

SEQ ID NO: 2516 - DNA, 2232 bp, Fusobacterium nucleatum subsp. vincentii ATCC 49256
  CDS (1)..(2232): transl_table=11
atggaagcttggagagattttaaagatggtgaatggcaaaaaagtattaatgtaagtaatttcatcaaaaacaattatacagaatatttaggtgatgaatcattcttggaaggtcctactgaaaatactaaaaaattatgggatattttaagtggaatgttaaaaatagaaagagaaaaaggtatctatgatgctgaaactaaaattccttctaaaattgatgcttatggagctgggtatattgataaaaatttagaaacaatagtaggtttacaaactgatgctcctctaaaaagagctatattcccaaatggtggattaagaatggttgaaaattctttagaagcttttggttataagttagatcctacaacaaaagaaatctatgaaaagtatagaaaaagtcataatgcaggagttttctcagcttatacacctgctataaaagctgctagacacacaggagttattactggacttcctgatgcttatggaagaggaagaattataggggattatagaagagttgctctttatggtgttgatagacttattgaagaaagaaaaagagaatttgatgcttatgatccagaagaaatgacagaagatgttattagagatagagaagaaatgtttgaacaattagaagcattaaaagcattaaaaagaatggctgctgcttatggttttgacattggaagacctgctgaaactgcacaagaagctatacaatggacttattttggttacttaggagctattaaagaccaaaatggtgctgcaatgagtttaggtaaaactgctggttttttagatgtatatatagaaagagatttaaaagaaggaagaatcactgaaaaacaagcacaagaatttatagaccatttcattatgaaacttagaattgtaagatttttaagaactcctgaatacgatcaattattctctggagatccagtatgggtaactgaatcaataggtggtatgaacaatgatggtaaatcttgggtaactaaaaatgcttttagatacttaaatactttatataatttaggaactgctcctgaacctaacttaacaattttatggagtgaaagattaccagaaaattggaaaaaattctgttctaaagtttcaatagatacatcttcattacaatatgaaaatgatgatattatgagacctcaatttggtgaagattatggaatagcttgttgtgtatctcctatggcaataggaaaacaaatgcaattctttggagcaagagctaatttacctaaggcattgctttatgctataaatggtggtaaagatgaaattaaaaaagaccaagttacacctcctggacaatttgaaaaaattactggtgattacttagattttgatgaagtttgggaaaaatatgataaaatgcttacttggcttgcttcaacttatataaaagcattaaatattatccactatatgcatgataaatattcttatgaagcattggaaatggctttacactcattagatattaagagaacagaagcttgtggtatagctggactttcaatagttgctgactcacttgctgctattaaatatggtaaagtaagagtaataagagatgaagctggagatgctgtcgattatgttgttgagcaaccttatgttccatttggaaataatgatgatagaacagatgaattagcagttaaagttgttagaacatttatgaataaaattagaagtcataaaatgtatagagatgctgaacctactcaatcagttcttacaataacttcaaatgttgtttatggtaagaaaacaggaaacactcctgatggaagaagagcaggagctccatttggaccaggagcaaaccctatgcacggaagagatactaagggagctgttgcttcattagcatcagttgctaagttaccatttgaagatgcaaatgatggaatttcttatacatttgctataactcctgaaacattaggaaaaacagaagatgaaaagaagaataacttagtgggacttcttgatggatactttaaacaaactggacaccatctaaatgtaaatgtatttggtagagaattattagaagatgctatggaacatcctgaaaattatccacaacttacaataagagtttctggatatgcagtaaactttattaaattaacaagagaacaacaattagatgttataaacagaactatcagtaacaaaatgtaa

SEQ ID NO: 2517 - protein, 743 aa, Fusobacterium nucleatum subsp. vincentii ATCC 49256
MEAWRDFKDGEWQKSINVSNFIKNNYTEYLGDESFLEGPTENTKKLWDILSGMLKIEREKGIYDAETKIPSKIDAYGAGYIDKNLETIVGLQTDAPLKRAIFPNGGLRMVENSLEAFGYKLDPTTKEIYEKYRKSHNAGVFSAYTPAIKAARHTGVITGLPDAYGRGRIIGDYRRVALYGVDRLIEERKREFDAYDPEEMTEDVIRDREEMFEQLEALKALKRMAAAYGFDIGRPAETAQEAIQWTYFGYLGAIKDQNGAAMSLGKTAGFLDVYIERDLKEGRITEKQAQEFIDHFIMKLRIVRFLRTPEYDQLFSGDPVWVTESIGGMNNDGKSWVTKNAFRYLNTLYNLGTAPEPNLTILWSERLPENWKKFCSKVSIDTSSLQYENDDIMRPQFGEDYGIACCVSPMAIGKQMQFFGARANLPKALLYAINGGKDEIKKDQVTPPGQFEKITGDYLDFDEVWEKYDKMLTWLASTYIKALNIIHYMHDKYSYEALEMALHSLDIKRTEACGIAGLSIVADSLAAIKYGKVRVIRDEAGDAVDYVVEQPYVPFGNNDDRTDELAVKVVRTFMNKIRSHKMYRDAEPTQSVLTITSNVVYGKKTGNTPDGRRAGAPFGPGANPMHGRDTKGAVASLASVAKLPFEDANDGISYTFAITPETLGKTEDEKKNNLVGLLDGYFKQTGHHLNVNVFGRELLEDAMEHPENYPQLTIRVSGYAVNFIKLTREQQLDVINRTISNKM

SEQ ID NO: 2518 - DNA, 2250 bp, Bacillus cereus G9241
  CDS (1)..(2250): transl_table=11
atgactcaagtattagaaaatgttaaaaacgcatgggaaaactttaaaggtgaaaaatggaaagcagagattgatgttcgcgatttcattttaaataatgtaaacgtttacgagggagatgaatctttcttagcgggagcaactgaagcaacgaaacaactttgggatcaagtaatggatttaacaacgaaagaacgtgaaaacggtggcgttcttgatatggatacaaaaattgtttcttctattacatcacatgaaccaggatatttaaataaagagactgaaaaagtagtcggtttccaaactgataaaccatttaaacgttctttacaaccatatggtggtattcgtatggcggaacaagcttgtgaatcttatggatacgaaatggataaagagcttagtcgtattttcagagattggagaaaaactcataaccaaggtgtatttgatgcttatacaccagaaatgagagctgctcgtaaatcaggtgttattactggtcttccagatgcatacggacgtggacgtattattggtgactaccgccgcgtagcattatatggagtagatcatttaattgaagcgaaaaaagcagatttaaatttaactggcggtgtaatgagtgaagatacaatgcgtttacgcgaagagttatctgagcaaatgcgtgcacttcaagagttaaaacaaatggctgcttctcatggctttgatatttctaagccagcaacaactgctcaagaagcattccaatggttatactttgcatatcttgcagcaattaaagagcaaaacggagctgcaatgagtcttggacgtacttctacattcttagatatttatattgaaagagatttagcaaatggtactttaacagaagaagacgtacaagaaattgtggatcacttcattatgaaattacgtcttgtgaaatttgcaagaacacctgattataatgaattattctctggtgacccaacttgggtaactgagtctatcggtggtatggcattagatggccgtccattagtaacaaagaactcattccgtttcttgcatacattagataatttaggaccagctccagaaccaaacttaacagttctttggtctaaacaattaccagagaactttaaaaactactgtgcgaaaatgtctattaaaacatcagcaattcaatacgaaaatgatgacattatgcgtgctgactacggcgatgactacggaattgcttgttgtgtatctgcaatgagaattggtaaacaaatgcagttcttcggtgcacgtgcaaacttagcaaaagcattattatatgcgattaacggtggtaaagatgaaaaatctaaagcgcaagttggtcctgagtacgcaccaattacttctgaagtattagattatgaagaagttatgcataagtttgatatgacaatggaatggttagcgggtctatatttaaacacattaaatgttattcactacatgcacgataaatatagctacgaacgtattgaaatggcacttcatgatacaaatgttcttcgtacaatggcaacaggtatcgcgggtctatctgtagtagcagactctttaagtgcaattaaacatgcaaaagtaaaaccaattcgcgatgaaaatggaattgcagttgactttgaaattgaaggagatttccctaaatacggtaacaatgatgaccgtgtagatgaaattgctgtagatcttgtgaaaacatttatgaataaacttcgtaaacataaaacatacagaaattctgttcatacaatgtcaattttaacaatcacatctaacgttgtatatggtaagaaaactggtaacactccagatggtcgccgtactggagaaccatttgcaccaggtgcgaacccaatgcatggacgtgatacaaaaggtgcgttagcttcattattatctgtagctaaattaccatatgaagatgcacaagatggtatttctaatacattctctattattccaaaagcacttggtaaagaagatgaagtacaagtacgtaacttagtatcaatgcttgatggttatgcagtaaaagaaggccatcacttaaatattaatgtatttaaccgtgaaacattaatggatgcaatggaacatcctgagaaatatccacaattaacaattcgcgtatctggttacgctgtaaactttattaaattaactcgtgaacaacaaatcgatgtaattaaccgtacaatgcatgaaagcatgtaa

SEQ ID NO: 2519 - protein, 749 aa, Bacillus cereus G9241
MTQVLENVKNAWENFKGEKWKAEIDVRDFILNNVNVYEGDESFLAGATEATKQLWDQVMDLTTKERENGGVLDMDTKIVSSITSHEPGYLNKETEKVVGFQTDKPFKRSLQPYGGIRMAEQACESYGYEMDKELSRIFRDWRKTHNQGVFDAYTPEMRAARKSGVITGLPDAYGRGRIIGDYRRVALYGVDHLIEAKKADLNLTGGVMSEDTMRLREELSEQMRALQELKQMAASHGFDISKPATTAQEAFQWLYFAYLAAIKEQNGAAMSLGRTSTFLDIYIERDLANGTLTEEDVQEIVDHFIMKLRLVKFARTPDYNELFSGDPTWVTESIGGMALDGRPLVTKNSFRFLHTLDNLGPAPEPNLTVLWSKQLPENFKNYCAKMSIKTSAIQYENDDIMRADYGDDYGIACCVSAMRIGKQMQFFGARANLAKALLYAINGGKDEKSKAQVGPEYAPITSEVLDYEEVMHKFDMTMEWLAGLYLNTLNVIHYMHDKYSYERIEMALHDTNVLRTMATGIAGLSVVADSLSAIKHAKVKPIRDENGIAVDFEIEGDFPKYGNNDDRVDEIAVDLVKTFMNKLRKHKTYRNSVHTMSILTITSNVVYGKKTGNTPDGRRTGEPFAPGANPMHGRDTKGALASLLSVAKLPYEDAQDGISNTFSIIPKALGKEDEVQVRNLVSMLDGYAVKEGHHLNINVFNRETLMDAMEHPEKYPQLTIRVSGYAVNFIKLTREQQIDVINRTMHESM

SEQ ID NO: 2520 - DNA, 2253 bp, Exiguobacterium sibiricum 255-15
  CDS (1)..(2253): transl_table=11
atgatgttacttgaaaaaacgccagcatggcaacaattcgaaacaggcgcgtggaacaatcagattgacgtggctgatttcattcgccgcaaccggacagagtaccggggagacgatcagtttctcgccggtcctaccgttgctacggaaacactgtggcaacaaatcatgaatttaacaagtgaagaacgtttacgcggcggggtctatgccgtcgatgcctcgacaccttcaacgattctgtcacacggtccggggtatctcaaccgcgagctcgaacaaatcgtcggtctgcaaaccgacgaaccgttcaaacggtcgattcacccgaacggcggcatccggatggtcaatgatgccttagaagcttatggttttcaagcggacccgctcgtcaccaaaacgttcagtgaataccggaaaacacataatcaaggtgtatttgatgcctatactcctgaaatgcgtgccgcccgtaaagccgggatcatcaccggtcttccggatgcatatggacgcgggcggatcatcggtgactaccgacgggttgccctgtacggtacctccttcctgattgcacagcgaaaacaggatttacaggaccgtggcggcttcttatcggaatcgatgattcgcgaccgcgaagagatgaacgaacaaatccgggcgctgcaggaactgaccgaactcggacaacggtatgactgtgatttatcccgtccggccgaaaccgcacaggaagcgttccagtgggtgtatctggcttatctcgctgccattaaagagcaaaacggcgccgcaatgtcactcggtcgcgtctcgacattccttgacatctacattgaacgggatttacagaccggtcgtttgacggaacaaacggcacaggaactcgtcgatcattttgtcatgaaactgcgcatcgtcaaattcctccggaccccggattataatgatctattctccggcgatccgacctgggtcacggaatcgatcggcggaatgagtgaagacggccgctccaacgtcaccaaaagttcgttccgcttcctgcagacactcgtcaatctcggtccggctcccgaaccgaatctgacggtgctttggtcgacaaaactgccgcgcggatttaaagaattctgtgccaagatgtcgattctctccagttcgattcagtacgagaacgatgatttgatgctgccggtttatggcgatgattacggcatcgcgtgttgtgtttccgccatgaaaatcgggaaacagatgcaatttttcggcgcacgggcgaacctcgcaaaagcattactctacacgttaaacggcggtatggatgaaaaactcaaaatacaggtcgctccaaagaccgacttgattctcgatgacgtcctggattatgagacggtcatggctgcttacgaccgccagctcgactggttggcggaactttatgtcaatacactgaatgttattcacttcatgcatgataaatacagttacgaacgtctcgaaatggcattacacgatccggaaatcttacggacgatggcttgcggtattgccggtctgtctgtcgtcgctgacagcctgtccgcgatccgttacgctaccgtctccccgatccgcgatgcggacggaattgcggttgattttaaaatcgagggcgacttcccgaaattcggcaataacgatgaacgagtcgatcagatggccgttgatctcgtcaaactgttcatggaaaaaatccggaaacatccgacgtatcgtgatgctttaccgactcaatctgtcctgacgattacttcgaacgtcgtctacggcaaaaaaaccggtaacacaccggacggacgacgggccggtgaaccgttcgcaccaggcgctaatccgatgcacgggcgcgatacgaaaggggctgtcgccgcgttgacatccgtcggcaaattaccatatgaacatgcactcgacggcatctcttatacgttctcgattgtcccgaaagccctcgggaaagacgaaccgacacgaatccgcaacactgtcggactgctcgacggctatatgggcggaactacttcaaaaggacatcacttaaacgtcaacgtctttgaccgggaaacgttgcttgacgcgatggaacatccggaactttatccccagttgaccatccgggtttccggttacgccgtcaacttcatcaaattgacccgcgaacaacaaatcgacgtcatcaaccggacattccacggtgcactttaa

SEQ ID NO: 2521 - protein, 750 aa, Exiguobacterium sibiricum 255-15
MMLLEKTPAWQQFETGAWNNQIDVADFIRRNRTEYRGDDQFLAGPTVATETLWQQIMNLTSEERLRGGVYAVDASTPSTILSHGPGYLNRELEQIVGLQTDEPFKRSIHPNGGIRMVNDALEAYGFQADPLVTKTFSEYRKTHNQGVFDAYTPEMRAARKAGIITGLPDAYGRGRIIGDYRRVALYGTSFLIAQRKQDLQDRGGFLSESMIRDREEMNEQIRALQELTELGQRYDCDLSRPAETAQEAFQWVYLAYLAAIKEQNGAAMSLGRVSTFLDIYIERDLQTGRLTEQTAQELVDHFVMKLRIVKFLRTPDYNDLFSGDPTWVTESIGGMSEDGRSNVTKSSFRFLQTLVNLGPAPEPNLTVLWSTKLPRGFKEFCAKMSILSSSIQYENDDLMLPVYGDDYGIACCVSAMKIGKQMQFFGARANLAKALLYTLNGGMDEKLKIQVAPKTDLILDDVLDYETVMAAYDRQLDWLAELYVNTLNVIHFMHDKYSYERLEMALHDPEILRTMACGIAGLSVVADSLSAIRYATVSPIRDADGIAVDFKIEGDFPKFGNNDERVDQMAVDLVKLFMEKIRKHPTYRDALPTQSVLTITSNVVYGKKTGNTPDGRRAGEPFAPGANPMHGRDTKGAVAALTSVGKLPYEHALDGISYTFSIVPKALGKDEPTRIRNTVGLLDGYMGGTTSKGHHLNVNVFDRETLLDAMEHPELYPQLTIRVSGYAVNFIKLTREQQIDVINRTFHGAL

SEQ ID NO: 2522 - DNA, 2346 bp, Streptococcus suis 89/1591
  CDS (1)..(2346): transl_table=11
atgtcaacaaaagttaaaacaaaaaatgttgctgaagacattttcgcccaagcctgggaaggctttaaaggtacagattggcaagataaggcaagtgtaacacgcttcgttcaagccaactacactccatacgatggagatgaaagcttcctcgcaggcccaactgagcgttcacttcatatcaaaaaaatcatcgaagaaacaaaagctggctacgaagacactcgcttcccaatggacgtagatcgtgctacttctatcgctgatattccagcaggtttcatcgataaagagaacgaactcatcttcggtatccaaaacgatgagctcttcaaactcaatttcatgccacgtggtggtattcgtatggctgaaacaactcttatcgaaaacggctatactccagacccactccttcatgaaatctatacaaaacacgctacaactgtaaatgacggtatcttccgtgcctacacagctgacatccgccgttctcgccactcacaccacgtttctggtcttccagatgcatactcacgtggtcgtatcatcggtatgtacgctcgtttggcactttacggtgcagactacttgatggaagaaaaagtagctgactggaatgcgattactgaaatcgacgaagaatcaatccgtcttcgcgaagaaatcaacatgcagtaccaagcattgcaacaagttgtacgcttaggtgatcactatggtgttgatgttcgcaaacctgcaatgaacactaaagaagctatccaatggacaaacattgctttcatggctgtatgtcgtgttatcaacggtgcagcaacttctcttggtcgtgtgccgatcgttcttgacatctatgcagagcgtgacttagctcgtggtacatttactgaatctgaaatccaagaatttgttgatgacttcgtattgaaacttcgtacagtgaaattcgctcgtacaaaagccttcgacgaaatctactctggtgacccaacattcttgacaacatctatggcaggtatgggtaacgatggtcgtcaccgtgttactaagatggactaccgtttcttgaacacacttgacaacatcggtaactctccagaaccaaacttgacagttctttggtcagaccaacttccatattcattccgtcgctactgtatggcaatgagccacaaacactcttctatccaatacgaaggtgtgacaacaatggcgaaagatggttatggcgaaatgtcatgtatctcttgctgtgtatctccacttgatccagaaagcgaagaccaacgccacaacattcagtacttcggtgctcgcgtaaacgtccttaaagctcttctttcaagctggaacaacggctacgacgatgttcacaaagattacaaagtgttcgatggtgttgaaccaaatacttctgaaatctttgactacgatcaagttattgccaactttgaaaaagcccttgactggttgactgacacttatgtagatgcaatgaacattatccactacatgactgacaagtacaactatgaagcagttcaaatggcattcttgccaactcaccttcgtgcaaacatgggcttcggtatctgtggcttcgcaaatactgttgactcattgtctgctatcaagtacgcacaagtgaaaccaatccgtgacgaagatggcttcatctacgattacgaagtaactggcgacttcccacgttatggtgaggatgacgaccgtgtagatgacatcgcgaaatggctcatggaagcattcttctctcgcttgaacaagcacaaattgtacaagaatgctgaagcaactgtgtctatcttgacaatcacttcaaacgttgcttactctaaacaaacagctaactcaccagttcaccgcggtgtattcctcaacgaagatggttctgttaacacttctaaagtggaattcttcccaccaggtgccaacccaacttctaaatctcgtggtggttggttgcaaaacttgaatactctttctaaactcaacttcaaacatgctaacgacggtatctcattgacaactcaagtttcaccaaaagctcttggtaaaacattcgatgagcaagtgaacaacttggtgacaatccttgacggatacttcgaacaaggtggtcaacacgtcaacttgaacgttatggacttgaacgacgtttatgacaagattatggcaggtgaagatgttatcgttcgtatctctggatactgcgtaaacactaaatacctcactaaagagcaaaaaactgaattgactcaacgtgtcttccacgaagttctttcaatggacgaccacgctgctgaagtttcaggtcaagcctaa

SEQ ID NO: 2523 - protein, 781 aa, Streptococcus suis 89/1591
MSTKVKTKNVAEDIFAQAWEGFKGTDWQDKASVTRFVQANYTPYDGDESFLAGPTERSLHIKKIIEETKAGYEDTRFPMDVDRATSIADIPAGFIDKENELIFGIQNDELFKLNFMPRGGIRMAETTLIENGYTPDPLLHEIYTKHATTVNDGIFRAYTADIRRSRHSHHVSGLPDAYSRGRIIGMYARLALYGADYLMEEKVADWNAITEIDEESIRLREEINMQYQALQQVVRLGDHYGVDVRKPAMNTKEAIQWTNIAFMAVCRVINGAATSLGRVPIVLDIYAERDLARGTFTESEIQEFVDDFVLKLRTVKFARTKAFDEIYSGDPTFLTTSMAGMGNDGRHRVTKMDYRFLNTLDNIGNSPEPNLTVLWSDQLPYSFRRYCMAMSHKHSSIQYEGVTTMAKDGYGEMSCISCCVSPLDPESEDQRHNIQYFGARVNVLKALLSSWNNGYDDVHKDYKVFDGVEPNTSEIFDYDQVIANFEKALDWLTDTYVDAMNIIHYMTDKYNYEAVQMAFLPTHLRANMGFGICGFANTVDSLSAIKYAQVKPIRDEDGFIYDYEVTGDFPRYGEDDDRVDDIAKWLMEAFFSRLNKHKLYKNAEATVSILTITSNVAYSKQTANSPVHRGVFLNEDGSVNTSKVEFFPPGANPTSKSRGGWLQNLNTLSKLNFKHANDGISLTTQVSPKALGKTFDEQVNNLVTILDGYFEQGGQHVNLNVMDLNDVYDKIMAGEDVIVRISGYCVNTKYLTKEQKTELTQRVFHEVLSMDDHAAEVSGQA

SEQ ID NO: 2524 - DNA, 2274 bp, Photobacterium sp. SKA34
  CDS (1)..(2274): transl_table=11
atggcagagcaattcactgcatgggaaagcttcacctctggtgattggcagaacgaagtaaacgttcgtgactttatccaaaagaactacactcctttcgagggtgacggctctttccttgaaacagaagcaactccagcaacagcgaaactatgggacgctgttatggaaggcatcaagcaggaaaacgcaactcacgcacctgttgatttcgatacagatgttgcctctactatcactgcacacgatgcaggttacattgaaaaagaacttgaaactattgttggtcttcaaactgacgcgcctcttaagcgtgctttgatccctaacggtggtattcgcatgattgaaaactcatgcaaagtgtacggtcgtgaattagatcctacattgaagaaggtttactctgaacttcgtaaaacacacaaccaaggtgttttcgatgtttacactccttcaattcttaagtgtcgtaagtctggtgttctaactggtcttccagatgcatacggtcgtggtcgtatcattggtgactaccgtcgcgtagcgctttacggtattgattacctaatgaaggataagcttgctcaatttgcttctctagaagaagacttcttgaatggcgaagatcttcagatgactatgcaacgtcgtgaagaaatttgtgagcagcaccgtgcacttgctcaaatcaaagagatggcagctaagtacggcttcgatatctctaacccagcaacaacagcacaagaagctatccagtggacttactttggctacctagctgcggttaaatcacaaaatggtgcagcaatgtctctaggtcgtacatcgactttcctagacatcttcatcgagcgtgatatcgctgctggtaagatcactgaagcacaagctcaggaaatgattgaccacttcgtaatgaagctacgtatggttcgtttcctacgtactcctgaatacgatgacctattctctggtgacccaatctgggcaacagaatcaatgggtggtatgggtctagacggacgtacactagttacacgtactaacttccgtttcctaaacagcctatacactatgggtccttctccagagccaaacatcactgttctttggtctgagcagcttcctgtaggcttcaaaaagttctgtgcgaaggtatctatcgatacatcttctatccagtacgaaaacgatgacctaatgcgtccagacatgaactctgacgactacgcaattgcttgttgtgtatcgccaatggttgttggtaagcaaatgcagttcttcggtgcacgtgcgaacctagctaagacgatgctttactctatcaatggtggtattgatgagaagctgaaaatccaagtaggtccagttggtgaaaaaatcactgacgaagttcttgattacgatacagtaatgagcaaacttgacccattcatggattggctagcaacaacttacgttgcggcactaaacgctattcactacagccatgataaatacagctatgagtcttcactaatggctcttcatgaccgtgacgttaagcgtacaatggcatgtggtatcgcaggtctatctgttgcagctgattcactatcagcgattaaatacgctacagttaaaccaattcgtgatgaagacggtgtagctatcgatttcgaaatcgaaggcgattaccctaaatttggtaacaacgatgcacgtgttgatgatatcgcatgtgaactagttgaaaccttcatgaacaaaatccgtactcacaagatgtaccgtgatgcgatccctactcagtctatcttaactatcacatctaacgttgtgtacggtaagaagacgggtaacactccagacggtcgtcgtgcaggtgctccttttgcaccaggtgctaacccaatgcacggtcgtgatgagaaaggtgctgtggcatctctaacatctgtaggtaaactaccatttgctcacgctaaagatggtatttcttacacattctctatcgtaccgaatgcactaggtaaagatcttgatactcaagagaacaacctagcaggccttatggatggttacttccaccatgagtcaggcattgaaggtggtcaacacctaaacgtgaacgttcttaaccgcgaaactcttgaagacgcagttaagcacccaaagaaatacccacagctaactatccgtgtatcgggttacgcagtgcgttttaactctctaactccagagcaacaagctgacgttatctctcgtactttcactgcttctctataa

SEQ ID NO: 2525 - protein, 757 aa, Photobacterium sp. SKA34
MAEQFTAWESFTSGDWQNEVNVRDFIQKNYTPFEGDGSFLETEATPATAKLWDAVMEGIKQENATHAPVDFDTDVASTITAHDAGYIEKELETIVGLQTDAPLKRALIPNGGIRMIENSCKVYGRELDPTLKKVYSELRKTHNQGVFDVYTPSILKCRKSGVLTGLPDAYGRGRIIGDYRRVALYGIDYLMKDKLAQFASLEEDFLNGEDLQMTMQRREEICEQHRALAQIKEMAAKYGFDISNPATTAQEAIQWTYFGYLAAVKSQNGAAMSLGRTSTFLDIFIERDIAAGKITEAQAQEMIDHFVMKLRMVRFLRTPEYDDLFSGDPIWATESMGGMGLDGRTLVTRTNFRFLNSLYTMGPSPEPNITVLWSEQLPVGFKKFCAKVSIDTSSIQYENDDLMRPDMNSDDYAIACCVSPMVVGKQMQFFGARANLAKTMLYSINGGIDEKLKIQVGPVGEKITDEVLDYDTVMSKLDPFMDWLATTYVAALNAIHYSHDKYSYESSLMALHDRDVKRTMACGIAGLSVAADSLSAIKYATVKPIRDEDGVAIDFEIEGDYPKFGNNDARVDDIACELVETFMNKIRTHKMYRDAIPTQSILTITSNVVYGKKTGNTPDGRRAGAPFAPGANPMHGRDEKGAVASLTSVGKLPFAHAKDGISYTFSIVPNALGKDLDTQENNLAGLMDGYFHHESGIEGGQHLNVNVLNRETLEDAVKHPKKYPQLTIRVSGYAVRFNSLTPEQQADVISRTFTASL

SEQ ID NO: 2526 - DNA, 2277 bp, Vibrio sp. Ex25
  CDS (1)..(2277): transl_table=11
atggcagagcaatttgctaaagcttgggaaggttttgctgcaggcgactggcaaaacgaagtaaacgttcgtgatttcattcagaagaactacactccgtacgaaggcgacgaatctttcctagtttctgaaggtactgaagcgactaacaagctttgggctaaggtaatggaaggcatcaaacaagagaacgcgactcacgctcctgttgattttgatacttcagttatctctaccatcactgctcacgatgcaggctacatcgaaaaagacctagaaactatcgtaggtcttcaaactgacgctcctctaaaacgtgcgatcatccctaacggtggtatccgtatggttgaaggttcatgcaaagcctacaaccgcgagcttgacccacaagttaagaaaatctacacagaataccgtaaaactcacaaccaaggcgttttcgacatctacactccacaaatcatggcgtgtcgtaagtctggcgtattgactggtcttcctgatgcatacggtcgtggtcgtatcatcggtgactaccgtcgtgttgctctatacggtattgatttcctaatgaaggataaattcgcacagttctcttctctacaagagcgtttcgagaacggcgaagacctacaaatgacaatgcagcttcgtgaagagatcgcagagcaacaccgtgctctaggtcaaatcaaagaaatggctgcaaaatacggttgtgacatttctcgtcctgctgaaactgcacaagaagctatccagtggacttacttcggttacctagctgctgttaaatctcaaaacggcgcagcaatgtctctaggccgtacttctacgttcctagacatcttcatcgagcgcgatatcgctgctggccgcatcacagaagaacaagctcaggaaatgatcgaccacttcgtaatgaaactacgtatggttcgtttcctacgtactcctgagtacgatgatctattctctggcgaccctatctgggcaactgagtctatgggtggtatgggtcttgacggtcgtacgctagttactcgtacaaacttccgtttcctaaactcactatacacaatgggtccttctccagagccaaacatcactgttctttggtctgagcaactacctgaaggcttcaagaagttctgtgcgaaagtgtctatcgatacttcttcaattcagtacgaaaacgacgacctaatgcgtccagacatgaactctgacgactacgcaatcgcatgttgtgtatctccaatggttgttggtaagcaaatgcagttctttggtgctcgtgctaaccttgcgaaaactatgctttacaccatcaacggtggtgtggatgagaagctaaaaatccaagttggtccacaaatgccgaagatcgaaggcgatgtactgaactacgatgagttgtgggagaaaatggaccacttcatggattggctagcgaagcagtacgtgactgcactaaacgctatccacttcatgcacgacaagtacagctacgaagcggcactaatggctctacatgaccgtgacgttaaacgtactatggcttgtggtattgctggtctatctgttgcggctgactctctgtctgcaatcaaatacgcaaaagttaagccaatccgtgacgaagacggtctagcaatcgacttcgaaatcgaaggtgattaccctaaatttggtaacaacgacccacgcgttgatgatatcgcatgtgaacttgtttctgtatttatgggcaaaatccgtaagcttaagacttaccgtgatgcaatccctactcagtcaattcttactatcacttcaaacgtggtttacggtaagaaaactggtaacacacctgacggtcgtcgtgctggtgctccatttgctccaggtgctaacccaatgcacggtcgcgatgagaaaggtgccgtagcatcactaacttcagttgcaaaactgccgtttgctgacgcacaagatggtatctcttacacattctctatcgtacctaatgcactaggtaaagatgagggttcacaacgcgctaacctagctggcctgatggatggttacttccaccacgaagcgggtatcgaaggtggtcaacacctaaacgtgaacgttcttaaccgcgaaactctagaagacgccgttaagcacccagagaaataccctcagctaacaatccgtgtatctggttacgctgttcgctttaactctctaactgcagagcaacaagctgacgtaatcgcacgtacattcacagagtctctataa

SEQ ID NO: 2527 - protein, 758 aa, Vibrio sp. Ex25
MAEQFAKAWEGFAAGDWQNEVNVRDFIQKNYTPYEGDESFLVSEGTEATNKLWAKVMEGIKQENATHAPVDFDTSVISTITAHDAGYIEKDLETIVGLQTDAPLKRAIIPNGGIRMVEGSCKAYNRELDPQVKKIYTEYRKTHNQGVFDIYTPQIMACRKSGVLTGLPDAYGRGRIIGDYRRVALYGIDFLMKDKFAQFSSLQERFENGEDLQMTMQLREEIAEQHRALGQIKEMAAKYGCDISRPAETAQEAIQWTYFGYLAAVKSQNGAAMSLGRTSTFLDIFIERDIAAGRITEEQAQEMIDHFVMKLRMVRFLRTPEYDDLFSGDPIWATESMGGMGLDGRTLVTRTNFRFLNSLYTMGPSPEPNITVLWSEQLPEGFKKFCAKVSIDTSSIQYENDDLMRPDMNSDDYAIACCVSPMVVGKQMQFFGARANLAKTMLYTINGGVDEKLKIQVGPQMPKIEGDVLNYDELWEKMDHFMDWLAKQYVTALNAIHFMHDKYSYEAALMALHDRDVKRTMACGIAGLSVAADSLSAIKYAKVKPIRDEDGLAIDFEIEGDYPKFGNNDPRVDDIACELVSVFMGKIRKLKTYRDAIPTQSILTITSNVVYGKKTGNTPDGRRAGAPFAPGANPMHGRDEKGAVASLTSVAKLPFADAQDGISYTFSIVPNALGKDEGSQRANLAGLMDGYFHHEAGIEGGQHLNVNVLNRETLEDAVKHPEKYPQLTIRVSGYAVRFNSLTAEQQADVIARTFTESL

SEQ ID NO: 2528 - DNA, 2295 bp, Escherichia coli B
  CDS (1)..(2295): transl_table=11
atgaaggtagatattgataccagcgataagctgtacgccgacgcatggcttggctttaaaggtacggactggaaaaacgaaattaatgtccgcgattttattcaacataactatacaccgtatgaaggcgatgaatctttcctcgccgaagcgacgcctgccaccacggaattgtgggaaaaagtaatggaaggcatccgtatcgaaaatgcaacccacgcgccggttgatttcgataccaatattgccaccacaattaccgctcatgatgcgggatatattaaccagccgctggaaaaaattgttggcctgcaaacggatgcgccgttgaaacgtgcgctacacccgttcggtggcattaatatgattaaaagttcattccacgcctatggccgagaaatggacagtgaatttgaatatctgtttaccgatctgcgtaaaacccataaccagggcgtatttgatgtttactcaccggatatgctgcgctgccgtaaatctggcgtactgaccggtttaccagatggttatggacgtgggcgcattatcggtgactatcgccgcgtagcgctgtatggcattcgttatctggtgcgtgaacgcgaactgcaatttgccgatctccagtctcgtctggaaaaaggcgaggatctggaagccaccatccgtctgcgtgaggagctggcagagcatcgtcatgcgctgttgcagattcaggaaatggcggcgaaatatggctttgatatctctcgcccggcgcagaatgcgcaggaagcggtgcagtggctctacttcgcttatctggcggcagtgaaatcacagaacggcggcgcgatgtcgctggggcgcacggcatcgttcctcgatatctacattgaacgcgactttaaagcaggcgtactcaatgagcagcaggcacaggaactgatcgatcacttcattatgaagatccgtatggtgcgcttcttgcgtacgccggaatttgattcgctgttctccggcgacccaatctgggcgacggaagtgatcggcgggatggggctggacggtcgtacgctggtgaccaaaaactccttccgctatttgcacaccctgcacactatggggccggcaccggagcctaacctgaccattctttggtcggaagaattaccgattgccttcaaaaaatatgccgcgcaggtgtcgatcgtcacctcttccttgcagtatgaaaatgacgatctgatgcgtactgacttcaacagcgacgattacgcgattgcctgctgcgtcagcccaatggtgattggtaagcaaatgcagttctttggtgcacgcgctaacctggcgaaaacgctgctctacgcaattaacggcggggtggacgagaagctgaagattcaggtcgggccgaaaacagcaccgctgatggacgacgtgctggattacgacaaagtgatggacagcctcgatcacttcatggactggctggcggtgcagtacatcagcgcactgaatatcattcactacatgcacgacaagtacagctacgaagcttcgctgatggcgctgcacgatcgtgatgtctatcgcactatggcatgcggcatcgcgggcctgtcggtggcgacggactccctgtctgccatcaaatatgcccgcgtgaaaccaatccgtgacgaaaacggcctggcggtggactttgaaatcgacggtgaatatccgcagtacggcaacaacgacgagcgcgtagacagcattgcctgcgacctggttgaacgctttatgaagaaaattaaagcgctgccaacctatcgcaacgccgtccctacccagtcgattctgactatcacttctaacgtggtgtacggccagaaaaccggtaatacgccggacggtcgtcgcgccggaacaccgttcgcgccgggcgctaacccgatgcatggtcgtgaccgcaaaggtgccgtggcctcattgacgtcggtggcgaaactgccgttcacctacgccaaagatgggatctcgtacaccttctcaatcgttcctgcggcgctgggcaaagaagatccagtacgtaaaaccaaccttgtcggcctgctggatgggtatttccaccacgaagcggatgtcgaaggcggtcaacacctcaacgtcaacgtaatgaatcgggaaatgctgctggatgccatcgagcacccggaaaaatatcctaacctgacaatccgtgtctctggctacgccgtgcgcttcaacgcactgacccgtgaacagcaacaggatgttatttcacgtacctttacccaggcgctctga

SEQ ID NO: 2529 - protein, 764 aa, Escherichia coli B
MKVDIDTSDKLYADAWLGFKGTDWKNEINVRDFIQHNYTPYEGDESFLAEATPATTELWEKVMEGIRIENATHAPVDFDTNIATTITAHDAGYINQPLEKIVGLQTDAPLKRALHPFGGINMIKSSFHAYGREMDSEFEYLFTDLRKTHNQGVFDVYSPDMLRCRKSGVLTGLPDGYGRGRIIGDYRRVALYGIRYLVRERELQFADLQSRLEKGEDLEATIRLREELAEHRHALLQIQEMAAKYGFDISRPAQNAQEAVQWLYFAYLAAVKSQNGGAMSLGRTASFLDIYIERDFKAGVLNEQQAQELIDHFIMKIRMVRFLRTPEFDSLFSGDPIWATEVIGGMGLDGRTLVTKNSFRYLHTLHTMGPAPEPNLTILWSEELPIAFKKYAAQVSIVTSSLQYENDDLMRTDFNSDDYAIACCVSPMVIGKQMQFFGARANLAKTLLYAINGGVDEKLKIQVGPKTAPLMDDVLDYDKVMDSLDHFMDWLAVQYISALNIIHYMHDKYSYEASLMALHDRDVYRTMACGIAGLSVATDSLSAIKYARVKPIRDENGLAVDFEIDGEYPQYGNNDERVDSIACDLVERFMKKIKALPTYRNAVPTQSILTITSNVVYGQKTGNTPDGRRAGTPFAPGANPMHGRDRKGAVASLTSVAKLPFTYAKDGISYTFSIVPAALGKEDPVRKTNLVGLLDGYFHHEADVEGGQHLNVNVMNREMLLDAIEHPEKYPNLTIRVSGYAVRFNALTREQQQDVISRTFTQAL

SEQ ID NO: 2530 - DNA, 4363 bp, Streptococcus bovis
  CDS (1707)..(4031): transl_table=11
  misc_feature (1126)..(1126): n is a, g, c or t
  misc_feature (1130)..(1130): n is a, g, c or t
  misc_feature (1131)..(1131): n is a, g, c or t
  misc_feature (1132)..(1132): n is a, g, c or t
aattcttgaaccttctaccaatgtttggatagtttatcattgcagttattgctcttgttgataaacatcattgtagcgtgcttttagcatacaatagacacttatcaaaaatcaaagacaatgctccaagtttatcaccttaccgcattgccttgatttatactgtggttaacaatcttggcaagctttgcctggagtgtatatcttaatattccactttcaccattcaatatcgttttgccacttgtctttttggggctttatgcttatgtgtacaacaaagcagcgcagctattagacaaagaagacgatgagactgattctgaaagtgttaatcaataacttttaagaaatcaaataccgtctcagaacttgagctaagacggtattttaatttttaaaagagatttaacggacgaatattatcttctaatcccgtgatagtaacccccagaagacgcacaccagattttgattcttctaagctgtcaaatatcgcatgagcagcttggtcaatcacctcaaaatcattggtgacatcatctagtgttttacgcttggttaaagtcgaaaaatccgcgtatcgaaccttcaaaacgacaatgcgaccaactttattatttcgcattaagctgtccacaactcgacgtgtattttttgaaatctctgacttaatatcagcatcctcgtacagtaatttactgtaggtacgttcactcccaatagattttcgaatacgattgggtctgacttgtgaatttgaaatacctcgcgctttacggtacaaatcataaccaaagcgcccgaaatgatcaatcaaggtcatctctggtatttctaataaatccgctcccgtaaaaacacccatttgatgtagtttttcaactgattttttaccaacaccatgaaatttttcaattggtaattttttcaaaaaatcctgcgcatcttctggcaatactaaggttaaacctttcggtttatcataatccgaagctagtttagctagaaattgtgttataagagacaccggctgaacaagtcaagtgaacttcttgccaaatatcatattgaatcattttagcgattttaatcgctgacttgatgccgcgtttattttcagtcncatnnnagtaagcctcatcaatcgacatgggctcaacaagatcggtgtaacgtctgaaaatctcacgaatttgcattccaatttctcggtatttctgataatttccagaaataaaaatagcctgtggacaacgttcgtaagcttcttttgaagacatggccgaatgaacgccaaattttctggcttcatagttacatgtcgatacgacgcctcgtccacctgtcttacgcggatcagagccgataatcacaggctttcctttgaggtctggattatccctttcttccactgatgcaaaaaaggcatccatatcaatgtgaataatttttcgagaagtgtcattaattaatggaaaaataagcatcatccagtcctttctgactctattataacaattttcattgctttcaagcaaaacttacaaatttctagtacagttgcccaaatttctgaaactgtactagaaaagattcttgttttttccaatttttttgcttgggaaaacgcttcctttgtgctaaacttatacttgtaaatgtaacagatgacttattactagaatttaaggagaaatctcattatggcgactgttaaaacaaatgcagatgtttttgaaaaagcctgggaaggctttaaaggtactgactggaaagaaaaagccagcgtttctcgcttcgttcaagctaactacacaccatatgatggtgatgaaagcttcttagcaccagctactgaacgctctcttaaaatcaagaaaatcattgaagacactaaagctgaatacgaagcaactcgtttcccaatggacactcgtccaacatcaatcgcagatattcctgccggctatattcaaaaagacgatgaattaatctacggtattcaaaatgatgagttgttcaaattgaatttcatgccaaaaggtggtatccgtatggcagaaacagcacttaaagaacatggttatgaaccagatcctgctgttcatgaaattttcacaaaatacactactacagtaaatgacggaattttccgcgcttatacatctaatatccgccgtgcccgtcacgctcacacagtaactggtcttccagatgcttactcacgcggacgtatcatcggtgtttatgctcgtcttgctctttatggtgcagactacttgatgcaagaaaaagttaacgactggaacgctatcacagaaatcgacgaagaatctattcgtcttcgcgaagaagttaacatgcaataccaagctcttggtgaagttgttaaacttggtgacctttacggacttgatgtccgtaaaccagccatgaacgttaaagaagctatccaatgggtaaacatcgccttcatggccgtatgtcgtgttatcaacggtgctgctacttctcttggacgtgtgccaatcgttcttgatatctttgctgaacgtgaccttgctcgtggtactttcacagaatcagaaatccaagaatttgtcgatgactttgtcttgaaacttcgtactgtaaaatttgctcgtactaaagcttacgacgaactttactctggtgacccaacattcatcactacatctatggctggtatgggtgctgacggtcgtcaccgtgttactaaaatggactaccgtttcttgcacacacttgataatatcggtaacgctccagaaccaaacttgacagttctttggactgataaattgccatattcattccgtcgctactgtatgaaaatgtcacacaaacactcgtcaatccaatacgaaggtgtgacaacaatggctaaagatggttacggtgaaatgtcatgtatctcatgttgtgtatcaccacttgacccagaaaacgaagaacaacgtcacaacatccaatactttggtgctcgtgtaaacgtccttaaagctcttcttactggtttgaacggtggttatgacgacgtccacaaagactacaaagtatttgatatcgaaccagttcgtgatgaaatccttgatttcgaaacggttaaagctaatttcgaaaaatctcttgattggttgacttcaacttacgtagatgcccttaacatcattcactacatgactgataaatacaactacgaagctgttcaaatggcattcttgccaactaaacaacgtgccaacatgggattcggtatctgtggtttcgctaataccgttgatactttatcagcaatcaaatacgctactgttaaaccaatccgtgacgaagatggttacatctacgactacgaaacaactggtgacttccctcgttggggtgaagatgaccctcgttctaacgaacttgctgaatggttggtagaagcttacactactcgtcttcgtagccacaaactttacaagaacgctgaagctactgtatcacttcttacaatcacttcaaacgttgcttattctaaacaaactggtaactctccagttcacaaaggtgtttaccttaacgaagatggtactgtaaacctttctaaacttgaattcttctcaccaggtgccaacccatctaacaaagctcgtggtggttggttgcaaaacttgaactctcttgcaagccttgacttctcatatgctgcagatggtatctcacttacaactcaagtttctccacgcgctcttggtaagacatttgatgaacaagttgataacttggtaactatccttgatggttacttcgaaaacggtggacaacacgttaacttgaacgtcatggaccttaaagatgtttatgacaagattatgaatggtgaagatgttatcgttcgtatatcaggttactgtgtcaacactaaataccttactaaagaacaaaagacagaattgacacaacgcgtcttccacgaagttctttcaatggatgatgttgctgaaactgttgctgctaaataataaatatcgaaaaagactttgtcagttgacagagtctttttttgtccttaaaatagagctatgaaaatcaaacaaaccagaaacacactttcagatacctacttggatgccatgaaaatccgtcaaatcgtttttgtaaaaggacaaggtgttcctttatctcttgaaattgatgaaaaaggtccttattgcctgcattttgttctttataatgacttaggaatgctgtcgctacttgccgtattttgccaaatcaagaccacagcaaagccaccttgcagcgtatggctgttcttcccgaccaacaaggaaagcattttggaaaacacctt

SEQ ID NO: 2531 - protein, 774 aa, Streptococcus bovis
MATVKTNADVFEKAWEGFKGTDWKEKASVSRFVQANYTPYDGDESFLAPATERSLKIKKIIEDTKAEYEATRFPMDTRPTSIADIPAGYIQKDDELIYGIQNDELFKLNFMPKGGIRMAETALKEHGYEPDPAVHEIFTKYTTTVNDGIFRAYTSNIRRARHAHTVTGLPDAYSRGRIIGVYARLALYGADYLMQEKVNDWNAITEIDEESIRLREEVNMQYQALGEVVKLGDLYGLDVRKPAMNVKEAIQWVNIAFMAVCRVINGAATSLGRVPIVLDIFAERDLARGTFTESEIQEFVDDFVLKLRTVKFARTKAYDELYSGDPTFITTSMAGMGADGRHRVTKMDYRFLHTLDNIGNAPEPNLTVLWTDKLPYSFRRYCMKMSHKHSSIQYEGVTTMAKDGYGEMSCISCCVSPLDPENEEQRHNIQYFGARVNVLKALLTGLNGGYDDVHKDYKVFDIEPVRDEILDFETVKANFEKSLDWLTSTYVDALNIIHYMTDKYNYEAVQMAFLPTKQRANMGFGICGFANTVDTLSAIKYATVKPIRDEDGYIYDYETTGDFPRWGEDDPRSNELAEWLVEAYTTRLRSHKLYKNAEATVSLLTITSNVAYSKQTGNSPVHKGVYLNEDGTVNLSKLEFFSPGANPSNKARGGWLQNLNSLASLDFSYAADGISLTTQVSPRALGKTFDEQVDNLVTILDGYFENGGQHVNLNVMDLKDVYDKIMNGEDVIVRISGYCVNTKYLTKEQKTELTQRVFHEVLSMDDVAETVAAK

SEQ ID NO: 2532 - DNA, 3379 bp, Chlamydomonas reinhardtii
  CDS (80)..(2638)
gttaaagcaaccaatacaacacagcacctactcgctacgcaagcactactgtcgtccctgcctctgagggacttgttctatgttaacacccttaagctatcctatcatcaacaccgtctcgtcaagtctgccagcgcttcacgccatgagccagatgctgctggagaagacaatgcgccggggcctcgccacggtctcggccgcagcgagctccgctgttggccggcccatccccatggctgttaggccgtctttgacgcttggaaacgttcgtggcatgcgcctgggtgttccggagctggccttcaggtcgccgatgcgctcgatggccgctgccagcgcggccgctgaggccctcccggtggcacccagccacagctgcgctgctgaccccgacaagcacccgcacctgcccgacccccgcccgaagccggccgtggacgcgggcatcaacgtccagaagtatgtgcaggacaactacaccgcttacgccggcaactcgtccttcctggctggccccactgacaacaccaagaagctgtggagcgagctggagaagatgattgccaccgagatcgagaagggcgtgatggacgtggatccctccaagccctccaccatcaccgccttcccgcccgggtacatcgacaaggacctggagacggtggtggggctgcagaccgacgcgccgctcaagcgcgccatcaagcccctgggcggcgtcaacatggtcaaggcggcgctggagtcgtacggctacacccccgaccccgaggtggcccgcctgtacagcacggtgcgcaagacgcacaacagcggcgtgtttgacgcctacacggacgagatgcgcgccgcgcgcaagagcggcatcctgtccggcctgcccgacggctacggccgcggccgcatcatcggcgactaccgccgcgtggcgctgtacggcgtggacgcgctgatcaaggccaagaagaccgacctgaagcacaacctgctgggcgtgatggacgaggagaagatccgcctgcgcgaggaggtgaacgagcagatccgcgcgctcagcgagctcaaggagatgggcgccgcctacggcttcgacctgagccgccccgccgccaactcgcgcgaggcggtgcagtggctgtacttcggctacctgggcgccgtcaaggagcaggacggcgccgccatgagcctgggccgcatcgacgccttcctggacacctactttgagcgcgacctcaaggccggcaccatcactgaggccgaggtgcaggagctgatcgaccacttcgtcatgaagctgcgcatcgtgcgccagctgcgcacccccgagtacaacgcgctgtttgccggcgaccccacctgggtcacctgcgtgctgggcggcactgacgccagcggcaaggccatggtcaccaagaccagcttccgcctgctcaacaccctgtacaacctgggccccgcgcccgagcccaacctgacggtgctgtggaacgacaacctgcccgcgcccttcaaggagttctgcgccaaggtgtcgctggacaccagctccatccagtacgagtccgacaacctcatgagcaagctgtttggctccgactactccatcgcctgctgcgtgtcggccatgcgcgtgggcaaggacatgcagtactttggcgcccgcgccaacctgcccaagctgctgctgtacacgctcaacggcggccgcgacgaggtgtcgggcgaccaggtggggcccaagttcgcgccggtgcgcagccccaccgcgccgttggactatgaggaggtcaaggccaagatcgaggacggcatggagtggctggcctccatgtacgcgaacaccatgaacatcatccactacatgcacgacaagtacgactacgagcggctgcagatggcgctgcacgacacgcacgtgcgccgcctgctggcgttcggcatcagcggcctgtccgtggtgaccgactcgctgtcggccatcgagtacgcccaggtgacgcccgtgattgacgagcgcggcctcatgacggacttcaaggtggagggcagcttccccaagtacggcaacgacgatgaccgcgtggacgagatcgccgagtgggtggtgtccaccttctccagcaagctggccaagcagcacacctaccgcaactcggtgcccacgctgtcggtgctgaccatcacctccaacgtggtgtacggcaagaaaacgggctccacccccgacggccgcaaaaagggcgagcccatcgcgcccggcgacaacccgctgcacggccgcgacgcccacggcgctctggcctcgctcaactcggtggccaagctgccctacaccatgtgcctggacggcatctccaacaccttctcgctcatcccccaggtgctgggcaggggcggcgagcacgagcgcgccaccaacctggcctccatcctggacggctactttgccaacggcggccaccacatcaacgtcaacgtgctcaaccgctccatgctcatggacgccgtggagcaccccgagaagtaccccaacctcaccatccgcgtgtccgggtacgctgtgcacttcgcgcgcctcacgcgcgagcagcagctggaggtgatcgcgcgcaccttccacgacaccatgtaaggaagtggcggccggggcgagagcaaggaggcgagccagtgacacggtctgctgtgctataatctgacggttggcgcagcgtgcgcaaggaatgggggcagcatccatgctaggccggagctgcaaggcgatggtctggccttgtctaagcttacgcattggcaagacgtagaaacatgcgtgggcggctttacattccaaggaacgaagcatcagaaggaaggccgcatggaggccacgtgcgagggttagtcggatattgccgtgcccggcccgtactgcgtcgttgtagcgggcggacttaaaacgggcgatacagcagttacatccgtgtgtgatgaaccaccgtaccatttatcattttagagtgtgtgcagagtgcaagcttatgaagaataatactgggtaggggcgttgtggttcaggggtgattgcgtggtacgcgcccaatcggcgctgtgtgattgagaggacgtgatcctgacacagggcatattgataagtcaatgacagcgaggcggcctggttagggtgccttctgccttggataagccctaactgtggttctttcgctgtgttagggttaggtgtgacttgcatggtgcattgagccgggtgagcgagcgtgtgcaaacttcgtacggccagtgagccagagatgcgtcgaggcgatgagctactcaagcaatcgtgtaactcgattctcgctaaaaaaaaaaaaaaaaaaaaaaaaaaaaaaaa

SEQ ID NO: 2533 - protein, 852 aa, Chlamydomonas reinhardtii
MLTPLSYPIINTVSSSLPALHAMSQMLLEKTMRRGLATVSAAASSAVGRPIPMAVRPSLTLGNVRGMRLGVPELAFRSPMRSMAAASAAAEALPVAPSHSCAADPDKHPHLPDPRPKPAVDAGINVQKYVQDNYTAYAGNSSFLAGPTDNTKKLWSELEKMIATEIEKGVMDVDPSKPSTITAFPPGYIDKDLETVVGLQTDAPLKRAIKPLGGVNMVKAALESYGYTPDPEVARLYSTVRKTHNSGVFDAYTDEMRAARKSGILSGLPDGYGRGRIIGDYRRVALYGVDALIKAKKTDLKHNLLGVMDEEKIRLREEVNEQIRALSELKEMGAAYGFDLSRPAANSREAVQWLYFGYLGAVKEQDGAAMSLGRIDAFLDTYFERDLKAGTITEAEVQELIDHFVMKLRIVRQLRTPEYNALFAGDPTWVTCVLGGTDASGKAMVTKTSFRLLNTLYNLGPAPEPNLTVLWNDNLPAPFKEFCAKVSLDTSSIQYESDNLMSKLFGSDYSIACCVSAMRVGKDMQYFGARANLPKLLLYTLNGGRDEVSGDQVGPKFAPVRSPTAPLDYEEVKAKIEDGMEWLASMYANTMNIIHYMHDKYDYERLQMALHDTHVRRLLAFGISGLSVVTDSLSAIEYAQVTPVIDERGLMTDFKVEGSFPKYGNDDDRVDEIAEWVVSTFSSKLAKQHTYRNSVPTLSVLTITSNVVYGKKTGSTPDGRKKGEPIAPGDNPLHGRDAHGALASLNSVAKLPYTMCLDGISNTFSLIPQVLGRGGEHERATNLASILDGYFANGGHHINVNVLNRSMLMDAVEHPEKYPNLTIRVSGYAVHFARLTREQQLEVIARTFHDTM

SEQ ID NO: 2534 - DNA, 2316 bp, Zymomonas mobilis
  CDS (1)..(2316): transl_table=11
atgaccatttccacccttgaaaaacctgacattgccgccggacaggcatcgaatgccgaaactcaacggatggactctgcccttgatccgtggcggggttttaaggggcgtaaatggcagcgagaaatcgacacgcgtgattttatcctgtcgaatgtcaccagctacaccggcaacagcgattttctggccggtatcacgcccaagacaaccaaactctgggaaaaattacaagtctctctcgaggccgaacggaaaacccaaggcggtgttctcgatgtagatacctccacggtttccaatatcacggcacatgcaccgggctttattgaaaaagaccttgaggtcgtcgttggtttacagaccgatgctccgctgaaacgggcaatcatgcctttcggcggctatcgcatggttaaaaaaggtctggaagcctatggcttcaaagaagatgaaagcctgtcaaagatttttccggctttacggaaaacccataatgacggtgtctttgatgtctatacgccggaaatcatggcttgccgccgctccggtattatcacgggtctgccggatgcttatggtcgtggccggattatcggtgactatcgtcgggtcgcgctttatggcgttgactgcctgattgaacataaaaaagagcagggcaagcgtctggaacgtaacccctttgatgaagaaaccatcaaattgcgggaagaagttgctgaacaaatcaaggcacttcatgaattggccgcaatggcaaaaagctatggctatgacatttcacagcctgcggtaacggcacagcaagcggttcaatggacatattttgcatatctggcagctgttaaagaagccaatggtgcggcaatgtctttgggtcgggtttcgaccttcctcgacatctatatcgaacgcgacttgaaagaaggccggattaccgaagccgaagcgcaagaactggttgaccagtttgtgatgaagctccgcattgtccgcttcctccgtactcctgaatatgaccagttattctctggtgatccgacatgggtcacggaatccttgggcggtatggctatagatggccggactttggtcacaaaatcgagcttccgcttcttgcatactctcgaaaatctggggcccgcaccagaaccgaatttgacggttctttggtcagaaaatctgcctaaaggcttcaaagattactgcgccaaaatttcgatcgatacctcgtcgatccaatatgaaaatgacgatctgatgcgctcttattggggcgatgattacggcattgcttgctgtgtctcggctatgcgcatcggtaaacagatgcagttcttcggggcgcgcgccaatctagcaaaaacgctgctttatgccatcaatggtggccgtgatgataaaagcggtgtgcaggttgcgcctgccttcgcgcctgtcacgggcgatattctggattacgaagacgtcaaaagccgcatggttcagatgatggaatggctgtccagcgtctatatcaatgctttgaatgccattcacttcatgcatgataaatatatgtatgaacgggtcgaaatggcgctccatgatctggaaatcttgcggacaatggcttgcggtatcgctggcctgtctgtcgccgcagacagcctgtccgccatgaaacatgccaaagttaaaatcatccgtgacgagcgtggtttagccaccgattttaagatcgaaggcgactatccggcttatggtaacaatgatgaccgcgccgatgaaattgcgatttggctggttgaaaccttcatgaatatgcttcggaagcagacgacttatcgccgttctgttccgacccagtctattctgacgatcacttccaatgtggtttacggtaaaaagaccggcaatacgcctgacggtcgtcgggctggtgaaccttttgcaccgggtgccaatccaatgcatggccgcgatttgaaaggccccgttgcctcgatggcgtcggttgccaaattgccttacgcccatgcacaggatggtatctccaataccttcaccattgtccccaatgctttgggtatgaacaaggaagaacggattgataatctgatcggcttgctttctggttatttcggggcaggggcgcatcatatgaatgtcaatgtgtttgaccggaatactttgctggatgccgtcgatcatcctgaaaaatatccgcaattaaccatccgtgtttctggttatgccgtcaatttcgtgaaattgacccgtgagcagcaaatggatgttatccaccggactttccatggccttgataattaa

SEQ ID NO: 2535 - protein, 771 aa, Zymomonas mobilis
MTISTLEKPDIAAGQASNAETQRMDSALDPWRGFKGRKWQREIDTRDFILSNVTSYTGNSDFLAGITPKTTKLWEKLQVSLEAERKTQGGVLDVDTSTVSNITAHAPGFIEKDLEVVVGLQTDAPLKRAIMPFGGYRMVKKGLEAYGFKEDESLSKIFPALRKTHNDGVFDVYTPEIMACRRSGIITGLPDAYGRGRIIGDYRRVALYGVDCLIEHKKEQGKRLERNPFDEETIKLREEVAEQIKALHELAAMAKSYGYDISQPAVTAQQAVQWTYFAYLAAVKEANGAAMSLGRVSTFLDIYIERDLKEGRITEAEAQELVDQFVMKLRIVRFLRTPEYDQLFSGDPTWVTESLGGMAIDGRTLVTKSSFRFLHTLENLGPAPEPNLTVLWSENLPKGFKDYCAKISIDTSSIQYENDDLMRSYWGDDYGIACCVSAMRIGKQMQFFGARANLAKTLLYAINGGRDDKSGVQVAPAFAPVTGDILDYEDVKSRMVQMMEWLSSVYINALNAIHFMHDKYMYERVEMALHDLEILRTMACGIAGLSVAADSLSAMKHAKVKIIRDERGLATDFKIEGDYPAYGNNDDRADEIAIWLVETFMNMLRKQTTYRRSVPTQSILTITSNVVYGKKTGNTPDGRRAGEPFAPGANPMHGRDLKGPVASMASVAKLPYAHAQDGISNTFTIVPNALGMNKEERIDNLIGLLSGYFGAGAHHMNVNVFDRNTLLDAVDHPEKYPQLTIRVSGYAVNFVKLTREQQMDVIHRTFHGLDN

SEQ ID NO: 2536 - DNA, 2430 bp, Aeromonas hydrophila
  CDS (118)..(2400): transl_table=11
aatgatcgcgctggatgccattcgtctggggcttaaggttcgtcaggccgagtgcgtctgacatcttccactgtagtgtcatgagtagtgaatgaggtttatttgatgaaagttgatatgcaattggatcaggataaattccgtcaggcatggcaagggtttgccggtgaaaactggaagcacgagatcaacgtccgtgattttatccagcagaactacaccccctatgaaggtgacgaacagtttttagcagatgccaccgaagcgaccaccactttatggaacaaggtgatggaggggatccgcatcgagaatgccacccacgcgcccgttgattttgataccaatattgccaccacaatcaccgcccacgggccgggttatatcgagcaggggctggaaaaaatcgttggcctgcaaaccgacaagccccttaaaagagcactgcatccatttggcggcgtaaatatgatccgcagctcttttgaagcatatggccgggagatggatcccgaatttgaatataccttcagcgaattgcgcaaaacccataaccagggagtgttcgacgtctactctcccgagatgttgcgctgccgaaaatcaggaattttgaccggtttgccggatggttacggccgtggtcgcattatcggagattatcgtcgggtcgcgctctatggcatagattatctaatccgtgagcgggagctgcagtttgccgatctgcaaccggcgcttgagcggggagagcagctggagcaggtgatccgccagcgcgaggagctggccgagcacaagcgggcactggtgcagatcaagcagatggcggccaactacggctttgacatctccgggccagcacgcacggcgcagcaggcggtgcagtggctctactttgcctatctggctgcggtgaagtcgcaaaatggcggggccatgtccctcggtcgtactgccaccttcctcgacatctatatcgagcgggatcttaaggcggggcttatcagcgagcaggatgcccaggagctggttgatcacttcatcatgaagatccgcatggtacgtttcctgcgtacccccgagtttgacaccctcttctccggcgaccccatttgggccaccgaggtgattggtggcatggggctggatggtcgcaccctggtgaccaagagctccttccgctacctccacaccctcaagaccatggggccggcgcccgagcccaacctcaccatcctctgggcggaaggactgccgcgggccttcaagacctatgcggcccgcgtctccatcgatacctcatccctgcagtatgagaacgatgacctgatgcgcaccgacttcgagagcgatgactacgccatcgcctgctgcgtgagccccatggtgatcggcaagcagatgcagttcttcggtgcccgcgccaacctggccaagaccctgctctattgcatcaacggtggcgtggacgagaagctgaagatccaggttggcccgaaagtggcgcccatcatggacgaggtgctggattacgagaccgtcatggccagcctcgacagctttatggattggctggcggtgcagtacatcagtgcgctcaaccttattcactacatgcacgacaagtacagctatgaggcttccctgatggcgctgcacgatcgcgacgtctatcgcaccatggcctgcggcattgccggtctgtcggtggcggtcgattcgctggcggccatcaagtacgctcgggtcaagccggtgcgcgatgctgacgggctggcggtcgattttgtgattgagggggagtatccccagtacggcaacaacgacgagcgggccgactccatcgcctgcgatctggtcgagcgcttcatgaagaagatccaggcgctgccgacctaccgcaatgcggtgccgacccagtcgatcctgaccatcacctccaacgtggtctatggccagaagaccggcaacaccccggatggccgccgcgccggtgccccgtttgcgccgggggccaacccgatgcacggtcgggatcgcaagggggcggtcgcttcgctcgcctcggtggccaagctgccgttcaaatatgccaaggacgggatctcctacaccttctccatcgtgccgggggcgctcggcaaggagccggccaatcgcgagaacaatctggtggggctgatggatggctacttccatcatgagcgggatgtagaagggggccagcacctcaacgtcaacgtgatgaaccgcgagatgctgctggatgccatcgagaatccggacaagtatcccagcctgaccatccgggtctccggctatgcggtgcgcttcaacgccctgacccgcgagcagcagcaggacgtcatctccagaaccttcaccaacatgatgtaactctgatgcccggggtgagcaggtttgctc

SEQ ID NO: 2537 - protein, 760 aa, Aeromonas hydrophila
MQLDQDKFRQAWQGFAGENWKHEINVRDFIQQNYTPYEGDEQFLADATEATTTLWNKVMEGIRIENATHAPVDFDTNIATTITAHGPGYIEQGLEKIVGLQTDKPLKRALHPFGGVNMIRSSFEAYGREMDPEFEYTFSELRKTHNQGVFDVYSPEMLRCRKSGILTGLPDGYGRGRIIGDYRRVALYGIDYLIRERELQFADLQPALERGEQLEQVIRQREELAEHKRALVQIKQMAANYGFDISGPARTAQQAVQWLYFAYLAAVKSQNGGAMSLGRTATFLDIYIERDLKAGLISEQDAQELVDHFIMKIRMVRFLRTPEFDTLFSGDPIWATEVIGGMGLDGRTLVTKSSFRYLHTLKTMGPAPEPNLTILWAEGLPRAFKTYAARVSIDTSSLQYENDDLMRTDFESDDYAIACCVSPMVIGKQMQFFGARANLAKTLLYCINGGVDEKLKIQVGPKVAPIMDEVLDYETVMASLDSFMDWLAVQYISALNLIHYMHDKYSYEASLMALHDRDVYRTMACGIAGLSVAVDSLAAIKYARVKPVRDADGLAVDFVIEGEYPQYGNNDERADSIACDLVERFMKKIQALPTYRNAVPTQSILTITSNVVYGQKTGNTPDGRRAGAPFAPGANPMHGRDRKGAVASLASVAKLPFKYAKDGISYTFSIVPGALGKEPANRENNLVGLMDGYFHHERDVEGGQHLNVNVMNREMLLDAIENPDKYPSLTIRVSGYAVRFNALTREQQQDVISRTFTNMM

SEQ ID NO: 2538 - DNA, 2247 bp, Staphylococcus epidermidis
  CDS (1)..(2247): transl_table=11
atgttagaaacaaataatcatactaatgcttggcaaggatttaaaacaggtcgttggaataaaaatatagacgtgagagaattcatacaattgaactattcattatatgaaggtgacgatgaatttttagaaggtcctacaaaagcaactgaaactttatgggatcaagtaatgcaattatcaaaagaagaacgtgagcgcggtggcatgtgggatatggatactaaagtggcatcgacaatcacttctcatgacgctggttacttagacaaagatttagaaaaagttgttggtgttcaaactgaaaaaccattcaaacgttctatgcaaccattcggtggtattcgtatggcaaaagcagcatgtgaagcgtatggttacgaattagatccagaaacagaaaaaatcttcactgaatatcgtaaaacacataaccaaggtgtattcgatgcatattcaagagaaatgttaaattgtcgtaaagctggtattattactggtttaccagatgcttacggacgtggacgtattatcggagactatcgtcgtgttgctttatacggtgtagacttcttaatggaacaaaaacttaaagactttaacacaatgtccactgaaatgtctgaagatgtgattcgtttacgtgaagaattatcagaacaatatcgctcacttcaagatttaaaagaattaggtcaaaaatatgggtttgatattagccgtcctgctactaacttcaaagaagctgtgcaatggttatacttagcatatttagctgctattaaagaacaaaatggtgcagcaatgagtttaggacgtacttcaacattcttagatatttatgctgaacgtgatttacaaaatggtgacatcactgaacaagaagttcaagaaatcattgaccacttcattatgaaattacgtatcgttaaattcgcacgtacgcctgaatataatgaattattctctggagatccaacttgggtaactgaatctattggtggtgtaggtattgacggccgtccgatggtaactaaaaactcattccgtttcttacactcattagataatttaggtccagcaccagaaccaaacttaacagtattatggtctacacgcttacctgaaaacttcaaaatctattgtgctaaaatgagtattaaaacgagctcaatccagtatgaaaatgatgacttaatgcgtgaaagctatggcgatgattatggtatcgcttgctgtgtatctgccatgaagattggtaaacaaatgcaattcttcggtgcacgtgctaacttagctaaagcattactttatgctatcaatggtggtaaagatgaaaaatctggcaaacaagttggaccaagttatgaaggtattaaatcagacgtactagattatgatgaagtcttcgaaagatatgaaaaaatgatggactggttagctggcgtatacatcaactcattaaatatcattcactatatgcatgataaatacagctatgaacgtcttgaaatggctttacatgatacagaaattattcgcacaatggcaactggtatcgctggattgtctgtggcagctgactctttatcagcgattaaatatgcacaagttaaacctatccgtaacgaagaaggtcttgtaactgactttgaaatcgaaggcgacttccctaaatatggtaataatgacagtcgtgttgatgaaattgcagtagatttagttgaacgtttcatgactaaattacgtagccataaaacataccgtaattctgaacacacaatgagtgtattaacaattacttcaaacgttgtttatggtaagaaaactggtaacacaccagatggacgtaaagctggcgaaccatttgcgcctggtgcaaacccaatgcatggtcgtgaccaaaaaggtgcattatcttcactaagttctgtagctaaaataccttacgattgctgtaaagatggtatctcaaatacatttagtatcgtaccgaaatcactaggtaaagaagaagtagatcaaaataaaaacttaactagtatgttagatggttatgcaatgcaacatggtcatcacctcaatattaacgtgtttaatagagaaacattaattgatgcaatggaacacccagaagagtatccacaattaacgattcgtgtatctggatacgctgtaaacttcattaaattaacacgtgaacaacaattagatgttatttcacgtacattccacgaatctatgtaa

SEQ ID NO: 2539 - protein, 748 aa, Staphylococcus epidermidis
MLETNNHTNAWQGFKTGRWNKNIDVREFIQLNYSLYEGDDEFLEGPTKATETLWDQVMQLSKEERERGGMWDMDTKVASTITSHDAGYLDKDLEKVVGVQTEKPFKRSMQPFGGIRMAKAACEAYGYELDPETEKIFTEYRKTHNQGVFDAYSREMLNCRKAGIITGLPDAYGRGRIIGDYRRVALYGVDFLMEQKLKDFNTMSTEMSEDVIRLREELSEQYRSLQDLKELGQKYGFDISRPATNFKEAVQWLYLAYLAAIKEQNGAAMSLGRTSTFLDIYAERDLQNGDITEQEVQEIIDHFIMKLRIVKFARTPEYNELFSGDPTWVTESIGGVGIDGRPMVTKNSFRFLHSLDNLGPAPEPNLTVLWSTRLPENFKIYCAKMSIKTSSIQYENDDLMRESYGDDYGIACCVSAMKIGKQMQFFGARANLAKALLYAINGGKDEKSGKQVGPSYEGIKSDVLDYDEVFERYEKMMDWLAGVYINSLNIIHYMHDKYSYERLEMALHDTEIIRTMATGIAGLSVAADSLSAIKYAQVKPIRNEEGLVTDFEIEGDFPKYGNNDSRVDEIAVDLVERFMTKLRSHKTYRNSEHTMSVLTITSNVVYGKKTGNTPDGRKAGEPFAPGANPMHGRDQKGALSSLSSVAKIPYDCCKDGISNTFSIVPKSLGKEEVDQNKNLTSMLDGYAMQHGHHLNINVFNRETLIDAMEHPEEYPQLTIRVSGYAVNFIKLTREQQLDVISRTFHESM

SEQ ID NO: 2540 - DNA, 2247 bp, Staphylococcus epidermidis
  CDS (1)..(2247): transl_table=11
atgttagaaacaaataatcatactaatgcttggcaaggatttaaaacaggtcgttggaataaaaatatagacgtgagagaattcatacaattgaactattcattatatgaaggtgacgatgaatttttagaaggtcctacaaaagcaactgaaactttatgggatcaagtaatgcaattatcaaaagaagaacgtgagcgcggtggcatgtgggatatggatactaaagtggcatcgacaatcacttctcatgacgctggttacttagacaaagatttagaaaaagttgttggtgttcaaactgaaaaaccattcaaacgttctatgcaaccattcggtggtattcgtatggcaaaagcagcatgtgaagcgtatggttacgaattagacccagaaacagaaaaaatcttcactgaatatcgtaaaacacataaccaaggtgtattcgatgcatattcaagagaaatgttaaattgtcgtaaagctggtattattactggtttaccagatgcttacggacgtggacgtattatcggagactatcgtcgtgttgctttatacggtgtagacttcttaatggaacaaaaacttaaagactttaacactatgtccactgaaatgtctgaagatgtgattcgtttacgtgaagaattaacagaacaatatcgctcacttcaagatttaaaagaattaggtcaaaaatatggatttgatattagccgtcctgctactaacttcaaagaagctgtgcaatggttatacttagcatatttagctgctattaaagaacaaaatggtgcagcaatgagtttaggacgtacttcaacattcttagatatttatgctgaacgtgatttacaaaatggtgacatcactgaacaagaagttcaagaaatcattgaccacttcattatgaaattacgtatcgttaaattcgcacgtacgcctgaatataatgaattattctctggagatccaacttgggtaactgaatctatcggtggtgtaggtattgacggccgtccgatggtaactaaaaactcattccgtttcttacactcattagataatttaggtccagcaccagaaccaaacttaacagtattatggtctacacgcttacctgaaaacttcaaaatctattgtgctaaaatgagtattaaaacgagctcaatccaatatgaaaatgatgacttaatgcgtgaaagctatggcgatgattatggtattgcttgctgtgtatctgctatgaagattggtaaacaaatgcaattcttcggtgcacgtgctaacttagctaaagcattactttacgctatcaatggtggtaaagatgaaaaatctggcaaacaagttggaccaagttatgaaggtattaaatcagacgtactagattatgatgaagttttcgaaagatatgaaaaaatgatggactggttagctggcgtatacatcaactcgttaaatatcattcactatatgcatgataaatacagctatgaacgtcttgaaatggctttacatgatacagaaattattcgcacaatggcaactggtatcgctggattgtctgtggcagctgactctttatcagcgattaaatatgcacaagttaaacctatccgtaacgaagaaggccttgtaactgactttgaaatcgaaggcgacttccctaaatatggtaataatgacagtcgtgttgatgaaattgcagtagatttagttgaacgtttcatgactaaattacgtagccataaaacataccgtaattctgaacacacaatgagtgtattaacaattacttcaaacgttgtttatggtaagaaaactggtaacacaccagatggacgtaaagctggcgaaccatttgcgcctggtgcaaacccaatgcatggtcgtgaccaaaaaggtgcattatcttcactaagttctgtagctaaaataccttatgattgctgtaaagatggtatctcaaatacatttagtatcgtaccgaaatcactaggtaaagaagaagcagatcaaaataaaaacttaactagtatgttagatggttatgcaatgcaacatggtcatcacctcaatattaacgtgtttaatagagaaacattaattgatgcaatggaacacccagaagagtatccacaattaacgattcgtgtatctggatacgctgtaaacttcattaaattaacacgtgaacaacaattagatgttatttcacgtacattccacgaatctatgtaa

SEQ ID NO: 2541 - protein, 748 aa, Staphylococcus epidermidis
MLETNNHTNAWQGFKTGRWNKNIDVREFIQLNYSLYEGDDEFLEGPTKATETLWDQVMQLSKEERERGGMWDMDTKVASTITSHDAGYLDKDLEKVVGVQTEKPFKRSMQPFGGIRMAKAACEAYGYELDPETEKIFTEYRKTHNQGVFDAYSREMLNCRKAGIITGLPDAYGRGRIIGDYRRVALYGVDFLMEQKLKDFNTMSTEMSEDVIRLREELTEQYRSLQDLKELGQKYGFDISRPATNFKEAVQWLYLAYLAAIKEQNGAAMSLGRTSTFLDIYAERDLQNGDITEQEVQEIIDHFIMKLRIVKFARTPEYNELFSGDPTWVTESIGGVGIDGRPMVTKNSFRFLHSLDNLGPAPEPNLTVLWSTRLPENFKIYCAKMSIKTSSIQYENDDLMRESYGDDYGIACCVSAMKIGKQMQFFGARANLAKALLYAINGGKDEKSGKQVGPSYEGIKSDVLDYDEVFERYEKMMDWLAGVYINSLNIIHYMHDKYSYERLEMALHDTEIIRTMATGIAGLSVAADSLSAIKYAQVKPIRNEEGLVTDFEIEGDFPKYGNNDSRVDEIAVDLVERFMTKLRSHKTYRNSEHTMSVLTITSNVVYGKKTGNTPDGRKAGEPFAPGANPMHGRDQKGALSSLSSVAKIPYDCCKDGISNTFSIVPKSLGKEEADQNKNLTSMLDGYAMQHGHHLNINVFNRETLIDAMEHPEEYPQLTIRVSGYAVNFIKLTREQQLDVISRTFHESM

SEQ ID NO: 2542 - DNA, 2328 bp, Streptococcus mutans
  CDS (1)..(2328): transl_table=11
atggcaactgtcaaaactaacactgacgtttttgaaaaagcctgggaaggctttaaaggaactgactggaaagacagagcaagcatttctcgctttgttcaagacaactacactccatatgacggagacgaaagttttcttgccggccctactgaacgttcacttcacatcaaaaaagtcgtagaagaaactaaagcgcattacgaagaaacacgttttccaatggatacacgtattacatctattgctgatatcccagcaggttatattgacaaggaaaatgaattgatttttggtatccaaaacgatgaactttttaagctgaacttcatgccaaaaggcggtattcgcatggctgaaacagctttgaaagaacatggttatgaaccagaccctgccgttcatgaaatctttaccaaatatgcaacaaccgttaatgatggtatctttcgtgcttacacttcaaacattcgccgtgcacgtcatgcccacactgtaactggtctcccagatgcatactctcgcggacgtattattggagtttatgcccgtcttgctctctatggtgctgactacttgatgcaagaaaaagtgaacgactggaactcaattgctgaaattgatgaagaatcaattcgtcttcgtgaagaaatcaatcttcaatatcaggcacttggcgaagtagtgcggttgggtgatctgtatggtcttgatgttcgcaaacctgctatgaatgttaaagaagctatccaatggattaatatcgcctttatggctgtctgccgcgttatcaatggtgctgcaacttctcttggacgtgtcccaatcgttcttgatatctttgcagaacgtgaccttgctcgtggcactttcactgaatcagaaatccaagaattcgttgatgacttcgttatgaaacttcgtacggttaaatttgcacgtactaaggcttatgacgaactttactcaggtgacccaacatttattacgacttctatggctggtatgggagctgatggacgtcaccgtgttactaagatggactaccgtttcttaaatacgcttgataatattggcaatgctccagaacctaacttaaccgttctttggtcaagtaaattgccttaccctttccgtcattattgtatgtctatgagccacaagcattcttcaattcaatatgaaggtgtcacaactatggctaaagaaggttatggtgaaatgtcatgtatctcatgctgtgtatctccgcttgatcctgaaaacgaagatcgtcgccacaatctacaatactttggtgctcgtgttaacgttcttaaagcacttcttacaggtcttaatggcggttacgacgatgttcacaaagactacaaagtatttgatgtcgaacctatccgtgatgaagtccttgattttgaaacggttaaagctaattttgaaaaagcacttgattggttgactgatacttacgtggacgcaatgaatatcattcactatatgactgataaatataactatgaagccgttcaaatggccttcttaccaacacgtgttaaagccaatatgggatttggtatttgcggattctctaatacagttgattcattatcagctattaaatatgctactgtaaaacctattcgtgatgaagatggttacatttacgactatgaaactgttggtaacttccctcgttacggagaagatgatgaccgtgtagactcaatcgctgaatggttgcttgaagctttccatactcgtcttgcacgtcataaactgtacaaagattccgaagctactgtatcattgcttacaatcacttctaatgttgcttattctaaacaaactggtaattctccagttcacaagggtgtttacctcaatgaagatggttctgtgaacttgtctaaagtagaattcttctcaccaggtgctaacccatcaaataaagcttccggcggctggttgcaaaacttgaactcattgaagaaacttgactttgctcacgcaaatgatggtatctcattgacaactcaagtttcaccaaaagctcttggtaagacattcgatgaacaagttgctaacttagtaacaattcttgatggttactttgaaggcggcggtcaacacgttaacttgaacgttatggatcttaaagatgtttatgataagatcatgaatggtgaagatgttatcgttcgtatctcaggttactgtgttaacactaaataccttactaaagaacaaaagactgaattgacacaacgtgttttccatgaagttctttcaatggatgatgcagctacagacttggttaacaacaaataa

SEQ ID NO: 2543 - protein, 775 aa, Streptococcus mutans
MATVKTNTDVFEKAWEGFKGTDWKDRASISRFVQDNYTPYDGDESFLAGPTERSLHIKKVVEETKAHYEETRFPMDTRITSIADIPAGYIDKENELIFGIQNDELFKLNFMPKGGIRMAETALKEHGYEPDPAVHEIFTKYATTVNDGIFRAYTSNIRRARHAHTVTGLPDAYSRGRIIGVYARLALYGADYLMQEKVNDWNSIAEIDEESIRLREEINLQYQALGEVVRLGDLYGLDVRKPAMNVKEAIQWINIAFMAVCRVINGAATSLGRVPIVLDIFAERDLARGTFTESEIQEFVDDFVMKLRTVKFARTKAYDELYSGDPTFITTSMAGMGADGRHRVTKMDYRFLNTLDNIGNAPEPNLTVLWSSKLPYPFRHYCMSMSHKHSSIQYEGVTTMAKEGYGEMSCISCCVSPLDPENEDRRHNLQYFGARVNVLKALLTGLNGGYDDVHKDYKVFDVEPIRDEVLDFETVKANFEKALDWLTDTYVDAMNIIHYMTDKYNYEAVQMAFLPTRVKANMGFGICGFSNTVDSLSAIKYATVKPIRDEDGYIYDYETVGNFPRYGEDDDRVDSIAEWLLEAFHTRLARHKLYKDSEATVSLLTITSNVAYSKQTGNSPVHKGVYLNEDGSVNLSKVEFFSPGANPSNKASGGWLQNLNSLKKLDFAHANDGISLTTQVSPKALGKTFDEQVANLVTILDGYFEGGGQHVNLNVMDLKDVYDKIMNGEDVIVRISGYCVNTKYLTKEQKTELTQRVFHEVLSMDDAATDLVNNK

SEQ ID NO: 2544 - DNA, 2295 bp, Escherichia coli
  CDS (1)..(2295): transl_table=11
atgaaggtagatattgataccagcgataagctgtacgccgacgcatggcttggctttaaaggtacggactggaaaaacgaaattaatgtccgcgattttattcaacataactatacaccgtatgaaggcgatgaatctttcctcgccgaagcgacgcctgccaccacggaattgtgggaaaaagtaatggaaggcatccgtatcgaaaatgcaacccacgcgccggttgatttcgataccaatattgccaccacaattaccgctcatgatgcgggatatattaaccagccgctggaaaaaattgttggcctgcaaacggatgcgccgttgaaacgtgcgctacacccgttcggtggcattaatatgattaaaagttcattccacgcctatggccgagaaatggacagtgaatttgaatatctgtttaccgatctgcgtaaaacccataaccagggcgtatttgatgtttactcaccggatatgctgcgctgccgtaaatctggcgtgctgaccggtttaccagatggctatggccgtgggcgcattatcggtgactatcgccgcgtagcgctgtatggcatcagttatctggtacgtgaacgcgaactgcaatttgccgatctccagtctcgtctggaaaaaggcgaggatctggaagccaccatccgtctgcgtgaggagctggcagagcatcgtcatgcgctgttgcagattcaggaaatggcggcgaaatatggctttgatatctctcgcccggcgcagaatgcgcaggaagcggtgcagtggctctacttcgcttatctggcggcagtgaaatcgcaaaatggcggcgcgatgtcgctgggccgcacggcatcgttcctcgatatctacattgagcgcgactttaaagctggcgtactcaatgagcagcaggcacaggaactgatcgatcacttcatcatgaagatccgtatggtacgcttcctgcgtacaccggaatttgattcgctgttctccggcgacccaatctgggcgacggaagtgatcggcgggatggggctggacggtcgtacgctggtgaccaaaaactccttccgctatttgcacaccctgcacactatggggccggcaccggaacctaacctgaccattctttggtcggaagaattaccgattgccttcaaaaaatatgccgcgcaggtgtcgatcgtcacctcttccttgcagtatgaaaatgacgatctgatgcgtactgacttcaacagcgacgattacgcgattgcctgctgcgtcagcccaatggtgattggtaagcaaatgcagttctttggtgcacgcgctaacctggcgaaaacgctgctttacgcaattaacggcggggtggacgagaagctgaagattcaggtcgggccgaaaacagcaccgctgatggacgacgtgctggattacgacaaagtgatggacagcctcgatcacttcatggactggctggcggtgcagtacatcagcgcgctgaatatcattcactacatgcacgacaagtacagctacgaagcttcgctgatggcgctgcacgatcgtgatgtctatcgcactatggcatgcggcatcgcgggcctgtcggtggcgacggactccctgtctgccatcaaatatgcccgcgtgaaaccaatccgtgacgaaaacggcctggcggtggactttgaaatcgacggtgaatatccgcagtacggcaacaacgacgagcgcgtagacagcattgcctgcgacctggttgaacgctttatgaagaaaattaaagcgctgccaacctatcgcaacgccgtccctacccagtcgattctgactatcacttctaacgtggtgtacggccagaaaaccggtaatacgccggacggtcgtcgcgccggaacaccgttcgcgccgggcgctaacccgatgcatggtcgtgaccgcaaaggtgccgtggcctcattgacgtcggtggcgaaactgccgttcacctacgccaaagatgggatctcgtacaccttctcaatcgttcctgcggcgctgggcaaagaagatccagtacgtaaaaccaaccttgtcggcctgctggatgggtatttccaccacgaagcggatgtcgaaggcggtcaacacctcaacgtcaacgtaatgaatcgggaaatgctgctggatgccatcgagcacccggaaaaatatcctaacctgacaatccgtgtctctggctacgccgtgcgcttcaacgcactgacccgtgaacagcaacaggatgttatttcacgtacttttacccaggcgctctga

SEQ ID NO: 2545 - protein, 764 aa, Escherichia coli
MKVDIDTSDKLYADAWLGFKGTDWKNEINVRDFIQHNYTPYEGDESFLAEATPATTELWEKVMEGIRIENATHAPVDFDTNIATTITAHDAGYINQPLEKIVGLQTDAPLKRALHPFGGINMIKSSFHAYGREMDSEFEYLFTDLRKTHNQGVFDVYSPDMLRCRKSGVLTGLPDGYGRGRIIGDYRRVALYGISYLVRERELQFADLQSRLEKGEDLEATIRLREELAEHRHALLQIQEMAAKYGFDISRPAQNAQEAVQWLYFAYLAAVKSQNGGAMSLGRTASFLDIYIERDFKAGVLNEQQAQELIDHFIMKIRMVRFLRTPEFDSLFSGDPIWATEVIGGMGLDGRTLVTKNSFRYLHTLHTMGPAPEPNLTILWSEELPIAFKKYAAQVSIVTSSLQYENDDLMRTDFNSDDYAIACCVSPMVIGKQMQFFGARANLAKTLLYAINGGVDEKLKIQVGPKTAPLMDDVLDYDKVMDSLDHFMDWLAVQYISALNIIHYMHDKYSYEASLMALHDRDVYRTMACGIAGLSVATDSLSAIKYARVKPIRDENGLAVDFEIDGEYPQYGNNDERVDSIACDLVERFMKKIKALPTYRNAVPTQSILTITSNVVYGQKTGNTPDGRRAGTPFAPGANPMHGRDRKGAVASLTSVAKLPFTYAKDGISYTFSIVPAALGKEDPVRKTNLVGLLDGYFHHEADVEGGQHLNVNVMNREMLLDAIEHPEKYPNLTIRVSGYAVRFNALTREQQQDVISRTFTQAL

SEQ ID NO: 2546 - DNA, 24 bp, Artificial sequence
  primer
atgtccgagcttaatgaaaagtta

SEQ ID NO: 2547 - DNA, 25 bp, Artificial sequence
  primer
ttacatagattgagtgaaggtacga

SEQ ID NO: 2548 - protein, 905 aa, Artificial sequence
  consensus sequence
  Variant (3)..(4): Xaa in position 3 to 4 is any amino acid
  Variant (6)..(9): Xaa in position 6 to 9 is any amino acid
  Variant (11)..(15): Xaa in position 11 to 15 is any amino acid
  Variant (16)..(98): Xaa in position 16 to 98 is any or no amino acid
  Variant (100)..(101): Xaa in position 100 to 101 is any amino acid
  Variant (104)..(105): Xaa in position 104 to 105 is any amino acid
  Variant (108)..(109): Xaa in position 108 to 109 is any amino acid
  Variant (111)..(111): Xaa in position 111 is any amino acid
  Variant (114)..(115): Xaa in position 114 to 115 is any amino acid
  Variant (118)..(120): Xaa in position 118 to 120 is any amino acid
  Variant (121)..(121): Xaa in position 121 is any or no amino acid
  Variant (123)..(124): Xaa in position 123 to 124 is any amino acid
  Variant (126)..(127): Xaa in position 126 to 127 is any amino acid
  Variant (130)..(137): Xaa in position 130 to 137 is any amino acid
  Variant (138)..(138): Xaa in position 138 is any or no amino acid
  Variant (140)..(145): Xaa in position 140 to 145 is any amino acid
  Variant (146)..(147): Xaa in position 146 to 147 is any or no amino acid
  Variant (149)..(149): Xaa in position 149 is any amino acid
  Variant (151)..(155): Xaa in position 151 to 155 is any amino acid
  Variant (156)..(156): Xaa in position 156 is any or no amino acid
  Variant (158)..(162): Xaa in position 158 to 162 is any amino acid
  Variant (165)..(169): Xaa in position 165 to 169 is any amino acid
  Variant (170)..(170): Xaa in position 170 is any or no amino acid
  Variant (172)..(173): Xaa in position 172 to 173 is any amino acid
  Variant (174)..(174): Xaa in position 174 is any or no amino acid
  Variant (177)..(177): Xaa in position 177 is any amino acid
  Variant (181)..(181): Xaa in position 181 is any amino acid
  Variant (183)..(183): Xaa in position 183 is any amino acid
  Variant (186)..(188): Xaa in position 186 to 188 is any amino acid
  Variant (190)..(190): Xaa in position 190 is any amino acid
  Variant (193)..(194): Xaa in position 193 to 194 is any amino acid
  Variant (196)..(203): Xaa in position 196 to 203 is any amino acid
  Variant (205)..(207): Xaa in position 205 to 207 is any amino acid
  Variant (209)..(218): Xaa in position 209 to 218 is any amino acid
  Variant (224)..(224): Xaa in position 224 is any amino acid
  Variant (229)..(229): Xaa in position 229 is any amino acid
  Variant (232)..(237): Xaa in position 232 to 237 is any amino acid
  Variant (239)..(243): Xaa in position 239 to 243 is any amino acid
  Variant (262)..(262): Xaa in position 262 is any amino acid
  Variant (267)..(267): Xaa in position 267 is any amino acid
  Variant (269)..(269): Xaa in position 269 is any amino acid
  Variant (271)..(273): Xaa in position 271 to 273 is any amino acid
  Variant (275)..(288): Xaa in position 275 to 288 is any amino acid
  Variant (289)..(295): Xaa in position 289 to 295 is any or no amino acid
  Variant (297)..(297): Xaa in position 297 is any amino acid
  Variant (302)..(303): Xaa in position 302 to 303 is any amino acid
  Variant (306)..(307): Xaa in position 306 to 307 is any amino acid
  Variant (310)..(318): Xaa in position 310 to 318 is any amino acid
  Variant (321)..(321): Xaa in position 321 is any amino acid
  Variant (323)..(325): Xaa in position 323 to 325 is any amino acid
  Variant (328)..(329): Xaa in position 328 to 329 is any amino acid
  Variant (331)..(331): Xaa in position 331 is any amino acid
  Variant (334)..(334): Xaa in position 334 is any amino acid
  Variant (337)..(337): Xaa in position 337 is any amino acid
  Variant (339)..(340): Xaa in position 339 to 340 is any amino acid
  Variant (345)..(345): Xaa in position 345 is any amino acid
  Variant (347)..(347): Xaa in position 347 is any amino acid
  Variant (355)..(355): Xaa in position 355 is any amino acid
  Variant (358)..(360): Xaa in position 358 to 360 is any amino acid
  Variant (366)..(366): Xaa in position 366 is any amino acid
  Variant (370)..(372): Xaa in position 370 to 372 is any amino acid
  Variant (374)..(375): Xaa in position 374 to 375 is any amino acid
  Variant (378)..(380): Xaa in position 378 to 380 is any amino acid
  Variant (383)..(384): Xaa in position 383 to 384 is any amino acid
  Variant (386)..(389): Xaa in position 386 to 389 is any amino acid
  Variant (393)..(393): Xaa in position 393 is any amino acid
  Variant (395)..(395): Xaa in position 395 is any amino acid
  Variant (397)..(397): Xaa in position 397 is any amino acid
  Variant (400)..(401): Xaa in position 400 to 401 is any amino acid
  Variant (403)..(404): Xaa in position 403 to 404 is any amino acid
  Variant (411)..(411): Xaa in position 411 is any amino acid
  Variant (413)..(413): Xaa in position 413 is any amino acid
  Variant (415)..(418): Xaa in position 415 to 418 is any amino acid
  Variant (421)..(422): Xaa in position 421 to 422 is any amino acid
  Variant (426)..(427): Xaa in position 426 to 427 is any amino acid
  Variant (431)..(432): Xaa in position 431 to 432 is any amino acid
  Variant (435)..(435): Xaa in position 435 is any amino acid
  Variant (437)..(437): Xaa in position 437 is any amino acid
  Variant (438)..(439): Xaa in position 438 to 439 is any or no amino acid
  Variant (442)..(444): Xaa in position 442 to 444 is any amino acid
  Variant (446)..(447): Xaa in position 446 to 447 is any amino acid
  Variant (452)..(452): Xaa in position 452 is any amino acid
  Variant (454)..(454): Xaa in position 454 is any amino acid
  Variant (458)..(459): Xaa in position 458 to 459 is any amino acid
  Variant (462)..(463): Xaa in position 462 to 463 is any amino acid
  Variant (466)..(471): Xaa in position 466 to 471 is any amino acid
  Variant (474)..(474): Xaa in position 474 is any amino acid
  Variant (477)..(478): Xaa in position 477 to 478 is any amino acid
  Variant (485)..(485): Xaa in position 485 is any amino acid
  Variant (488)..(491): Xaa in position 488 to 491 is any amino acid
  Variant (492)..(492): Xaa in position 492 is any or no amino acid
  Variant (496)..(496): Xaa in position 496 is any amino acid
  Variant (503)..(503): Xaa in position 503 is any amino acid
  Variant (505)..(506): Xaa in position 505 to 506 is any amino acid
  Variant (508)..(512): Xaa in position 508 to 512 is any amino acid
  Variant (513)..(515): Xaa in position 513 to 515 is any or no amino acid
  Variant (517)..(517): Xaa in position 517 is any amino acid
  Variant (525)..(525): Xaa in position 525 is any amino acid
  Variant (530)..(531): Xaa in position 530 to 531 is any amino acid
  Variant (534)..(534): Xaa in position 534 is any amino acid
  Variant (539)..(539): Xaa in position 539 is any amino acid
  Variant (542)..(545): Xaa in position 542 to 545 is any amino acid
  Variant (546)..(546): Xaa in position 546 is any or no amino acid
  Variant (549)..(552): Xaa in position 549 to 552 is any amino acid
  Variant (553)..(555): Xaa in position 553 to 555 is any or no amino acid
  Variant (557)..(561): Xaa in position 557 to 561 is any amino acid
  Variant (562)..(564): Xaa in position 562 to 564 is any or no amino acid
  Variant (566)..(569): Xaa in position 566 to 569 is any amino acid
  Variant (571)..(579): Xaa in position 571 to 579 is any amino acid
  Variant (583)..(584): Xaa in position 583 to 584 is any amino acid
  Variant (586)..(588): Xaa in position 586 to 588 is any amino acid
  Variant (591)..(591): Xaa in position 591 is any amino acid
  Variant (600)..(600): Xaa in position 600 is any amino acid
  Variant (603)..(605): Xaa in position 603 to 605 is any amino acid
  Variant (611)..(614): Xaa in position 611 to 614 is any amino acid
  Variant (616)..(616): Xaa in position 616 is any amino acid
  Variant (619)..(619): Xaa in position 619 is any amino acid
  Variant (626)..(628): Xaa in position 626 to 628 is any amino acid
  Variant (638)..(638): Xaa in position 638 is any amino acid
  Variant (640)..(642): Xaa in position 640 to 642 is any amino acid
  Variant (644)..(645): Xaa in position 644 to 645 is any amino acid
  Variant (646)..(663): Xaa in position 646 to 663 is any or no amino acid
  Variant (665)..(667): Xaa in position 665 to 667 is any amino acid
  Variant (669)..(672): Xaa in position 669 to 672 is any amino acid
  Variant (674)..(675): Xaa in position 674 to 675 is any amino acid
  Variant (677)..(678): Xaa in position 677 to 678 is any amino acid
  Variant (681)..(681): Xaa in position 681 is any amino acid
  Variant (683)..(683): Xaa in position 683 is any amino acid
  Variant (687)..(688): Xaa in position 687 to 688 is any amino acid
  Variant (690)..(695): Xaa in position 690 to 695 is any amino acid
  Variant (697)..(705): Xaa in position 697 to 705 is any amino acid
  Variant (706)..(706): Xaa in position 706 is any or no amino acid
  Variant (709)..(712): Xaa in position 709 to 712 is any amino acid
  Variant (714)..(714): Xaa in position 714 is any amino acid
  Variant (716)..(716): Xaa in position 716 is any amino acid
  Variant (724)..(724): Xaa in position 724 is any amino acid
  Variant (728)..(728): Xaa in position 728 is any amino acid
  Variant (737)..(738): Xaa in position 737 to 738 is any amino acid
  Variant (739)..(743): Xaa in position 739 to 743 is any or no amino acid
  Variant (745)..(745): Xaa in position 745 is any amino acid
  Variant (746)..(752): Xaa in position 746 to 752 is any or no amino acid
  Variant (755)..(755): Xaa in position 755 is any amino acid
  Variant (761)..(762): Xaa in position 761 to 762 is any amino acid
  Variant (764)..(768): Xaa in position 764 to 768 is any amino acid
  Variant (771)..(772): Xaa in position 771 to 772 is any amino acid
  Variant (774)..(775): Xaa in position 774 to 775 is any amino acid
  Variant (779)..(779): Xaa in position 779 is any amino acid
  Variant (782)..(782): Xaa in position 782 is any amino acid
  Variant (786)..(788): Xaa in position 786 to 788 is any amino acid
  Variant (789)..(789): Xaa in position 789 is any or no amino acid
  Variant (791)..(791): Xaa in position 791 is any amino acid
  Variant (796)..(796): Xaa in position 796 is any amino acid
  Variant (798)..(799): Xaa in position 798 to 799 is any amino acid
  Variant (801)..(801): Xaa in position 801 is any amino acid
  Variant (803)..(804): Xaa in position 803 to 804 is any amino acid
  Variant (807)..(814): Xaa in position 807 to 814 is any amino acid
  Variant (815)..(815): Xaa in position 815 is any or no amino acid
  Variant (818)..(821): Xaa in position 818 to 821 is any amino acid
  Variant (825)..(828): Xaa in position 825 to 828 is any amino acid
  Variant (829)..(851): Xaa in position 829 to 851 is any or no amino acid
  Variant (853)..(853): Xaa in position 853 is any amino acid
  Variant (855)..(855): Xaa in position 855 is any amino acid
  Variant (857)..(857): Xaa in position 857 is any amino acid
  Variant (860)..(864): Xaa in position 860 to 864 is any amino acid
  Variant (866)..(866): Xaa in position 866 is any amino acid
  Variant (869)..(871): Xaa in position 869 to 871 is any amino acid
  Variant (874)..(874): Xaa in position 874 is any amino acid
  Variant (877)..(877): Xaa in position 877 is any amino acid
  Variant (888)..(888): Xaa in position 888 is any amino acid
  Variant (890)..(891): Xaa in position 890 to 891 is any amino acid
  Variant (894)..(894): Xaa in position 894 is any amino acid
  Variant (898)..(899): Xaa in position 898 to 899 is any amino acid
  Variant (902)..(902): Xaa in position 902 is any amino acid
AWXXFXXXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXFIXXNYXXYXGDXXFLXXXXTXXTXXLWXXXXXXXXXEXXXXXXXXDXDXXXXXXIXXXXXGYXXXXXXEXXXVGXQTDXPXKRXXXPXGGXXMXXXXXXXXGXXXDXXXXXXXXXXRKTHNXGVFDXYTXXXXXXRXXXXXTGLPDAYGRGRIIGDYRRXALYGXDXLXXXKXXXXXXXXXXXXXXXXXXXXXIXLREEXXEQXXALXXXXXXXXXYGXDXXXPAXXAXEAXQWXYXXYLAAXKXQNGAAMSXGRXXXFLDIYXERDXXXGXXTEXXXQEXXDXXXXKLRXVXFXRTXXYXXLFSGDPXWXTXXXXGMXXDGRXXVTKXXFRXLXXXTLXXXGXXPEPNXTXLWSXXLPXXFKXXXXXXSIXTSXXQYENDDXMRXXXXXDDYXIACCVSXMXXGXXXXXXXXKXMQFFGARXNLAKXXLYXINGGXDEXXXXXQVXXXXXXXPXXXXXXXXLXXXXVXXXXXXXXXWLAXXYXXXLNXIHYMHDKYXYEXXXMALHDXXXXRXMAXGIAGLSXXXDSLSAIKYAXVXXXRXXXXXXXXXXXXXXXXXXXXGXXXDXXXXGXXPXXGNXDXRVDXXAXXXXXXFXXXXXXXXXXYRXXXXTXSXLTITSNVXYGKXTGNTPDGRXXXXXXXGXXXXXXXXPFXPGANPXXGXXXXXRDXXGXXASLXSVXKLPXXXXAXDGISXTXXIXPXXLGXXXXXXXXXNLXXXXDGYXXXXXXXXXXXXXXXXXXXXXXXXXXXGXHXNXNVXXXXXLXDAXXXPEXYPXLTIRVSGYAVXFXXLTXEQQXXVIXRTF

SEQ ID NO: 2549 - protein, 41 aa, Artificial sequence
  protein pattern
  Variant (2)..(3): Xaa in position 2 to 3 is any amino acid
  Variant (5)..(5): Xaa in position 5 is Asp, Glu or Asn
  Variant (6)..(6): Xaa in position 6 is any amino acid
  Variant (8)..(8): Xaa in position 8 is Phe or Tyr
  Variant (9)..(9): Xaa in position 9 is Ala or Ser
  Variant (10)..(10): Xaa in position 10 is Gly or Ser
  Variant (11)..(11): Xaa in position 11 is any amino acid
  Variant (13)..(13): Xaa in position 13 is any amino acid
  Variant (14)..(14): Xaa in position 14 is Phe or Trp
  Variant (15)..(15): Xaa in position 15 is Ala, Ile or Val
  Variant (17)..(17): Xaa in position 17 is any amino acid
  Variant (18)..(18): Xaa in position 18 is Cys, Gly, Ser, Thr or Val
  Variant (19)..(19): Xaa in position 19 is Ile, Leu, Met or Val
  Variant (20)..(20): Xaa in position 20 is Ala, Cys or Gly
  Variant (22)..(22): Xaa in position 22 is any amino acid
  Variant (23)..(23): Xaa in position 23 is Ala, Asp, Gly, Asn, Ser or Thr
  Variant (24)..(24): Xaa in position 24 is any amino acid
  Variant (25)..(25): Xaa in position 25 is Asp, Glu, Asn or Ser
  Variant (27)..(29): Xaa in position 27 to 29 is any amino acid
  Variant (32)..(32): Xaa in position 32 is Lys or Arg
  Variant (33)..(33): Xaa in position 33 is any amino acid
  Variant (34)..(34): Xaa in position 34 is Ala, Asp, Asn, Ser or Thr
  Variant (35)..(35): Xaa in position 35 is Phe or Tyr
  Variant (37)..(37): Xaa in position 37 is any amino acid
  Variant (39)..(39): Xaa in position 39 is any amino acid
  Variant (40)..(40): Xaa in position 40 is Cys, Ser or Thr
TXXYXXLXXXXPXXXTXXXXGXXXXGXXXVTXXXXRXLXXL

SEQ ID NO: 2550 - protein, 40 aa, Artificial sequence
  protein pattern
  Variant (3)..(3): Xaa in position 3 is Ala, Asp, Glu, Gln or Ser
  Variant (5)..(5): Xaa in position 5 is Ile or Val
  Variant (6)..(6): Xaa in position 6 is Phe or Tyr
  Variant (7)..(7): Xaa in position 7 is Asp, Gly or Ser
  Variant (8)..(8): Xaa in position 8 is Ala, Ile or Val
  Variant (10)..(10): Xaa in position 10 is Ser or Thr
  Variant (11)..(11): Xaa in position 11 is any amino acid
  Variant (12)..(12): Xaa in position 12 is Ala, Asp, Glu, Gln or Ser
  Variant (13)..(15): Xaa in position 13 to 15 is any amino acid
  Variant (16)..(16): Xaa in position 16 is Ala or Cys
  Variant (17)..(17): Xaa in position 17 is Lys or Arg
  Variant (18)..(18): Xaa in position 18 is any amino acid
  Variant (19)..(19): Xaa in position 19 is Ala, Asn, Ser, Thr or Val
  Variant (20)..(20): Xaa in position 20 is any amino acid
  Variant (21)..(21): Xaa in position 21 is Ile, Leu or Val
  Variant (22)..(22): Xaa in position 22 is Ile or Leu
  Variant (28)..(28): Xaa in position 28 is Ala or Gly
  Variant (38)..(38): Xaa in position 38 is Phe or Tyr
HNXGXXXXYXXXXXXXXXXXXXTGLPDXYGRGRIIGDXRR

SEQ ID NO: 2551 - protein, 39 aa, Artificial sequence
  protein pattern
  Variant (2)..(3): Xaa in position 2 to 3 is any or no amino acid
  Variant (8)..(8): Xaa in position 8 is Ile, Leu or Met
  Variant (10)..(10): Xaa in position 10 is Ile or Val
  Variant (14)..(15): Xaa in position 14 to 15 is any amino acid
  Variant (18)..(19): Xaa in position 18 to 19 is any amino acid
  Variant (21)..(21): Xaa in position 21 is Lys or Arg
  Variant (22)..(22): Xaa in position 22 is any amino acid
  Variant (23)..(23): Xaa in position 23 is Phe or Tyr
  Variant (24)..(24): Xaa in position 24 is Ala or Cys
  Variant (25)..(27): Xaa in position 25 to 27 is any amino acid
  Variant (29)..(31): Xaa in position 29 to 31 is any amino acid
  Variant (32)..(32): Xaa in position 32 is Cys, Asp or Ser
  Variant (33)..(33): Xaa in position 33 is Ala, Ser or Thr
  Variant (34)..(34): Xaa in position 34 is Ile, Leu or Val
  Variant (38)..(38): Xaa in position 38 is Gly, Asn or Ser
  Variant (39)..(39): Xaa in position 39 is Asp or Val
GXXPEPNXTXLWSXXLPXXFXXXXXXXSXXXXXXQYEXX

SEQ ID NO: 2552 - protein, 30 aa, Artificial sequence
  protein pattern
  Variant (2)..(2): Xaa in position 2 is Lys or Arg
  Variant (3)..(3): Xaa in position 3 is Asp, Gly, Asn, Gln or Ser
  Variant (4)..(4): Xaa in position 4 is Ala or Ser
  Variant (5)..(6): Xaa in position 5 to 6 is any amino acid
  Variant (8)..(8): Xaa in position 8 is any amino acid
  Variant (10)..(10): Xaa in position 10 is Ile, Leu, Met or Val
  Variant (18)..(18): Xaa in position 18 is Met or Val
  Variant (21)..(21): Xaa in position 21 is any or no amino acid
  Variant (23)..(23): Xaa in position 23 is any or no amino acid
  Variant (26)..(26): Xaa in position 26 is Ala, Asn, Ser or Thr
YXXXXXTXSXLTITSNVXYGXKXTGXTPDG

SEQ ID NO: 2553 - protein, 29 aa, Artificial sequence
  protein pattern
  Variant (2)..(2): Xaa in position 2 is Ala or Gly
  Variant (3)..(3): Xaa in position 3 is any amino acid
  Variant (5)..(5): Xaa in position 5 is Ile or Met
  Variant (6)..(6): Xaa in position 6 is Ala or Cys
  Variant (8)..(8): Xaa in position 8 is Phe or Leu
  Variant (9)..(9): Xaa in position 9 is Ala or Ser
  Variant (10)..(10): Xaa in position 10 is any amino acid
  Variant (11)..(11): Xaa in position 11 is Ala, Cys, Thr or Val
  Variant (12)..(12): Xaa in position 12 is Ala, Thr or Val
  Variant (16)..(16): Xaa in position 16 is Ala or Ser
  Variant (18)..(18): Xaa in position 18 is Ile, Met or Val
  Variant (19)..(19): Xaa in position 19 is Lys or Arg
  Variant (20)..(20): Xaa in position 20 is Phe, His or Tyr
  Variant (22)..(22): Xaa in position 22 is any amino acid
  Variant (24)..(25): Xaa in position 24 to 25 is any amino acid
  Variant (26)..(26): Xaa in position 26 is Ile or Val
  Variant (28)..(28): Xaa in position 28 is Asp, Glu, Gly or Asn
  Variant (29)..(29): Xaa in position 29 is Ala, Asp, Glu or Asn
MXXGXXGXXXXXDSLXAXXXAXVXXXRXX

SEQ ID NO: 2554 - protein, 60 aa, Artificial sequence
  protein pattern
  Variant (3)..(3): Xaa in position 3 is any amino acid
  Variant (5)..(5): Xaa in position 5 is Phe, Leu or Met
  Variant (6)..(6): Xaa in position 6 is Ala or Gly
  Variant (9)..(9): Xaa in position 9 is Ala or Gly
  Variant (11)..(11): Xaa in position 11 is Ile or Val
  Variant (12)..(12): Xaa in position 12 is Lys or Arg
  Variant (13)..(13): Xaa in position 13 is Asp, Glu, Ser or Thr
  Variant (14)..(14): Xaa in position 14 is Ala or Gln
  Variant (15)..(15): Xaa in position 15 is Asp or Asn
  Variant (17)..(17): Xaa in position 17 is Ala or Gly
  Variant (21)..(21): Xaa in position 21 is Phe, Ile, Leu or Val
  Variant (23)..(24): Xaa in position 23 to 24 is any amino acid
  Variant (25)..(25): Xaa in position 25 is Ala, Asp or Ser
  Variant (26)..(26): Xaa in position 26 is Ala, Gly, Ser or Thr
  Variant (27)..(27): Xaa in position 27 is any amino acid
  Variant (28)..(28): Xaa in position 28 is Ile, Leu or Met
  Variant (30)..(30): Xaa in position 30 is any amino acid
  Variant (31)..(31): Xaa in position 31 is Phe or Tyr
  Variant (32)..(32): Xaa in position 32 is any amino acid
  Variant (33)..(33): Xaa in position 33 is Asp, Glu or Gln
  Variant (34)..(34): Xaa in position 34 is any amino acid
  Variant (35)..(35): Xaa in position 35 is Asp or Glu
  Variant (36)..(36): Xaa in position 36 is Phe, Ile, Leu or Met
  Variant (37)..(38): Xaa in position 37 to 38 is any amino acid
  Variant (40)..(40): Xaa in position 40 is any amino acid
  Variant (41)..(41): Xaa in position 41 is Ala, Ile, Leu or Val
  Variant (42)..(42): Xaa in position 42 is Asp, Asn, Ser or Thr
  Variant (44)..(45): Xaa in position 44 to 45 is any amino acid
  Variant (46)..(46): Xaa in position 46 is Ala, Ile, Leu or Val
  Variant (49)..(49): Xaa in position 49 is any amino acid
  Variant (50)..(50): Xaa in position 50 is Ile, Met or Val
  Variant (52)..(52): Xaa in position 52 is any amino acid
  Variant (53)..(53): Xaa in position 53 is Phe or Leu
  Variant (54)..(54): Xaa in position 54 is Ile or Val
  Variant (55)..(55): Xaa in position 55 is Ile or Met
  Variant (57)..(57): Xaa in position 57 is Ile or Leu
  Variant (59)..(59): Xaa in position 59 is any amino acid
QWXYXXYLXAXXXXXGXAMSXGXXXXXXDXXXXXXXXXGXXXEXXXQEXXDXXXXKXRXV

SEQ ID NO: 2555 - protein, 24 aa, Artificial sequence
  protein pattern
  Variant (8)..(8): Xaa in position 8 is any amino acid
  Variant (10)..(11): Xaa in position 10 to 11 is any amino acid
  Variant (14)..(14): Xaa in position 14 is any amino acid
  Variant (15)..(15): Xaa in position 15 is Asp, Glu or Asn
  Variant (18)..(18): Xaa in position 18 is any amino acid
  Variant (19)..(19): Xaa in position 19 is Asp or Glu
  Variant (22)..(22): Xaa in position 22 is any amino acid
RVSGYAVXFXXLTXXQQXXVIXRT

SEQ ID NO: 2556 - protein, 28 aa, Artificial sequence
  protein pattern
  Variant (3)..(3): Xaa in position 3 is Ala or Gly
  Variant (6)..(6): Xaa in position 6 is Ala, Cys, Thr or Val
  Variant (8)..(8): Xaa in position 8 is any amino acid
  Variant (9)..(9): Xaa in position 9 is Ala or Pro
  Variant (11)..(11): Xaa in position 11 is Ala, Cys, Ser or Thr
  Variant (12)..(12): Xaa in position 12 is Leu, Met or Val
  Variant (15)..(15): Xaa in position 15 is Ala, Cys, Ser, Thr or Val
  Variant (16)..(16): Xaa in position 16 is Ile or Leu
  Variant (20)..(20): Xaa in position 20 is any amino acid
  Variant (22)..(22): Xaa in position 22 is Asp or Glu
  Variant (23)..(27): Xaa in position 23 to 27 is any amino acid
  Variant (28)..(28): Xaa in position 28 is Ile or Val
FFXARXNXXKXXLYXXNGGXDXXXXXXX

SEQ ID NO: 2557 - protein, 45 aa, Artificial sequence
  protein pattern
  Variant (2)..(15): Xaa in position 2 to 15 is any amino acid
  Variant (16)..(16): Xaa in position 16 is any or no amino acid
  Variant (19)..(19): Xaa in position 19 is Ala, Ser or Thr
  Variant (20)..(21): Xaa in position 20 to 21 is any amino acid
  Variant (23)..(24): Xaa in position 23 to 24 is any amino acid
  Variant (25)..(25): Xaa in position 25 is Ala, Ser or Thr
  Variant (26)..(26): Xaa in position 26 is Leu or Met
  Variant (28)..(28): Xaa in position 28 is any amino acid
  Variant (31)..(31): Xaa in position 31 is Phe or Tyr
  Variant (33)..(33): Xaa in position 33 is any amino acid
  Variant (37)..(37): Xaa in position 37 is any amino acid
  Variant (40)..(42): Xaa in position 40 to 42 is any amino acid
  Variant (45)..(45): Xaa in position 45 is Phe or Leu
LXXXXXXXXXXXXXXXWLXXXYXXXXNXIHXMXDKYXYEXXXMAX

SEQ ID NO: 2558 - protein, 15 aa, Artificial sequence
  protein pattern
  Variant (2)..(2): Xaa in position 2 is any amino acid
  Variant (3)..(3): Xaa in position 3 is Ala, Gly or Ser
  Variant (10)..(10): Xaa in position 10 is Ala or Pro
  Variant (12)..(12): Xaa in position 12 is any amino acid
  Variant (13)..(13): Xaa in position 13 is Ile or Val
DXXIACCVSXMXXGK

SEQ ID NO: 2559 - protein, 21 aa, Artificial sequence
  protein pattern
  Variant (3)..(3): Xaa in position 3 is Phe, Leu or Val
  Variant (6)..(6): Xaa in position 6 is Asp or Glu
  Variant (7)..(7): Xaa in position 7 is any amino acid
  Variant (9)..(9): Xaa in position 9 is any amino acid
  Variant (12)..(12): Xaa in position 12 is any amino acid
  Variant (13)..(13): Xaa in position 13 is Phe, Ile, Leu, Met or Val
  Variant (14)..(14): Xaa in position 14 is any amino acid
  Variant (16)..(16): Xaa in position 16 is any amino acid
  Variant (19)..(20): Xaa in position 19 to 20 is any amino acid
  Variant (21)..(21): Xaa in position 21 is Met or Val
VGXQTXXPXKRXXXPXGGXXX

SEQ ID NO: 2560 - protein, 19 aa, Artificial sequence
  protein pattern
  Variant (2)..(2): Xaa in position 2 is any amino acid
  Variant (7)..(7): Xaa in position 7 is any amino acid
  Variant (9)..(9): Xaa in position 9 is any amino acid
  Variant (10)..(10): Xaa in position 10 is Ala, Gly, Gln, Ser or Thr
  Variant (11)..(11): Xaa in position 11 is Ala, Ile or Val
  Variant (12)..(12): Xaa in position 12 is any amino acid
  Variant (14)..(14): Xaa in position 14 is any amino acid
  Variant (15)..(15): Xaa in position 15 is Ala, Gly, Ser or Thr
  Variant (18)..(18): Xaa in position 18 is any amino acid
  Variant (19)..(19): Xaa in position 19 is Asp, Glu, Asn or Thr
AXDGISXTXXXXPXXLGXX

SEQ ID NO: 2561 - protein, 23 aa, Artificial sequence
  protein pattern
  Variant (2)..(2): Xaa in position 2 is Ile or Val
  Variant (3)..(4): Xaa in position 3 to 4 is any amino acid
  Variant (6)..(8): Xaa in position 6 to 8 is any amino acid
  Variant (10)..(10): Xaa in position 10 is any amino acid
  Variant (13)..(13): Xaa in position 13 is Ala, Asp, Glu or Gly
  Variant (14)..(14): Xaa in position 14 is Ala, Glu, Gln, Ser or Thr
  Variant (17)..(18): Xaa in position 17 to 18 is any amino acid
  Variant (19)..(19): Xaa in position 19 is Ala, Pro or Ser
  Variant (21)..(22): Xaa in position 21 to 22 is any amino acid
  Variant (23)..(23): Xaa in position 23 is Ser or Thr
FXXXNXXXYXGDXXFLXXXTXXX

SEQ ID NO: 2562 - protein, 38 aa, Artificial sequence
  protein pattern
  Variant (2)..(3): Xaa in position 2 to 3 is any or no amino acid
  Variant (6)..(7): Xaa in position 6 to 7 is any amino acid
  Variant (9)..(11): Xaa in position 9 to 11 is any amino acid
  Variant (12)..(12): Xaa in position 12 is Ala or Ser
  Variant (14)..(15): Xaa in position 14 to 15 is any amino acid
  Variant (16)..(16): Xaa in position 16 is Ile, Leu or Met
  Variant (17)..(18): Xaa in position 17 to 18 is any amino acid
  Variant (19)..(19): Xaa in position 19 is Leu or Met
  Variant (20)..(20): Xaa in position 20 is Ala or Gly
  Variant (21)..(22): Xaa in position 21 to 22 is any amino acid
  Variant (23)..(23): Xaa in position 23 is His or Tyr
  Variant (25)..(25): Xaa in position 25 is any amino acid
  Variant (26)..(26): Xaa in position 26 is Asp or Gly
  Variant (27)..(27): Xaa in position 27 is Ile, Leu or Val
  Variant (28)..(28): Xaa in position 28 is Gly or Ser
  Variant (29)..(29): Xaa in position 29 is any amino acid
  Variant (32)..(32): Xaa in position 32 is any amino acid
  Variant (33)..(33): Xaa in position 33 is Asp, Asn or Thr
  Variant (34)..(35): Xaa in position 34 to 35 is any amino acid
  Variant (36)..(36): Xaa in position 36 is Glu or Gln
  Variant (38)..(38): Xaa in position 38 is Phe, Ile or Val
RXXEEXXEXXXXLXXXXXXXXXXGXXXXXPAXXXXXAX

SEQ ID NO: 2563 - protein, 35 aa, Artificial sequence
  protein pattern
  Variant (2)..(2): Xaa in position 2 is any amino acid
  Variant (3)..(4): Xaa in position 3 to 4 is any or no amino acid
  Variant (6)..(7): Xaa in position 6 to 7 is any or no amino acid
  Variant (9)..(9): Xaa in position 9 is Asp or Glu
  Variant (10)..(10): Xaa in position 10 is Phe or Tyr
  Variant (12)..(12): Xaa in position 12 is any amino acid
  Variant (13)..(13): Xaa in position 13 is Phe or Tyr
  Variant (15)..(15): Xaa in position 15 is Glu or Asn
  Variant (16)..(16): Xaa in position 16 is Asp or Asn
  Variant (18)..(18): Xaa in position 18 is any amino acid
  Variant (20)..(20): Xaa in position 20 is Ala or Val
  Variant (22)..(22): Xaa in position 22 is Ala, Asp, Glu or Ser
  Variant (23)..(23): Xaa in position 23 is Ile, Leu or Met
  Variant (25)..(26): Xaa in position 25 to 26 is any amino acid
  Variant (27)..(27): Xaa in position 27 is Ile, Leu or Val
  Variant (28)..(30): Xaa in position 28 to 30 is any amino acid
  Variant (32)..(34): Xaa in position 32 to 34 is any amino acid
  Variant (35)..(35): Xaa in position 35 is Ile, Leu or Val
DXXXEXXGXXPXXGXXDXRXDXXAXXXXXXFXXXX

SEQ ID NO: 2564 - DNA, 768 bp, Escherichia coli
  CDS (1)..(768): transl_table=11
atgagcgaactgatcgtcagccgtcagcaacgagtattgttgctgacccttaaccgtcccgccgcacgtaatgcgctaaataatgccctgctgatgcaactggtaaatgaactggaagctgcggctaccgataccagcatttcggtctgtgtgattaccggtaatgcacgcttttttgccgctggggccgatctcaacgaaatggcagaaaaagatctcgcggccaccttaaacgatacacgtccgcagctatgggcgcgattgcaggcctttaataaaccacttatcgcagccgtcaatggttacgcgcttggggcgggttgcgaactggcattgttgtgcgatgtggtggttgccggagagaacgcgcgttttgggttgccggaaatcactctcggcatcatgcctggcgcaggcggaacgcaacgtttaatccgtagtgtcggtaaatcgttagccagcaaaatggtgctgagcggagaaagtatcaccgctcagcaagcacagcaggccgggctggttagcgacgtcttccccagcgatttaaccctcgaatacgccttacagctggcatcgaaaatggcacgtcactcgccgctggccttacaagcggcaaagcaagcgctgcgccagtcgcaggaagtggctttgcaagccggacttgcccaggagcgacagttattcaccttgctggcggcaacagaagatcgtcatgaaggcatctccgctttcttacaaaaacgcacgcccgactttaaaggacgctaa

SEQ ID NO: 2565 - protein, 255 aa, Escherichia coli
MSELIVSRQQRVLLLTLNRPAARNALNNALLMQLVNELEAAATDTSISVCVITGNARFFAAGADLNEMAEKDLAATLNDTRPQLWARLQAFNKPLIAAVNGYALGAGCELALLCDVVVAGENARFGLPEITLGIMPGAGGTQRLIRSVGKSLASKMVLSGESITAQQAQQAGLVSDVFPSDLTLEYALQLASKMARHSPLALQAAKQALRQSQEVALQAGLAQERQLFTLLAATEDRHEGISAFLQKRTPDFKGR

SEQ ID NO: 2566 - DNA, 777 bp, Chloroflexus aurantiacus
  CDS (1)..(777): transl_table=11
atgagtgaagagtctctggttctcagcacaattgaaggccccatcgccatcctcaccctcaatcgcccccaggccctcaatgcgctcagtccggccttgattgatgacctcattcgccatttagaagcctgcgatgccgatgacacaatccgcgtgatcattatcaccggcgccggacgggcatttgctgccggcgctgatatcaaagcgatggccaatgccacgcctattgatatgctcaccagtggcatgattgcgcgctgggcacgcatcgccgcggtgcgcaaaccggtgattgctgccgtgaatgggtatgcgctcggtggtggttgtgaattggcaatgatgtgcgacatcatcatcgccagtgaaaacgcgcagttcggacaaccggaaatcaatctgggcatcattcccggtgctggtggcacccaacggctgacccgcgcccttggcccgtatcgcgcaatggaattgatcctgaccggcgcgaccatcagtgctcaggaagctctcgcccacggcctggtgtgccgggtctgcccgcctgaaagcctgctcgatgaagcccgtcggatcgcgcaaaccattgccaccaaatcaccactggctgtacagttggcgaaagaggcagtccgtatggccgccgaaaccactgtgcgcgaggggttggctatcgagctgcgtaacttctatctgctgtttgccagtgctgaccaaaaagaggggatgcaggcatttatcgagaaacgcgctcccaacttcagtggtcgttga

SEQ ID NO: 2567 - protein, 258 aa, Chloroflexus aurantiacus
MSEESLVLSTIEGPIAILTLNRPQALNALSPALIDDLIRHLEACDADDTIRVIIITGAGRAFAAGADIKAMANATPIDMLTSGMIARWARIAAVRKPVIAAVNGYALGGGCELAMMCDIIIASENAQFGQPEINLGIIPGAGGTQRLTRALGPYRAMELILTGATISAQEALAHGLVCRVCPPESLLDEARRIAQTIATKSPLAVQLAKEAVRMAAETTVREGLAIELRNFYLLFASADQKEGMQAFIEKRAPNFSGR

SEQ ID NO: 2568 - DNA, 771 bp, Archaeoglobus fulgidus DSM 4304
  CDS (1)..(771): transl_table=11
atgggagagagagtcaagcttgagcttgatggtgaaattgctgttgcaaccctcaacagaccagagaagctaaacgctcttgacaccaaaacgaggatggagctggctgaggttattgagggcatcgaggaagtggcaagagttttaatcattaccggcagcggcaaggcctttgctgccggcgctgacatcaacgagcttcttcagagggatgcaattaaggcttttgaggcaacaaagctcggaacggatctcttttcgagaattgaggagcttgagattccggtgattgccgcagttaacggatacaccctcggtgggggttgtgagctggcgatggcgtgcgacataagaattgccagtgaaaaggcaaagttcgggcagccagagataaacctcgccataattcccggagcgggagggacgcagaggctgccgaggctcgtggggctggggatggcgaaaaagcttgttcttacgggggagataatcgatgctcagactgctttaagaatagggctggttgaggaggttgtggagcacgaaaggctgatggagagggcaaaggaggttgccgctaaaataatcgagaaatcgcctctcgctgtaaaggtggcgaagaaagctttgaacgcatcaatcaacatgcccctgaaggaggggctgaggtatgaggcaagcctcttcgccctgctcttctccagcgaggatgctaaggaggggatgagggcgtttctggagaagaggaagcctgagtttaggggaaggtga

SEQ ID NO: 2569 - protein, 256 aa, Archaeoglobus fulgidus DSM 4304
MGERVKLELDGEIAVATLNRPEKLNALDTKTRMELAEVIEGIEEVARVLIITGSGKAFAAGADINELLQRDAIKAFEATKLGTDLFSRIEELEIPVIAAVNGYTLGGGCELAMACDIRIASEKAKFGQPEINLAIIPGAGGTQRLPRLVGLGMAKKLVLTGEIIDAQTALRIGLVEEVVEHERLMERAKEVAAKIIEKSPLAVKVAKKALNASINMPLKEGLRYEASLFALLFSSEDAKEGMRAFLEKRKPEFRGR

SEQ ID NO: 2570 - DNA, 2007 bp, Archaeoglobus fulgidus DSM 4304
  CDS (1)..(2007): transl_table=11
gtgccacggagagtgaagcaggtgattaatatggatgtaagggagagaataaaaaccgttgcagttctcggtgccgggctgatgggacacggaattgctgaagtctgcgcgatggcgggctacaacgtgacaatgagggacatcaagcaggagtttgttgacagaggaatgaacatgataaaggagagccttgcgaagctcgagcagaagggcaaaataaagagcgccgaagaagtcctttccagaataaagccaacagtagatctggaggaggctgttaaggatgccgacttggttatagaggcagttccagaagtggttgaaatcaagaagcaggtctgggaggaggttgacaagctggcaaagccggactgcatcttcacctccaacacctcaacaatgagaataaccatgctcgcagacttcacctcaaggccggagaagtttgcaggcctgcacttcttcaacccgccagtcttgatgaggctggttgaggttataaggggagagaagaccagcgacgaggtaatggatttgcttgttgagttcgtgaagagcattggtaagacgcctgtgagagtggagaaggacgtgccagggttcatagtcaacagagtgcaggctcccgcgagcgttctgctgatggccatcctcgagaagggcatagcgacacctgaggaagttgacgccaccgtaagaaggctcggacttccgatggggcccttcgagcttgttgactacacgggagttgacatcctctacaacgccctgaagtactacgcccagacaataagccccgactacgagccgccaaagttcctggaggagatggtgaaagcgaacaagctcggaagaaagaccggacagggattctacgactggagcaagggcagaccgcaaatcgactcgagcaaggcaacagacaaaatcaacccgatggacttcacctttgtcgaaatcaatgaagccgtaaagctcgtcgaaatgggtgttgccacaccccaggacatagacacggcgataaagctcggcctcaacagacccttcggcccctttgagctggcgaagcagtttggagcggagcagattgcgaagaggctcgaggagcttgcaaagcagttcggaaagaagattttcgagccagcaaagactctgaaggaggggaaacttgaggaactgttgaaggcgggaaaggctgaggctgaggagaaaaaagaggacgagttcaagaccatcaagattgaaaagctcgatggagggataacgaagctcgtgctgaacagacctgacaggctaaacacgatctccccagaagttctggatgagatcgatagggcgattacgcagctatggaacgataaagacacgagggtcatcgtcatcacaggtgctggagacagagccttctccgcaggagcagaccttggagggagcatcataacgcaccccttcgacttccttgagcacaacaggaagggagagagagttttcacaaggctaagggagattccgaaaccagtcattgcagcaataaacggctacgcccttggtggtggtttggagattgcgatgaactgcgacattaggctggctaagaagtctgctgttctcggccttccagaggttgggctgggcatactgcccggctggagcggaactcagagattggtgaagctcgttggcataagcagggcaatgcagcttgccttaaccggagagagaatcaccgcagaggaggcagagagatgggggctggttaacaaagtctttgatgacgacaagttcgaggaggaggtaatgaactacgccaagaacatcgcagagcgctgcgccccgatttcgatggccctcatcaagaggctcatcaacaagggcggagaggtgccgatggacatcggccttgagtgggagtgcactgcagcaggtctgcttttcgcaacagaggacatgagagagggaatctcagccttcctgaggaaggacaagccccagttcaaggggcgctaa

SEQ ID NO: 2571 - protein, 668 aa, Archaeoglobus fulgidus DSM 4304
MPRRVKQVINMDVRERIKTVAVLGAGLMGHGIAEVCAMAGYNVTMRDIKQEFVDRGMNMIKESLAKLEQKGKIKSAEEVLSRIKPTVDLEEAVKDADLVIEAVPEVVEIKKQVWEEVDKLAKPDCIFTSNTSTMRITMLADFTSRPEKFAGLHFFNPPVLMRLVEVIRGEKTSDEVMDLLVEFVKSIGKTPVRVEKDVPGFIVNRVQAPASVLLMAILEKGIATPEEVDATVRRLGLPMGPFELVDYTGVDILYNALKYYAQTISPDYEPPKFLEEMVKANKLGRKTGQGFYDWSKGRPQIDSSKATDKINPMDFTFVEINEAVKLVEMGVATPQDIDTAIKLGLNRPFGPFELAKQFGAEQIAKRLEELAKQFGKKIFEPAKTLKEGKLEELLKAGKAEAEEKKEDEFKTIKIEKLDGGITKLVLNRPDRLNTISPEVLDEIDRAITQLWNDKDTRVIVITGAGDRAFSAGADLGGSIITHPFDFLEHNRKGERVFTRLREIPKPVIAAINGYALGGGLEIAMNCDIRLAKKSAVLGLPEVGLGILPGWSGTQRLVKLVGISRAMQLALTGERITAEEAERWGLVNKVFDDDKFEEEVMNYAKNIAERCAPISMALIKRLINKGGEVPMDIGLEWECTAAGLLFATEDMREGISAFLRKDKPQFKGR

SEQ ID NO: 2572 - DNA, 777 bp, Mesorhizobium loti MAFF303099
  CDS (1)..(777): transl_table=11
atgatggaccgcctcgttcaggcagtggaaccggcgcccggcatccgactgctgacgctcaaccggccggacaagctgaacgcgttgtccaaggcgttgctggccgaattgagccacctgctttctggctacgacgccgacacggaggtcggctgcgtggtgctgacgggtgccggtcgcgcctttgcggcaggcgccgacatctctgacatgctggaacgcggggtcgcctcctacgccgacccggaacggctggcatgctggcgcgccattgagggcttcaccaagccgattatcgccgccgtgaatggatatgcgctgggcggcgggctggagcttgcgcttctgtgcgacatcgtcattgcctcgcaagcagctcaattcgcgactcctgaaatcaagatcggcgcgtttcccggcgatggcggcacgcagcgtctgccacgtctcgtcggcaaatcctttgccatgcagatggtcctgaccggtgacatggtcgatgcgaccctcgccgagcgcaaaggactggtcagcgaagtcgtggaggcggacaggctcctgccacgggcgctggagatcgccgctgcgatcgccgccaagtcggttgccatcacgccctatgcgaagaaggccgttctggcggcattcgaaaccgaactgcaaagcgggctcgagattgagcaccggctgaccgtcgaggcattcggcaaggaggaccggattgaagggctgcgagcctttgccgagaaacgggcgccggccttcaggggcaaatag

SEQ ID NO: 2573 - protein, 258 aa, Mesorhizobium loti MAFF303099
MMDRLVQAVEPAPGIRLLTLNRPDKLNALSKALLAELSHLLSGYDADTEVGCVVLTGAGRAFAAGADISDMLERGVASYADPERLACWRAIEGFTKPIIAAVNGYALGGGLELALLCDIVIASQAAQFATPEIKIGAFPGDGGTQRLPRLVGKSFAMQMVLTGDMVDATLAERKGLVSEVVEADRLLPRALEIAAAIAAKSVAITPYAKKAVLAAFETELQSGLEIEHRLTVEAFGKEDRIEGLRAFAEKRAPAFRGK

SEQ ID NO: 2574 - DNA, 774 bp, Mesorhizobium loti MAFF303099
  CDS (1)..(774): transl_table=11
atggcctatgaaacgatcatcaccgagacacgcggcaaggtcgggctggtcacgctgaaccggccaaaggcgctcaatgcgctgaaccttcagcttctcgccgaactggtcgcggccgtgaaggacttcgacgccgatgccggcatcggcgcggtggtcattaccggttcggacaaggcctttgccgccggcgccgacatcaaggagatgcaagcaatctcctttgcggacgcctatttgcaggacctgttcgtcggctgggaagacctgacgcgggtgcggaaacccgttatcgccgcggtggccggctatgcgctcggcggcgggtgcgagctggcgatgatgtgcgactttatcattgccgctgacacggccaaattcggccagcccgaaatcacgctcggcgtcattcccggcatgggcggatcgcaacgcctgaccaggtttgtcggcaagtctaaggcgatggacatgtgcctgaccggacggatgatggatgcagcggaagccgagcgctcgggcctggtgtcgcgggtcgtgcccgccgccgagcttgtcgaggaggcggtcaaggcggcggccaagatcgccgatttctcgctgccctcggtgatgatggcgaaggaagccgtcaaccgttcctatgagacgacgctgaccgagggattgcggttcgaacgtcgtctgttccactcgcttttcgcgctcgaagaccagaaggaaggcatggcggccttcgccgaaaagcggaagccgaatttcgccaatcggtag

SEQ ID NO: 2575 - protein, 257 aa, Mesorhizobium loti MAFF303099
MAYETIITETRGKVGLVTLNRPKALNALNLQLLAELVAAVKDFDADAGIGAVVITGSDKAFAAGADIKEMQAISFADAYLQDLFVGWEDLTRVRKPVIAAVAGYALGGGCELAMMCDFIIAADTAKFGQPEITLGVIPGMGGSQRLTRFVGKSKAMDMCLTGRMMDAAEAERSGLVSRVVPAAELVEEAVKAAAKIADFSLPSVMMAKEAVNRSYETTLTEGLRFERRLFHSLFALEDQKEGMAAFAEKRKPNFANR

SEQ ID NO: 2576 - DNA, 2010 bp, Aeropyrum pernix K1
  CDS (1)..(2010): transl_table=11
ttggcaggggaagttaagaccataacggttgtgggcgccgggaccatgggccacgggatagctgagctcgcagccatagcgggcttcaaagtctacctggccgacatcaacatagacatcctgaacaacgccctccagaggataaggtggagcctcgaaaagctcgccgagaaggggaggataagggagtctgtcgaaaccgtcatgtcgaggatcacccccatagtcagcgtgagggatggcgagtacagcgaggacctggcgaaggcgctttcggagtccgacttcatgatagaggcgataccggagaagctggagctgaagcagcagctcttcgccttcgccgacaagcacgcgaaggagacagcgatactggcctcaaacacgagcagcctccctataacagagatagccgcggcgactagcaggcccgagaaggttgtgggaatgcacttcttcaaccccccagtcctgatgcccctagttgaggttgtcaagggcgagaagaccagcgaggagacggtggctgcaacggtggatctagccaagaagatggggaagcagactgtggttgtgaagaaggatgtgccggggttcatagtaaacaggatactgggccggctgatggagtctgcctgccttctggtcgagaggggcgggtataccgtggtgcaggttgacgccacggccaagtacctactaggcctgccgatgggtgttttcgagctcgccgactacagcgggatagacgtgttctactatgtcttcgaggccatgagcaggagggggttcaggagcgctaagtgcagcatattcgaggagaagttcaaggcgggggagtacggagtcaaggcgggcaaggggatctacagctaccccgccccgaacaagtatgtgaagcctaacatacctagggaggaggctaaggtagacccactcctcctaatggctctgcccataaacgaggctgcatggctgcttagggaagatgtggcgactagggaggatatagacaaggcggtcaagctcggcctgggatggccaaaaggcgttttcgagtatgccgacgagttcgggcttgaccgggtcgttgaggccctcgagaggataaaaagggatttcggggtggaccacgccgagcctgacccgctcctcaagaagatggtggaggaggggaggatagggaggaaggctggcaagggcttctacgagtacggtgaggtcgaggagaagaagatggagaccctcctcgtgagggtggaaaagcccatagcctggatagtgctcaacaggcccgacaagctcaacgccatatcccccaagatgataatggagctgtctcaggccctagacgagcttgaggagaggagcgacgtcagggctgtgatactgacgggcgcgggtagggcattcagcgccggggccgacgttacagccttcgcccaggtaacccccatcgacatactcaggttctcaaggaagttccaagagcttaccctgaagatccagttctacactaagccagtgatagttgctatcaagggctacgcactcggaggcggcctggagctggcgatgtcaggcgacatacggatagccagcgaggacgcgatgctaggccagcccgagataaacctgggcttcataccaggcgcaggcgggactcagaggcttgcgaggctcgccggccccgccagggccaaagagctgataatgacgggcgacatgatacctgccagtgatgctgagaagatgggcatagtcaacagagtggtgcccccagagctgctcgagcaggaagcaagtagcctggccttaaagcttgcggagaagcctccaatagcacttgcagccgctaaatacgccatagacttcggcctagaaagcaacatatgggcagggctgcagctcgaggcatccctcttcagcgtcctcttcagcaccgaagacgtgatagaaggggtcacagcgttcctggagaagaggaagccaaagttcaagggaagatag

SEQ ID NO: 2577 - protein, 669 aa, Aeropyrum pernix K1
MAGEVKTITVVGAGTMGHGIAELAAIAGFKVYLADINIDILNNALQRIRWSLEKLAEKGRIRESVETVMSRITPIVSVRDGEYSEDLAKALSESDFMIEAIPEKLELKQQLFAFADKHAKETAILASNTSSLPITEIAAATSRPEKVVGMHFFNPPVLMPLVEVVKGEKTSEETVAATVDLAKKMGKQTVVVKKDVPGFIVNRILGRLMESACLLVERGGYTVVQVDATAKYLLGLPMGVFELADYSGIDVFYYVFEAMSRRGFRSAKCSIFEEKFKAGEYGVKAGKGIYSYPAPNKYVKPNIPREEAKVDPLLLMALPINEAAWLLREDVATREDIDKAVKLGLGWPKGVFEYADEFGLDRVVEALERIKRDFGVDHAEPDPLLKKMVEEGRIGRKAGKGFYEYGEVEEKKMETLLVRVEKPIAWIVLNRPDKLNAISPKMIMELSQALDELEERSDVRAVILTGAGRAFSAGADVTAFAQVTPIDILRFSRKFQELTLKIQFYTKPVIVAIKGYALGGGLELAMSGDIRIASEDAMLGQPEINLGFIPGAGGTQRLARLAGPARAKELIMTGDMIPASDAEKMGIVNRVVPPELLEQEASSLALKLAEKPPIALAAAKYAIDFGLESNIWAGLQLEASLFSVLFSTEDVIEGVTAFLEKRKPKFKGR

SEQ ID NO: 2578 - DNA, 774 bp, Bacillus halodurans C-125
  CDS (1)..(774): transl_table=11
atgagtagcgatttcattcagtcgtggaccgaaggagcagtgggcgtgattcagctcaaccgtccaaaagtcgcgaatgctttaaatcgtcagatggttcaggaaatagtagagcaagcggaacgctacgatcgtgatcaagagattcgcgtcattttagtcaaggggagcgagcgggcatttgctgcaggagctgatatccgagagatggaaggtgaaactcctattcgttttgagctagccgacccttttgctgactgggatcgatttacgagaattcataaaccgatggtagctgcggtgagtggctttgccttagggggcggctttgaattggcccttcattgcgatctgattgtggcagcgaccaatgctcgttttggctttccagaagtgtcgttaggtgttttaccaggggcaggggggactcagctgctcactcgcgcggtaggacgaaagaaagcgctcgaatggatttggacgggtaagcacatatcagctcaagaggcgttgcagattgggattatcaataaaatcgttgagccagagctagtagaagaggaggcttttcgattggctcgaaccattgtcaagcaagcaccgattgccgttcgtcttattaaggaagctgttcatcaggcagaggacgtaacgttagcagatggcatgatgctcgaaaggaaaaatttttatctcgcgtttgctacaaaggatcaaaaagaaggaatgaaagcctttcttgaaaaacgtccaccgatttttaaaggagagtaa

SEQ ID NO: 2579 - protein, 257 aa, Bacillus halodurans C-125
MSSDFIQSWTEGAVGVIQLNRPKVANALNRQMVQEIVEQAERYDRDQEIRVILVKGSERAFAAGADIREMEGETPIRFELADPFADWDRFTRIHKPMVAAVSGFALGGGFELALHCDLIVAATNARFGFPEVSLGVLPGAGGTQLLTRAVGRKKALEWIWTGKHISAQEALQIGIINKIVEPELVEEEAFRLARTIVKQAPIAVRLIKEAVHQAEDVTLADGMMLERKNFYLAFATKDQKEGMKAFLEKRPPIFKGE

SEQ ID NO: 2580 - DNA, 786 bp, Pseudomonas aeruginosa PAO1
  CDS (1)..(786): transl_table=11
atgtccgccgatccttcgcccgtggtcctgctcgaatttcccgcagccgatatagccctgcttcgcctcaatcgtccgcaagccaggaacgcgctgaacgacgaagtgcgccagcgcctcgccagccacttccagacgctcggcgcggatccggcgatccgcgtcatcgtgctcaccggcgactcgcgctgctttgcagctggcgccgatctccgcgatctctcgacgagcacggcgatcggcctgtacggccgccacggcgagcgctactgggaagccatcgcgcgctgcccgaagccggtgatcgccgcggtcaacggcttcgccctgggcggcggctgcgaactggcgatgcactgcgacctgatcgtcgccggcgagtcggcacagttcgcccagccggagatcaaggtcggggtgatgccgggtgccggcggcacccagcgcctggtacgggcggtgggcaagttccaggcgctgcgcatgctgttcaccggctgcctggtgaaggctccgcaagcgctggccatgggcctggtcagcgaagtggtggcggacgagtcgacgctggcgcgcgccctggaactggccatggagatcgcccgcctgccccctctggcgctggcgcagatcaaggaggtggtcctggccggtgccgacctgccgctggacagtgccctggccctggaacgcaaggcgttccagttgctgttcgactcgcaggaccagaaggaaggcatgcacgccttcctggagaaacgcccgccgaactaccaggggaaatag

SEQ ID NO: 2581 - protein, 261 aa, Pseudomonas aeruginosa PAO1
MSADPSPVVLLEFPAADIALLRLNRPQARNALNDEVRQRLASHFQTLGADPAIRVIVLTGDSRCFAAGADLRDLSTSTAIGLYGRHGERYWEAIARCPKPVIAAVNGFALGGGCELAMHCDLIVAGESAQFAQPEIKVGVMPGAGGTQRLVRAVGKFQALRMLFTGCLVKAPQALAMGLVSEVVADESTLARALELAMEIARLPPLALAQIKEVVLAGADLPLDSALALERKAFQLLFDSQDQKEGMHAFLEKRPPNYQGK

SEQ ID NO: 2582 - DNA, 798 bp, Pseudomonas aeruginosa PAO1
  CDS (1)..(798): transl_table=11
atggattcctcccctggggcggtgcgccccgaactcgtgctgctggagcggccggagcagggcgtggccctgttgcgactgaaccgcccggcagtgctcaacgccctgaacatgcgcctgcgcgaggctctggcggagcacgtacggcgcctcgacgagtgcgccgatacccgggtcatcgtcctcaccggaaatggcacggcgttcgccgccggcgccgatctcaacgaactggcggaggcgtccgcgctggagatccagcagcgcggggtggagcgccactggcaggccctcgccgcctgccgcaaaccgctgatcgccgccgtggagggccatgccctgggcggaggctgcgagttggcgatgcactgcgacctgatcgtcgccggtgcctcggcgcgcttcgcccagccggaaatccgtgtcggcgtgatgcccggcgccggcggcacccagcgcctggtgcgagcggtgggcaagttccaggcgctgcgcatgctgtttaccggttgcacggtacgggcgccggaggccctggccatagggttggtcagcgaggtggcggcggatggccaggcattggatcgcgccctcgaactggctcgccagatcgccggcctgccgccgctggcgctggcgcagatcaaggaagtggtcctggccggcgccgacctgccgctggaccaggccctggcgctggagcgcaaggccttccagttgctgttcgacagccacgaccagaaggagggcatgcgtgccttcctggaaaaacgcacagcggagtacctgggaaaatga

SEQ ID NO: 2583 - protein, 265 aa, Pseudomonas aeruginosa PAO1
MDSSPGAVRPELVLLERPEQGVALLRLNRPAVLNALNMRLREALAEHVRRLDECADTRVIVLTGNGTAFAAGADLNELAEASALEIQQRGVERHWQALAACRKPLIAAVEGHALGGGCELAMHCDLIVAGASARFAQPEIRVGVMPGAGGTQRLVRAVGKFQALRMLFTGCTVRAPEALAIGLVSEVAADGQALDRALELARQIAGLPPLALAQIKEVVLAGADLPLDQALALERKAFQLLFDSHDQKEGMRAFLEKRTAEYLGK

SEQ ID NO: 2584 - DNA, 1992 bp, Sulfolobus solfataricus P2
  CDS (1)..(1992): transl_table=11
atgaaagtagaagatattaaaaagattctcgtagtaggagcaggaacaatgggacacggaatagctgaaattgctgcaatttctgggtataaggtgtacttaagtgatatatctcaagatatattaaacaatgctttggaaagaataagatggagtttaagtaagttacaagagagagggcagataaaagaaagtgttgataccataatgtctagaataaccactatagtgggattagataagacagtaagtgatgctgacttctctatagaggcttcgactgaaagaatggatataaaaaggcaagttttctcaaaacttgacgaattattaccaccccatgcaatattagctacaaatacgagtagtctaccaatatctaaaatagctgaagctactaaaagacaagataaagttgtgggaatgcacttcttcaacccgccagtactaatgcaacttgtagaagtaatgaaaggagataaaactagtgatgagactgcaaaaataacttatgatttagccaagaagtttggcaaacaaccaataatgataaataaggatgtgccaggttatgtcgtaaatagaatattaggtcaaataaatatcgcctcatgcatattagtggagaagaaagtagcagactacagagaagttgatgcagtagctagatacaaactagggtttccaatgggggtatttgaattaatagactatacaggggtagatgttgcgtactacgtttcgaagtctagagaagaactaggaataagagatgatataccgatatgcagtctgatagagcaaaagtttaagaataacgaactaggtgtgaaaactggtaaaggtttctacacttatccagctccaggcaaatatgttaaaccggaattgcctaaggaattagctgataaattaaacccagcattaattttagctggaggcgtaaatgaggctactagactattgagagaaggaatagcaagtagggatgatatagatttaggtgtgagattgggattagggcttccaaagggaatattccaatatgcggatgagttaggagttgatacagtacttaaggctttggaagatctaaaagcgttatctggttataacaccttcaatccagatcccatgataactcaaatgataagagagaataagttaggaataaagacgggaagtggattctaccagtatgggaaggtcgaggaaaagaaaatgaacacccttatcatacgtattgaaccaccgctagcgtggatcatactaaatagaccagaacgattgaacgcactaaatccagagttagtaagtgaacttgacaagagtctagatgaattagaaagtagaagtgatgtaagggtagtcataattactggtaacggtagggctttctcagctggggcagacgttagctcgttcattacgctaagaccaatagacgtgataaggttgaggactttaagaaatgttgtgaacaaaattgctctctacactaagccgataattgcgggaataaatgggtttgcattaggtggtggacttgagttggccatggcttgtgatataaggatagcttctgaggttgcacaactaggacaaccggaaatcaatataggtataatacccggagctgggggaacgcagaggctacccagactagttggaaaaggaaaggctaagttaatgatatataccggtgatatggtttccgctgaggatgcgtataagatgggattagtggatttagtagttccaagtaatagatttgaggaagaagtaagaagagtagcattgaaaatagctgaaaaatcaccaatatcactattggcagctaaattagcaatagagttaggatacgaatctaatatctggactggacaaactctagagtcaacattatttgggcttttattcacaactaaagatgtagaagaaggagtgaaagctttcttagaaaaaagaaaaccccaatttaaaggagaataa

SEQ ID NO: 2585 - protein, 663 aa, Sulfolobus solfataricus P2
MKVEDIKKILVVGAGTMGHGIAEIAAISGYKVYLSDISQDILNNALERIRWSLSKLQERGQIKESVDTIMSRITTIVGLDKTVSDADFSIEASTERMDIKRQVFSKLDELLPPHAILATNTSSLPISKIAEATKRQDKVVGMHFFNPPVLMQLVEVMKGDKTSDETAKITYDLAKKFGKQPIMINKDVPGYVVNRILGQINIASCILVEKKVADYREVDAVARYKLGFPMGVFELIDYTGVDVAYYVSKSREELGIRDDIPICSLIEQKFKNNELGVKTGKGFYTYPAPGKYVKPELPKELADKLNPALILAGGVNEATRLLREGIASRDDIDLGVRLGLGLPKGIFQYADELGVDTVLKALEDLKALSGYNTFNPDPMITQMIRENKLGIKTGSGFYQYGKVEEKKMNTLIIRIEPPLAWIILNRPERLNALNPELVSELDKSLDELESRSDVRVVIITGNGRAFSAGADVSSFITLRPIDVIRLRTLRNVVNKIALYTKPIIAGINGFALGGGLELAMACDIRIASEVAQLGQPEINIGIIPGAGGTQRLPRLVGKGKAKLMIYTGDMVSAEDAYKMGLVDLVVPSNRFEEEVRRVALKIAEKSPISLLAAKLAIELGYESNIWTGQTLESTLFGLLFTTKDVEEGVKAFLEKRKPQFKGE

SEQ ID NO: 2586 - DNA, 867 bp, Agrobacterium tumefaciens str. C58
  CDS (1)..(867): transl_table=11
ttgaaagggtggtgcaggccggtcgttcgacattctattgcgccgcctgccagaaatagcggtgctgcaaattacggagaaggggagattgccgtggactatgaaatgatactggtcgagaagcgcgatgaggtgggcgtcatcacgctcaaccgccccaaggtgctcaacgccctcaattcggtgcttctgaaagagctgcggcacattctgtcttctttctcagccgatgattccatcggcgccatcatcatcaccggctcggaaaaggcatttgcggccggcgccgacatcaaggaaatgcaggggctggatttcgtcgatgcctatgtgggcgatttcctgggtggctgggatgaggttgcggccacacgcaagcctgttattgccgctgtttccggttttgcgctcggcggcggctgcgagctggcgatgatgtgcgatttcattatcgcttcggacacggcgaagttcggccagccggaaatcaccctcggcgtcattcccggcatgggcggatcgcagcggctgacgcgggcggtgggcaaggcgaaggccatggacctcgttctgaccggccgcatgatggatgcggcggaagccgagcgcgccggcctcgtatcgcgtatcgtgccggctgcagatctcatggaggtggcggtggaagctgcgacccgcattgcctcgctgtcgcgtgcttccgtgctcatggccaaggaaagcgtcaaccgctccttcgaggtgccgctcgccgaggggctgagatatgaacggcgtgccttccagtcgctctttgcgacggaggatcagaaggagggcatggcggccttcgttgaaaagcgcaaacccgctttccggaatcgctaa

SEQ ID NO: 2587 - protein, 288 aa, Agrobacterium tumefaciens str. C58
MKGWCRPVVRHSIAPPARNSGAANYGEGEIAVDYEMILVEKRDEVGVITLNRPKVLNALNSVLLKELRHILSSFSADDSIGAIIITGSEKAFAAGADIKEMQGLDFVDAYVGDFLGGWDEVAATRKPVIAAVSGFALGGGCELAMMCDFIIASDTAKFGQPEITLGVIPGMGGSQRLTRAVGKAKAMDLVLTGRMMDAAEAERAGLVSRIVPAADLMEVAVEAATRIASLSRASVLMAKESVNRSFEVPLAEGLRYERRAFQSLFATEDQKEGMAAFVEKRKPAFRNR

SEQ ID NO: 2588 - DNA, 1959 bp, Sulfolobus tokodaii str. 7
  CDS (1)..(1959): transl_table=11
atgaaattagaaaaagtgttagttgtaggagcaggtactatgggacacggtattgctgaactattcgcaatagcgggatatgaggtatatttaagtgatataagtcaagaaattctggataatgcattaaacaaaattaagtggagtttagataaactccaagaaaaagggcagttaaaggaaagtacgagtaatataatttctaggataaagactgttgtaggattgaatgaaagtgtgaatgatgctgattttgcaattgaggctgcgatagaaagactggatttaaagaggcaaatattctctaaacttgatgaattattacctactcatgcaatattagctactaatacgagcagtttatctatatctaaaatagctgaagctacgaaaagaccggaaaaagttgttgggatgcatttctttaatcccccagtattaatgcagttagttgaagtaatgaagggtgagaagactagtgatgagactgcaaagacaacttatgagttagctaaaaagctaggtaaaattcctataatgataaataaagatgttccagggtatgtagtaaatagaattttaggagaaataatttcagcatcgtgtattatattacaaaaaggtattgctgattacctaacaattgacgctgtagcgaaatacaaactgggatttccaatgggtgtttttgagctgttagactatactggtattgatgttaattattatgtttctaaatctttagaggaatacgggataaaatctccttgttcagctttatttgaggagaaggtcaaaaagaatgagcttggagttaagagcggaaagggattttattcttatcctgccccagggaagtactcaaagcccgaaatacctaaagagttggctgataagttagatccagtgttaatcatagcactaggagttaatgaggcttcaaggctgtttagacaaggaatagtgagtaaagaagacatagatttgggtgtcaaactgggattgggatttcctaagggaattttccagtatgctgacgaattaggaatagataatgtggttaaagcaattaattcactttcagtcgaggagccagatcgtttattattagatatggtcaatgaaggaaagttaggtataaagagtggttctggattttatgagtatggtaaagttgaggagaaaaaattaaatacgttaatagttcgtgttgaaccgcccttagcatggattatattaaatagaccggagaggcttaacgcactaagtatggaattgataggggaattaaacaaagcattagatgagttagaaaatgacagtagagtaagggttataatcttgtccggaagtggtagggctttttctgctggagctgatgtaacgtctttcttaacgttaaaaccaatagacgtaataagatttagaagcttacgtgaactaaccaataagattcagttttatacaaaaccagttattgctgcaataaatggttatgctttaggtggaggattagagattgcattagcgtgtgatattagaattgcgtctgaaaattctatgcttggtcaaccggaaataaatctaggtataattcccggtgctggtggtactcaaagattgcctaagttagtagggaagggaagagctaaattacttatttataccggtgatatgatacctgcgaaggatgcatacgaaatgggattagttgatatagttgtacctacaggcaggtttgaggatgaagtgagaaggatagcccttaaaatagctgaaaaatctcctctttcattacttgctgcaaaattagctatagaattaggctatgatgcaaatatatttagtggagagtatttagagtcgagtttatttggcttactctttacgactaaggatgtgcaagagggagtaagagctttcttagaaaagagaaaacccgaatttaaaggagaataa

SEQ ID NO: 2589 - protein, 652 aa, Sulfolobus tokodaii str. 7
MKLEKVLVVGAGTMGHGIAELFAIAGYEVYLSDISQEILDNALNKIKWSLDKLQEKGQLKESTSNIISRIKTVVGLNESVNDADFAIEAAIERLDLKRQIFSKLDELLPTHAILATNTSSLSISKIAEATKRPEKVVGMHFFNPPVLMQLVEVMKGEKTSDETAKTTYELAKKLGKIPIMINKDVPGYVVNRILGEIISASCIILQKGIADYLTIDAVAKYKLGFPMGVFELLDYTGIDVNYYVSKSLEEYGIKSPCSALFEEKVKKNELGVKSGKGFYSYPAPGKYSKPEIPKELADKLDPVLIIALGVNEASRLFRQGIVSKEDIDLGVKLGLGFPKGIFQYADELGIDNVVKAINSLSVEEPDRLLLDMVNEGKLGIKSGSGFYEYGKVEEKKLNTLIVRVEPPLAWIILNRPERLNALSMELIGELNKALDELENDSRVRVIILSGSGRAFSAGADVTSFLTLKPIDVIRFRSLRELTNKIQFYTKPVIAAINGYALGGGLEIALACDIRIASENSMLGQPEINLGIIPGAGGTQRLPKLVGKGRAKLLIYTGDMIPAKDAYEMGLVDIVVPTGRFEDEVRRIALKIAEKSPLSLLAAKLAIELGYDANIFSGEYLESSLFGLLFTTKDVQEGVRAFLEKRKPEFKGE

SEQ ID NO: 2590 - DNA, 777 bp, Sulfolobus tokodaii str. 7
  CDS (1)..(777): transl_table=11
gtgagtaaagtgcctaataccgtaatatatgagattatggataatattgcaatagttagactgaacagaccagataagttaaacgctttaaatatggaaatggtatgggattttgttaatgtatttaatgagctagagaataataagaatgttaaagtagtcataattactggaaatggtagagctttttgtgctggtgctgatgttaatgaaatggctaatatgaaagttgaggatgtagtgagagttggtcatgctcctatgtgggaaagattaaggacattcagaaaaccagttattgctgcacttaacggattaactgtaggtggaggtttagagttagcaatggcatgtgatattataattgctgctgaaagtgctatgttgggtcaacctgagataaatcttggtataattcccggtgctggtggtactcagagattaactaggactgtagggaaatacaagggtatggaaatggtactaactggaagattaatatcagcatgggaagcttacagaaggggtctggtcattaaggttgttcctgatgaggctttacttgatgaggcaattaggttagcaaaagagattgctactaaatctctatttgcagtagaattaggcaaggaggctgtaaataaggctttagataccactttacagcaagggttggatattgagagaaggaacttttatgttgctttaatcagcgaagatggtaaagaaggtatgaaggcatttatagagaagagaaaacctaattggaaaacataa

SEQ ID NO: 2591 - protein, 258 aa, Sulfolobus tokodaii str. 7
MSKVPNTVIYEIMDNIAIVRLNRPDKLNALNMEMVWDFVNVFNELENNKNVKVVIITGNGRAFCAGADVNEMANMKVEDVVRVGHAPMWERLRTFRKPVIAALNGLTVGGGLELAMACDIIIAAESAMLGQPEINLGIIPGAGGTQRLTRTVGKYKGMEMVLTGRLISAWEAYRRGLVIKVVPDEALLDEAIRLAKEIATKSLFAVELGKEAVNKALDTTLQQGLDIERRNFYVALISEDGKEGMKAFIEKRKPNWKT

SEQ ID NO: 2592 - DNA, 789 bp, Caulobacter crescentus CB15
  CDS (1)..(789): transl_table=11
atggcccagttccagaccctgatcgtcgaggcgccggaaagcgcgccgggcgtcaccctgatccgcctgaaccggcccgaggcgctcaacgcgctcaacaccgccctgctgggcgaacttgcccaggccctggcggcggcgcaggccgacgacagcgtgggctgcatcgtgctgaccggttcggccaaggccttcgccgccggcgccgacatcaaagagatgtcggacaagacctatgcgcagatgttcaaggccgactttttcacggcgggcgcccgggcgatcgaacagtgccgcaagccgatcatcgccgccgtcgcgggctacgccctgggcggcggctgcgagctggcgatgatgtgcgacttcatcctggccgccgacaccgccaagttcggccagcccgagatcaatctgggcgtggcgcccggcatcggcggcacccagcgcctgacccgctttgtcggcaagtccaaggccatggacatgatcctgaccggccggatgatgggcgcggaggaagccgagcgctccggtctggtgtcgcggatcttccccgccgacagcctggtcgacgagaccctggcgatcgccgccaagatcgccggccaatcgccgctggccgtggcgatgaacaaggaactggtcgaagccgcctatgagacgaccctgacgaccggcgtcgcgctggagcgccggctgttccattcgctgtttgcgttcgaggatcagaaggaaggcatgacagccttcgtcgagaagcgtaaacccctgttcaagggcgcgtga

SEQ ID NO: 2593 - protein, 262 aa, Caulobacter crescentus CB15
MAQFQTLIVEAPESAPGVTLIRLNRPEALNALNTALLGELAQALAAAQADDSVGCIVLTGSAKAFAAGADIKEMSDKTYAQMFKADFFTAGARAIEQCRKPIIAAVAGYALGGGCELAMMCDFILAADTAKFGQPEINLGVAPGIGGTQRLTRFVGKSKAMDMILTGRMMGAEEAERSGLVSRIFPADSLVDETLAIAAKIAGQSPLAVAMNKELVEAAYETTLTTGVALERRLFHSLFAFEDQKEGMTAFVEKRKPLFKGA

SEQ ID NO: 2594 - DNA, 777 bp, Ralstonia solanacearum GMI1000
  CDS (1)..(777): transl_table=11
atgtcctaccaacacattctggtcgaaacgcgcggtcgtgtcggccttgtcacgctcaaccgccccaaggcgctcaacgcgctcaacgatgcgctgatggacgaactcggcgccgcgctgctcgccttcgatgccgacgagggcatcggcgccatgatcatcaccggtagcgacaaggcgtttgcagctggtgcggacatcggcgccatggccgactacgacttcgccaccgtctataagaatgaatacatcacgcgcaactgggaaaccatccggcgcatccgcaagccggtgatcgccgccgtggcgggctacgcgctgggcggcggctgcgagttggcgatgatgtgcgacatcatcctggcggcggacaccgccaggttcggccagccggagatcaaactcggcaccatgccgggcgcgggcggcacccagcgcctgccacgcgccgtctccaaggccaaggccatggacctctgcctgaccgcgcgcatgatgggcgccgatgaagctgagcgcgccggcttggtttcacgcgttatccccgccgacaagctcctggatgaagccttggcggccgccgagaccatcgccggcttctccctgccgaccgccatgatgatcaaggagtcgatcaatgcggcatacgaaaccacgctgagcgagggcgtgcgcctggagcgccgcctgttccacgccacatttgccacggaagaccagaaagagggcatgcacgctttcctggggaagcggcaacctgctttcaaacaccgctaa

SEQ ID NO: 2595 - protein, 258 aa, Ralstonia solanacearum GMI1000
MSYQHILVETRGRVGLVTLNRPKALNALNDALMDELGAALLAFDADEGIGAMIITGSDKAFAAGADIGAMADYDFATVYKNEYITRNWETIRRIRKPVIAAVAGYALGGGCELAMMCDIILAADTARFGQPEIKLGTMPGAGGTQRLPRAVSKAKAMDLCLTARMMGADEAERAGLVSRVIPADKLLDEALAAAETIAGFSLPTAMMIKESINAAYETTLSEGVRLERRLFHATFATEDQKEGMHAFLGKRQPAFKHR

SEQ ID NO: 2596 - DNA, 762 bp, Agrobacterium tumefaciens str. C58
  CDS (1)..(762): transl_table=11
atgatactggtcgagaagcgcgatgaggtgggcgtcatcacgctcaaccgccccaaggtgctcaacgccctcaattcggtgcttctgaaagagctgcggcacattctgtcttctttctcagccgatgattccatcggcgccatcatcatcaccggctcggaaaaggcatttgcggccggcgccgacatcaaggaaatgcaggggctggatttcgtcgatgcctatgtgggcgatttcctgggtggctgggatgaggttgcggccacacgcaagcctgttattgccgctgtttccggttttgcgctcggcggcggctgcgagctggcgatgatgtgcgatttcattatcgcttcggacacggcgaagttcggccagccggaaatcaccctcggcgtcattcccggcatgggcggatcgcagcggctgacgcgggcggtgggcaaggcgaaggccatggacctcgttctgaccggccgcatgatggatgcggcggaagccgagcgcgccggcctcgtatcgcgtatcgtgccggctgcagatctcatggaggtggcggtggaagctgcgacccgcattgcctcgctgtcgcgtgcttccgtgctcatggccaaggaaagcgtcaaccgctccttcgaggtgccgctcgccgaggggctgagatatgaacggcgtgccttccagtcgctctttgcgacggaggatcagaaggagggcatggcggccttcgttgaaaagcgcaaacccgctttccggaatcgctaa

SEQ ID NO: 2597 - protein, 253 aa, Agrobacterium tumefaciens str. C58
MILVEKRDEVGVITLNRPKVLNALNSVLLKELRHILSSFSADDSIGAIIITGSEKAFAAGADIKEMQGLDFVDAYVGDFLGGWDEVAATRKPVIAAVSGFALGGGCELAMMCDFIIASDTAKFGQPEITLGVIPGMGGSQRLTRAVGKAKAMDLVLTGRMMDAAEAERAGLVSRIVPAADLMEVAVEAATRIASLSRASVLMAKESVNRSFEVPLAEGLRYERRAFQSLFATEDQKEGMAAFVEKRKPAFRNR

SEQ ID NO: 2598 - DNA, 882 bp, Brucella melitensis 16M
  CDS (1)..(882): transl_table=11
atgccggtccaatttgcgccacggaattttaaggcggggcagccttgccggcacattatcccggatgagccgggctgtcacgcgctgatgaaggaggaacgggtttacatggcctatgaaacaatcatcgttgagacgcgtgacagcgttggtctcatccgtctcaaccgtccgcaggcgctcaacgcgctcaatcgcgccgtgcttgaggagctgaccgatgcgcttgccgccttcgacgcggatggcaaggtcggcgccgtggtgctgaccggctcggaaaaggctttcgccgccggggccgacatcaaggaaatgcagttgatcaatttcgtcgatgcctatttgcaggacatgttcgccgactggcagaaggtggatcgtatccgcaagccgattatcgcggctgtttcgggctatgcgctgggcggcggctgcgaactcgccatgatgtgcgatttcatcatcgcgggcagcaatgcgaaattcggccagccggaaatcacgctgggcgccattcctggcatgggcggctcgcagcgcctgacgcgctatgtcggcaagtccaaggctatggatatgtgcctgacgggccgcatgatggatgcagccgaagcggagcgttgcggccttgtttcccgcgttgtcgcaccggaggctcttctggaagaggcactgaaagcagccgaacgcatcgcatccttctcgcgcgtctcggtctatatggccaaggaagcggtcaaccgcgcctatgaaacgacgctggacgagggcctgcgtttcgagcgccgcctgttccattcgcttttcgcgaccgaagaccagaaggaaggcatgtccgctttcgttgataaacgtaccccttccttcaagaaccgctga

SEQ ID NO: 2599 - protein, 293 aa, Brucella melitensis 16M
MPVQFAPRNFKAGQPCRHIIPDEPGCHALMKEERVYMAYETIIVETRDSVGLIRLNRPQALNALNRAVLEELTDALAAFDADGKVGAVVLTGSEKAFAAGADIKEMQLINFVDAYLQDMFADWQKVDRIRKPIIAAVSGYALGGGCELAMMCDFIIAGSNAKFGQPEITLGAIPGMGGSQRLTRYVGKSKAMDMCLTGRMMDAAEAERCGLVSRVVAPEALLEEALKAAERIASFSRVSVYMAKEAVNRAYETTLDEGLRFERRLFHSLFATEDQKEGMSAFVDKRTPSFKNR

SEQ ID NO: 2600 - DNA, 894 bp, Brucella melitensis 16M
  CDS (1)..(894): transl_table=11
ttgctaagcgaatgtttcatagaatattgttcaactcaacataaaatgaaatttaattccattactggaggttccacgtcgggtacgatgtgggacggcatggggaacaaaatgagcgaagctactgatgttgtgatagaaactcgtccggctgacggtgttgccctcctggaactcaaccgccctgatgcattgaatgccgtgaacatggatgtgcgccagaaactggctgcatcagccgacagtctcgttgaggatccggacatccgggtgatcgtcattgccggacgtggcggaaatttcgccgcgggttcagatgtcaaggtttttgcgcaaaccggggcgggtagtctgcttgcacagcgcatgcaccgctattgggaaagcctcgcccattgccccaagccggttatcgcggccgtagagggatatgccctaggtggcgggtgcgagctggcaatgcacgccgacattattgtagctgcaagaaccgccagtttcggccagccagaaataaagctcggactgatgcctggagcaggcggcacgcagcgccttttgcgcgcgatcggcaagtacaagactatgctgctcgcattgacgggcgaaatgctgcctgcaacggaagctgaaaaatacggacttgtaagcaggctctcggaagaaggtgaagcgcttgaagaagccttgaaactggcgcggaaaatcgcgcttatgcccgcgttggctgctgaacagataaaggaggcggtcatgtacggcgaggatgcgccgctggaaaccgcactccgcctggagcgcaaggcatttcagctcctgttcgatacggaagacaagcgtgaaggcatcgatgcatttttgaccaagcgcaagccggcattcaaagggcgctga

SEQ ID NO: 2601 - protein, 297 aa, Brucella melitensis 16M
MLSECFIEYCSTQHKMKFNSITGGSTSGTMWDGMGNKMSEATDVVIETRPADGVALLELNRPDALNAVNMDVRQKLAASADSLVEDPDIRVIVIAGRGGNFAAGSDVKVFAQTGAGSLLAQRMHRYWESLAHCPKPVIAAVEGYALGGGCELAMHADIIVAARTASFGQPEIKLGLMPGAGGTQRLLRAIGKYKTMLLALTGEMLPATEAEKYGLVSRLSEEGEALEEALKLARKIALMPALAAEQIKEAVMYGEDAPLETALRLERKAFQLLFDTEDKREGIDAFLTKRKPAFKGR

SEQ ID NO: 2602 - DNA, 786 bp, Brucella melitensis 16M
  CDS (1)..(786): transl_table=11
ttggctgcttccgaggataggttcgtgtcggtcgaacgacatgcggatggggtcgcaacagtccggatcaacaggccggaagcgaggaacgcgctcaacctgacgacgcgccagcaactggctgaacatttccgcgccttgtcgggggatgaaagcgtgcgcgccatcgtgctgacgggcggggaaacctgctttgtggacggtgccgatgttcgcgaattcgcttccgccggtcccatcgaaatgtatcttcgccatacggaatatctttgggatgccatcgcttcctgtgcgaagcctgtcatcgctgcggtcaacggttatgcgctgggcgggggctgtgagcttgccatgcattgcgacatcatcgtcgcaggcgagggcgcggtgtttggccagcctgaagtgaagcttggcctcatgccgggtgccggcggcacgcagaggctcatccgtgcggtcgggaaattccaggccatgcgcattgcgctgacgggctgtatggttcccgcagccgaggcgctgtcgattggcatgatcagcgaaatgaccgccaatgaaaggacattgccgcgcgcgcatgaactggctgtggaaattgcgcggctgcccgcgctcgccgttgcgcagatcaaggaagtgatgctcgtcggcgccgatctgccgctggatggcgcattggcgcttgaacgaaaggctttccagcttctgttcgattcgaaagaccagaaagagggcgcagccgctttcctcgaaaaacgcaaacctgcctataacggacgctag

SEQ ID NO: 2603 - protein, 261 aa, Brucella melitensis 16M
MAASEDRFVSVERHADGVATVRINRPEARNALNLTTRQQLAEHFRALSGDESVRAIVLTGGETCFVDGADVREFASAGPIEMYLRHTEYLWDAIASCAKPVIAAVNGYALGGGCELAMHCDIIVAGEGAVFGQPEVKLGLMPGAGGTQRLIRAVGKFQAMRIALTGCMVPAAEALSIGMISEMTANERTLPRAHELAVEIARLPALAVAQIKEVMLVGADLPLDGALALERKAFQLLFDSKDQKEGAAAFLEKRKPAYNGR

SEQ ID NO: 2604 - DNA, 1989 bp, Pyrobaculum aerophilum str. IM2
  CDS (1)..(1989): transl_table=11
atgcctaaagtggcagtaataggcgcgggcacaatgggccacggcattgccgagctctttgccatagccgggtacgaggtagcccttgtcgacgtggcggaggatttcttaaagagagctttgcaaaacattgagtggtcgcttaaaaaactcgcagagaaggggcagataaaggaagatgttggcgttattctcgggaggattaagcccatagttaatgacgtgtgtaaggccgttgagggggccgagcttatggttgaggctgtggtcgaggatattgaaattaagaggaaggtctttgcagaggctgaccgctgcgctcctcccagcgctattttggccacgaatacctcctctttgccaattacggagatagctgaggccgtgaagcccgagaggaggccgctggtggtggggatgcactttttcaacccgcctgtattaatgccgctggtagagataataaaaggcgcttacactagcgacgagactgtcaaaaaaacggcggagtacgcctcaaagctggggaagcagacagtagttgtgaataaagacgtcccgggctttattgtaaatagaatactcgccagattaaacgaggcggcttgttggatggtggctaggggggaggcaactatccaagaggtggactctgcgttaatatataaggcaggtctgccgatgggcgcctttatattaatggactacacgggcatagacgtcgtctgctttataggagacgccatggttaagagggggtttaagacccacccatgccccgtaatagctgagaagtgcaaggagaagaaatacggcgttaagagcggagagggcttttacaaatacccagcgcctggtaaattccagtggcccgaggtgcccaaggcggctggggacaaggtagacgtcacatacctactcgctcccgcgataaacgaggctgcgtatctattacgtgagagtattgccagcagagaagatattgacaaagcgatcagattaggccttaactggccaaaagggccattggaatacgcagatgaattaggcatagacacagtggtgaaggcgctggaggagtggaagaataagactggatttgaggagtacgagccagatcccctcttgagggacatggcggctaaagggaaattgggtaagaaaagcggcgagggcttttatacatatgtcaaggctgaggagaaaaagctcgagactttaattgtgcgctacgagcctggcattgcctggattattctcaacagacccgagaggctcaacgccataaacccgaaaatgatagaagagctgtggaaagtcctcgatgaaattgagcaaatggattacgacaaagtgagagtagtagtaattacgggatctggcagggcattctcagctggggcggacgtcacggggtttatgggcgccactccggtgacgatatttaaagtgtctaggaaattacaaatgctgtatgagcggctggagttactggacaggcctgtgatatgcggcctcaacggctacaccctcggaggcggcttggagctggccatggcctgcgacttcagaatcgcggcagagacggcggaactaggacagcccgaaataaacctcggctttatacccggggccggaggcacgcagagattggctaggctaataggcagagacaaggcgaaggagctcatctttaccggagatagaataccggctagagaggccgagaggctcggcttagtacacaaggtagttccgccggatagacttgagcaagagctcagggcttttgctaacaaactggcggaaaagccgccattggcgctggccatggcaaaatacgccataaacttcggcttagaggcgccgcagtgggtgggcatgatgttagaggcctccaacttcgggctactcttcagcacagaggacgtaattgagggcgtctccgccttcttgcagaaaaggaagccccagttcaagggcaaatag

SEQ ID NO: 2605 - protein, 662 aa, Pyrobaculum aerophilum str. IM2
MPKVAVIGAGTMGHGIAELFAIAGYEVALVDVAEDFLKRALQNIEWSLKKLAEKGQIKEDVGVILGRIKPIVNDVCKAVEGAELMVEAVVEDIEIKRKVFAEADRCAPPSAILATNTSSLPITEIAEAVKPERRPLVVGMHFFNPPVLMPLVEIIKGAYTSDETVKKTAEYASKLGKQTVVVNKDVPGFIVNRILARLNEAACWMVARGEATIQEVDSALIYKAGLPMGAFILMDYTGIDVVCFIGDAMVKRGFKTHPCPVIAEKCKEKKYGVKSGEGFYKYPAPGKFQWPEVPKAAGDKVDVTYLLAPAINEAAYLLRESIASREDIDKAIRLGLNWPKGPLEYADELGIDTVVKALEEWKNKTGFEEYEPDPLLRDMAAKGKLGKKSGEGFYTYVKAEEKKLETLIVRYEPGIAWIILNRPERLNAINPKMIEELWKVLDEIEQMDYDKVRVVVITGSGRAFSAGADVTGFMGATPVTIFKVSRKLQMLYERLELLDRPVICGLNGYTLGGGLELAMACDFRIAAETAELGQPEINLGFIPGAGGTQRLARLIGRDKAKELIFTGDRIPAREAERLGLVHKVVPPDRLEQELRAFANKLAEKPPLALAMAKYAINFGLEAPQWVGMMLEASNFGLLFSTEDVIEGVSAFLQKRKPQFKGK

SEQ ID NO: 2606 - DNA, 783 bp, Thermoanaerobacter tengcongensis MB4
  CDS (1)..(783): transl_table=11
gtggaatataaaaacatagaagtgaaaattgaaaaggggattgccacaatcacaattaacaggccaaaggctttaaatgcattaaacacagagactcttgaagaattagaaaatgttttagaagttttgcaaaatgacgatggggtaaaagttatagttataactggtgcaggagaaaaggcatttgtggcaggagcagatatttctgaaatgaaggacatgagcgtatttgaggcgaaaaagtttgctgagttaggtcagaaggtatttagaaagattgaacttgtgaagaagccagtcattgctgctgtgaatggatacgctcttggaggaggatgtgaacttgctttggcttgcgatataaggattgcaagtcgtaatgcaaaatttggtcagccagaagtaggacttggaattataccgggatttggtggtacgcagaggctacctcgaattgtaggtgtttcaaaagcgaaagaactcatatacactggagatatgatagatgcagaggaggctttgagaataggccttatttcaaaagtagtagaacaagataaacttttagaggaagcttatggtattgcaaaaaagataatgtcaaaagggcttgtggcagtatcactggctaaagaagctataaacaaaagcctcgaagttgatatcgattcaggcatggaatatgaggccaatgcttttgccatgtgttttggtacacaggatcaaaaagagggcatggcagcttttttagagaagagagctcctaaatttgaaggaagatga

SEQ ID NO: 2607 - protein, 260 aa, Thermoanaerobacter tengcongensis MB4
MEYKNIEVKIEKGIATITINRPKALNALNTETLEELENVLEVLQNDDGVKVIVITGAGEKAFVAGADISEMKDMSVFEAKKFAELGQKVFRKIELVKKPVIAAVNGYALGGGCELALACDIRIASRNAKFGQPEVGLGIIPGFGGTQRLPRIVGVSKAKELIYTGDMIDAEEALRIGLISKVVEQDKLLEEAYGIAKKIMSKGLVAVSLAKEAINKSLEVDIDSGMEYEANAFAMCFGTQDQKEGMAAFLEKRAPKFEGR

SEQ ID NO: 2608 - DNA, 783 bp, Xanthomonas axonopodis pv. citri str. 306
  CDS (1)..(783): transl_table=11
atgtccaatcacgtcattctgatcgccgatcacgccagcgtccggacgattacggtcaaccggccggacaaactgaacgctttgaaccaggcgaccatgcaggcgctggatcaggcgttccaagacgcagccgctgcggacgatgtacgcgccgtgattctcaccggcgccggccccaaggccttcgtggcgggtgcggatatcgcggaaatgagtgatctgtcggcaatccagggccgcgcattctcgctgctgggccagcggctgatgcgccggatcgaacgcatgcccaagccggtgatcgcgatgatcaatggcttcgcgctggggggcggcctggagctggcgatggcgtgccacctgcgcatcgccgcagcaacagcgcgcctggggcaaccggaaatcaatctcggcctgatccctggctttggcggcacgcagcgcctgctgcgtctgaccggccgcgccgcagcgctggaactgtgcctgctcggcctgccgatcgacgcagcccgcgcactgcaactgggcctggtcaatcgcgtggtcgaagcggatgccttgcacgaagagacgctggcgctcgcgcaacgcctggcaaacgcggcgccgctggcgctgcgcggcattctcgatgcggtgatgttcggcggcgaatgcgccatcgaagaaggcctgcagctggaagccgcgcaatttgcgttgttattcgccactgacgatatgcgcgaaggcactcgcgcgtttctcgacaaacgccctgcacagttccgcaatcgttga

SEQ ID NO: 2609 - protein, 260 aa, Xanthomonas axonopodis pv. citri str. 306
MSNHVILIADHASVRTITVNRPDKLNALNQATMQALDQAFQDAAAADDVRAVILTGAGPKAFVAGADIAEMSDLSAIQGRAFSLLGQRLMRRIERMPKPVIAMINGFALGGGLELAMACHLRIAAATARLGQPEINLGLIPGFGGTQRLLRLTGRAAALELCLLGLPIDAARALQLGLVNRVVEADALHEETLALAQRLANAAPLALRGILDAVMFGGECAIEEGLQLEAAQFALLFATDDMREGTRAFLDKRPAQFRNR

SEQ ID NO: 2610 - DNA, 762 bp, Brucella suis 1330
  CDS (1)..(762): transl_table=11
gtgtcggtcgaacgacatgcggatggggtcgcaacagtccggatcaacaggccggaagcgaggaacgcgctcaacctgacgacgcgccagcaactggctgaacatttccgcgccttgtcgggggatgaaagcgtgcgcgccatcgtgctgacgggcggggaaacctgctttgtggccggtgccgatgttcgcgaattcgcttccgccggtcccatcgaaatgtatcttcgccatacggaatatctttgggatgccatcgcttcctgtgcgaagcctgtcatcgctgcggtcaacggttatgcgctgggcgggggctgtgagcttgccatgcattgcgacatcatcgtcgcaggtgagggcgcggtgtttggccagcctgaagtgaagcttggcctcatgccgggtgccggcggcacgcagaggctcatccgtgcggtcgggaaattccaggccatgcgcattgcgctgacgggctgtatggttcccgcagccgaggcgctgtcgattggcatgatcagcgaaatgaccgccaatgaaaggacattgccgcgcgcgcatgaactggctgtggaaattgcgcggctgcccgcgctcgccgttgcgcagatcaaggaagtgatgctcgtcggcgccgatctgccgctggatggcgcattggcgcttgaacgaaaggctttccagcttctgttcgattcgaaagaccagaaagagggcgcagccgctttcctcgaaaaacgcaaacctgcctataacggacgctag

SEQ ID NO: 2611 - protein, 253 aa, Brucella suis 1330
MSVERHADGVATVRINRPEARNALNLTTRQQLAEHFRALSGDESVRAIVLTGGETCFVAGADVREFASAGPIEMYLRHTEYLWDAIASCAKPVIAAVNGYALGGGCELAMHCDIIVAGEGAVFGQPEVKLGLMPGAGGTQRLIRAVGKFQAMRIALTGCMVPAAEALSIGMISEMTANERTLPRAHELAVEIARLPALAVAQIKEVMLVGADLPLDGALALERKAFQLLFDSKDQKEGAAAFLEKRKPAYNGR

SEQ ID NO: 2612 - DNA, 819 bp, Corynebacterium efficiens YS-314
  CDS (1)..(819): transl_table=11
atgaccaactccatcacctccatcacagagcaggacaccgctgtcggtttcgagaccatcaccgcggaggccaccgaccgcatcggtgtcatcaccatcaaccgcccggagaagcgcaatgcgctgtccaagacggtgctcgcggagatcggccgggtcctggacacctgggaggaggaccccgatgtgcaggcggtcatcttcaccggtgccggtgagaaggcgtttgtggcgggtgcggatatctcccagctggcccactatgacctccactatggcctggctgcccatatgcagaagctctatgaccggatcgaggactaccccaaaccgacgatcgcggccatcaacggtgtcgcactcggtggcgggctggaactggccatgagctgtgacatccggatcgtctccgagaacgccaaggtgggtctgccggaggccaccctgggtgtgctgcccggtgcgggtggcccccagcgactgtcgcgcctggtgggcaagggccgtgcggtggagatgatcctcacctcccgcgtcctgaccgcccagcaggcactggactacgggctggccacggaggtacacccgctggctgagcttgtcgacgccgcccgcaccacggccggcaccatcctgagcaagggtccactggcggtgcagctggccaaactggtcatcggcaacggtgcggagaccgatcagcgcaccggtctgctgctggagcgtctcgcccagaccctgctgtacaccaccgaggacaaggccgagggcgcggatgcgttcctgaacaagcggacaccggaattcaaggggaattaa

SEQ ID NO: 2613 - protein, 272 aa, Corynebacterium efficiens YS-314
MTNSITSITEQDTAVGFETITAEATDRIGVITINRPEKRNALSKTVLAEIGRVLDTWEEDPDVQAVIFTGAGEKAFVAGADISQLAHYDLHYGLAAHMQKLYDRIEDYPKPTIAAINGVALGGGLELAMSCDIRIVSENAKVGLPEATLGVLPGAGGPQRLSRLVGKGRAVEMILTSRVLTAQQALDYGLATEVHPLAELVDAARTTAGTILSKGPLAVQLAKLVIGNGAETDQRTGLLLERLAQTLLYTTEDKAEGADAFLNKRTPEFKGN

SEQ ID NO: 2614 - DNA, 774 bp, Pseudomonas putida KT2440
  CDS (1)..(774): transl_table=11
atggcattcgaaaccatcctgttggacatccacggcaaggttggcctgatcaccctcaaccggccgcaggcgctcaatgcgctgaacgcgcagattgtcggcgagatcaaccaggctctggaccagctcgagcgcgacccgaacatcggctgcgtggtgctgacaggctcggccaaagcctttgccgctggcgccgacatcaaggaaatggccgagctgcaatacccgcagatctacgtcgacgacctgttcagcgacgctgaccgcatcgccaatcgccgtaagccgatcattgctgctgtgtctggatttgccttgggcggcggctgtgagctggcgatgatgtgcgactttatcctcgctgcggacaatgccaaatttggtcaaccggaaatcaacctgggcgtgctgccgggcatgggcggcacccagcgcctgacgcgtgcggtgggcaaggccaaggccatggagctttgcctgaccggccgcctgatgggcgcggaagaagccgagcgtgcaggcctggtggcgcggatcgtgccgcaggcagagctggtggaagaggcgctgaaggtggcggcgaccattgccagcaagtcgattccggtgagcatgatggtcaaggagagcgtcaaccgggcatttgaagtcaccctcagcgagggggttcgctttgagcgtcgggtcttccatgcggctttctccaccgaagaccagaaagaaggcatggccgcattcatcgccaagcgtgaggcacagttcaaggaccgttga

SEQ ID NO: 2615 - protein, 257 aa, Pseudomonas putida KT2440
MAFETILLDIHGKVGLITLNRPQALNALNAQIVGEINQALDQLERDPNIGCVVLTGSAKAFAAGADIKEMAELQYPQIYVDDLFSDADRIANRRKPIIAAVSGFALGGGCELAMMCDFILAADNAKFGQPEINLGVLPGMGGTQRLTRAVGKAKAMELCLTGRLMGAEEAERAGLVARIVPQAELVEEALKVAATIASKSIPVSMMVKESVNRAFEVTLSEGVRFERRVFHAAFSTEDQKEGMAAFIAKREAQFKDR

SEQ ID NO: 2616 - DNA, 774 bp, Pseudomonas putida KT2440
  CDS (1)..(774): transl_table=11
atgccgcgatatatcgatgtgcaggcgcccgaacatggcgttcagctcattaccctgcaacggcccgaggccttgaatgccctgtgcaccgagctactggcagaactggccgctgcgctgcaggctgccgggaacgacgagcatgtccgtgccacagtgattaccggcagcgccaaggcattcgccgcaggcgccgacatccgcgagatggccgatcgcgacctggtcggcatcctcaatgacccgcgcgtagcgcattggcaaagcatcgccgcattcgccaaaccgctgattgctgcagtcaacggctatgccctgggtggcggttgcgaactggcaatgtgcgccgacatcgtcatcgccagtaccgacgcccgtttcggccagccggaaatcaaccttggcatcatccccggtgctggcggcacccagcgcctgttacgtgccgtcggtaagccgttggccatgcagatggtgctgacgggggaagccatcactgccctccgcgcccagcaggccggcctggtcagcgaaatcacccagcccgaactcaccgtagaacgcgccatgcaggttgcccgcagcatcgccgccaaagcgccgctggctgtgcgcctggccaaggaggcgttactgaaggccggtgataccgacctggccagcggcctgcgcttcgagcgccatgccttcaccctgctggcgggcaccgccgaccgcgatgaaggcatccgcgccttccaggaaaagcgccaggcccgcttccaagggcgctga

SEQ ID NO: 2617 - protein, 257 aa, Pseudomonas putida KT2440
MPRYIDVQAPEHGVQLITLQRPEALNALCTELLAELAAALQAAGNDEHVRATVITGSAKAFAAGADIREMADRDLVGILNDPRVAHWQSIAAFAKPLIAAVNGYALGGGCELAMCADIVIASTDARFGQPEINLGIIPGAGGTQRLLRAVGKPLAMQMVLTGEAITALRAQQAGLVSEITQPELTVERAMQVARSIAAKAPLAVRLAKEALLKAGDTDLASGLRFERHAFTLLAGTADRDEGIRAFQEKRQARFQGR

SEQ ID NO: 2618 - DNA, 780 bp, Bradyrhizobium japonicum USDA 110
  CDS (1)..(780): transl_table=11
atgagcacgttcgaacacatcatcgtcgaaagccaaggcgcggtcggcatcatcaagctgaaccggccgaagatgctcaatgcgctctccttcggcgtcttccgcgagattgcggccgccgtcgacgatctcgagggcgatgatgccatcggctgcatcgtcgtgaccggcagcgagaaggcctttgccgccggcgccgacatcaaggagatgcagccgaagggcttcatcgacatgttctccgaggatttcgccgcgatcggcggcgaccgcgttgcgcgctgccgcaagccgaccatcgccgctgttgcgggctacgcgctcggcggcggctgcgagctcgccatgatgtgcgacttcatcatcgccgccgacaccgccaagttcggccagcccgaaatcacgctcggcaccattcccggcatcggcggcacccagcgcctgacccgcgcgatcggcaagtccaaggcgatggacctctgcctcaccggccgcatgatggatgcggcggaagccgagcgaagcggcctcgtcagccgcatcgtgcccgccgacaagctcatggacgaggtgatggcggccgccgaaaagatcgcgtcgatgtcacggcccgccgtcgccatggccaaggaagcggtgaaccgcgccttcgagaccacgctcgccgagggcatgagcgtcgagcgcaacctgttccactcgaccttcgcgctggaagaccgctccgagggcatggccgcgttcatcgagaagcgcaagccggtgaacaagaaccgctga

SEQ ID NO: 2619 - protein, 259 aa, Bradyrhizobium japonicum USDA 110
MSTFEHIIVESQGAVGIIKLNRPKMLNALSFGVFREIAAAVDDLEGDDAIGCIVVTGSEKAFAAGADIKEMQPKGFIDMFSEDFAAIGGDRVARCRKPTIAAVAGYALGGGCELAMMCDFIIAADTAKFGQPEITLGTIPGIGGTQRLTRAIGKSKAMDLCLTGRMMDAAEAERSGLVSRIVPADKLMDEVMAAAEKIASMSRPAVAMAKEAVNRAFETTLAEGMSVERNLFHSTFALEDRSEGMAAFIEKRKPVNKNR

SEQ ID NO: 2620 - DNA, 783 bp, Clostridium tetani E88
  CDS (1)..(783): transl_table=11
atggattttaaaaatcttatccttgaaaaggatggtaaaatagcggttttaacaattaatagacctgatgctctaaacgctttaaatagtgaactgctaaaagaactagattatgctattgactgtctagcagaagatgatgaagtattagcagtagtacttacaggagcaggaaaagcttttgtagctggtgcggatataggagagatgaaagatcttactgtaagtgaaggtagaaaatttggagtacttggaaatagagtattcagaaagttggaaaccttagaaaaaccagttattgcagcagtaaatggattcgctttaggcggaggttgtgaaatatccatggcttgtgatataagaattgcttctgaaaaggctaaatttggacaaccggaagttgggctaggaataacccctggatttggtggaactcaaaggttacctagattagttggaccagcagtagccaaagaattaatatatacagcagatataattggtgcagaagaggcattaagaataggattaattaataagatagtagaaaaggatgaacttttagataaagctaaagaaatggctaataagatagctaataatgctcctatagctataaaactatgtaagtcagctataaacagaggagtacaatgtgatatagatacagggatagcttttgaagcagaagtatttggagaatgcttctctacagaagaccaaaaagaaggtatgacagcatttcttgaaaaaagaaaagataaatgcttcaaaaatagatag

SEQ ID NO: 2621 - protein, 260 aa, Clostridium tetani E88
MDFKNLILEKDGKIAVLTINRPDALNALNSELLKELDYAIDCLAEDDEVLAVVLTGAGKAFVAGADIGEMKDLTVSEGRKFGVLGNRVFRKLETLEKPVIAAVNGFALGGGCEISMACDIRIASEKAKFGQPEVGLGITPGFGGTQRLPRLVGPAVAKELIYTADIIGAEEALRIGLINKIVEKDELLDKAKEMANKIANNAPIAIKLCKSAINRGVQCDIDTGIAFEAEVFGECFSTEDQKEGMTAFLEKRKDKCFKNR

SEQ ID NO: 2622 - DNA, 774 bp, Pseudomonas syringae pv. tomato str. DC3000
  CDS (1)..(774): transl_table=11
atggattacgagacaatcctcagtgaggttgtaggcagcgtcgggctggtcactttgaaccgtcccaaggccctgaacgcactgaatgctcgtctgatcgacgagttgaaccacgcgcttgaccagttcgaggcggacagcgccattggctgtatcgtgctgaccggcacgcaaaaagccttcgctgcgggggctgacatcaaggaaatggtcgagctctcctacccgcagatctacctcgatgacctgtttcgtgaaagtgaccgcgtggccgcgcggcgtaaaccgatggtcgcggccgtggccggtttcgcgctgggcggtggctgtgaattggcactgatgtgtgacttcattctggctgccgaaaacgccaggtttggtcaaccggagatcaacctcggcgtgttaccgggcatgggcgggacgcaacgtctgacccgtgcggttggcaaggccaaggcaatggaaatgtgcctgacaggccgcctgatcgacgcccatgaagccgagcgcgcgggtctggtgtcccgcgtcttgccgcttgaccagctactgcccgaagcacttgcagtggccgccaccatcgccgcgaaatcgctgccggtggcgatgatggtcaaggagagcgtcaaccgcgcttttgaggtgagcctggctgaaggtatccgtttcgagcgccgggtgttccatgcggccttcgccagtcacgaccagaaagaaggcatgcaagcgtttatcgacaagcgccagccggatttcaaggactgttag

SEQ ID NO: 2623 - protein, 257 aa, Pseudomonas syringae pv. tomato str. DC3000
MDYETILSEVVGSVGLVTLNRPKALNALNARLIDELNHALDQFEADSAIGCIVLTGTQKAFAAGADIKEMVELSYPQIYLDDLFRESDRVAARRKPMVAAVAGFALGGGCELALMCDFILAAENARFGQPEINLGVLPGMGGTQRLTRAVGKAKAMEMCLTGRLIDAHEAERAGLVSRVLPLDQLLPEALAVAATIAAKSLPVAMMVKESVNRAFEVSLAEGIRFERRVFHAAFASHDQKEGMQAFIDKRQPDFKDC

SEQ ID NO: 2624 - DNA, 828 bp, Bordetella pertussis Tohama I
  CDS (1)..(828): transl_table=11
gtgtcgttcatgcgcatatcttacatttcatactctgacaggaggcaatcaatgagcgagtcgtttgtgctggtcgaaacccggggccgcgtgggatggctgacgctgaaccggcccaaggcattgaatgcgctgaacgaccagttgatggaggaactgggcgcggcgttgctggcgctcgacgccgacgacggcatcggcgcgatcgtgatcaccggcagcgagaaagccttcgccgcgggcgcggatatcggcgccatgaaagactggtcctacatggacgtctaccgcagcgactacatcacccgcaactgggaaaccataaagcgcgtacgcaagcccgtgatcgccgcggtggccggctatgcgctgggcggcggctgcgaactggccatgatgtgcgacatcgtcatcgccgccgactcggcccgcttcggccagcccgagatcaagctgggcgtgattcccggcgccggcggcacgcagcgcctgccgcgcgcggtgggcaaggccaaggccatggacctggcgctgacggcgcgcatgatggatgccgcggaggccgagcgggccggcctggtatcgcgcgtggtgccggccgacaggctggcggatgaggcgctcgaggccgccaccgtcatcgcctcgatgtcgctgccgtcggtcatgatggccaaggagtgcatcaaccgcgcgtacgaagtgccgctcaacgatgggttgctgttcgagcgccgcgtgttccactcgctgttcgccaccgaagaccagaaagagggcatggcggcgttcaccgagaagcgcaagcctgacttcaagcacaggtag

SEQ ID NO: 2625 - protein, 275 aa, Bordetella pertussis Tohama I
MSFMRISYISYSDRRQSMSESFVLVETRGRVGWLTLNRPKALNALNDQLMEELGAALLALDADDGIGAIVITGSEKAFAAGADIGAMKDWSYMDVYRSDYITRNWETIKRVRKPVIAAVAGYALGGGCELAMMCDIVIAADSARFGQPEIKLGVIPGAGGTQRLPRAVGKAKAMDLALTARMMDAAEAERAGLVSRVVPADRLADEALEAATVIASMSLPSVMMAKECINRAYEVPLNDGLLFERRVFHSLFATEDQKEGMAAFTEKRKPDFKHR

SEQ ID NO: 2626 - DNA, 777 bp, Bordetella bronchiseptica RB50
  CDS (1)..(777): transl_table=11
atgagcgagtcgtttgtgctggtcgaaacccggggccgcgtgggatggttgacgctgaaccggcccaaggcattgaatgcgctgaacgaccagttgatggaggagctgggcgcggcgttgctggcgctcgacgccgacgacggcatcggcgcgatcgtgatcaccggcagcgagaaagccttcgccgcgggcgcggatatcggcgccatgaaagactggtcctacatggacgtctaccgcagcgactacatcacccgcaattgggaaaccataaagcgcgtacgcaagcccgtgatcgccgcggtggccggctatgcgctgggcggcggctgcgaactggccatgatgtgcgacatcgtcatcgccgccgactcggcccgcttcggccagcccgagatcaagctgggcgtgattcccggcgccggcggcacgcagcgcctgccgcgcgcggtgggcaaggccaaggccatggacctggcgctgacggcgcgcatgatggatgccgcggaggccgagcgggccggcctggtatcgcgcgtggtgccggccgacaggctggcggatgaggcgctcgaggccgccaccgtcattgcctcgatgtcgctgccgtcggtcatgatggccaaggagtgcatcaaccgcgcgtacgaagtgccgctcaacgatgggttgctgttcgagcgccgcgtgttccactcgctgttcgccaccgaagaccagaaagagggcatggcggcgttcaccgagaagcgcaagcctgacttcaagcacaggtag

SEQ ID NO: 2627 - protein, 258 aa, Bordetella bronchiseptica RB50
MSESFVLVETRGRVGWLTLNRPKALNALNDQLMEELGAALLALDADDGIGAIVITGSEKAFAAGADIGAMKDWSYMDVYRSDYITRNWETIKRVRKPVIAAVAGYALGGGCELAMMCDIVIAADSARFGQPEIKLGVIPGAGGTQRLPRAVGKAKAMDLALTARMMDAAEAERAGLVSRVVPADRLADEALEAATVIASMSLPSVMMAKECINRAYEVPLNDGLLFERRVFHSLFATEDQKEGMAAFTEKRKPDFKHR

SEQ ID NO: 2628 - DNA, 777 bp, Rhodopseudomonas palustris CGA009
  CDS (1)..(777): transl_table=11
ttgtcgtccaatcctatcctcaccgaaacccagggccgggtcggcatcatcacgctgaaccggccggatgtgctcaacgcgctcaacgatgccctgatggatgcgctcggcggcgcgctgctggcgttcgacgccgacgacggcatcggcgcgatcgtgatcgccggcaatacccgggccttcgcggccggcgccgacatcgcctcgatggcagcatggagctatagcgacgtctatggctcgaacttcatcacccgcaattgggaaacgatccgccaaatacggaagccggtgctggccgcggttgccggcctcgcctatggcggcggctgcgagctggcactcgcctgcgacatcgtgatcgctggccgcagcgccaagttcgcgctgccggaaatcaagctcggcctgctgcccggcgccggcggcacgcaacgattgccgcgcgcgatcggtaaggccaaggcgatggacatgtgcctgtcggcgcggccgctcaacgccgaagaggccgatcgctatggtctggtctcccgcgtcgtcgatgacgacaggctgcgtgacgagaccgtcgcgctggccaccacgatcgcggcgttctccgctccggcgctgatggcgctgaaggaaagcctcaatcgcgccttcgaaagcacgctcgccgaaggcatcctgttcgaacgccgcgaactgcatgcccgcttcgccagtgccgacgcccgcgagggcattcaggcgttcctggagaagcgcgcaccgtgcttctcccaccgctag

SEQ ID NO: 2629 - protein, 258 aa, Rhodopseudomonas palustris CGA009
MSSNPILTETQGRVGIITLNRPDVLNALNDALMDALGGALLAFDADDGIGAIVIAGNTRAFAAGADIASMAAWSYSDVYGSNFITRNWETIRQIRKPVLAAVAGLAYGGGCELALACDIVIAGRSAKFALPEIKLGLLPGAGGTQRLPRAIGKAKAMDMCLSARPLNAEEADRYGLVSRVVDDDRLRDETVALATTIAAFSAPALMALKESLNRAFESTLAEGILFERRELHARFASADAREGIQAFLEKRAPCFSHR

SEQ ID NO: 2630 - DNA, 780 bp, Rhodopseudomonas palustris CGA009
  CDS (1)..(780): transl_table=11
atgagcacattcgaattcatcatcgtcgagcgtcaaaacgcggtcggcatcatcaagctcaaccgcccgaagatgctgaatgcgctgtcgttcggcgtgtttcgcgagatcggcgcagcggtcgaggatctcgaggccgacgatgcgatcggatgcatcctgatcaccggcagcgagaaggcgttcgccgccggcgccgatatcaaggagatgcagccgaagggtttcatcgacatgttcaacgaggacttcacttcgatcggcggtgaccggctcgcgcgctgccgcaagccgaccgtcgccgcggtcgccggctacgcgctcggcggcggctgcgaattggcaatgatgtgcgacatcattatcgccgccgacaccgccaagttcggtcaaccggaaatcacgctgggcaccattccgggcatcggcggcacccagcgtctcacccgcgctatcggcaagtacaaggcgatggacctgtgcctcaccggacggatgatggacgcgcaggaagccgagcgctcgggtctggtcagccgcatcgtgccggccgacaagctaatggaagaagcgctcggcgccgccgaaaagattgccacgatgtcgcgccccaccgcagcgatggccaaaagcgcggtgaaccgggcgctggaaactacgctcgccgaaggtctcgccgtcgagcgcgacctgttccgatcgaccttcgcgctggaagaccgcgccgagggcatggcggcgttcatcgaaaagcgcaagccgaacaaccagaaccgctga

SEQ ID NO: 2631 - protein, 259 aa, Rhodopseudomonas palustris CGA009
MSTFEFIIVERQNAVGIIKLNRPKMLNALSFGVFREIGAAVEDLEADDAIGCILITGSEKAFAAGADIKEMQPKGFIDMFNEDFTSIGGDRLARCRKPTVAAVAGYALGGGCELAMMCDIIIAADTAKFGQPEITLGTIPGIGGTQRLTRAIGKYKAMDLCLTGRMMDAQEAERSGLVSRIVPADKLMEEALGAAEKIATMSRPTAAMAKSAVNRALETTLAEGLAVERDLFRSTFALEDRAEGMAAFIEKRKPNNQNR

SEQ ID NO: 2632 - DNA, 753 bp, Rhodopseudomonas palustris CGA009
  CDS (1)..(753): transl_table=11
atggtggtggaagtcgatcgtcagggagccgtcggcatcgtcacgctgaacctgccggaggcccgcaacgcgttgtcgcgagaaatgatcagggcactggccgccgcgctcgatgagctggaacgtgatgccgcgatcgccgcgatcgtgctctccggccgcgaggtgttctgcgccggcgctgacatcgccgagatgcgcggcatcgatctcgccacggtgctggccgaggatttttccggctgctgcgaccggttggccacctgcgccaagccgctgatcgcggcggtcgaaggttacgcgatcggtggcggctgcgagttgatcgagatgtgcgacctggtgatcgctggcatcggtgccaagttcggtcacccagagatcgcgttcggtacgctatcgggcggtggtggcacgcagcggctggcacgagcggtgggccgggcccgcgcgatggatctgatcctgaccggccgtctgatctccgcgatcgaggccgagcggatcgggctgatcagccgcgtggtcgaagacggcgaagctcaccaagccgcccgcgaggcggccaagctgattgcggcgcatccagtgcgcgcggtgcgattcgccaagcaggctgtcgaccgtgcggtctcggccgggctcgcggacgggctggcgttggagcggcggctgtttcacctcagctttgcgaccggcgaactaccgccacggctcgatcgttttctgacgcggcgaagtccgcgccgctga

SEQ ID NO: 2633 - protein, 250 aa, Rhodopseudomonas palustris CGA009
MVVEVDRQGAVGIVTLNLPEARNALSREMIRALAAALDELERDAAIAAIVLSGREVFCAGADIAEMRGIDLATVLAEDFSGCCDRLATCAKPLIAAVEGYAIGGGCELIEMCDLVIAGIGAKFGHPEIAFGTLSGGGGTQRLARAVGRARAMDLILTGRLISAIEAERIGLISRVVEDGEAHQAAREAAKLIAAHPVRAVRFAKQAVDRAVSAGLADGLALERRLFHLSFATGELPPRLDRFLTRRSPRR

SEQ ID NO: 2634 - DNA, 792 bp, Mycobacterium avium subsp. paratuberculosis K-10
  CDS (1)..(792): transl_table=11
atgacagacagcaccgaccgcaccttcgaaaccatcctcgtcgagcgcgaggagcgcgtcggcatcatcaccctgaaccggcccaaggcgctcaacgcgctcaacacccaggtgatgaacgaggtcaccgccgcggcaacggatttcgacgccgaccccggcatcggcgcgatcatcatcaccggatcggccaaggcgttcgccgcgggcgcggacatcaaggagatggccgagctgaccttcgccgacgcctacggcgccgacttcttcgccccctggggcaagctcgccgcggtgcgcaccccgacgatcgccgcggtggccgggcacgccctcggcggcggctgcgagctggccatgatgtgcgacgtgctgatcgccgccgacacggcgaaattcggccagcccgagatcaaactcggggtgctgcccggcatgggcggatcgcagcggctgacccgcgccatcggcaaggccaaggcgatggacctgatcctgaccggccgcaccatcgacgccgcggaagccgaacgcagcggcctggtttcgcgcgtggtgcccgccgacgacctgctgaccgaggccaagaaggtcgccaccacgatttcgcagatgtcccggtcggcagcccggatggccaaggaggccgtcaaccgcgctttcgaaaccaccctggccgagggactcctctacgaacgccggttgttccattcgactttcgccaccgccgaccagaccgaggggatggcggccttcgtcgagaagcgcgcgccgaacttcacccaccgctag

SEQ ID NO: 2635 - protein, 263 aa, Mycobacterium avium subsp. paratuberculosis K-10
MTDSTDRTFETILVEREERVGIITLNRPKALNALNTQVMNEVTAAATDFDADPGIGAIIITGSAKAFAAGADIKEMAELTFADAYGADFFAPWGKLAAVRTPTIAAVAGHALGGGCELAMMCDVLIAADTAKFGQPEIKLGVLPGMGGSQRLTRAIGKAKAMDLILTGRTIDAAEAERSGLVSRVVPADDLLTEAKKVATTISQMSRSAARMAKEAVNRAFETTLAEGLLYERRLFHSTFATADQTEGMAAFVEKRAPNFTHR

SEQ ID NO: 2636 - DNA, 777 bp, Gibberella zeae PH-1
  CDS (1)..(777)
atggaccagcaactcatcctcccttccactcccgcagacggcgtacgcgtcctcgcgttaaacagaccctccaagcgaaacgccctctcgcaggaactcataaccgtctttctggaacagctcaagacagcatcccaagacgatggcgtgcgagtcattgtcatcactggcagctcgactttcttttgcgccggagctgatatcggggagatctcacgcctcgatgcggaaggcgcgcgggactgccgctacttgtcggatctttgtacggggatgcaagccgtgcgcaagcctttgatagcggctgttgagggaatggcgctcggtgggggcttcgagcttgctctcatgtgcgacctgatttttgcagcgcatgacagtcgatttggtctcccagaggtctcaattggtcttatccctggtgctggcggtacacagcggcttaccaacgccgtaggaaagttcaaggccatgcagatgatccttcttggacgtcccatacaagcagaagaggctcagtctgcaggactagttgcgcagctctatgaaagcggcagcgtcttggacaacgtggtgaaagacacggcatcgacgcttgcggcgctaagccccacggccttgggcttggctaaggaagcaatctgcaaatcggatgatttgggggttgatcacgagttcgagaggagtttgtattactttgcttttgggaccaaggataaagaagagggtgtccgagccttcctggagaagaggaagcctgagtggacgtccaagtaa

SEQ ID NO: 2637 - protein, 258 aa, Gibberella zeae PH-1
MDQQLILPSTPADGVRVLALNRPSKRNALSQELITVFLEQLKTASQDDGVRVIVITGSSTFFCAGADIGEISRLDAEGARDCRYLSDLCTGMQAVRKPLIAAVEGMALGGGFELALMCDLIFAAHDSRFGLPEVSIGLIPGAGGTQRLTNAVGKFKAMQMILLGRPIQAEEAQSAGLVAQLYESGSVLDNVVKDTASTLAALSPTALGLAKEAICKSDDLGVDHEFERSLYYFAFGTKDKEEGVRAFLEKRKPEWTSK

SEQ ID NO: 2638 - DNA, 789 bp, Gibberella zeae PH-1
  CDS (1)..(789)
atggacaatcttacagacctcaagctctcagtcaacgaggaaacaggtgttgcaaccattcagttcaacagacctgcaaagcgcaatgcgtttgcgcaaaagacaattgatgagatggtggccactttggcctacctcgactcagtggatactgtccgcgccgttgttctgactggtggaccagagggccatttctgcgctggaatggatctcaatgagcttgttgagctttccacttccaaagctcatcagattgcctttctcaaggacctcacagatgctcttgatcgattcaccaagcccatcatcgctgctgttgtaggctatgcgcttggcggtggttttgagatttcgcttgcatgcgacatcatctacgccgccgaagatgccatgtttggtcttcccgaggtaaagattggaacgatccctggagccgggggtacacagcgcctggctcgtgctcttggcaagcacaaggcaatggaattcgtcctcaccggcgaacctgccagcggcgcagaattcgagcggcttggagtggtaaccaaggttttccccaaggcggatgtgttgtcttccgcaacagcccttgccgaaaagattgcaaggctctctggtccagtcatcaagacggcgaagcaagctgtgttgacagtggaaaacagcaccctgagcgctggcatgacccatgaaaaggccctgtactactcgactttcggcctaaacgatttccaggagggcattcagtcattcctccagaagagagcgcctacattcaagcattcttga

SEQ ID NO: 2639 - protein, 262 aa, Gibberella zeae PH-1
MDNLTDLKLSVNEETGVATIQFNRPAKRNAFAQKTIDEMVATLAYLDSVDTVRAVVLTGGPEGHFCAGMDLNELVELSTSKAHQIAFLKDLTDALDRFTKPIIAAVVGYALGGGFEISLACDIIYAAEDAMFGLPEVKIGTIPGAGGTQRLARALGKHKAMEFVLTGEPASGAEFERLGVVTKVFPKADVLSSATALAEKIARLSGPVIKTAKQAVLTVENSTLSAGMTHEKALYYSTFGLNDFQEGIQSFLQKRAPTFKHS

SEQ ID NO: 2640 - DNA, 1041 bp, Yarrowia lipolytica CLIB122
  CDS (1)..(1041)
atgcgaagcctatatataaacgttccgggtctttttccttccacctctctagcacgagaaacagtccaccacagaacagaaatgctccgaaccatccgatcttcctctcgacttggcgtccgagccatgtctaccgctgccacccgacgagctgcccagattggcttccacacccgagtccccactgtcgtcaccaaggcccccaccctccgaatgcagaccacccctttctcttcctctgctcccgcccagacctttggtgacaagaagtacgagcacatcctgacctccacccccgtccccaaggtcgctctcgtcaccctcaaccggcccaaggccctcaacgccctgtgcactcctctcattaaggagctgaacgaggctctccaggctgctgatgccgaccccaccattggcgccatcgttctcaccggatccgagaagtcctttgctgccggcgccgacatcaaggagatgaaggacaagaccgtcacttccgtgctcaacgagaacttcatcgaggagtggggcaacatggccaacatcaagaaacccatcattgctgccgtcaacggctttgccctcggtggtggatgcgagcttgccatgatggccgacatcatctacgccggcgccaaggccaagtttggccagcccgagatcaagcttggtgtcattcccggagctggaggaacccagcgactcacccgagccattggcctctaccgagctaaccactacattcttaccggagagatgttcactgctcagcaggctgctgactggggtctggccgccaaggtctacgagcccgcccagctcgttgacgagtccgtcaaggctgctgctcagatcgcctcttacggccagttggctgtccaggccgccaaggcttctgtccaccagtccgctgaggtcggtctccgagccggtctcgagtttgagcgagtccgattccacggtctctttggcacccacgaccagaaggagggcatggctgcttttgccgagaagcgagagcccaacttcaagaacgagtaa

SEQ ID NO: 2641 - protein, 346 aa, Yarrowia lipolytica CLIB122
MRSLYINVPGLFPSTSLARETVHHRTEMLRTIRSSSRLGVRAMSTAATRRAAQIGFHTRVPTVVTKAPTLRMQTTPFSSSAPAQTFGDKKYEHILTSTPVPKVALVTLNRPKALNALCTPLIKELNEALQAADADPTIGAIVLTGSEKSFAAGADIKEMKDKTVTSVLNENFIEEWGNMANIKKPIIAAVNGFALGGGCELAMMADIIYAGAKAKFGQPEIKLGVIPGAGGTQRLTRAIGLYRANHYILTGEMFTAQQAADWGLAAKVYEPAQLVDESVKAAAQIASYGQLAVQAAKASVHQSAEVGLRAGLEFERVRFHGLFGTHDQKEGMAAFAEKREPNFKNE

SEQ ID NO: 2642 - DNA, 975 bp, Ustilago maydis 521
  CDS (1)..(975)
atggagccgatggtgctttgcagcgtgaagtcagaagatttgtttcgcgacaccatcatcttcccgtcccgtagctcgcacaagatgttggcctcaaccgttcgcaccgcgcttcgcaccagcgcgccccgcatcgctgcgctcccctccacacgctgcctgtccacctcgctgccgcgtctttcgtcggcaactgccaaggaataccaaaacatcctcgtctcgtcgcccgccaaaggcgttacgctgatcacgttgaaccgacctaaggcgctgaatgcactcaattcggcgctcttccacgaactcaacgaagccaccgagatcgccgacaatgaccctgaggtcggagctatcgtcctcaccggatccgaaaaggcgttcgctgcgggcgccgatatcaaggagatgaaggacaagcagtacgctgatgcatacaagaccaacttcttgggtcactggaccaagctcaccacggtgcgcaaaccgatcattgctgctgtgagcgggttcgcccttggtggtggttgcgagttggccatgatgtgcgatatcatcctcgcttcgcccacagccaactttggtcaacctgagatcaacctcggcgtcattcctggcgccggtggcacgcaacgtctcaccaaagctgttggaaaatccaccgccatggagatggtactcacgggccgcaactttagcgccgatgacgccgagcgtcgcggcttgatctcgcgcgtcgttcgcgagggaagcgtcgttgatgaagccgtcaaggtcgcttccaccattgccaaaaagggtcagatcgctgtccaggccgccaaggaaggtgtcaatgcctccttcgagctgagcttgcaagagggaactcgcttcgaacgccgtctcttccagagtctattcgctaccaaagatcagaaagaaggcatggcggctttcgccgaaaaaaggaaggccaactttacgcacgagtaa

SEQ ID NO: 2643 - protein, 324 aa, Ustilago maydis 521
MEPMVLCSVKSEDLFRDTIIFPSRSSHKMLASTVRTALRTSAPRIAALPSTRCLSTSLPRLSSATAKEYQNILVSSPAKGVTLITLNRPKALNALNSALFHELNEATEIADNDPEVGAIVLTGSEKAFAAGADIKEMKDKQYADAYKTNFLGHWTKLTTVRKPIIAAVSGFALGGGCELAMMCDIILASPTANFGQPEINLGVIPGAGGTQRLTKAVGKSTAMEMVLTGRNFSADDAERRGLISRVVREGSVVDEAVKVASTIAKKGQIAVQAAKEGVNASFELSLQEGTRFERRLFQSLFATKDQKEGMAAFAEKRKANFTHE

SEQ ID NO: 2644 - DNA, 792 bp, Bacillus thuringiensis serovar konkukian str. 97-27
  CDS (1)..(792): transl_table=11
atgaaaaatgaacgattagtaatatgcagtaagaaagggagtagtgcagtcattacaattcaaaacccaccagtcaacgctttaagtttagaagtagtgcaacaattaataaatgtattagaggaaatagagatggacgatgatattgcagtcgtaattataactggaattggggggaaagcgtttgtagctggaggggatataaaagaatttccaggttggataggaaaaggtgaaaaatatgctgagatgaaatcaatagaattacaaaggcctcttaatcaactagagaatttgtctaaaccaactatagctgctattaatgggttagcactaggcggaggttgtgaattagcacttgcttgtgatttaagagtaatagaagaacaagccttaattggattaccagaaattacgttaggtctatttcctggggctggaggaactcagcgcttacctagattaattggagaaggaaaagcaaaagagatgatgttcacaggaaaaccaattacagcgaaagaagcaaaagaaataaatttagttaactacattacctctcgaggagaggcgttaaataaagcaaaagagattgctaaagatataagtgaattttctcttccagcactttcctatatgaagttagcaattcgtgaaggtttggcagtacctttacaagaagggcttcagatcgaagcgcgttattttgggaaagtgtttcaaacagaagatgtgaaggagggggtaaaggcatttattgaaaaaagagtaccgcgtttcaccaataaataa

SEQ ID NO: 2645 - protein, 263 aa, Bacillus thuringiensis serovar konkukian str. 97-27
MKNERLVICSKKGSSAVITIQNPPVNALSLEVVQQLINVLEEIEMDDDIAVVIITGIGGKAFVAGGDIKEFPGWIGKGEKYAEMKSIELQRPLNQLENLSKPTIAAINGLALGGGCELALACDLRVIEEQALIGLPEITLGLFPGAGGTQRLPRLIGEGKAKEMMFTGKPITAKEAKEINLVNYITSRGEALNKAKEIAKDISEFSLPALSYMKLAIREGLAVPLQEGLQIEARYFGKVFQTEDVKEGVKAFIEKRVPRFTNK

SEQ ID NO: 2646 - DNA, 774 bp, Acinetobacter sp. ADP1
  CDS (1)..(774): transl_table=11
atgacattcgcaacaattttattggaaaaacgtaagggtgtgggcttgattacacttaaccgtccaaaagcattaaatgctttaaactcagaattaatttatgaaataaatttagccttagacgatttagaaaatgatcaaacgattggttgtatcgtccttacaggttcagaaaaagcctttgccgcaggtgcggatatcaaagaaatggcagaattaacttttccaaatatttattttgatgatttttttagtcttgcagatcgtattgcacagcgtcgtaagcctttaattgccgcagtgagtggttatgctttaggtggtggctgtgagttagcactcatgtgtgactttatttattgtgccgacaatgccaagtttgcactaccagaagtaactttaggtgtcattcctggtattggtggaacacagcgtctaacgcttgcaataggcaaagccaaagccatggaaatgtgtttgactgcacggcaaatgcaggctgctgaggcagaacaaagtggtttggtggcacgcgtttttagtaaagaagaacttttagaacaaaccttacaggctgccgaaaaaatagcggaaaaatcacgggtatctaccataatgattaaagagtcaattaatcgagcttttgaagtgagtttagcagagggtttacgttttgagcgccgaatgttccattcagtttttgcgaccttagatcagaaagaaggcatgcaagcatttattgataaacgtccagcccaatttaaacatcaataa

SEQ ID NO: 2647 - protein, 257 aa, Acinetobacter sp. ADP1
MTFATILLEKRKGVGLITLNRPKALNALNSELIYEINLALDDLENDQTIGCIVLTGSEKAFAAGADIKEMAELTFPNIYFDDFFSLADRIAQRRKPLIAAVSGYALGGGCELALMCDFIYCADNAKFALPEVTLGVIPGIGGTQRLTLAIGKAKAMEMCLTARQMQAAEAEQSGLVARVFSKEELLEQTLQAAEKIAEKSRVSTIMIKESINRAFEVSLAEGLRFERRMFHSVFATLDQKEGMQAFIDKRPAQFKHQ

SEQ ID NO: 2648 - DNA, 786 bp, Acinetobacter sp. ADP1
  CDS (1)..(786): transl_table=11
atgattccagatcaggataatttcgttgaaattgatttttcaattgaacaaattgcaatcgtcaagattaaccgaccagcctcaaagaatgctttaaatacagaagttcgtaagcaacttgcacaagcatttacagagctgagctttaatgaccaaatcaatgcaattgttctaacgggtggtgaggatgtctttgcagcaggtgcagacctcaaagaaatggcaacagcaagctcgaccgatatgttgttacgtcataccgaacgttactggaatgctattgcacaatgtcccaagcccgtaattgcagccgtaaacggttatgctttgggaggtggttgtgagctggccatgcataccgacattattattgcaggaaaaagcgctactttcgggcagcctgaaattaaggttggtttgatgccaggtgcaggcggtacgcaacgtttatttcgtgccgttggaaaatttcatgcgatgcgtatgatcatgacaggtgtcatggttccagcagaagaagcctatctgattggtctagtgtctcaagtcactgaagatagtcaaacaattcctaccgcaatcaaaatggctcaaagtcttgcaaaaatgccacctattgctttacagcaaattaaagaagtcgctttgatgagtgaagatgtccccttaaatgccggcttaactctggaacgcaaatcgtttcaattgctgttttctaccgaagataaaaatgaaggtatcaatgcgtttatcgaaaaacgtaaaccctcctatcacggtaaataa

SEQ ID NO: 2649 - protein, 261 aa, Acinetobacter sp. ADP1
MIPDQDNFVEIDFSIEQIAIVKINRPASKNALNTEVRKQLAQAFTELSFNDQINAIVLTGGEDVFAAGADLKEMATASSTDMLLRHTERYWNAIAQCPKPVIAAVNGYALGGGCELAMHTDIIIAGKSATFGQPEIKVGLMPGAGGTQRLFRAVGKFHAMRMIMTGVMVPAEEAYLIGLVSQVTEDSQTIPTAIKMAQSLAKMPPIALQQIKEVALMSEDVPLNAGLTLERKSFQLLFSTEDKNEGINAFIEKRKPSYHGK

SEQ ID NO: 2650 - DNA, 774 bp, Symbiobacterium thermophilum IAM 14863
  CDS (1)..(774): transl_table=11
gtggcgtacgagaacatcctggtctttcgtgagggagctgtcggccgggtgcagctgaaccgcccccaggcgctcaacgccctcaacttccgcctgatgacggagctggtggaggcgttccgggagatggagcgcgatccgggcatcgggtgcctcctgctgcacggcaatgagaaggccttcgccgccggcgccgacatcaaggagatggcggagctgggcgcaatcgacatgtacacccgggactacatcgaactctgggatgaagtcgcccgcatcaagaagcccatcgtcgctgccgtcagcggctactgcctgggcggcggcctggagctggcgatgatctgcgacatcatcgtcgcctcggagacggcgaagttcggccagccggagatcaacatcggcgtcctgccgggcgccggcggcacccagcggctcacccgggcggtcgggaagtcgctggcgatggagatggtcctgaccggccggatgctcaccgcgcaggaggccctggcggccggtctggtcagtcgggtggttccggtggaggtctacctcagcgaggcgcagaagctggccggcgagatcgcgtccaagtcgcccgtggccctgcggctggccaaggaggcggtgctgcaggccttcgagggcagcctgagcagcggactcgcgtacgagcgccggctgttcgccatggcttttgcctccgaggaccagaaggagggcatgcgggccttcaccgagaagcggaagcccgagtggaaggggaggtaa

SEQ ID NO: 2651 - protein, 257 aa, Symbiobacterium thermophilum IAM 14863
MAYENILVFREGAVGRVQLNRPQALNALNFRLMTELVEAFREMERDPGIGCLLLHGNEKAFAAGADIKEMAELGAIDMYTRDYIELWDEVARIKKPIVAAVSGYCLGGGLELAMICDIIVASETAKFGQPEINIGVLPGAGGTQRLTRAVGKSLAMEMVLTGRMLTAQEALAAGLVSRVVPVEVYLSEAQKLAGEIASKSPVALRLAKEAVLQAFEGSLSSGLAYERRLFAMAFASEDQKEGMRAFTEKRKPEWKGR

SEQ ID NO: 2652 - DNA, 792 bp, Bacillus cereus E33L
  CDS (1)..(792): transl_table=11
atgaaaaatgaacgattagtaatatgcagtaaaaaagggagtagtgcagtcattacaattcaaaacccaccagtcaacactttaagtttagaagtagtgcaacaattaataaatgtattagaggaaatagagatggacgatgatgttgcagtcgtaattataactggaattggggagaaagcctttgtagctggaggggatataaaagaatttccaggttggataggaaaaggtgaaaaatatgctgagatgaaatcaatagaattacaaaagcctcttaatcaactagagaatttgtctaaaccaactatagctgctattaatgggttagcactaggcggaggttgtgaattagcacttgcttgtgatttaagagtaatagaagaacaagctttaattggattaccagaaattacgttaggtctatttcctggggctggaggaactcagcgcttacctagattaattggagaaggaaaagcaaaagagatgatgttcacaggaaaaccaattacagcgaaagaagcaaaagaaataaatttagttaactacattacctctcgaggagaggcgttaaataaagcaaaagagattgctaaagatataagtgaattttctcttccagcactttcctatatgaagttagcaattcgtgaaggtttggcagtacctttacaagaagggcttcagatcgaagcgcgttattttgggaaagtgtttcaaacagaagatgtgaaggagggggtaaaggcatttattgaaaaaagagtaccgcgtttcaccaataaataa

SEQ ID NO: 2653 - protein, 263 aa, Bacillus cereus E33L
MKNERLVICSKKGSSAVITIQNPPVNTLSLEVVQQLINVLEEIEMDDDVAVVIITGIGEKAFVAGGDIKEFPGWIGKGEKYAEMKSIELQKPLNQLENLSKPTIAAINGLALGGGCELALACDLRVIEEQALIGLPEITLGLFPGAGGTQRLPRLIGEGKAKEMMFTGKPITAKEAKEINLVNYITSRGEALNKAKEIAKDISEFSLPALSYMKLAIREGLAVPLQEGLQIEARYFGKVFQTEDVKEGVKAFIEKRVPRFTNK

SEQ ID NO: 2654 - DNA, 795 bp, Burkholderia pseudomallei K96243
  CDS (1)..(795): transl_table=11
ttgatcgaggagaagcagatggcttacgagaacattctggtggagacgcggggcagggtggggctgattacgctgaaccgtccgaaggcgctgaatgcgttgaatgacgccctgatggatgaacttggcttggcgctcaaagcgttcgacgcggacgagggtattggcgcgatcgtgctgacgggcagcgagaaggcgttcgcggcgggcgccgacatcgggatgatggcgacctattcatacatggacgtcttcaagggcgactacatcacgcgtaactgggagacggtgcgccagatccgcaagccgatcatcgcggcggtggcgggtttcgcgctgggcggcggctgcgaactcgcgatgatgtgcgacatcatctttgcggccgatacggcgaagttcggccagccggaaatcaagctcggcgtgctgccgggtgcgggcggcacgcagcgcctgccgcgcgcggtgtcgaaggcgaaagcgatggacatgtgcttgaccgcgcgcttcatggacgcggaggaagctgagcgggcgggcttggtgtcgaggatcctgccggcggacaagttgctcgacgaggcgatcgccgcggcgacgacgatcgcggaattctcgctgcctgccgtaatgatggtgaaggaggcggtgaatcgcgcatacgagacgaccttgtccgaaggggtgcacttcgagcgtcgcttgtttcactcggcatttgcgactgaagatcagaaggaagggatggcggcgttcgtcgagaagcgcaagcccgtcttcaagcatcgctga

SEQ ID NO: 2655 - protein, 264 aa, Burkholderia pseudomallei K96243
MIEEKQMAYENILVETRGRVGLITLNRPKALNALNDALMDELGLALKAFDADEGIGAIVLTGSEKAFAAGADIGMMATYSYMDVFKGDYITRNWETVRQIRKPIIAAVAGFALGGGCELAMMCDIIFAADTAKFGQPEIKLGVLPGAGGTQRLPRAVSKAKAMDMCLTARFMDAEEAERAGLVSRILPADKLLDEAIAAATTIAEFSLPAVMMVKEAVNRAYETTLSEGVHFERRLFHSAFATEDQKEGMAAFVEKRKPVFKHR

SEQ ID NO: 2656 - DNA, 777 bp, Azoarcus sp. EbN1
  CDS (1)..(777): transl_table=11
atgagtttccagaacatcctcgttgaaacgcgtggccgggtcggcctgatcacccttaatcgcccgaaggcgatgaacgcgctcaacgatcaggtcgtcgatgaaatgtgggaggcgctcgaccacttcgaggccgacgagggaatcggcgccatcgtcatcaccggcagcgagaaagctttcgccgcaggcgccgatatcggcgcaatggcgaacttttcgcatatggacgcctacaagggcgactacatcacgcgcaattgggaacgcgtcaagacctgccgcaagccggtcatcgcagcggtcgccggcttcgcgctcggcggcgggtgcgaactggcgatgatgtgcgacatgatcatcgctgccgacaacgccaagttcggccagcccgaaatcaagctcggcatcctgcccggctcgggtggcacgcagcgcctgccccgcgcgatcggcaaggcgaaaacgatggacatgtgcctcaccgcgcggctgatgggggccgaggaagcagaacgttcgggactcgttgcccgggtggtgccggccgacaaactgctcgacgaagcgcttgcggtggccaccgaggtcgccaacttctcgctgccggtcgtgatgatgatcaaggaatcagtcaatcgcgccttcgaaggaagcctcaacgaaggccttctgttcgaacgccgcgttttccatgccgcgttcggcctcgacgatcagaaggaaggaatggctgccttcgtcgagaaacgcaagcctgacttcaagcaccgctga

SEQ ID NO: 2657 - protein, 258 aa, Azoarcus sp. EbN1
MSFQNILVETRGRVGLITLNRPKAMNALNDQVVDEMWEALDHFEADEGIGAIVITGSEKAFAAGADIGAMANFSHMDAYKGDYITRNWERVKTCRKPVIAAVAGFALGGGCELAMMCDMIIAADNAKFGQPEIKLGILPGSGGTQRLPRAIGKAKTMDMCLTARLMGAEEAERSGLVARVVPADKLLDEALAVATEVANFSLPVVMMIKESVNRAFEGSLNEGLLFERRVFHAAFGLDDQKEGMAAFVEKRKPDFKHR

SEQ ID NO: 2658 - DNA, 771 bp, Azoarcus sp. EbN1
  CDS (1)..(771): transl_table=11
atggacgaagtcctcatcgagcgcccggggcccggcatcgtgctgctgcgcctgaaccggcccgacgcccgcaatgcgctgaaccaggaagtccggcagcagctcgccacgcatttcaccgcgttcgggcaggacccggacgtgcgctgcatcgtcctgacgggcggcgacaagttcttcgccgcgggagcggacatccgcgcgatggccgatgccggggcgatcgacatgatgctgcgccacacccatcgcctgtggcaggcgatcgcgagctgccccaagccggtgatcgccgcggtcaacggctacgcctggggcggcggctgcgaacttgcgatgcatgccgacatcatcgtcgcaggcgaatccgcatcgttctgccagccggaagtgaaagtcggcatcatgcccggcgcgggcggcacgcagcggctcacccgcgcagtcggcaagttcaaggcgatgaagatggtcctcaccgggcagccggtaaacggccgcgacgcgctggaaatgggcctggcgagcgaagtcgtcgccgacgcggacgtgcaggcgcacgccgttgagcttgccgcccagatcgccgcgctgccgccgctggcgatcgcgcagatcaaggaagtgctgatcgccggccaggacgcttcgctcgagacggcgctgatgctcgagcgcaaggcattccaattgctgttcgcgagccgggaccagaaggaaggcatgcaggccttcctcgagaaacggaaagccaactttgaaggaaggtga

SEQ ID NO: 2659 - protein, 256 aa, Azoarcus sp. EbN1
MDEVLIERPGPGIVLLRLNRPDARNALNQEVRQQLATHFTAFGQDPDVRCIVLTGGDKFFAAGADIRAMADAGAIDMMLRHTHRLWQAIASCPKPVIAAVNGYAWGGGCELAMHADIIVAGESASFCQPEVKVGIMPGAGGTQRLTRAVGKFKAMKMVLTGQPVNGRDALEMGLASEVVADADVQAHAVELAAQIAALPPLAIAQIKEVLIAGQDASLETALMLERKAFQLLFASRDQKEGMQAFLEKRKANFEGR

SEQ ID NO: 2660 - DNA, 774 bp, Azoarcus sp. EbN1
  CDS (1)..(774): transl_table=11
atgaatctcgtaatcctcgtcgaaacccggcacaaggtcggcctgatccgcatcaacaggcccgaagtgcataacgcgctcaacgatgacgtgatgaccgagctcggccgcgcgctcgacgcgttcgaggccgaccggagcattgcctgcgtcgtgctgaccggctccgaaaaagctttcgccgccggcgccgacatcgcggcgatgcgcgcgatggacttcatggacgcctacaagtcggacttcatcacgcgcaactgggagcggctgcgcactttccgcaagccggtcatcgcggcggtgaatggggtcgcgctcggcggcggctgcgagctggcgatgatgtgcgacatcgtcttcgctgccgacaacgcccgtttcggccaacccgagatcaagatcggcacgattcccggcgccggcggcacgcaacgcctgccgcgcgcgatcggcaagaccaaggcgatggacatgtgtctgaccggtcgcctgatggacgcgcaggaagccgagcgcagcgggctcgtcgcacgcatcttcccggccggcacggtactcgacgaggcgctcgcgaccgccgcgcagctcgccgagtattcgctgccggtgctgatgatgatgaaggagtcggtcaaccgtgcatacgagagcccgctcagcgaagggctgctgttcgagcgccgcacgctgcacgcgacgtttgcgctcgctgaccagaaggaaggcatgaacgcgttcgtcgagaaacgcacgccgcagttcgcgcactgttag

SEQ ID NO: 2661 - protein, 257 aa, Azoarcus sp. EbN1
MNLVILVETRHKVGLIRINRPEVHNALNDDVMTELGRALDAFEADRSIACVVLTGSEKAFAAGADIAAMRAMDFMDAYKSDFITRNWERLRTFRKPVIAAVNGVALGGGCELAMMCDIVFAADNARFGQPEIKIGTIPGAGGTQRLPRAIGKTKAMDMCLTGRLMDAQEAERSGLVARIFPAGTVLDEALATAAQLAEYSLPVLMMMKESVNRAYESPLSEGLLFERRTLHATFALADQKEGMNAFVEKRTPQFAHC

SEQ ID NO: 2662 - DNA, 804 bp, Azoarcus sp. EbN1
  CDS (1)..(804): transl_table=11
atgaatctcgatcattccaacgaagcggccgccgagccaccgatcctcgtcgaccggcgcgggcgggtcggcctgctgcggctgaaccggccgtcgcggttcaacgcgctcagcgacgcgctgatcgaccggctcggcgacgagctcgaggcgatggacgccgacgacggcatcggcgcgatcgtcatcaccggctccgacaaggccttcgccgctggcgcggacatcggcgcgatggcggactgggacttcgtccacgtctacaagacgaactacgtgtcgcgcaactgggaccgcctggcgcgcatccgcaagccggtcatcgccgcggtcggcggctttgcgctcggcggcggatgcgagctcgcaatgacctgcgacctcgtcatcgccgcggagaccgcccgcttcggtcaacccgaagtccggctcggcgtgcttccgggcgcgggcggcacgcagcggctgccgcgcgcggtcggcaaggcgaaggcgatggacctgtgcctgaccgcgcgcatgatggacgcgcaggaagccgagcgtgccggactcgtgtcgcgcatcgtccccgccgagcgcctgctcgacgaggcgctcgaagcggccgcaagaatcgcagccttctcgctgccggtcgcgatgatgatcaaggaatcggtgaatcgtgccttcgaatcggggctatcggaagggctgctgttcgaacgccggagtttccacgccgccttcggcttgcaggaccagaaggaaggcatggcggccttcctcgcgaaacgcaacgcttcgttcagtcattgttga

SEQ ID NO: 2663 - protein, 267 aa, Azoarcus sp. EbN1
MNLDHSNEAAAEPPILVDRRGRVGLLRLNRPSRFNALSDALIDRLGDELEAMDADDGIGAIVITGSDKAFAAGADIGAMADWDFVHVYKTNYVSRNWDRLARIRKPVIAAVGGFALGGGCELAMTCDLVIAAETARFGQPEVRLGVLPGAGGTQRLPRAVGKAKAMDLCLTARMMDAQEAERAGLVSRIVPAERLLDEALEAAARIAAFSLPVAMMIKESVNRAFESGLSEGLLFERRSFHAAFGLQDQKEGMAAFLAKRNASFSHC

SEQ ID NO: 2664 - DNA, 777 bp, Silicibacter pomeroyi DSS-3
  CDS (1)..(777): transl_table=11
atggcctttgagacgatcatcgtcgaagttgaagaccacgtagccctgatcaggctgaaccgtcccgatgcgctcaatgcgctcaacacccagttgctgggcgagttgtgtaccgcgctggaagaggccgacggcaatgacaaggtgcgctgcatcgtcatcaccggcagcgacaaggcatttgccgccggggccgatatccgcgagatgtcccaaaagacctatgtcgaggtgtatagcgagaacctgttcgcggccgccaacgaccgtgtcagcgccatccgcaagccgatcatcgccgcagtggcgggctatgcgctgggcggtggctgtgaactggcgatgctgtgcgatttcatcatcgcggcggacaccgcaaagttcggccagcccgagatcaacctgggcgtgatcgccggtatcggcggcacccagcgtctgacccggctggtgggcaagtccaagtcgatggacctgaacctgaccgggcggttcatggatgccgaagaggccgagcgcgccgggctggtcagccgcgtggttccggccaagaagctggtcgaagaggcgctgagcgcagcccagaagatcgccgagaaatcgatgatctcggcctatgcggtcaaggaggcggtcaaccgctcttacgagaccacgctgagcgaggggctgctgttcgagcgccgggtgttccattcgatgttcgccaccgaagatcagaaggaaggcatggccgctttcctcgagaagcgggcggcacagttccgcgacaagtga

SEQ ID NO: 2665 - protein, 258 aa, Silicibacter pomeroyi DSS-3
MAFETIIVEVEDHVALIRLNRPDALNALNTQLLGELCTALEEADGNDKVRCIVITGSDKAFAAGADIREMSQKTYVEVYSENLFAAANDRVSAIRKPIIAAVAGYALGGGCELAMLCDFIIAADTAKFGQPEINLGVIAGIGGTQRLTRLVGKSKSMDLNLTGRFMDAEEAERAGLVSRVVPAKKLVEEALSAAQKIAEKSMISAYAVKEAVNRSYETTLSEGLLFERRVFHSMFATEDQKEGMAAFLEKRAAQFRDK

SEQ ID NO: 2666 - DNA, 792 bp, Azoarcus sp. EbN1
  CDS (1)..(792): transl_table=11
atgacgaccgccaatgaacacgtcaagatcgagcgccaaggcgcggtcgcgctggtcacgctcaatcgccccgaggcgctcaacgcgatcaacgacgacatccgcggcagcctgccccaaatgctgcgcgagttcgatgccgatgtcgaaatcggtgcgatcgtcattgccgggtcaggcgagcgcggctttagcgtgggcgccgacatcaaggagagccggccgaacgactcgccgattgcgacgcgccggcggctcgttcccacgacttggatcgaggctctggatgcgacctgcaagccggtgattgcggccattcacggcttctgcctgggcggcggcatggagctcgccctggcgtgcgacgtgcgcgtcgtggccaagggcgccgagttcgccctgccggagaccgctctggggttgatgccgggtggtggcggcacgcagcggctgccgcgcctcatcggactgtcccggtcgctggacctgctccttaccggggaccgcatcggtgccgaggaagcctaccggatcgggattgcgacccgtctggcggagtcgcccgaagccgccctcgccgaggcgatgcgggttgccgagctgatcgcggcacgtccccgcgtggctgtcgcttatgtcaaggaagccgcgcgtgcggggctcgacatggacctggccaatggcctgaagctggagaagagcctcttcgccctcctgacctcgtccgccgaccgcatcgaggcggctcgtgccttccgcgagaagcggcaaccgaacttcattggcgcctga

SEQ ID NO: 2667 - protein, 263 aa, Azoarcus sp. EbN1
MTTANEHVKIERQGAVALVTLNRPEALNAINDDIRGSLPQMLREFDADVEIGAIVIAGSGERGFSVGADIKESRPNDSPIATRRRLVPTTWIEALDATCKPVIAAIHGFCLGGGMELALACDVRVVAKGAEFALPETALGLMPGGGGTQRLPRLIGLSRSLDLLLTGDRIGAEEAYRIGIATRLAESPEAALAEAMRVAELIAARPRVAVAYVKEAARAGLDMDLANGLKLEKSLFALLTSSADRIEAARAFREKRQPNFIGA

SEQ ID NO: 2668 - DNA, 774 bp, Pseudomonas syringae pv. syringae B728a
  CDS (1)..(774): transl_table=11
atgctttacgagactattctcattgagattataggtagtgtgggcctgatcaggcttaaccggcctaacgcgttgaacgccttgaatgcgcgtctgatcaacgaattgaaccatgcgctcgatcagttcgaggcggacagtgcgatcggctgcatcgtgctgaccggctcggaaaaagccttcgccgccggtgcggacatcaaggaaatggtcgacctgtcctacccgcagatctacctcgatgacctgtttcgtgacagcgaccgggttgcggcccgacgcaaacccctggtggctgcggtggccggttttgccttgggtggcggctgtgaactggcattgatgtgcgatttcattctggctgccgagaacgccaggtttggacagcccgagatcaatctcggcgtgttgccggggatgggcggaacgcagcgtctgacccgcgcggtgggcaaggccaaggccatggagatgtgcctgaccggccggttgatcgatgctcacgaggccgagcgcgccggtctggtggcccgcgtgctgccgctcgatcagttgctgccggaagcgcttgcagtggcagcggtcatcgccagtaaatccctgccagtagcgatgatggtcaaagagagcgtcaaccgcgcgttcgaggtcagcctggccgaaggcatccgcttcgagcgccgggtttttcacgccgccttcgccagccaggatcagaaggagggcatgcgcgccttcatcgacaagcgccagcccgatttcaaggactgctga

SEQ ID NO: 2669 - protein, 257 aa, Pseudomonas syringae pv. syringae B728a
MLYETILIEIIGSVGLIRLNRPNALNALNARLINELNHALDQFEADSAIGCIVLTGSEKAFAAGADIKEMVDLSYPQIYLDDLFRDSDRVAARRKPLVAAVAGFALGGGCELALMCDFILAAENARFGQPEINLGVLPGMGGTQRLTRAVGKAKAMEMCLTGRLIDAHEAERAGLVARVLPLDQLLPEALAVAAVIASKSLPVAMMVKESVNRAFEVSLAEGIRFERRVFHAAFASQDQKEGMRAFIDKRQPDFKDC

SEQ ID NO: 2670 - DNA, 774 bp, Pseudomonas fluorescens Pf-5
  CDS (1)..(774): transl_table=11
atgagctacgaaaccattctgttggacatcaagggccgggtcggcctgatcactctcaaccgcccccaggcgctgaacgccctcaatgcacagatcgtcggcgaggtgaaccaggccctggatcgcctggaagccgacccgcagatcggctgcatcgtcatcaccggttccaagaaagccttcgccgccggtgccgacatcaaggaaatggccgagctgagctacccgcagatctacctcgacgacctgttcagcgacagcgaccgcgtggccaaccggcgcaagccgatcatcgccgcggtcaacggcttcgccctgggcggcggttgcgaactggcgctgatgtgcgacttcatcctggccggcgacaacgccaagttcggccaaccggaaatcaacctcggcgtgctgccgggcatgggcggcacccagcgcctgacccgcgcggtaggcaaggccaaggccatggaaatgtgcctgaccgggcgttttatcgacgccgtggaagctgagcgttgcggcatcgtcgcacgcatcgtgccggccgatgaactggtggaagaagccctgaaagtggcagcggtgattgccggcaaatcgatcccggtgagcatgatgatcaaggaaagcgtgaaccgcgcctttgaagtcagcctgtccgagggcgtgcgcttcgagcgccgggtattccacgccgccttcgccacccaggaccagaaagaaggcatggccgccttcatcgccaagcgtgacccgcagttcaaggaccagtaa

SEQ ID NO: 2671 - protein, 257 aa, Pseudomonas fluorescens Pf-5
MSYETILLDIKGRVGLITLNRPQALNALNAQIVGEVNQALDRLEADPQIGCIVITGSKKAFAAGADIKEMAELSYPQIYLDDLFSDSDRVANRRKPIIAAVNGFALGGGCELALMCDFILAGDNAKFGQPEINLGVLPGMGGTQRLTRAVGKAKAMEMCLTGRFIDAVEAERCGIVARIVPADELVEEALKVAAVIAGKSIPVSMMIKESVNRAFEVSLSEGVRFERRVFHAAFATQDQKEGMAAFIAKRDPQFKDQ

SEQ ID NO: 2672 - DNA, 777 bp, Psychrobacter arcticus 273-4
  CDS (1)..(777): transl_table=11
atggaagagcaaatcattatttgtgagcaacaagaaaatggcgttagtgtgataagactcaatcgtcctaaagttcgcaatgctttgaatactgaattacgcgaacaaatggcagagattttcaacaaattaaacgatgacgtgaataccaaggccattgtgctgacgggtggtaataaggtgttcgcggccggtgctgatattaatgattttttaaccgcgaaaacagtcgatgtgtatttgcgtcatagcgaacgttattgggatgccatcaccaattgttgtaagccgattatcgcagcagtaaatggctatgcacttggcggtggctgtgaactcgctatgcatgccgacatcattgtcgctggtaagtctgctaagtttggacaaccagaaatcaaaataggactgatgccaggagcagggggtacgcagcggctatttcgcgtaattggcaaacataaagctatgaagctgatattgactggtgacatgataagcgctgatgaagcggatcaaatggggctggtctctgaagtagtcgaagatgaagcaactatcaaacgtgctatcgagattgctgagcaactagcaggttattcgcctattgccttaacccaaattaaagaagtcgccaatttaggggtggatatgccactacaagccgcattggctttagagcgtaaagcctttcagattctgtttgatactgaagatcaaaaagaaggcgcaaaagccttcttagaaaaacgtagtgctgaatacaaaggacgatag

SEQ ID NO: 2673 - protein, 258 aa, Psychrobacter arcticus 273-4
MEEQIIICEQQENGVSVIRLNRPKVRNALNTELREQMAEIFNKLNDDVNTKAIVLTGGNKVFAAGADINDFLTAKTVDVYLRHSERYWDAITNCCKPIIAAVNGYALGGGCELAMHADIIVAGKSAKFGQPEIKIGLMPGAGGTQRLFRVIGKHKAMKLILTGDMISADEADQMGLVSEVVEDEATIKRAIEIAEQLAGYSPIALTQIKEVANLGVDMPLQAALALERKAFQILFDTEDQKEGAKAFLEKRSAEYKGR

SEQ ID NO: 2674 - DNA, 768 bp, Colwellia psychrerythraea 34H
  CDS (1)..(768): transl_table=11
atggaaactatattagtcgaacgccgtgaacgggtaggtatgatcactcttcatagacctaaaagcctaaatgctttaagtaggcagcttgccagagaagttgttgataccttaaaaacctttgacgccgacgataatatcggcgcgattgttattactggcagtgctagagcatttgccgccggggcagatattgaggaaatggcaaacctgacctacgccgaattttattgcgacgatatctttgcaccgtgggatgaattgcgttcaatcagcaaaccgatcattgccgccgtgagtggttatgctttgggcggtggctgtgagctagcgttgatgtgtgattttatcattgcctctgaagacgctcagtttggacaaccagaaattaagcttggtattttgcctggtattggaggctcacaacgcttggccaatgccgttggtaagtcattggcgatggatctagttctaacaggtagaacaatcgatgttcatgaagcaaaagctgcaggattggtggcgcgtgttgttccaggtaaagagttgttacaaacggctttagaagctgcacataccattgcaggctataacagtcctgccgtacgtatggcgaaagaagcggtaaatgtcgcttttgaaaccagccttactgaggggatgcgtcatgagcgccgtttattccaagcagccttcgctaccgaagggcagaaagaaggtatgcatgcgtttatagccaagcgagcacctgtttttcgccatcgctag

SEQ ID NO: 2675 - protein, 255 aa, Colwellia psychrerythraea 34H
METILVERRERVGMITLHRPKSLNALSRQLAREVVDTLKTFDADDNIGAIVITGSARAFAAGADIEEMANLTYAEFYCDDIFAPWDELRSISKPIIAAVSGYALGGGCELALMCDFIIASEDAQFGQPEIKLGILPGIGGSQRLANAVGKSLAMDLVLTGRTIDVHEAKAAGLVARVVPGKELLQTALEAAHTIAGYNSPAVRMAKEAVNVAFETSLTEGMRHERRLFQAAFATEGQKEGMHAFIAKRAPVFRHR

SEQ ID NO: 2676 - DNA, 774 bp, Pseudomonas syringae pv. phaseolicola 1448A
  CDS (1)..(774): transl_table=11
atgtcttacgagacaattctaagtgagattataggtaaggttggcgtgattacgctgaaccgtcccaaggcacttaatgcattgaatgctcagttgattgacgagttgaaccacgcactcgaccagttcgaagcagacagtgccatcggctgcatcgtgctgaccggttcggaaaaagcctttgcggccggtgccgatatcaaggaaatggtcgacctgtcctacccacaaatctacctcgacgatctgtttcgcgaaagtgatcgggtggccgcgcggcgcaaacccatcgtggcggcagtggccggttttgcgttgggtggcggttgtgagctggcgttgatgtgcgattttattctggcggctgaaaacgccaggttcgggcagccggagatcaatctcggtgtgttgccgggcatgggcgggacgcagcgtctgacccgcgctgtcggcaaggccaaagccatggaaatgtgcctgactggtcgcctgattgatgctcacgaagccgaacgtgccgggctggttgcgcgggttttgccgcttgaacagttgctgcctgaagccctcgcggtagcggcggtgatcgccggcaagtccctgccggtggcgatgatggtcaaggagagcgtcaaccgcgcgttcgaggtcagtctggccgaaggcatccggttcgagcgccgggtgtttcacgcagccttcgccagtcacgatcagaaggagggcatgaatgcgtttatcgacaagcgccagccggatttcaaggactgctga

SEQ ID NO: 2677 - protein, 257 aa, Pseudomonas syringae pv. phaseolicola 1448A
MSYETILSEIIGKVGVITLNRPKALNALNAQLIDELNHALDQFEADSAIGCIVLTGSEKAFAAGADIKEMVDLSYPQIYLDDLFRESDRVAARRKPIVAAVAGFALGGGCELALMCDFILAAENARFGQPEINLGVLPGMGGTQRLTRAVGKAKAMEMCLTGRLIDAHEAERAGLVARVLPLEQLLPEALAVAAVIAGKSLPVAMMVKESVNRAFEVSLAEGIRFERRVFHAAFASHDQKEGMNAFIDKRQPDFKDC

SEQ ID NO: 2678 - DNA, 774 bp, Dechloromonas aromatica RCB
  CDS (1)..(774): transl_table=11
atgacccaagtagtcctcaccgaagtgatcggcaaggtcggcctgatccgcatcaaccgtccggaagcgatgaacgcactgaacaacgacgtcgtcgacggcatcggtgccgccatcgacatctacgaagccgacgagaacatcggctgcatcgtcatcaccggcaatgagaaagccttcgccgccggagccgacatcggcttcatgaaggatttcgactacatgcacgcctacaagaccgacttcatcacccgcaactgggaacgcatcaagaccacccgcaagccggtcatcgccgcagtgtccggctttgccctcggtggtggctgcgaaatggcgatgatgtgcgacatgatcttcgccgccgataccgccaagttcggccaaccggaaattcgccttggcaccatgcccggggccggtggcacccagagattgccccgcgccgtcggcaaggccaaggcgatggacatgtgcctgacggcccgcatgatggatgcggccgaagctgaaaaggccggcctggtcgcccgcatcatcccggccgaccaattgctcgacgaaaccctgaaagccgcccagaccattgccggctattcgctgccggtggtcatgatgatcaaggagtcggtcaatcgcgcctatgaatcctcgctgaacgaaggcctgctctttgagcgccgcgtcttccattcggccttcgccctcgaggaccagaaggaaggcatggctgcctttgtcgagaagcgcaagcccgtattcaagaaccgctga

SEQ ID NO: 2679 - protein, 257 aa, Dechloromonas aromatica RCB
MTQVVLTEVIGKVGLIRINRPEAMNALNNDVVDGIGAAIDIYEADENIGCIVITGNEKAFAAGADIGFMKDFDYMHAYKTDFITRNWERIKTTRKPVIAAVSGFALGGGCEMAMMCDMIFAADTAKFGQPEIRLGTMPGAGGTQRLPRAVGKAKAMDMCLTARMMDAAEAEKAGLVARIIPADQLLDETLKAAQTIAGYSLPVVMMIKESVNRAYESSLNEGLLFERRVFHSAFALEDQKEGMAAFVEKRKPVFKNR

SEQ ID NO: 2680 - DNA, 774 bp, Dechloromonas aromatica RCB
  CDS (1)..(774): transl_table=11
atgacccaagtagtcctcaccgaagtgatcggcaaggtcggcctgatccgcatcaaccgtccggaagcgatgaacgcactgaacaacgacgtcgtcgacggcatcggtgccgccatcgacatctacgaagccgacgagaacattggctgcatcgtcatcaccggcaatgagaaagccttcgccgccggagccgacatcggcttcatgaaggatttcgactacatgcacgcctacaagaccgacttcatcacccgcaactgggaacgcatcaagaccacccgcaagccggtgattgccgcagtatccggtttcgctctgggtggcggctgtgaaatggccatgatgtgcgacatgatcttcgccgccgatactgccaagttcggccagccggagatccgtcttggcaccatgcccggggccggtggcacgcaacgtctgccccgggccgtcggcaaggccaaggccatggacatgtgcctgaccgcccgcatgatggatgcggccgaagccgaaaaggccgggctggtcgcccgcatcatcccggccgagcaactgctcgacgaaaccctgaaggccgcccagaccattgccggctattcgctgccggtggtcatgatgatcaaggaatcggtcaatcgcgcctacgaatcctcgttgaacgaaggcctgctctttgagcgccgcgttttccattcggccttcgccctcgaagatcagaaggaaggcatggcggcctttgtcgagaagcgaaaacccgtgttcaagaaccgctga

SEQ ID NO: 2681 - protein, 257 aa, Dechloromonas aromatica RCB
MTQVVLTEVIGKVGLIRINRPEAMNALNNDVVDGIGAAIDIYEADENIGCIVITGNEKAFAAGADIGFMKDFDYMHAYKTDFITRNWERIKTTRKPVIAAVSGFALGGGCEMAMMCDMIFAADTAKFGQPEIRLGTMPGAGGTQRLPRAVGKAKAMDMCLTARMMDAAEAEKAGLVARIIPAEQLLDETLKAAQTIAGYSLPVVMMIKESVNRAYESSLNEGLLFERRVFHSAFALEDQKEGMAAFVEKRKPVFKNR

SEQ ID NO: 2682 - DNA, 777 bp, Ralstonia eutropha JMP134
  CDS (1)..(777): transl_table=11
atgtcgtacgaaaacatcctcgtggaaacgcgcggccgcgtcgggctggtcacgctgcaccgtccgaaggcgctgaatgcgctcaatgacgcattgatggatgaactgggtgccgcactgacggtgttcgacaaggacgagaacatcggtgccatcgttattaccggcagcgaaaaggcgttcgcggccggcgccgatattggcatgatggccaagtactcgttcatggacgtgtacaagggcgactacattacccgcaactgggaaacgatccgcaccatccgcaagccggtgattgcagccgtggcaggctacgcgctgggcggtggctcggaactcgcgatgatgtgcgacatcatcattgccgctgaaaatgcccgcttcgggcagccggaagtcaagctcggcaccatgcccggcgccggcggcacccagcgcatgccgcgcgcggtgtccaaagccaaggccatggacctgtgcctgaccgcgcgcatgatggatgccgccgaagcggagcgggccggccttgtctcgcgcgtggtgccggcggacaagctgctggatgaagcgctcgcagcggcggagaccatcgccggctactcgctgcctgtggtcatgatgatcaaggaatcgatcaacgcggcctatgagacaacgctcgctgagggcgtgcgcttcgagcgccggctcttccatgcgacgtttgccagcgaagaccagaaggaaggcatggctgcttttgtcgagaaacgcagccctgacttcaagcatcgctga

SEQ ID NO: 2683 - protein, 258 aa, Ralstonia eutropha JMP134
MSYENILVETRGRVGLVTLHRPKALNALNDALMDELGAALTVFDKDENIGAIVITGSEKAFAAGADIGMMAKYSFMDVYKGDYITRNWETIRTIRKPVIAAVAGYALGGGSELAMMCDIIIAAENARFGQPEVKLGTMPGAGGTQRMPRAVSKAKAMDLCLTARMMDAAEAERAGLVSRVVPADKLLDEALAAAETIAGYSLPVVMMIKESINAAYETTLAEGVRFERRLFHATFASEDQKEGMAAFVEKRSPDFKHR

SEQ ID NO: 2684 - DNA, 774 bp, Pseudomonas fluorescens PfO-1
  CDS (1)..(774): transl_table=11
atgagttacgaaacgattttgctggaaacccatggccgcgtcggcctgattaccctcaatcgcccgcaggcgctgaatgccctgaatgcgcaactggtcagcgaagtgaatcgcgcgctcgatggatttgaagccgacgcgaacatcggctgcatcgtcatcaccggctcgaccaaggccttcgccgccggcgccgacatcaaggaaatggccgatctgacctacccgcagatctacatggacgacctgttcagcgacagcgatcgcgtggccaaccggcgcaagccgatcatcgccgcggtcaacggttttgccctcggcggcggctgtgagctggcgctgatgtgcgacttcatcctggccggcgacaacgccaaattcggccagccggaaatcaacctcggcgtgctgccgggcatgggcggcacccagcgcctgacccgcgcggtgggcaaggccaaggccatggaaatgtgcctgagcggccgcatgatcgacgcggtggaagccgagcgctgcggcatcgtcgcgcgaatcgtgccgagtgccgagttgctggatgaggcgctgaaagtcgccgcagtgatcgccagcaaatcgctgccgattacgatgatggtcaaggaaagcgtcaaccgcgcgtttgaagtgaatctgaccgaaggcgtgcgcttcgagcgccgggtgttccatgcggcgtttgcgacgcaggatcagaaggaagggatggcggcgtttgtggccaagcgtgcgcctgaatttcagggcaagtaa

SEQ ID NO: 2685 - protein, 257 aa, Pseudomonas fluorescens PfO-1
MSYETILLETHGRVGLITLNRPQALNALNAQLVSEVNRALDGFEADANIGCIVITGSTKAFAAGADIKEMADLTYPQIYMDDLFSDSDRVANRRKPIIAAVNGFALGGGCELALMCDFILAGDNAKFGQPEINLGVLPGMGGTQRLTRAVGKAKAMEMCLSGRMIDAVEAERCGIVARIVPSAELLDEALKVAAVIASKSLPITMMVKESVNRAFEVNLTEGVRFERRVFHAAFATQDQKEGMAAFVAKRAPEFQGK

SEQ ID NO: 2686 - DNA, 777 bp, Rhodobacter sphaeroides 2.4.1
  CDS (1)..(777): transl_table=11
atggcctacgaaaccctgatcgtcgagatcgaggattatgtggcgctgatccggctgaaccgcccggacgcgctcaatgcgctcaacagcaagatgatgtccgaactggccgatgcgctcggcgcggccgaccggaacgagaaggtgcgctgcatcgtcctcaccgggtcggagaaggccttcgccgccggtgccgacatcaaggagatggccgagcagagcttcgtcgatgtcttcggcagcgatttcttcacctcggattccgaggcgatgctgcgggtgcgcaagccgatcgtggcggcggtggcgggctatgcgctcggcggcggctgcgagctggcgatgatgtgcgacttcatcattgccgccgatacggccaagttcggccagcccgagatcaacctcggcgtcgtggccgggctcggcggcacgcagcgcctgacgcgcttcgtgggcaagtcgaagtccatggacatgcatctgaccggccgcttcatggatgcggccgaagccgagcgctgcggcctcgtgagccgcgtggtaccggccaagaacctgatggaggaggcgatgaaggccgcctccaagatcagcgagaagtcgcttctgaccgccatggcggtgaaggaggcggtgaaccgcagctacgagaccacgctgcgcgagggtgtcctcttcgagcgccgcctcttccacgcgcttttcgccaccgaagaccagaaggagggcatggcggccttcctcgagaagcggactccgcagttccgcgacaagtaa

SEQ ID NO: 2687 - protein, 258 aa, Rhodobacter sphaeroides 2.4.1
MAYETLIVEIEDYVALIRLNRPDALNALNSKMMSELADALGAADRNEKVRCIVLTGSEKAFAAGADIKEMAEQSFVDVFGSDFFTSDSEAMLRVRKPIVAAVAGYALGGGCELAMMCDFIIAADTAKFGQPEINLGVVAGLGGTQRLTRFVGKSKSMDMHLTGRFMDAAEAERCGLVSRVVPAKNLMEEAMKAASKISEKSLLTAMAVKEAVNRSYETTLREGVLFERRLFHALFATEDQKEGMAAFLEKRTPQFRDK

SEQ ID NO: 2688 - DNA, 774 bp, Carboxydothermus hydrogenoformans Z-2901
  CDS (1)..(774): transl_table=11
atgagcgtaattgaaatggtaagggaagaaggaattgctatacttaccatcaatagggcaaatgttttaaatgctttaaataccgaagtgcttttagaattaaaaaaggttttatctcaaatcaaagaagatacaagtattaaggttgttataattaccggggccggagagaaagcctttgttgcaggtgctgatataagtgaaatggtaaagcaaagcgtagatgaagggtatagatattcccgtttagggcaggaggtacttgcacttatcgagaatcttccccaaccggtaatagcagcagtaaatggttatgctctgggcggtggctgcgaattagctatggcctgtgacatgaggattgcttcggagaaagcaaagtttggtctgccagaaattaatttgggtattattccagggtttggaggcacgaaaaggctaacagaactggtaggtaaagctaaagcaatggagttaatattaaccggagagatgattgatgctgcccaagctgagcgtttaggattagttaaccaggtagtaaaagcagataagttattggagacagcaaagacgctggctcaaaaaattgcatctaaaagtcaaattgctgttcgggcagctaaactggcagtaaataagagtttgtacactgatattgaaactgcaaatgcttgtgaagcagggctttttggagtctgttttgcttcagaggatagaaaagaagggatgatggcttttttagagaagcgtcctgcaaaatttaaaaattag

SEQ ID NO: 2689 - protein, 257 aa, Carboxydothermus hydrogenoformans Z-2901
MSVIEMVREEGIAILTINRANVLNALNTEVLLELKKVLSQIKEDTSIKVVIITGAGEKAFVAGADISEMVKQSVDEGYRYSRLGQEVLALIENLPQPVIAAVNGYALGGGCELAMACDMRIASEKAKFGLPEINLGIIPGFGGTKRLTELVGKAKAMELILTGEMIDAAQAERLGLVNQVVKADKLLETAKTLAQKIASKSQIAVRAAKLAVNKSLYTDIETANACEAGLFGVCFASEDRKEGMMAFLEKRPAKFKN

SEQ ID NO: 2690 - DNA, 777 bp, Burkholderia sp. 383
  CDS (1)..(777): transl_table=11
atggcttacgagaacatcctggtggagacccgggggcgtgtcgggctggttacgctgaaccgtccgaaggcgctgaatgcgctgaacgatgcgctgatggatgagctgggtgacgcgctgaaggcgttcgatgcggacgatggtatcggtgcaatcgtcgtgaccgggagcgagaaggcgttcgcggccggcgcagatatcggcatgatggcgacctactcctatatggatgcctaccggggcgactacatcacgcgcaactgggagacggtccgcgaaattcgcaagccgatcattgcggcggtttctggctttgcgctgggtggcggctgcgagctggccatgatgtgcgacatcatcttcgcggcggacacggccaagttcggccagccggaaatcaagctgggcgtcatgccgggggcgggcggcacgcagcgcctgccgcgcgcggtgtctaaggcgaaggcgatggacatgtgcctgaccgcgcgtttcatggatgctgccgaagcggagcgcgcggggctcgtgtcgcgcgtattgccggccgacacgctgcttgatgaggcgcttgccgccgcggcgacgatcgccgagttttcgctgccggcggtcatgatggtcaaggagtcggtgaaccgcgcgtacgagacgacgctggccgaaggcgtccacttcgagcgtcggctgtttcattcgctgttcgcgaccgaagaccagaaggaagggatggcggcattcgtcgagaaacggaagccggtgttcaagcaccgctga

SEQ ID NO: 2691 - protein, 258 aa, Burkholderia sp. 383
MAYENILVETRGRVGLVTLNRPKALNALNDALMDELGDALKAFDADDGIGAIVVTGSEKAFAAGADIGMMATYSYMDAYRGDYITRNWETVREIRKPIIAAVSGFALGGGCELAMMCDIIFAADTAKFGQPEIKLGVMPGAGGTQRLPRAVSKAKAMDMCLTARFMDAAEAERAGLVSRVLPADTLLDEALAAAATIAEFSLPAVMMVKESVNRAYETTLAEGVHFERRLFHSLFATEDQKEGMAAFVEKRKPVFKHR

SEQ ID NO: 2692 - DNA, 783 bp, Geobacter metallireducens GS-15
  CDS (1)..(783): transl_table=11
atgggaaccgagaatctgcttgttgacataaaagacggcgtggccctgctgaccatcaaccggcccaaggtgctgaacgccctccacacctcggtgatcgccgagttgcaggaaaccttcgaagcgttgaacgccaaccaggctgtcaaggcggtcgttatcacgggcagcggcgagaaggcctttgtggccggagccgacattgccgagatggcggtcatggacgcccagcaggccctcgttttcgcccgcacgggacagaagctggtgaactacatcggcaccatgcccaagccggtcatagccgccgtcaacggttttgccctggggggagggatggaactggccctggcctgcgatttcatctacgcctcggaaaacgccaagatgggactgccggaggtgaccctcgggatcatgcccgggttcggcggttcccagaagttcgcccggctcctggggcgcagtcgggccaacgagttgattttcaccggcaagatgctgactgccgccgaagcgaaggagtgggggatcgtcaacgccgtcttaccgcttgcggagctggtgggaaaggcccttgagacggccgcgagaattgccggcaacggcctcctcggggtcgcccatgtcaaggaagccatccgccggggcctcgatatgacggaaccggacggcatggactacgagtcggtcctttttgcctccctcttcgcctcccgtgaccagaaggaaggtatgggggcttttgtggaaaagcggaaaccgaactttaccgggtcgtaa

SEQ ID NO: 2693 - protein, 260 aa, Geobacter metallireducens GS-15
MGTENLLVDIKDGVALLTINRPKVLNALHTSVIAELQETFEALNANQAVKAVVITGSGEKAFVAGADIAEMAVMDAQQALVFARTGQKLVNYIGTMPKPVIAAVNGFALGGGMELALACDFIYASENAKMGLPEVTLGIMPGFGGSQKFARLLGRSRANELIFTGKMLTAAEAKEWGIVNAVLPLAELVGKALETAARIAGNGLLGVAHVKEAIRRGLDMTEPDGMDYESVLFASLFASRDQKEGMGAFVEKRKPNFTGS

SEQ ID NO: 2694 - DNA, 777 bp, Rhodospirillum rubrum ATCC 11170
  CDS (1)..(777): transl_table=11
atggcctacgaaaacattctcgtggaaaccaacggtaaagtgggcatcgtcacgctcaaccggcccaaggcgctcaatgccctttcggccgggttggtccgcgatctcggcgccgccctcgacgccttcgaggccgatgtgaacgtccacgtcatcgtcctgaccggctcggacaaggctttcgccgccggcgccgatatcaaggagatggccgaaaagtcctatatggacgcctatctcgaagacttcatcaccaagggctgggagcgggtgaccacctgccgcaagccgatcatcgccgccgtggccggattcgccctgggcggtggctgcgagatggcgatgatgtgcgatttcatcatcgccgcccagaacgccaaattcggccagcccgaaatcaacctgggcaccctgcccggcgccggcggcacccagcgtctgacccgcttcgtcggcaagtccaaggcgatggacatgtgtctgaccgggcggatgatggatgccgacgaggcttggaaatgcggcctcgtcagccgcatcgtcccggtggacgatctcaaggacgaggtgctgaagatcgccgaggcgatcgccgataaaagcctgccgatcaccatgatggtcaaggaggcggtcaatgccgcctatgagaccaccctggcccagggtgtccgattcgagcgccggcttttccaggcgagtttcgccaccgacgaccagaaggaaggcatgaacgccttcatcgaaaagcgtcagcccagtttcaccgaccgctga

SEQ ID NO: 2695 - protein, 258 aa, Rhodospirillum rubrum ATCC 11170
MAYENILVETNGKVGIVTLNRPKALNALSAGLVRDLGAALDAFEADVNVHVIVLTGSDKAFAAGADIKEMAEKSYMDAYLEDFITKGWERVTTCRKPIIAAVAGFALGGGCEMAMMCDFIIAAQNAKFGQPEINLGTLPGAGGTQRLTRFVGKSKAMDMCLTGRMMDADEAWKCGLVSRIVPVDDLKDEVLKIAEAIADKSLPITMMVKEAVNAAYETTLAQGVRFERRLFQASFATDDQKEGMNAFIEKRQPSFTDR

SEQ ID NO: 2696 - DNA, 777 bp, Burkholderia thailandensis E264
  CDS (1)..(777): transl_table=11
atggcttacgagaacatcctggtggagacgcggggccgggtgggactgattacgctgaatcgtccgaaggcgctgaatgcgctgaacgacgcgctgatggacgagctcggcgcggcgctcaaggtatttgatgcggatgagggtatcggcgcgatcgtgctgacgggcagcgagaaggcgttcgcagctggcgccgacatcgggatgatggcgacctattcgtatatggacgtcttcaagggcgactacatcacgcgtaactgggaggcggtgcgtcaggttcgcaagccggtcattgcggcggtggcgggtttcgcgctgggcggcggctgcgagctcgcgatgatgtgcgacatcatctttgcggccgataccgcgaaattcggccaacccgaaatcaagctcggcgtgctgccgggggcgggcggcacgcagcgtctgccgcgggcggtatcgaaggcgaaggcgatggacatgtgcctaaccgctcgcttcatggatgcggaggaggccgagcgcgcggggctggtgtcgcggattctgccggccgacaagttgctcgacgaagcgattgccgcggcgtcgacgatcgccgagttctcgttgcccgccgtgatgatggtgaaggaggcggtgaatcgcgcgtacgagacgaccttgtccgaaggggtgcacttcgagcgccgcttgtttcattcggcgtttgcaactgaagatcagaaggaaggcatggcggcgttcgtcgagaagcgcaagcccgtcttcaagcaccgctga

SEQ ID NO: 2697 - protein, 258 aa, Burkholderia thailandensis E264
MAYENILVETRGRVGLITLNRPKALNALNDALMDELGAALKVFDADEGIGAIVLTGSEKAFAAGADIGMMATYSYMDVFKGDYITRNWEAVRQVRKPVIAAVAGFALGGGCELAMMCDIIFAADTAKFGQPEIKLGVLPGAGGTQRLPRAVSKAKAMDMCLTARFMDAEEAERAGLVSRILPADKLLDEAIAAASTIAEFSLPAVMMVKEAVNRAYETTLSEGVHFERRLFHSAFATEDQKEGMAAFVEKRKPVFKHR

SEQ ID NO: 2698 - DNA, 786 bp, Novosphingobium aromaticivorans DSM 12444
  CDS (1)..(786): transl_table=11
atggccgagtacgaaaccatcctcgtcgaacagaagggtgctgtcaccctcatcactctgaaccgcccgcaggcgctcaacgcgctcaattcgcaggtgctggccgagctgatcgaagccttcgccgcctacgaggccgacgcctcgcagcgctgcgccgtgctgaccggatcgggcgagaaggcttttgccgccggggccgacatcaaggaaatgtcggaaaagcccgccgccgacttctataacgaggacttcttctcgaagtggaccagccacctcgtgaagaccacccgcaagccctggatcgctgccgtgaacggctttgctctgggcggcggctgcgagcttgccatgatggcggacttcatcatcgcttccgagaacgcgaagttcggccagcccgagatcaagcttggcgttgcccccggcatgggcggctcgcagcgcctgacccgcgcggtgggcaaggccaaggcgatggacatgtgcctgaccggccggatgatggacgccgccgaagccgagcgttcgggcctcgttacccgcgtcgtgccgctggccgatctgctggccgatgcgctcaagaccgccgagaccatcgccgcgatgccgccgatggcggctgtcgccaacaaggaaatggtcaacgccgcgttcgagaccacgctagaccagggcctgctgttcgaacgccgcgtgttccagatcctcaccgccagcgaggacaaggccgaaggcatgaaggccttcatcgaaaagcgccccggcgtgtggaagggacgttaa

SEQ ID NO: 2699 - protein, 261 aa, Novosphingobium aromaticivorans DSM 12444
MAEYETILVEQKGAVTLITLNRPQALNALNSQVLAELIEAFAAYEADASQRCAVLTGSGEKAFAAGADIKEMSEKPAADFYNEDFFSKWTSHLVKTTRKPWIAAVNGFALGGGCELAMMADFIIASENAKFGQPEIKLGVAPGMGGSQRLTRAVGKAKAMDMCLTGRMMDAAEAERSGLVTRVVPLADLLADALKTAETIAAMPPMAAVANKEMVNAAFETTLDQGLLFERRVFQILTASEDKAEGMKAFIEKRPGVWKGR

SEQ ID NO: 2700 - DNA, 783 bp, Desulfitobacterium hafniense Y51
  CDS (1)..(783): transl_table=11
atgacgtattcgaatatcctggttgattatcaggagcagattgccctggtgacgatcgatcgccccaaagccttaaacgcgctgaatacgctgaccttgcaggagctcagccaggttgttgaggatttggctaataattcctcggtacgggtcgtgattctgacgggaagcggtgaaaaggcctttgtagccggtgccgatatcgccgaaatgaacatgaaaaccccgctggaagcaaggacgttcagccaattaggccaaaagctgatgaatcagattgaaagcctgccccaaccggtcattgccgccatcaatggttttgccctgggtggaggtctggaattggcgatggcttgcgatattcgcctggccagtgagaaggcccgcttcgggcagccggaagtaaacctgggtataccggcaggctttggcggcacccaacggcttccccgcttggtaggcagcggacgggccagtgaaattctcctcacagccgagctgtttgatgctcaggaggccttccgcatgggtctggttaaccgggtttatcccaaagaagagcttcaggaacaagctctggctatggccaggaagatcgccgccaaagctcccgtcgccatacaattaaccaaaagcgccatttataaaggggccaatatggatctgatcagtggacaagattatgaagccgaggtttttgctttggccttccatactgaagaccgcaaggcgggctttaaagcctttctcgagaaaagccagactgaattccaggggcggtaa

SEQ ID NO: 2701 - protein, 260 aa, Desulfitobacterium hafniense Y51
MTYSNILVDYQEQIALVTIDRPKALNALNTLTLQELSQVVEDLANNSSVRVVILTGSGEKAFVAGADIAEMNMKTPLEARTFSQLGQKLMNQIESLPQPVIAAINGFALGGGLELAMACDIRLASEKARFGQPEVNLGIPAGFGGTQRLPRLVGSGRASEILLTAELFDAQEAFRMGLVNRVYPKEELQEQALAMARKIAAKAPVAIQLTKSAIYKGANMDLISGQDYEAEVFALAFHTEDRKAGFKAFLEKSQTEFQGR

SEQ ID NO: 2702 - DNA, 792 bp, Burkholderia xenovorans LB400
  CDS (1)..(792): transl_table=11
atgaccgaaaccgaaacattggtgcaatgcgaacgacgcggcgccgtgggtctgatcacgatcgaccggccgaaggcgctcaatgcgttgaatattgcgaccttgcttcagctcgaaacagcgctcaccgatctggagaacgaccccgccattcgcgtgatcgtcgtcacgggcagcggcgagcgtgccttcgtggcgggcggcgacatcggcgatctggacagccggcgtggactcgctcactaccaggagttcgccgaagtgatccatcgcgtgttccgtcgttttgagctgaccgacaagcccaccatcgcggcggtcaacggttgggcgctaggcggcggcactgagctgctgctcgcgctggacatccgtctggtggcgaaagaggcccgcgtgggtgtgccggagatcacgctcggcctgtttcccggcgccggtggttcgcaacgcctgattcggcagattccgctgtgccgcgcgaaggaactgatgttcgtcggcgaacagatcgacgccgacgaagcggtgtcgatcggtctgtgcaatcgcgccgtgccgcgagccgatctgctggatgaagcgctgggtatggccgccaggattgcgcagaagtcgccgctgacgctcaagctgctcaagcgtacgctgcgcgatgggctcgagatgcctctcgcctcggcgctttcacatgagcaggcaatgatcggcctggtactggacagcgaagacgcacacgaaggttgccgcgcatttctcgacaagcggccacccaatttcaccggtcgctga

SEQ ID NO: 2703 - protein, 263 aa, Burkholderia xenovorans LB400
MTETETLVQCERRGAVGLITIDRPKALNALNIATLLQLETALTDLENDPAIRVIVVTGSGERAFVAGGDIGDLDSRRGLAHYQEFAEVIHRVFRRFELTDKPTIAAVNGWALGGGTELLLALDIRLVAKEARVGVPEITLGLFPGAGGSQRLIRQIPLCRAKELMFVGEQIDADEAVSIGLCNRAVPRADLLDEALGMAARIAQKSPLTLKLLKRTLRDGLEMPLASALSHEQAMIGLVLDSEDAHEGCRAFLDKRPPNFTGR

SEQ ID NO: 2704 - DNA, 777 bp, Burkholderia xenovorans LB400
  CDS (1)..(777): transl_table=11
atggcttacgagaatattctggttgagacgcgggggcgggtcgggttggtcactttgaatcgaccgaaggcgctgaacgcgctgaacgacgcattgatggacgaactgggcgcggcgctgcgcgagttcgatgccgacgacgcgatcggtgcgatcgtggtgaccggcagcgagaaagcgttcgcggccggtgcagacgtcggcatgatgtccacttatacctatatggatgtttataagggggactacatcacccgcaactgggaaacggtccgctccatccgcaagccgatcattgcggcggtggcgggctttgcgcttggcggcggctgcgaattggcgatgatgtgcgatattatttttgccgccgacacggcaaagttcggtcagccggaaatcaagctcggcatcatgccgggtgccggaggcacgcagcggttgccgcgcgccgtctccaaggcgaaggcaatggacctttgcctgaccgcgcgtttcatggatgccgccgaagccgagcgtgccggcctggtgtcgcgtgttattccggctgcttctctggttgacgaggcggtagccgcggctgccacgatcgcagaattcccgttgccggccgtgatgatggtgaaggaatcggttaatcgtgcttatgagacgacgctcgcggaaggtgtgcatttcgagcgccgcctgttccattcgctcttcgctaccgaagaccagaaggaaggcatggccgcgttcgtggagaagcgcaaaccggttttcaaacatcgttaa

SEQ ID NO: 2705 - protein, 258 aa, Burkholderia xenovorans LB400
MAYENILVETRGRVGLVTLNRPKALNALNDALMDELGAALREFDADDAIGAIVVTGSEKAFAAGADVGMMSTYTYMDVYKGDYITRNWETVRSIRKPIIAAVAGFALGGGCELAMMCDIIFAADTAKFGQPEIKLGIMPGAGGTQRLPRAVSKAKAMDLCLTARFMDAAEAERAGLVSRVIPAASLVDEAVAAAATIAEFPLPAVMMVKESVNRAYETTLAEGVHFERRLFHSLFATEDQKEGMAAFVEKRKPVFKHR

SEQ ID NO: 2706 - DNA, 777 bp, Ralstonia metallidurans CH34
  CDS (1)..(777): transl_table=11
atgtcgtacgagaacatcctggtggagacgcgaggtcgcgttggtctggtgacgctgaaccggcccaaagcgctcaatgcgctcaatgacgcgctgatggacgaactgggcgcggcgctgacggcattcgaccaggacgaggcaatcggctgcatcgtcatcacggggagcgagcgtgccttcgccgcaggggccgatatcagcatgatggcgaagtactcctatatggatgtctacaagggcgactacatcacccgcaactgggagacaatccgccgcatccgcaaaccggtgatcgccgccgtggccggctatgcgctgggcggtggttgcgaactggcgatgatgtgcgacattgtgattgccgccgacagcgcgaagttcggccagccggaagtgaagctcggcacgatgcctggcgccggcggcacgcagcggctgccgcgtgccgtctccaaggccaaggcgatggacctgtgcctgaccgcgcgcatgatggatgccaccgaggccgagcgcgccgggctggtttcccggatcgtcccggcagacaaactggtagacgaagccgtggccgcggccgagactatcgccggttactcgctgccggttgtcatgatgatcaaggagtcggtgaacgctgcctatgagacgactctgaatgaaggggtccacttcgagcgccgactgttccactcgaccttcgccaccgaagaccagaaggagggtatggcagcgtttgtggagaagcgtgcacccaatttccagaatcggtga

SEQ ID NO: 2707 - protein, 258 aa, Ralstonia metallidurans CH34
MSYENILVETRGRVGLVTLNRPKALNALNDALMDELGAALTAFDQDEAIGCIVITGSERAFAAGADISMMAKYSYMDVYKGDYITRNWETIRRIRKPVIAAVAGYALGGGCELAMMCDIVIAADSAKFGQPEVKLGTMPGAGGTQRLPRAVSKAKAMDLCLTARMMDATEAERAGLVSRIVPADKLVDEAVAAAETIAGYSLPVVMMIKESVNAAYETTLNEGVHFERRLFHSTFATEDQKEGMAAFVEKRAPNFQNR

SEQ ID NO: 2708 - DNA, 783 bp, Acidobacteria bacterium Ellin345
  CDS (1)..(783): transl_table=11
atgacattcgaaaacattctctacgaagtaagaaatcagatcgcttacgtcaccatcaatcgcccgaaggtcctcaacgcgctcagcatcgccaccatcggcgagatcgggcaggcgatgcaggccgcgaaggacgatgccaacgcgcatgtcgtcatcctcactgggtcaggtgagaaggctttcgtcgcgggtgccgacatcaacgaactgaagaccgctacaagcgaagtcggcaagcaatatgcgctgcgcggacaggccgtgctgagcttgctcgaaaatctcggcaagcctgtcatcgcggctgttaacggtttcgccctcggcggaggctgcgaactggcgctcggctgcacgatgcgcttcgcttcggataacgcgaaactcggacagcccgaagtgaagctgggcatcatggccggtttcggtggctcgcaacgcttgccgcgactcgtagggcgcgggatgggcatgcagcttctcctcaccggcgagaccatcaccgcgcaggaggctctgcgcatcggactggtgaatgcggtcgttccgcaagccgagctgatggcctatgtcgagggcgtggcagcgaagatcatcgccaacgctccgctggcgatccagtacacgatggaggcggtgaatcacggcgccgatatgacgctcgcggaggggctctatctcgaagcgacacttttctcgatcacatgcgcgacggaagacaagaacgaaggcacgtcggcgtttctcgagaagcggggagcgacgtttaagggaagataa

SEQ ID NO: 2709 - protein, 260 aa, Acidobacteria bacterium Ellin345
MTFENILYEVRNQIAYVTINRPKVLNALSIATIGEIGQAMQAAKDDANAHVVILTGSGEKAFVAGADINELKTATSEVGKQYALRGQAVLSLLENLGKPVIAAVNGFALGGGCELALGCTMRFASDNAKLGQPEVKLGIMAGFGGSQRLPRLVGRGMGMQLLLTGETITAQEALRIGLVNAVVPQAELMAYVEGVAAKIIANAPLAIQYTMEAVNHGADMTLAEGLYLEATLFSITCATEDKNEGTSAFLEKRGATFKGR

SEQ ID NO: 2710 - DNA, 777 bp, Silicibacter sp. TM1040
  CDS (1)..(777): transl_table=11
atggcctatgagacgatcaacgtcgatactcaggaccacgtctgccttatcaagctgaaccggcctgaagcgttgaacgcgctcaattccgtccttttgggcgagttgtgtgccgctttggaagaagcggacgccagcgacaaagtgcgctgcatcgtgctgaccggatcggaaaaggcatttgcagcgggcgccgacatcaaggagatgtcggagatgagctatgtggatgtgttcacatccaacctctttgcggacgccaatgaccggatcgctgccatccgcaaaccgatcatcgctgcggtgtctggctatgcgctgggcggcgggtgcgaagtggccatgatgtgtgatttcatcatcgcggctgagaccgcgaaattcggccagcccgagatcaatctgggtgtcattgccggtatgggcggcacgcaacgcctcacccgttttgtgggcaagtcgaagtcgatggacatgaatctgaccggccgcttcatgactgccgatgaggcagagcgggcaggtctggtgtcgcgcgtggttccggccaaaaagctgatcgaagaggcgatggcagcagcctctaagatcgccgagaaatcagtactgacctcgattgcggccaaggaggccgtcaatcgcgcgtatgaattgccgcttagcgaaggcatgctctttgagcggcgggtcttccattccatgtttgcgacggaagaccaaaaggaaggtatggcagcgtttctagaaaaacgcgaagcccagttccgagacaagtaa

SEQ ID NO: 2711 - protein, 258 aa, Silicibacter sp. TM1040
MAYETINVDTQDHVCLIKLNRPEALNALNSVLLGELCAALEEADASDKVRCIVLTGSEKAFAAGADIKEMSEMSYVDVFTSNLFADANDRIAAIRKPIIAAVSGYALGGGCEVAMMCDFIIAAETAKFGQPEINLGVIAGMGGTQRLTRFVGKSKSMDMNLTGRFMTADEAERAGLVSRVVPAKKLIEEAMAAASKIAEKSVLTSIAAKEAVNRAYELPLSEGMLFERRVFHSMFATEDQKEGMAAFLEKREAQFRDK

SEQ ID NO: 2712 - DNA, 774 bp, Mycobacterium sp. MCS
  CDS (1)..(774): transl_table=11
atggactacgagaccatcctcgtcacccgcgagggccgggtcggcacgatcacgctgaaccgccccaaggcgctcaatgcgctcaactcgcaggtgatggccgaagtcaccacagcggcagccgaattcgactccgacgagggtatcggcgcgatcgtcgtcaccggcagcgagaaggccttcgcggcgggcgccgacatcaaggagatggcgagcctgtcgttcgccgaggtgttcacctcggacttcttcgcgctgtggggcaaattcgccgccacccgcaccccgaccatcgccgccgtggcgggttacgccctgggcggcggatgcgagctggcgatgatgtgcgacatcctcatcgccgccgacaccgcgaagttcggccagcccgagatcaagctgggcgtgctgcccggcatgggcggatcgcagcggctgacccgcgcgatcggcaaggccaaggcgatggacctgatcctgaccggccgcacgatcggcgccgaggaggccgagcgcagcggtctggtgtcacgggtggtgcccgccgaccgactgctcgacgaggccaacgaggtggccgcgacgatcgcggggatgtcgcgcaacgcatcccggatggccaaggaagcggtcgaccgtgccttcgagtccacgctgaccgagggcctgctctacgaacgccggctcttccactccaccttcgcgaccgaggatcagaaggaaggtatggcggcgttcagcgagaagcgcccggccaacttcacgcatcgctag

SEQ ID NO: 2713 - protein, 257 aa, Mycobacterium sp. MCS
MDYETILVTREGRVGTITLNRPKALNALNSQVMAEVTTAAAEFDSDEGIGAIVVTGSEKAFAAGADIKEMASLSFAEVFTSDFFALWGKFAATRTPTIAAVAGYALGGGCELAMMCDILIAADTAKFGQPEIKLGVLPGMGGSQRLTRAIGKAKAMDLILTGRTIGAEEAERSGLVSRVVPADRLLDEANEVAATIAGMSRNASRMAKEAVDRAFESTLTEGLLYERRLFHSTFATEDQKEGMAAFSEKRPANFTHR

SEQ ID NO: 2714 - DNA, 777 bp, Rubrobacter xylanophilus DSM 9941
  CDS (1)..(777): transl_table=11
ttggactacgtcaggctggagagggacgagagcggcatcgccgtcctcaccatagaccgccaggagaagctcaacgccctcaacccccaggtcaccgaggagatcgggcagaccctgctggacctggagcgggagtttccgcgggcgatcatcgtgaccggggccggggaccgctccttcgtggccggggcggacatcgaggcgatgagcaccatgcccccgctggaggccaagcgcttcgccgagatggggcacgccgcgatggccctcctggaccgtacgccggtgcccaccatcgccgcggtcaacggctacgcgctcgggggcggctgcgagatagccctggcctgcgatctgcgcgtcgccgccgagaacgccgtcttcggcttccccgaggtctctttgggcatcctgcccggcatgggcgggacccagcgcctcccgcgcctcgtgggcccggcggtcgcgaaggagctgatcttcaccggcaggcgcataagcgccggggaggcgcacaggatagggctggtcaaccgcgtcgtcccgcgcggcgaggcgcttgaggcggcccgtgagatggccgccgagatagccgccaacgccccgctcgccgtgcggcacgccaaggcggcggccaaccgggccttcgacgtggacctcatcagcgggctggagtacgaggccgaccagttctcgctgctgttctccaccgaggacgcccgcgaggggatgggcgccttcgtgcagaagcggaaggcggagttcaggggacgctga

SEQ ID NO: 2715 - protein, 258 aa, Rubrobacter xylanophilus DSM 9941
MDYVRLERDESGIAVLTIDRQEKLNALNPQVTEEIGQTLLDLEREFPRAIIVTGAGDRSFVAGADIEAMSTMPPLEAKRFAEMGHAAMALLDRTPVPTIAAVNGYALGGGCEIALACDLRVAAENAVFGFPEVSLGILPGMGGTQRLPRLVGPAVAKELIFTGRRISAGEAHRIGLVNRVVPRGEALEAAREMAAEIAANAPLAVRHAKAAANRAFDVDLISGLEYEADQFSLLFSTEDAREGMGAFVQKRKAEFRGR

SEQ ID NO: 2716 - DNA, 774 bp, Mesorhizobium sp. BNC1
  CDS (1)..(774): transl_table=11
atggcctatgaaacgattctggtggagacgcgtgggcgggtgggtctcatcacgctcaaccgcccgaaggcgctgaatgcgctcaataccaaaatgatggaggagttgatcggcgcggcagaggcattcgacgccaatccgcgcgtggggaccgttgtcattaccgggtcagagcgggcctttgccgccggggccgacatcaaggagatgcagcccaagacattcattgatgtctatatggaagacctctattcggattgggagcggctcacccgtgtccgcaagcctctcatcgctgcggtaagcggctatgcgcttgggggcggttgtgagctggcgatgatgtgcgatttcatcatagcggctgataatgccaagttcggccagccggagatcacccttggtgtcacgccgggcatgggcgggtcccagcgccttgctcgtttcgttggaaaatccaaggccatggagatgtgcctgacgggccgcatgatggatgcggaggaggctgagcgttgtggcctggtctcccgtgtcgtacctctgggagaattgattgaggatgtgcttgaggtggccggcaaaattgccgagttttccatgcccgcggtgatgatgacgaaagaggccgtcaaccgcgcctatgagacgacgctttcggaaggcctgcggttcgagcggcgggccttccattccctgtttgcgcttgatgaccgggaggaaggcatggccgcctttacggaaaagcgctctccgcaattccgtaaccgttga

SEQ ID NO: 2717 - protein, 257 aa, Mesorhizobium sp. BNC1
MAYETILVETRGRVGLITLNRPKALNALNTKMMEELIGAAEAFDANPRVGTVVITGSERAFAAGADIKEMQPKTFIDVYMEDLYSDWERLTRVRKPLIAAVSGYALGGGCELAMMCDFIIAADNAKFGQPEITLGVTPGMGGSQRLARFVGKSKAMEMCLTGRMMDAEEAERCGLVSRVVPLGELIEDVLEVAGKIAEFSMPAVMMTKEAVNRAYETTLSEGLRFERRAFHSLFALDDREEGMAAFTEKRSPQFRNR

SEQ ID NO: 2718 - DNA, 777 bp, Rhodococcus sp. RHA1
  CDS (1)..(777): transl_table=11
gtgaccgacttcgagaccatcctgctcgaacgcacgggccgggtggggatcatcaccctcaaccgtccgaaagcgctcaacgccctgaactccgagctgatgcgcgaggtcgtgtcggcggtagaggagttggagaaggattcggagatcggtgccattctgatcaccggttccgatcgcgcattcgcggcgggcgccgacatcaaggagatgcagcccaagtcgtacatggacgtctacctggacgacttcttcgccgcgtgggatcggctcgccgcggcccgcaagccgacgatcgcggccgtcgccggttacgcgctcggcggcggatgcgagctggcgatgctctgcgacatcctgatcgccgccgacaccgcgaagttcggtcagccggagatcaagctcggtgtcatccccggcatcggcggttcacagcggctgacgcgcgcggtgggtaaggccaaggccatggaattgtgcctgaccggccggaacatggacgccgaggaagccgaacgcgccggactggtgtcgcggatcgtgcccgccgcggatctcctggacgaggcgctgcagacggcgaccaccatcgccgagatgtcgcttccggtcgcgatgatggcgaaggaagccgtgaaccgctcgttcgagaccaccctcaccgagggtgtccggttcgagcgtcgggtgttccattcgacgttcgccaccgaggatcagaaggaagggatggcggcgttcgtcgagaagcgtgcgccagtattcaagcaccgctag

SEQ ID NO: 2719 - protein, 258 aa, Rhodococcus sp. RHA1
MTDFETILLERTGRVGIITLNRPKALNALNSELMREVVSAVEELEKDSEIGAILITGSDRAFAAGADIKEMQPKSYMDVYLDDFFAAWDRLAAARKPTIAAVAGYALGGGCELAMLCDILIAADTAKFGQPEIKLGVIPGIGGSQRLTRAVGKAKAMELCLTGRNMDAEEAERAGLVSRIVPAADLLDEALQTATTIAEMSLPVAMMAKEAVNRSFETTLTEGVRFERRVFHSTFATEDQKEGMAAFVEKRAPVFKHR

SEQ ID NO: 2720 - DNA, 777 bp, Rhodococcus sp. RHA1
  CDS (1)..(777): transl_table=11
gtgaccgactacgacaccatcctcctcgaccgcaaaggtcgggtcggaatcatcaccctcaaccgcccgaaagcgctcaacgcgttgaacacccagcttctacgcgaactcgtcaccgccgtcgaagaactcgacaccgacagcgacatcggggccatcctcgtcaccggctccgaccgcgccttcgccgccggcgccgacatcaaagaaatgcaaaccaagtcgtacatggacgtctacctggacgacttcttctccatcggcgaccgcatcgccgccgcacgcaaacccatcatcgccgcagtcgcgggatacgccctcggcggcggctgcgagctggcaatgatgtgcgacatccttctcgccgcggacaccgccaagttcggtcagcccgagatcaagctcggcgtcatccccggcatcggcggctcacaacgcctcacccgcgccgtcggtaaggcgaaggcgatggagctgtgcctgaccggccgcaccatggacgccgaggaggccgaacgcgccggactcgtgtcccggatcgtccccgccgccgacctgttcgacgaagcactgcagaccgccaccactgtcgccgagatgtcactgcccgtcgcgatgatggcgaaggaagcagtcaaccgggcattcgagaccaccctcaccgaagggatccgcttcgaacggcgggtcttccactccaccttcgccaccgaggaccagaaggaaggcatggccgcgttcgtggagaagcgcacgcctgcgttcacacaccgctag

SEQ ID NO: 2721 - protein, 258 aa, Rhodococcus sp. RHA1
MTDYDTILLDRKGRVGIITLNRPKALNALNTQLLRELVTAVEELDTDSDIGAILVTGSDRAFAAGADIKEMQTKSYMDVYLDDFFSIGDRIAAARKPIIAAVAGYALGGGCELAMMCDILLAADTAKFGQPEIKLGVIPGIGGSQRLTRAVGKAKAMELCLTGRTMDAEEAERAGLVSRIVPAADLFDEALQTATTVAEMSLPVAMMAKEAVNRAFETTLTEGIRFERRVFHSTFATEDQKEGMAAFVEKRTPAFTHR

SEQ ID NO: 2722 - DNA, 777 bp, Hyphomonas neptunium ATCC 15444
  CDS (1)..(777): transl_table=11
atgaccgattacaagacgattacgtttgagcagaagggccgcgtagccctggtgaccctcaatcgccctgacgcgctcaatgcactgaacgctgaagttatgcaggaagtggtggattgtttcgctgcgattgatcgcaacaaggacattgccgtcagcgtcctgaccggggccgggcgggcgtttgccgctggcgctgacatcaaggaaatgcagccgcaatctttctctgacatgtatgtggaagactatttcgcaggctgggaccgttttgcggcttcgcgcaagccggttattgctgcggttaatggcttcgcgctgggcggcggatgcgaactcgcgatgatgtgtgacctgatcattgcgtctgataaagccaagttcggtcagcccgaaatcaagctcggcgtgacaccgggtatgggcggctccatccgtctgacgaaagctgtcggcaaggccaaggctatggatctcgtactcacagggcggatgattgacggcactgaagccgaccggatcggccttgtttcccgcgttgtgcctcatgatacgttgatggaggttgcactggcggcggcagaagagatcgcggcattctccgtgccttcgttgatggcggccaaggaaatggttgcccgcgcgctagaacttccgacaacggaaggggtgaaattcgaacgccgcctgttccagggcctgtttggcactgccgaccagaaagaaggcatgagcgcattcagtgagaagcgccctgcaaagtttgaggacaagtaa

SEQ ID NO: 2723 - protein, 258 aa, Hyphomonas neptunium ATCC 15444
MTDYKTITFEQKGRVALVTLNRPDALNALNAEVMQEVVDCFAAIDRNKDIAVSVLTGAGRAFAAGADIKEMQPQSFSDMYVEDYFAGWDRFAASRKPVIAAVNGFALGGGCELAMMCDLIIASDKAKFGQPEIKLGVTPGMGGSIRLTKAVGKAKAMDLVLTGRMIDGTEADRIGLVSRVVPHDTLMEVALAAAEEIAAFSVPSLMAAKEMVARALELPTTEGVKFERRLFQGLFGTADQKEGMSAFSEKRPAKFEDK

SEQ ID NO: 2724 - DNA, 774 bp, Rhizobium leguminosarum bv. viciae 3841
  CDS (1)..(774): transl_table=11
atggcctatgagaccctgatcgtcgaaacccgaggtaatgtcggcctcgtcacgctgaaccgcccgcaggcgctgaatgcgctgaattccaccgtcctgaaggaactgaaagaggcctatgccgccttccacgccgacgagacggtcggggcgatcgtgctgaccggttccgagcgcgccttcgctgccggcgcagatatcaaggagatgcagccgcttcagttcgccgatatctataagagtgatttcatcagtggctgggatgaggtcgccaaggcacgcaagccggtgatcgctgccgtcagcggctttgcgctcggcggcggctgcgagctcgccatgatgtgcgatttcatcatcgcctcggagacggcgaagttcggccagccggaaatcaccctcggcgtcattcccggcatgggcggttcgcagcggctgacgcgcgccgtcggcaaggcgaaggcgatggatcttatcctgaccggccgcatgatggatgcggcggaagccgaacgatcgggactcgtttcgcgtgtggtggcgcccgaacgtctgctcgacgaggcttttgccgcagccgaaaagatcgcttcgctgtcgcgcccctcggtgatgatggccaaggaggcggtcaaccgcgcattcgagacgacgatggaggagggattgcgtttcgagcgccgcctgtttcacagtctctttgccacggacgaccagaaggaaggcatggcggccttcgtcgagaagcgcaaacctgcttttacgcaccgttga

SEQ ID NO: 2725 - protein, 257 aa, Rhizobium leguminosarum bv. viciae 3841
MAYETLIVETRGNVGLVTLNRPQALNALNSTVLKELKEAYAAFHADETVGAIVLTGSERAFAAGADIKEMQPLQFADIYKSDFISGWDEVAKARKPVIAAVSGFALGGGCELAMMCDFIIASETAKFGQPEITLGVIPGMGGSQRLTRAVGKAKAMDLILTGRMMDAAEAERSGLVSRVVAPERLLDEAFAAAEKIASLSRPSVMMAKEAVNRAFETTMEEGLRFERRLFHSLFATDDQKEGMAAFVEKRKPAFTHR

SEQ ID NO: 2726 - DNA, 798 bp, Pseudomonas aeruginosa UCBPP-PA14
  CDS (1)..(798): transl_table=11
atggattcctcccctggggcggtgagccccgaactcgtgctgctggaccggccggagcagggcgtggccctgttgcgactgaaccgcccggcagtactcaacgccctgaacatgcgcctgcgcgaggctctggcggagtacgtacggcgcctcgacgagtgcgccgatacccgggtcatcgtcctcaccggaaatggcacggcgttcgccgccggcgccgatctcaacgaactggcggaggcgtccgcgctggagatccagcagcgcggggtggagcgccactggcaggcgctcgccgcctgccgcaagccgctgatcgccgccgtggagggccatgccctgggcggaggctgcgagttggcgatgcactgcgacctgatcgtcgccggtgcctcggcgcgcttcgcccagccggaaatccgtgtcggcgtgatgcccggcgccggcggcacccagcgcctggtgcgagcggtgggcaagttccaggcgctgcgcatgctgtttaccggttgcacggtacgggcgccggaggccctggccatagggttggtcagcgaggtggcggcggatggccaggcattggatcgcgccctcgaactggctcgccagatcgccggcctgccgccgctggcgctggcgcagatcaaggaagtggtcctggccggcgccgacctgccgctggaccaggccctggcgctggagcgcaaggccttccagttgctgttcgacagccacgaccagaaggagggcatgcgtgccttcctggaaaaacgcacagcggagtacctgggaaaatga

SEQ ID NO: 2727 - protein, 265 aa, Pseudomonas aeruginosa UCBPP-PA14
MDSSPGAVSPELVLLDRPEQGVALLRLNRPAVLNALNMRLREALAEYVRRLDECADTRVIVLTGNGTAFAAGADLNELAEASALEIQQRGVERHWQALAACRKPLIAAVEGHALGGGCELAMHCDLIVAGASARFAQPEIRVGVMPGAGGTQRLVRAVGKFQALRMLFTGCTVRAPEALAIGLVSEVAADGQALDRALELARQIAGLPPLALAQIKEVVLAGADLPLDQALALERKAFQLLFDSHDQKEGMRAFLEKRTAEYLGK

SEQ ID NO: 2728 - DNA, 786 bp, Pseudomonas aeruginosa UCBPP-PA14
  CDS (1)..(786): transl_table=11
atgtccgccgatccttcgcccgtggttctgctcgaatttcccgcagccgatatcgccctgcttcgcctcaatcgtccgcaagccaggaacgcgctgaacgacgaagtgcgccagcgcctcgccagccacttccagacgctcggcgcggatccggcgatccgcgtcatcgtgctcaccggcgactcgcgctgctttgcagctggcgccgatctccgcgatctctcgacgagcacggcgatcggcctgtacggccgccacagcgagcgctactgggaagccatcgcgcgctgcccgaagccggtgatcgccgcggtcaacggcttcgccctgggcggcggctgcgaactggcgatgcattgcgacctgatcgtcgccggcgagtcggcacagttcgcccagccggagatcaaggtcggggtgatgccgggtgccggcggcacccagcgcctggtacgggcggtgggcaagttccaggcgctgcgcatgctgttcaccggctgcctggtgaaggctccgcaagcgctggccatgggcctggtcagcgaagtggtggcggacgagtcgacgctggcgcgcgccctggaactggccacggagatcgcccgcctgccccctctggcgctggcgcagatcaaggaggtggtcctggccggtgccgacctgccgctggacagtgccctggccctggaacgcaaggcgttccagttgctgttcgactcgcaggaccagaaggaaggcatgcacgccttcctggagaaacgcccgccgaactaccaggggaaatag

SEQ ID NO: 2729 - protein, 261 aa, Pseudomonas aeruginosa UCBPP-PA14
MSADPSPVVLLEFPAADIALLRLNRPQARNALNDEVRQRLASHFQTLGADPAIRVIVLTGDSRCFAAGADLRDLSTSTAIGLYGRHSERYWEAIARCPKPVIAAVNGFALGGGCELAMHCDLIVAGESAQFAQPEIKVGVMPGAGGTQRLVRAVGKFQALRMLFTGCLVKAPQALAMGLVSEVVADESTLARALELATEIARLPPLALAQIKEVVLAGADLPLDSALALERKAFQLLFDSQDQKEGMHAFLEKRPPNYQGK

SEQ ID NO: 2730 - DNA, 786 bp, Solibacter usitatus Ellin6076
  CDS (1)..(786): transl_table=11
atgccttacagccagatcctgttcgacgtgtccgaggccggggttgcgctgatcacgatcaatcgtccggagaagctgaatgccctctcgagcgcggtgatcggcgaactggcgcaggcgttcgcgcaggtggccggcgacccgggcattcgcggcgcgattctgacaggagccggcgagaaggccttcgtggccggcgcggacatcagtgaactggcgtcgctgacggcgtatgaagcgcgcggattcgcgctgcgcggccagggtgtgttccgcgagctggaaacctgcggcaagccctccgtggcggctgtgaatggcttcgccctgggcggcggcttggaactggcgatggcgtgtacggtgcgcttcgcgagcgagaacgcgaagctggggcagccggaagtgaagctcggaatcatcccgggctacggcggcacgcagcggctgccgcgcctggtgggccgggggcgcgcgctcgagctgctgttggccggcgacccgattccggcggcggaggcctaccgcatcggcctggtgaacgcggtgaccccgcaggcggaactgctggagtacagccggggatggctggcgaaggtgctggccaacggtccactggcgctcggtctggtgatggacgcggtggataccgggatgagctgcgggttggacgaggggctgcggcttgaggccgaggcgttcggcgtcagcgcggccaccgaagaccgccgcgaaggaacgcgcgcgtttctggagaagcgccgcgcggtatttacaggaaagtga

SEQ ID NO: 2731 - protein, 261 aa, Solibacter usitatus Ellin6076
MPYSQILFDVSEAGVALITINRPEKLNALSSAVIGELAQAFAQVAGDPGIRGAILTGAGEKAFVAGADISELASLTAYEARGFALRGQGVFRELETCGKPSVAAVNGFALGGGLELAMACTVRFASENAKLGQPEVKLGIIPGYGGTQRLPRLVGRGRALELLLAGDPIPAAEAYRIGLVNAVTPQAELLEYSRGWLAKVLANGPLALGLVMDAVDTGMSCGLDEGLRLEAEAFGVSAATEDRREGTRAFLEKRRAVFTGK

SEQ ID NO: 2732 - DNA, 792 bp, Mycobacterium avium 104
  CDS (1)..(792): transl_table=11
atgaccgacagcaccgaccgcaccttcgaaaccatcctcgtcgagcgcgaggagcgcgtcggcatcatcaccctgaaccggcccaaggcgctcaacgcgctcaacacccaggtgatgaacgaggtcaccaccgcggcaacggatttcgacgccgaccccggcatcggcgcgatcatcatcaccggatcggccaaggcgttcgccgcgggcgcggacatcaaggagatggccgagctgaccttcgccgacgcctacggcgccgacttcttcgccccctggggcaagctcgccgcgctgcgcaccccgacgatcgccgcggtggccgggcacgccctcggcggcggctgcgagctggccatgatgtgcgacgtgctgatcgccgccgacacggcgaaattcggccagcccgagatcaaactcggggtgctgcccggcatgggcggatcgcagcggctgacccgcgccatcggcaaggccaaggcgatggacctgatcctgaccggccgcaccatcgacgccgcggaagccgaacgcagcggcctggtttcgcgcgtggtgcccgccgacgacctgctgaccgaggcgaagaaggtcgccaccacgatttcgcagatgtcgcggtcggcggcccggatggccaaggaggccgtcaaccgcgctttcgaaactaccctggccgaggggctgctctacgaacgccggttgttccattcgactttcgccaccgccgaccagtccgaggggatggcggccttcgtcgagaagcgcgcgccgaacttcacccaccgctag

SEQ ID NO: 2733 - protein, 263 aa, Mycobacterium avium 104
MTDSTDRTFETILVEREERVGIITLNRPKALNALNTQVMNEVTTAATDFDADPGIGAIIITGSAKAFAAGADIKEMAELTFADAYGADFFAPWGKLAALRTPTIAAVAGHALGGGCELAMMCDVLIAADTAKFGQPEIKLGVLPGMGGSQRLTRAIGKAKAMDLILTGRTIDAAEAERSGLVSRVVPADDLLTEAKKVATTISQMSRSAARMAKEAVNRAFETTLAEGLLYERRLFHSTFATADQSEGMAAFVEKRAPNFTHR

SEQ ID NO: 2734 - DNA, 777 bp, Mycobacterium smegmatis str. MC2 155
  CDS (1)..(777): transl_table=11
atgagcgacttcgagacgatcctggtgacccgcaccgaccgggtcgccaccatccagctgaaccggcccaaggcgctcaacgcgctcaacagccaggtgatgacggaagtgaccgcggccgcagccgaactcgacaaggatccgggcgtcggcgcgatcatcgtcacgggcaacgagaaggccttcgccgcgggtgcggacatcaaggagatggcggacctgtcgttcgccgaggtcttcgaggcggacttcttcgaactgtggtccaagttcgccgccacccgcacgcccaccatcgccgcggtcgccgggtacgccctcggcggcggctgcgagctcgcgatgatgtgtgacatcctgatcgccgccgacaccgcgaaattcgggcagcccgagatcaagctcggcgtgctccccggaatgggcggttcgcaacggctcacccgcgcgatcggcaaggccaaggccatggacctcatcctcaccggacgcaccatcgacgccgccgaggccgaacgggccgggctggtctcgcgtctggtgcccgcggacacgctgatcgacgaggcgctcgcggtggcgcagaccatcgccgggatgtcgctgtcggcgtcgcgcatggccaaggaagccgtcaaccgcgcgttcgagaccagcctcaccgagggtctgctctacgagcgcaggctgttccactccgctttcgccaccgccgaccagaaagagggcatggccgcgtttgccgagaagcgcgccgccaacttcacgcatcgctaa

SEQ ID NO: 2735 - protein, 258 aa, Mycobacterium smegmatis str. MC2 155
MSDFETILVTRTDRVATIQLNRPKALNALNSQVMTEVTAAAAELDKDPGVGAIIVTGNEKAFAAGADIKEMADLSFAEVFEADFFELWSKFAATRTPTIAAVAGYALGGGCELAMMCDILIAADTAKFGQPEIKLGVLPGMGGSQRLTRAIGKAKAMDLILTGRTIDAAEAERAGLVSRLVPADTLIDEALAVAQTIAGMSLSASRMAKEAVNRAFETSLTEGLLYERRLFHSAFATADQKEGMAAFAEKRAANFTHR

SEQ ID NO: 2736 - DNA, 780 bp, Mycobacterium smegmatis str. MC2 155
  CDS (1)..(780): transl_table=11
atgaccacctacacaacgatcgcaaccagccggccggtggccggggtgggcctcatccgcctcgaccggccggacgcgctcaacgcgctcaaccagacgctcgaggccgaggtcctcgatgccgcgcgtgatttcgacgccgacctcgagatcggcgccatcgtggtgaccggttctgagcgtgcgttcgcggccggcgccgacatcgccgagatggtcaccctcaccccgcaccaggcgcgggagcgaaacctgttgtcgggctgggactctctgacgcaggtccgaaaaccgatcgtcgcggcggtcgccggctacgccctgggcggtggctgcgaactcgccatgctgtgcgacctggtcatcgcggccgacacggccagattcggccagcccgagatcaccctcggcatcctgccgggtctcggtgggacgcaacggctcacgcgggcggtcgggaaggccaaggccatggacctgtgcctgacggggcgcagcctgaccgccgaagaagccgagagggtcggcctggtcagccgcatcgtcccggccgccgatctgctcgacgaagccctcgccgtcgcgcagcgcatcgcgcgtatgtcgcgccccgcaggccgtgcggtcaaggatgccatcaacgaggcgttcgaacggccgctgtccgcgggcatgcgatacgagcgtgacgccttctacgccatgttcgacacccacgaccagaccgagggcatgaccgcgttcctggagaaacgcacgccagagttcaccgaccgctga

SEQ ID NO: 2737 - protein, 259 aa, Mycobacterium smegmatis str. MC2 155
MTTYTTIATSRPVAGVGLIRLDRPDALNALNQTLEAEVLDAARDFDADLEIGAIVVTGSERAFAAGADIAEMVTLTPHQARERNLLSGWDSLTQVRKPIVAAVAGYALGGGCELAMLCDLVIAADTARFGQPEITLGILPGLGGTQRLTRAVGKAKAMDLCLTGRSLTAEEAERVGLVSRIVPAADLLDEALAVAQRIARMSRPAGRAVKDAINEAFERPLSAGMRYERDAFYAMFDTHDQTEGMTAFLEKRTPEFTDR

SEQ ID NO: 2738 - DNA, 867 bp, Nocardioides sp. JS614
  CDS (1)..(867): transl_table=11
ttgttcccgatgacggcacaatgccggggagcgaccatcgagatcggcgaccgattcggcaaccaggacagagaggcgggtcacggcatgggtgagttcgtacgactggaggtggccgacggcgtcggcacgatccggctggaccggccgaagatgaacgccctgaacgtgcaggtgcaggaggagatccgcgcggcggccgtcgaggccaccgagcgcgacgacgtgaaggccgtggtggtgtacggcggcgagcgggtcttcgccgcgggcgccgatatcaaggagatggccgacatgtcgtacaccgacatggtcaagcgctccggcccactccagtccgcgctcggcgcggtggcccggatcccgaagcccgtggtcgccgcgatcaccggctacgcgctcggcggcggctgcgagctggcgctgtgcgcggatgtccggttcgccgccgaggacgcggtcctcggccagcccgaggtgctgctcggcatcatcccgggggccggcggcacccagcggctgacccgactggtcggcccgagcaaggcgaaggacatcgtcttcaccggccggttcgtcaaggccgacgaggcgctggcgatcggcctggtcgaccgggtcttcccggccgcgtcggtctacgacgaggcgctcgcgtgggcgggccggttcgccggggcggcgtcgtacgcactgcgggccgcgaaggagagcatcgaccgcggcatcgaggtcgacctggagacgggcctggagatcgagcggcagcagttcgcggcgctgttcgcgaccgaggaccgctcgatcggtatgcgatccttcgtcgagaacggaccgggcaaggcgcagttcgagggcaggtga

SEQ ID NO: 2739 - protein, 288 aa, Nocardioides sp. JS614
MFPMTAQCRGATIEIGDRFGNQDREAGHGMGEFVRLEVADGVGTIRLDRPKMNALNVQVQEEIRAAAVEATERDDVKAVVVYGGERVFAAGADIKEMADMSYTDMVKRSGPLQSALGAVARIPKPVVAAITGYALGGGCELALCADVRFAAEDAVLGQPEVLLGIIPGAGGTQRLTRLVGPSKAKDIVFTGRFVKADEALAIGLVDRVFPAASVYDEALAWAGRFAGAASYALRAAKESIDRGIEVDLETGLEIERQQFAALFATEDRSIGMRSFVENGPGKAQFEGR

SEQ ID NO: 2740 - DNA, 783 bp, Nocardioides sp. JS614
  CDS (1)..(783): transl_table=11
atgagcgccgggttcgagacgctgctggtcgaggtcgccgacgggatcgcagtggtgaccgtcaaccgcccggaggtccgcaatgcggtgagccggcaggtccaggccgacctccgcgccgtcctcgacacgttccgtcacgacgacgcggtggaggtggtggtgttcaccggcgcgggcgaccgcgccttcgtcgccggcgccgacatcgcccagctgcgcgactacacgctgcacaccggactcgcctcggagatgcaggcgctctacgacgaggtcgaggcctatgagaagccgaccatcgccgcggtcaacggctacgccctgggcggtggctgcgagctcgcgatggcgtgcgacctgcgggtggcgtccacgagcgcccggttcgggctgccggagaccaacctcgccgtactgcccggcgcgggcggcacccagcggctcgccaggctggtcggcgtggggcgtgccctcgagctgatcctcaccggacggctcgtcgacgccgaggaggcccgcacgatcgggctggtcacctcggtggtcgcaccggaggagctcctcccccacgcccgcgaggtggccgggcagatccgggccaagggtccgctcgcggtccggctcgccaagctggtggtgcgctccggcatggacaccgaccggcggaccggcctggtcatcgagcagctggcccagtcgctgctctacaccaccggggacaagcgggagggcgccgaggcgttcctggccaagcgcacccctgcgttccggggggcctga

SEQ ID NO: 2741 - protein, 260 aa, Nocardioides sp. JS614
MSAGFETLLVEVADGIAVVTVNRPEVRNAVSRQVQADLRAVLDTFRHDDAVEVVVFTGAGDRAFVAGADIAQLRDYTLHTGLASEMQALYDEVEAYEKPTIAAVNGYALGGGCELAMACDLRVASTSARFGLPETNLAVLPGAGGTQRLARLVGVGRALELILTGRLVDAEEARTIGLVTSVVAPEELLPHAREVAGQIRAKGPLAVRLAKLVVRSGMDTDRRTGLVIEQLAQSLLYTTGDKREGAEAFLAKRTPAFRGA

SEQ ID NO: 2742 - DNA, 777 bp, Azoarcus sp. BH72
  CDS (1)..(777): transl_table=11
atgagcttcgagaacatcctcaccgagacccgcggccgcgtcgggctcatcaccctcaaccggccgaaggcgctcaacgcgctcaatgacgccctggtggacgaagtcggccaggcgctggacgccttcgaggccgacgagaacatcggcgcaatcgtcatcaccggttcggagaaggccttcgccgcgggcgccgacatcggcgccatggcgaccttctcgtacatggacgcctacaagggcgactacatcacccgcaactgggaacgcgtgaagacctgccgcaagccggtgatcgccgcggtggccggtttcgccctcggcggcggctgcgaactggcgatgatgtgcgacatcatcatcgccgccgacaccgcgaagttcggacaacccgaagtcaagctcggcatcctgccgggtgccggcggaacccagcgcctcccgcgcgcagtgggcaaggccaaggcgatggacatgtgcctgaccgcccgcttcatggacgccaccgaagcggaacgcgccggcctggtgtctcgcgtcgtcccggccgacacgctcgtcgatgaggcgctctcggcggctgaagccatcgccagctactcgctgccggtcgtcatgatgatcaaggaatcggtcaaccgggcattcgaaagcagcctcaacgaaggcctgctgttcgagcgccgcgtgttccacgccgccttcgcgctcaatgaccagaaagaaggcatggcggccttcgtcgccaagcgcaaagccaacttcagtcacgactga

SEQ ID NO: 2743 - protein, 258 aa, Azoarcus sp. BH72
MSFENILTETRGRVGLITLNRPKALNALNDALVDEVGQALDAFEADENIGAIVITGSEKAFAAGADIGAMATFSYMDAYKGDYITRNWERVKTCRKPVIAAVAGFALGGGCELAMMCDIIIAADTAKFGQPEVKLGILPGAGGTQRLPRAVGKAKAMDMCLTARFMDATEAERAGLVSRVVPADTLVDEALSAAEAIASYSLPVVMMIKESVNRAFESSLNEGLLFERRVFHAAFALNDQKEGMAAFVAKRKANFSHD

SEQ ID NO: 2744 - DNA, 795 bp, Azoarcus sp. BH72
  CDS (1)..(795): transl_table=11
atgacagacaaggcttacctgcccggtgagggcgtgatcgtggccggccccgatgccggcgtactcgaaatccggctggatcgtccgcaggcgaagaacgcattgtcgacgccgctgctgcgcagcatcgtcgcgctgctggagcaggcggaacacgacgacgcggtgcgctgcatcgtgctcaccggcggtgatcaggtgttcgccgccggcgccgacctggccgagatggccgccaaggacatgcaggcggtgctgctggaagagcggccccggctgttcggcgcgatcgcgcgctttcccaagcccatcatcgccgccgtgtgcggctatgcgctgggcggcggttgcgagctggtgatgcatgccgacatcgtcatcgccggcgagtcggcgcagttcggtcagcccgaaatcaatctcggcatcatccccggcgccggcggcacccagcgcctgacccgcgcggtcggcaagtcggtggcgatgaagctggtgctggcgggcgagttcatcccggcgcaggaagcgcgcgccgccgggctggtggcggaagtggtggccgacgaggcctgcatcgcacgcgcccacgagctggccggcaagatcgccaagaaggcaccgctggcggtgcggctggccaaggattcggtgctgcaggccttcgagacgccgctcgccgccgggctggcgatcgagcgccgcaacttcgtggtgctcgccggcaccgaggaccgcaacgagggcgtcaaatccttcctggaaaagcgcaagccggtctggaagggccgctga

SEQ ID NO: 2745 - protein, 264 aa, Azoarcus sp. BH72
MTDKAYLPGEGVIVAGPDAGVLEIRLDRPQAKNALSTPLLRSIVALLEQAEHDDAVRCIVLTGGDQVFAAGADLAEMAAKDMQAVLLEERPRLFGAIARFPKPIIAAVCGYALGGGCELVMHADIVIAGESAQFGQPEINLGIIPGAGGTQRLTRAVGKSVAMKLVLAGEFIPAQEARAAGLVAEVVADEACIARAHELAGKIAKKAPLAVRLAKDSVLQAFETPLAAGLAIERRNFVVLAGTEDRNEGVKSFLEKRKPVWKGR

SEQ ID NO: 2746 - DNA, 771 bp, Magnetospirillum magnetotacticum MS-1
  CDS (1)..(771): transl_table=11
atgacggaagtgctgttggaaaaaccctttgattccgtggtgttgctgcgaatcaaccggcccgaggccaagaacgcccttaacggcgaggtccgccgtcagttggccgagcacatgacggcgctgggtgcggacccctcggtgcgggccatcgtcatgacgggcaaccaggaggctttcgccgccggggccgatatcaaggacatggccgaggtgggcgccatcgaactgatgcagaggaacaaccacctgctgtggcgggctatcgccaattgcccaaagccggtgattgccgccgtgaacggttatgcctggggcggcggctgtgaactggtcatgcatgccgacatcatcgtggcgggcgaaaacgccagcttctcccagcccgaggtcaaggtgggcatcatgcccggcgcgggcggcacccagcgcctgacgcgggccgtgggcaagttcaaggccatgctgatggtgatgaccggccaggccatcagcggtgtggaggccggtcagatgggccttgccagtctggtggtccccgatgagcaggttctggacaaggctttggagatcgccaagaccatctcgcgcatgccgcccgtggccatcgcccagatcaaggaagtgctgctggcgggtcaggatgcctcgctcgataccgccttgatgctggagcgtaaggcgttccaactgctattcgccagccgcgaccagaaggaaggcatgaaggccttcatcgagaagcgcaagcctgcttatgagggaaaatga

SEQ ID NO: 2747 - protein, 256 aa, Magnetospirillum magnetotacticum MS-1
MTEVLLEKPFDSVVLLRINRPEAKNALNGEVRRQLAEHMTALGADPSVRAIVMTGNQEAFAAGADIKDMAEVGAIELMQRNNHLLWRAIANCPKPVIAAVNGYAWGGGCELVMHADIIVAGENASFSQPEVKVGIMPGAGGTQRLTRAVGKFKAMLMVMTGQAISGVEAGQMGLASLVVPDEQVLDKALEIAKTISRMPPVAIAQIKEVLLAGQDASLDTALMLERKAFQLLFASRDQKEGMKAFIEKRKPAYEGK

SEQ ID NO: 2748 - DNA, 777 bp, Magnetospirillum magnetotacticum MS-1
  CDS (1)..(777): transl_table=11
atggctttcgagaacatcaccgtcgagacccgcggcaatgtcggcctgatcgcgctgaaccgccccaaggccatgaacgcgctctgtgccgccctgatcaccgagctgggccaggcgctggacgccttcgaggccgatgatgccatcggcgccgtggtgctgaccggttcggaaaaggccttcgccgccggtgccgacatcaaggagatggccgataagggctatatggacaactacctgtccaacttcatcaccgacggctgggagcgtgtcaccaagtgccgcaagccggtcgtcgcggcggtggccggcttcgcgctgggcggcggctgcgagatggccatgatgtgcgacttcatcatcgccggcgacaatgccaagttcggccagcccgagatcaccatcggcaccatccccggcgcgggcggcacccagcgcctgacgcgggccgtgggcaaggccaaggccatggaaatgtgcctgacggggcgcatgatggacgccgccgaggccgagcgctccggtctggtcagccgcgtcgtgccggtggccgaactggtggacgaagccgtcaaggccgccaccaagatcgccgctctgtcgcggcccatcgtcatgctgtgcaaggaatcggtcaacgccgccttcgagaccacgctggcccagggcgtcaccttcgagcgccgcctgtttcattccaccttcgccaccctcgaccagaaggaaggcatggcagccttcgtcgagaagcgcgcgcctgctttcaagaatcgttaa

SEQ ID NO: 2749 - protein, 258 aa, Magnetospirillum magnetotacticum MS-1
MAFENITVETRGNVGLIALNRPKAMNALCAALITELGQALDAFEADDAIGAVVLTGSEKAFAAGADIKEMADKGYMDNYLSNFITDGWERVTKCRKPVVAAVAGFALGGGCEMAMMCDFIIAGDNAKFGQPEITIGTIPGAGGTQRLTRAVGKAKAMEMCLTGRMMDAAEAERSGLVSRVVPVAELVDEAVKAATKIAALSRPIVMLCKESVNAAFETTLAQGVTFERRLFHSTFATLDQKEGMAAFVEKRAPAFKNR

SEQ ID NO: 2750 - DNA, 789 bp, Rubrivivax gelatinosus PM1
  CDS (1)..(789): transl_table=11
atggactaccagcatctgctgaccgaagtgcgcggcagcgccgcgctgaagaccgggtggatcactctgaaccggcccaaggcgctgaatgcgctcaacgatgcgctgatggacgaactgggcgacgcgctgcgggtctacgatgccgacgcctcgatcggctgcgtggtgatcaccggcagcgagaaggccttcgccgccggcgccgacatcggcggcatggcgtcgcagacctacatggacgcctacaagggcgacttcatcacccgcaactgggaggcggtgcgcagcgtgcgcaagccggtgatcgcggcagtggccggctacgcgctgggcggtggctgcgagctggccatgatgtgcgacctgatcatcgccgcggacacggcgcgcttcggtcagccggagatcaagctcggcatcatccccggcgctggcggcacgcagcggctgccgcgggcggtcggcaaggccaaggcgatggacctggtgctgacggcacgcatgatggatgcggccgaggccgagcgcgccggcctggtgtcacgcgtggtgccggccgatcgcctgctggccgaggcccaggaggcggcggacgcgatcggcgcgatggggttgccggccatcctggtggccaaggagtgcgtgaaccgcgcctacgagtcgccgctgtcggacggcgtgtggttcgagcggcgcatgttccagtcgctgttcggcaccgaggaccagaaggaaggcatggacgccttcgcgaacaagcgcaagccggtgttccgtcaccgctga

SEQ ID NO: 2751 - protein, 262 aa, Rubrivivax gelatinosus PM1
MDYQHLLTEVRGSAALKTGWITLNRPKALNALNDALMDELGDALRVYDADASIGCVVITGSEKAFAAGADIGGMASQTYMDAYKGDFITRNWEAVRSVRKPVIAAVAGYALGGGCELAMMCDLIIAADTARFGQPEIKLGIIPGAGGTQRLPRAVGKAKAMDLVLTARMMDAAEAERAGLVSRVVPADRLLAEAQEAADAIGAMGLPAILVAKECVNRAYESPLSDGVWFERRMFQSLFGTEDQKEGMDAFANKRKPVFRHR

SEQ ID NO: 2752 - DNA, 777 bp, Burkholderia vietnamiensis G4
  CDS (1)..(777): transl_table=11
atgtcttacgagaacatcctggtggagacccgagggcgagtcggattgatcacgctcaaccgtccgaaggcgctcaatgcgctgaacgatgcgttgatggatgagttgggtgcggcgctgaaggcgttcgacgcagacgacgaaatcggcgcgatcgtcgtgacgggcagcgagaaggcgttcgcggccggcgccgacatcggcatgatggccacctattcgtatatggatgtgtaccgcggcgactacatcacgcgtaactgggagaccgtccgcgagatccgcaagccgatcattgcggccgtggcggggtttgcgctcggtggcggctgcgaactcgcgatgatgtgcgacatcatcttcgcggccgatacggccaagttcggccagccggagatcaagctgggcgtgatgcctggcgccggcggcacgcagcgtctgccgcgcgcggtctcgaaggcgaaggccatggacatgtgcctgactgcacgtttcatggatgcggccgaagccgagcgcgccgggctcgtgtcgcgtgtgctgccggccgacaaactcctcgacgaagcggttgcggctgcgacgacgatcgccgagttttcgctgccggcagtcatgatggtgaaggagtcggtgaatcgcgcgtacgagacaacgctggccgagggcgtccacttcgagcgccgcctgttccattcgctgtttgcgacggaagatcagaaggaagggatggcggcattcgtcgagaagcggaagccggtattcaagaaccgctga

SEQ ID NO: 2753 - protein, 258 aa, Burkholderia vietnamiensis G4
MSYENILVETRGRVGLITLNRPKALNALNDALMDELGAALKAFDADDEIGAIVVTGSEKAFAAGADIGMMATYSYMDVYRGDYITRNWETVREIRKPIIAAVAGFALGGGCELAMMCDIIFAADTAKFGQPEIKLGVMPGAGGTQRLPRAVSKAKAMDMCLTARFMDAAEAERAGLVSRVLPADKLLDEAVAAATTIAEFSLPAVMMVKESVNRAYETTLAEGVHFERRLFHSLFATEDQKEGMAAFVEKRKPVFKNR

SEQ ID NO: 2754 - DNA, 777 bp, Sulfitobacter sp. EE-36
  CDS (1)..(777): transl_table=11
atggcttatgaaacgatcacggtcgacgtcgacaaccacatcgcgcttgtcacgctgaaccgtcccgatgcgatgaacgcactgaatgaccagctgatgaccgagctggccgatgcgttgaaatcggctcaggaaaacgaaaaagtccgctgcatcgtgatcaccggctcggaaaaggcttttgccgccggtgccgatatcgccatgatgcgcgacaaaagcttcgtcgatgtctttgccggtgacctcttcacccccgagacagaccagattatgcgcgtgcgcaaacccatcattgctgctgtgtcgggctatgcccttggcggcggctgcgaactggcgatgatgtgtgactttatcatctgttccgaaagcgccaaattcgggcagcctgaaatcaaccttggcgttgttgcaggtattggcggcacgcagcgcctgacccgcgccatcggcaaatccaaagcgatggacatgaacctgaccggccgcttcatggatgccgccgaggcagagcgtgcgggccttgtatcgcgcgtcgtccccgtcaagaaactgatggaagaagccatggccgccgccgccaagatcgccgagaaatcgatgatctcgaccatggtggtaaaggaagccgtaaaccggtcgttcgaagtacccttgcgcgagggcctgctgtttgagcgtcgtattttccattcgctgttcgcgacggaagaccaaaaagaaggcatgtccgccttccttgaaaagcgcgaagcgcagttccgggacaagtaa

SEQ ID NO: 2755 - protein, 258 aa, Sulfitobacter sp. EE-36
MAYETITVDVDNHIALVTLNRPDAMNALNDQLMTELADALKSAQENEKVRCIVITGSEKAFAAGADIAMMRDKSFVDVFAGDLFTPETDQIMRVRKPIIAAVSGYALGGGCELAMMCDFIICSESAKFGQPEINLGVVAGIGGTQRLTRAIGKSKAMDMNLTGRFMDAAEAERAGLVSRVVPVKKLMEEAMAAAAKIAEKSMISTMVVKEAVNRSFEVPLREGLLFERRIFHSLFATEDQKEGMSAFLEKREAQFRDK

SEQ ID NO: 2756 - DNA, 777 bp, Roseovarius nubinhibens ISM
  CDS (1)..(777): transl_table=11
atggcctatgagacgatcatcgtcgaagtagaagaccacgtcgccctcatcaccctgaaccgccctgacgcattgaacgctctcaacgatcagttgctgagcgagctggtcaaggcgctcgaggacgcacagaacaatgacaaggtgcgctgcatcgtgatcaccggctcggaaaaggcattcgccgccggggccgacatcaagatgatgagcgagaagagctttgtcgatgtcttcgctggcgatcttttcggccccgaggccgaaggcattatgcgcatccgcaaaccgatcatcgcggccgtctccggctatgcgctgggcggcggctgcgaactggcgatgatgtgcgactttatcatctgctcggacaccgcgaaattcggccagcccgagatcaacctcggcgtcatcgccgggatgggcggcagccagcggctgacccgcttcatcggcaaatcgaaatccatggacatgaacctcaccggtcgcttcatggatgccgaagaggccgaacgctcgggtctggtgagccgcgtcgtgcccgccaagaagctgatggaagagaccatgacggcggcccagaagatcgccgagaaatccatgattgccgtgatggcggtcaaggaggcggtgaaccgctcctacgaggtgccgctgcgcgaaggtcttcttttcgagcgccgcgtcttccagtcgctctttgccaccgaagaccagaaagagggcatgtccgccttcgccgaaaaacgcgaggcccagttccgcgacaagtga

SEQ ID NO: 2757 - protein, 258 aa, Roseovarius nubinhibens ISM
MAYETIIVEVEDHVALITLNRPDALNALNDQLLSELVKALEDAQNNDKVRCIVITGSEKAFAAGADIKMMSEKSFVDVFAGDLFGPEAEGIMRIRKPIIAAVSGYALGGGCELAMMCDFIICSDTAKFGQPEINLGVIAGMGGSQRLTRFIGKSKSMDMNLTGRFMDAEEAERSGLVSRVVPAKKLMEETMTAAQKIAEKSMIAVMAVKEAVNRSYEVPLREGLLFERRVFQSLFATEDQKEGMSAFAEKREAQFRDK

SEQ ID NO: 2758 - DNA, 777 bp, Oceanicola batsensis HTCC2597
  CDS (1)..(777): transl_table=11
atggcatacgagacgattgtcgtcgaagtcgaagatcatatcgcgctggtgaaattgaaccgcccggacgcgatgaacgccctgaacaacgaccttctgggggaactggccgacgcgctcaccgcggcgcagtcgaacgacaaggtccgttgcatcgtcatcaccggaaccgagaaattcttcgcggccggcgcggatatcaagatgatgtccgacaagagctttgtcgacgttttcgccggcgatctcttcacccgcgagaccggcgcgatcctgcgggtccgcaagccgatcatcgcggcggtctgcggctatgccctgggcggcggctgcgaactggccatgatgtgcgatttcatcatcgcgggcgacaacgccaagttcggccagcccgagatcaacctcggcgtcatcgcgggcatcggcggcacccagcggctgacccgcttcgtcggcaagtccaaggcgatggacatgaacctgaccggtcgcttcatggatgccgaagaggccgagcgctccggcctcgtctcgcgcgtggtgccctgcaagaagctcatggacgaggccatgggcgccgccgccaagatcgccgagaaatcgatgatttcggtcatggcggtgaaggaagcggtgaaccgctcctacgagacgccgctggccgagggcctgctcttcgagcgccgggtcttcaattcgctcttcgcgaccgaggaccaggccgaggggatgagcgcgttcctggaaaaacgcgagccgcaattccgcgaccgctga

SEQ ID NO: 2759 - protein, 258 aa, Oceanicola batsensis HTCC2597
MAYETIVVEVEDHIALVKLNRPDAMNALNNDLLGELADALTAAQSNDKVRCIVITGTEKFFAAGADIKMMSDKSFVDVFAGDLFTRETGAILRVRKPIIAAVCGYALGGGCELAMMCDFIIAGDNAKFGQPEINLGVIAGIGGTQRLTRFVGKSKAMDMNLTGRFMDAEEAERSGLVSRVVPCKKLMDEAMGAAAKIAEKSMISVMAVKEAVNRSYETPLAEGLLFERRVFNSLFATEDQAEGMSAFLEKREPQFRDR

SEQ ID NO: 2760 - DNA, 807 bp, Erythrobacter sp. NAP1
  CDS (1)..(807): transl_table=11
atgactgagacccaaggctacgaaacgatccagattgagactaacgcccatggcaccaagggcgtcacgctgatcacgctcgatcgtcccaaggcactcaacgcgctcaattccaaggtgcttgatgagcttatgtgcgcctttgccggttatcaggcggacgatagccagctttgtgccgttatcactggctcgggcgacaaagcatttgcagcaggcgctgacatcaaggaaatgtcagaaaagcccgcttccgacttctatctcgacgacttcttctcgccgtggacctccgaaatcgtaaagaagactcgcaagccttggattgccgcggtcaacgggtttgcacttggcggcgggtgcgagcttgcgatgatggcagacttcatcatcgcttcggacaacgccaagttcggacagcccgaaatcaagctcggagttgctccgggcatgggcggctcacagcgtcttacccgcgcaatcggcaagtccaagtccatggaaatgtgcctgaccggccgcatgatgagcgcggaggaagcagagcgtgcaaacctcgtcgtgcgcgtggtgtctcaggctgatttgctcgccgagacgctcaagacggcagcaacaatcgccagcatgccgcctatggcagccatcgcgaacaaagagatggtgaatgccgcgtttgaaacgacgctcgaccagggcctgatcatggagcgccgcatcttccagatcctcaccgcaagcgaggataaggcagaaggcatggcagctttcatcgaaaagcgcgaaggaaactggaaagggcgctaa

SEQ ID NO: 2761 - protein, 268 aa, Erythrobacter sp. NAP1
MTETQGYETIQIETNAHGTKGVTLITLDRPKALNALNSKVLDELMCAFAGYQADDSQLCAVITGSGDKAFAAGADIKEMSEKPASDFYLDDFFSPWTSEIVKKTRKPWIAAVNGFALGGGCELAMMADFIIASDNAKFGQPEIKLGVAPGMGGSQRLTRAIGKSKSMEMCLTGRMMSAEEAERANLVVRVVSQADLLAETLKTAATIASMPPMAAIANKEMVNAAFETTLDQGLIMERRIFQILTASEDKAEGMAAFIEKREGNWKGR

SEQ ID NO: 2762 - DNA, 780 bp, Oceanospirillum sp. MED92
  CDS (1)..(780): transl_table=11
atgagcactccaacaaaccttaaggtgagtgaacctactaagggtgtgttaactattaccctgcaccgccctgaagcattaaatgcactgaatacgaaactgctggaagaactggcagaccttcttgatgagatccagagcaacccggaagtgggtgctgtggttattaccggttccagcaaagcatttgcagccggcgctgatgttcgtgagatggcgaccctggatgccgttggcgtactacgcgacccacgtgttgatcattggaaacgaattaccgcttttaaaaagccattgattgctgccgttaacggcttctgcctgggcggcggctgtgaactggcgatgcacgcagacattatcatcgcgggtgaagaagccaaatttggtcagcctgaaatcaaactaggcatcatgccaggtgccggcggcactcagcgcttgcttcgcgctgttggtaagtcgatggcgatgcagatggtgctaaccggcgagcctatctcagcccaacaggcgatgggcttcggtctgatctctgaaatcactattcctgaaacaactgttgaacgcgctcagaaagttgcacaacagattgctcgccacgcaccgatcgcggtggagatggcaaaagattccgtacttaaagcttttgatactgatctggcttctggcctgctctatgagcgtaaggcatttacgctgctggctgctactgaagaccgtaacgaaggtatcaacgcttttatcgaaaaacgcaaacccgctttcaaaggatgctaa

SEQ ID NO: 2763 - protein, 259 aa, Oceanospirillum sp. MED92
MSTPTNLKVSEPTKGVLTITLHRPEALNALNTKLLEELADLLDEIQSNPEVGAVVITGSSKAFAAGADVREMATLDAVGVLRDPRVDHWKRITAFKKPLIAAVNGFCLGGGCELAMHADIIIAGEEAKFGQPEIKLGIMPGAGGTQRLLRAVGKSMAMQMVLTGEPISAQQAMGFGLISEITIPETTVERAQKVAQQIARHAPIAVEMAKDSVLKAFDTDLASGLLYERKAFTLLAATEDRNEGINAFIEKRKPAFKGC

SEQ ID NO: 2764 - DNA, 771 bp, Xanthobacter autotrophicus Py2
  CDS (1)..(771): transl_table=11
atggcatacgagacgatcctggtggagcagcacgaccgcgtggggctcatccgcctgaaccgcccccaggcgctcaatgcgctcaacggccagctgatcggcgagctgaacgcggcgctggatgcgttcgagcaggatcggggcatcggctgcgttgttctcaccggctcggagaaggcgttcgccgccggggccgacatcaaggagatgcaagtcttctcctatccggcgacctatctcgacgatttcatcacctcctgggagcggctgtcgcgcacccgcaagccggtgatcgcggcggtggcgggcttcgccctgggtggcggctgcgagctggccatgatgtgcgacttcatcctggccgccgataccgcgaagttcggccagcccgagatcaagctgggggtgatgcccggtgccggcggcactcagcgcctcacccgattcgtgggcaagtcgaaggccatggaaatgtgcctcaccggccgcttgatggatgccgtcgaagccgagcgcgctggcctcgtctcgcgcgtggtgccggcagccgagcttctggacgaggcgctgaaggtggcgaaggtcatcgccggcatgtccgcgcacgtggccatgcagaccaaggaaagcgtgaaccgctcctacgagaccacgcttgccgaaggcatccgcttcgagcggcgggtgttccaggcccagttcggcgtcgccgaccagaaggaaggcatggccgccttcatcgagaagcgccccgcgaagttcgagcactga

SEQ ID NO: 2765 - protein, 256 aa, Xanthobacter autotrophicus Py2
MAYETILVEQHDRVGLIRLNRPQALNALNGQLIGELNAALDAFEQDRGIGCVVLTGSEKAFAAGADIKEMQVFSYPATYLDDFITSWERLSRTRKPVIAAVAGFALGGGCELAMMCDFILAADTAKFGQPEIKLGVMPGAGGTQRLTRFVGKSKAMEMCLTGRLMDAVEAERAGLVSRVVPAAELLDEALKVAKVIAGMSAHVAMQTKESVNRSYETTLAEGIRFERRVFQAQFGVADQKEGMAAFIEKRPAKFEH

SEQ ID NO: 2766 - DNA, 777 bp, Xanthobacter autotrophicus Py2
  CDS (1)..(777): transl_table=11
atgacctatgaaaccatcctcgtcgcgatcgacggaccggtcggcatcatcaccctcaaccgcccggacgtcctcaacgcgctgaaccaccaaatcacctcggagctgtctcatgccgcggccgccctcgacgctgccggctcgatcggcgccatcgttgtgaccggctcggacaaggccttcgccgcaggcgccgacatcaaggagatcaaggacaagacctttgccgaagtctatgaagcgcagctcatcaccgccacatgggagggcttggcacgggtgcgcaagccgaccgtcgcggcggtgtcggggcatgcgatcgggggcggttgcgagctggcgctgatgtgcgacatcatcgtggcgtcgcagaccgcccgcttcgccctgccggaaaccacgattggcatcatccccggcgccggcggcacccagcgcctcacgcgcatcgttggcaaggcgaccgccatggacatgatcctcaccggccgggccttgtccgcggtggaggcgcaggccatggggctcgtcagccgggtggcggcagaagggcaacatctggcggaggccgtcgccatcgccgcacgcatcgcctcgtcctcccgccccgtcgtggcgctggcgaaggaagcggtgaacaaggcctacgagacccatctccaggagggcctgtatgtcgagcgccgactgctctacgccaccttcgccctagaggaccggcgcgaggggatgaacgcctttgcggaaaagcgaaagccggttttccgaaatcggtga

SEQ ID NO: 2767 - protein, 258 aa, Xanthobacter autotrophicus Py2
MTYETILVAIDGPVGIITLNRPDVLNALNHQITSELSHAAAALDAAGSIGAIVVTGSDKAFAAGADIKEIKDKTFAEVYEAQLITATWEGLARVRKPTVAAVSGHAIGGGCELALMCDIIVASQTARFALPETTIGIIPGAGGTQRLTRIVGKATAMDMILTGRALSAVEAQAMGLVSRVAAEGQHLAEAVAIAARIASSSRPVVALAKEAVNKAYETHLQEGLYVERRLLYATFALEDRREGMNAFAEKRKPVFRNR

SEQ ID NO: 2768 - DNA, 834 bp, Acidovorax sp. JS42
  CDS (1)..(834): transl_table=11
atgaaggcttgggtatattcccggcatcccacccactacaaacaggagatcaccttggcctacgaatgcatcgaagtccgcaccgaagcggacaaggtcggcatcatcacgctcgcccgtcccaagcagctcaacgcgctcaacgaccagctcatgaccgagctgggcgaggccctcaaggcgttcgacgccgacgagaagatcggctgcatcatcctgacgggcagcgagaaggccttcgccgcgggcgccgacatcggcgccatggccaagtacagctttgccgatgcgtacaagggcgactacatcacgcgcaactgggagcagatccgcagcatccgcaagcccgtcatcgcggcggtgagcggctacgccttgggcggcggctgcgagctggcgatgatgtgcgacttcatcatcgcggccgacaatgccaagttcggacagcccgaaatcaagctgggcgtgatccccggcgccggcggcacgcagcgcctgccgcgcgccgtgggcaaggccaaggccatggacatggccctcaccggccgcatgatggacgccacggaagccgagcgctccggcctcgtcagccgcgtggtgccgctggacaagctgatggaagaagccctgggcgcggccctcgtcatcagcggtttctcgcagatcgccgtgatggccgccaaggaatcggtgaaccgcgccttcgaagggactttgagcgatggcgtgatgttcgagcgccgcctgttccatgcgctgttcgccacccaggaccagaaggaaggcatggacgccttcgtgaacaagcgcgcagcagtcttcacgcaccaataa

SEQ ID NO: 2769 - protein, 277 aa, Acidovorax sp. JS42
MKAWVYSRHPTHYKQEITLAYECIEVRTEADKVGIITLARPKQLNALNDQLMTELGEALKAFDADEKIGCIILTGSEKAFAAGADIGAMAKYSFADAYKGDYITRNWEQIRSIRKPVIAAVSGYALGGGCELAMMCDFIIAADNAKFGQPEIKLGVIPGAGGTQRLPRAVGKAKAMDMALTGRMMDATEAERSGLVSRVVPLDKLMEEALGAALVISGFSQIAVMAAKESVNRAFEGTLSDGVMFERRLFHALFATQDQKEGMDAFVNKRAAVFTHQ

SEQ ID NO: 2770 - DNA, 774 bp, Pseudomonas putida
  CDS (1)..(774): transl_table=11
atgccgcgatatctcgacgtgcaggcgccggaaaacggcgttcagctcattaccctgcaacggcccgaggcactgaatgccctgtgtaccgagttactggcagagctggccactgcgctcgacgcagccgcccgggatgaccagataggcgttgttgtgctcaccggcagccgcaaggcgttcgccgcaggcgctgacatccgtgaaatggccgagcgcgacctggtcggcatcctcaacgaccctcgagtagcccactggcaacgcatcgccgcctttgccaagccgctgattgctgcggtcaacggctacgccctgggtggcggttgcgaattggtgatgtgtgccgacatcgtcatcgccggcagcgacgcccgcttcggccagccggagatcaacctcggcatcatccccggtgctggcggcacacagcgcctgttgcgtgccgtcggcaagccgctggccatgcagatggtgctgaccggcgaagccatcaccgcccgtcacgcccagcaagccggcctggtcagcgaaataacccagcccgaattcaccgtagaacgcgccatgcagatcgcccgcaacatcgccgccaaggcgccgctggcagtgcgcctggcaaaagaggcgctgctcaaggccggtgataccgacctggccagtggcctgcgcttcgaacgccatgcattcaccctgctggccggcaccgccgaccgtgacgaaggcattcaggcctttcaggaaaagcgcccggcgcgcttccaaggccgctga

SEQ ID NO: 2771 - protein, 257 aa, Pseudomonas putida
MPRYLDVQAPENGVQLITLQRPEALNALCTELLAELATALDAAARDDQIGVVVLTGSRKAFAAGADIREMAERDLVGILNDPRVAHWQRIAAFAKPLIAAVNGYALGGGCELVMCADIVIAGSDARFGQPEINLGIIPGAGGTQRLLRAVGKPLAMQMVLTGEAITARHAQQAGLVSEITQPEFTVERAMQIARNIAAKAPLAVRLAKEALLKAGDTDLASGLRFERHAFTLLAGTADRDEGIQAFQEKRPARFQGR

SEQ ID NO: 2772 - DNA, 777 bp, Pseudomonas fluorescens
  CDS (1)..(777): transl_table=11
atgcctcatacccttagcgtcgacgcgcccgaacagggcgtacgcctgatcaccctgcagcgtcccgaagcgctcaatgccctcaatacccagttgctcgacgagctggccgccgaactggccctggccgaacaggatgccgagatccgcaccgtggtgttgaccggcagccgccagggccttcgccgccgggcgccgacatcaaggaaaatgtccgagcgcgacctggtcggcatcctcgaagacccgcgcgtcgcccactggcaacgcatcgccgccttctccaaaccactgatcgccgcggtcaacggcttctgcctcggcggcggctgcgagctggcgatgcacgccgacatcctcatcgccggcgaggacgcccgtttcggccagccggagatcaacctcggcatcatgcccggcgccggcggcacccagcgcctgctgcgcgcggtaggcaagagcctggccatgcagatggtgctcagcggccaggccatcgatgcccgccacgcccagcgcgccggcctggtcagcgaagtgacccagccggaactcaccgtcgagcgcgccctggccatcgcccgcgtcatcgcgcagaaggcgccgctggccgtgcgcctggccaaggaggcgctgctcaaggccgaggacaccgacctggccagcggcctgcgtttcgagcgccacgccttcaccgtgctggccggcaccgccgaccgcgccgaaggcatccgcgccttccaggaaaagcgtcgccccgaattcaccggccggtag

SEQ ID NO: 2773 - protein, 258 aa, Pseudomonas fluorescens
MPHTLSVDAPEQGVRLITLQRPEALNALNTQLLDELAAELALAEQDAEIRTVVLTGSRQGLRRRAPTSRKMSERDLVGILEDPRVAHWQRIAAFSKPLIAAVNGFCLGGGCELAMHADILIAGEDARFGQPEINLGIMPGAGGTQRLLRAVGKSLAMQMVLSGQAIDARHAQRAGLVSEVTQPELTVERALAIARVIAQKAPLAVRLAKEALLKAEDTDLASGLRFERHAFTVLAGTADRAEGIRAFQEKRRPEFTGR

SEQ ID NO: 2774 - DNA, 768 bp, Klebsiella sp
  CDS (1)..(768): transl_table=11
atgagcgaactgttaattgctcgccacgcgcgcgtcctccagctgacgcttaatcgccctcaggcgcgcaacgcgctgaataacgcgctgctgacgcaaattgccgacgtgctcgacgcggcggcgctggacccgacggtcggcgtctgcgtcattagcggtaatcaacgcttttttgccgcaggggctgacctgaacgaaatggcggaaaaagatctgcctgccaccctcgatgatattcgaccgcggctgtgggcgcgtatcgacgccttcaccaaaccgctgatcgcctcggtaaacggctatgccctcggcgccggatgcgaactggcgctgctctgcgacctgatagtcgccggcgataacgcccgttttggcctgccggaaatcaccctcggtattatgccgggcgcgggcgggacccagcgcctgatccgcagcgtcggtaaagcgctggccagccggatgatattgagcggcgaaagcatcgatgccaggcaggcgctgcgggcggggctggtaagcgaggtttatccgccagcgctcaccgatgaatatgcactcgctttggcagcaaccgtggcccgccactcgccgctggcgctgcgcgcggctaaacaggccttacggttgtcgcaggaggtcagcctgcaggccgggattcagcaggaacgccagttatttactttgctgagcgcgactgaagaccgtcgcgaaggcatcgacgcctttctccataaacgtactgcggaatttaaaggacgctaa

SEQ ID NO: 2775 - protein, 255 aa, Klebsiella sp
MSELLIARHARVLQLTLNRPQARNALNNALLTQIADVLDAAALDPTVGVCVISGNQRFFAAGADLNEMAEKDLPATLDDIRPRLWARIDAFTKPLIASVNGYALGAGCELALLCDLIVAGDNARFGLPEITLGIMPGAGGTQRLIRSVGKALASRMILSGESIDARQALRAGLVSEVYPPALTDEYALALAATVARHSPLALRAAKQALRLSQEVSLQAGIQQERQLFTLLSATEDRREGIDAFLHKRTAEFKGR

SEQ ID NO: 2776 - DNA, 771 bp, Pseudomonas sp
  CDS (1)..(771): transl_table=11
atgccgaacacccttgtggtgcaggcgcatcaggccacgcgcctgatcaccctgcatcgtccacatgcactgaacgccctgaccaccgagctgctgggcgaactggcggacgaactgcaacgctgcgccgacgacccggacgtgcgcgccgtggtcatcaccggcagccgcaaggcgttcgccgccggtgccgacctcaacgaaatggccgagcgcgacctggtaggcatgctcgacgacccgcgccagggctactggcagcgcatcacccagttccccaaacccctgatcgctgccgtcaacggctacgccctgggcggcggctgcgagctggcgatgcacgccgacattcttatcgccggtgaagacgcccagttcggccagccggaaatcaacctcggcatcatgcccggcgcaggcggcacccagcgtctgctgcgggcggtaggcaaatcgctggcgatgcagatggtcctggccggtgaatccatcagcgcccgccgcgccctcgacgcaggcctggtcagcgaaatcacccagcccgaactcaccgtcgaacgcgccctgcagatcgcccagcgcatcgccgccaaggcgccgctggcggtgcgcctggccaaggaagcactgctcaaggcccaggacctggacctggccagcggcctgcgcttcgaacgtcacgcattcaccctgctggccggcaccgccgaccgcgacgaaggcatccgcgccttccaggaaaaacgtcaggccgacttcaagggctgctaa

SEQ ID NO: 2777 - protein, 256 aa, Pseudomonas sp
MPNTLVVQAHQATRLITLHRPHALNALTTELLGELADELQRCADDPDVRAVVITGSRKAFAAGADLNEMAERDLVGMLDDPRQGYWQRITQFPKPLIAAVNGYALGGGCELAMHADILIAGEDAQFGQPEINLGIMPGAGGTQRLLRAVGKSLAMQMVLAGESISARRALDAGLVSEITQPELTVERALQIAQRIAAKAPLAVRLAKEALLKAQDLDLASGLRFERHAFTLLAGTADRDEGIRAFQEKRQADFKGC

SEQ ID NO: 2778 - DNA, 774 bp, Pseudomonas sp
  CDS (1)..(774): transl_table=11
atgcctcatacccttagcgtcgacgcgcccgaacagggcgtacgcctgatcaccctgcagcgtcccgaagcgctcaatgccctcaatacccagttgctcgacgagctggccgccgaactggccctggccgaacaggatgccgagacccgcgccgtggtgctgaccggcagccgcaaggccttcgccgccggcgccgacatcaaggaaatggccgagcgcgatctggtcggtatcctcgaagacccgcgcgtcgcccactggcaacgcatcgccgccttctccaaaccactgatcgccgcggtcaacggcttctgcctcggcggcggctgcgagctggcgatgcacgccgacatcctcatcgccggcgaggacgcccgtttcggccagccggagatcaacctcggcatcatgcccggcgccggcggcacccagcgcctgctgcgcgcggtaggcaagagcctggccatgcagatggtgctcagcggccaggccatcgatgcccgccacgcccagcgcgcgggcctggtcagcgaagtgaccttgcccgagctcaccatcgagcgcgccctggccatcgcccgcgtcatcgcgcagaaggcgccgctggccgtgcgcctggccaaggaggcgctgctcaaggccgaggacaccgacctggccagcggcctgcgtttcgagcgccacgccttcaccgtgctggccggcaccgccgaccgcgccgaaggcatccgtgcctttcaggaaaagcgtcgccccgaattcaccggccggtag

SEQ ID NO: 2779 - protein, 257 aa, Pseudomonas sp
MPHTLSVDAPEQGVRLITLQRPEALNALNTQLLDELAAELALAEQDAETRAVVLTGSRKAFAAGADIKEMAERDLVGILEDPRVAHWQRIAAFSKPLIAAVNGFCLGGGCELAMHADILIAGEDARFGQPEINLGIMPGAGGTQRLLRAVGKSLAMQMVLSGQAIDARHAQRAGLVSEVTLPELTIERALAIARVIAQKAPLAVRLAKEALLKAEDTDLASGLRFERHAFTVLAGTADRAEGIRAFQEKRRPEFTGR

SEQ ID NO: 2780 - DNA, 807 bp, Brucella abortus
  CDS (1)..(807): transl_table=11
atgtgggacggcatggggaacaaaatgagcgaagctactgatgttgtgatagaaactcgtccggctgacggtgttgccctcctggaactcaaccgccctgatgcattgaatgccgtgaacatggatgtgcgccagaaactggctgcatcagccgacagtctcgttgaggatccggacatccgggtgatcgtcattgccggacgtggcggaaatttcgccgcgggttcagatgtcaaggtttttgcgcaaaccggggcgggtagtctgcttgcacagcgcatgcaccgctattgggaaagcctcgcccattgccccaagccggttatcgcggccgtagagggatatgccctaggtggcgggtgcgagctggcaatgcacgccgacattattgtagctgcaagaaccgccagtttcggccagccagaaataaagctcggactgatgcctggagcaggcggcacgcagcgccttttgcgcgcgatcggcaagtacaagactatgctgctcgcattgacgggcgaaatgctgcctgcaacggaagctgaaaaatacggacttgtaagcaggctctcggaagaaggtgaagcgcttgaagaagccttgaaactggcgcggaaaatcgcgcttatgcccgcgttggctgctgaacagataaaggaggcggtcatgtacggcgaggatgcgccgctggaaaccgcactccgcctggagcgcaaggcatttcagctcctgttcgatacggaagacaagcgtgaaggcatcgatgcatttttgaccaagcgcaagccggcattcaaagggcgctga

SEQ ID NO: 2781 - protein, 268 aa, Brucella abortus
MWDGMGNKMSEATDVVIETRPADGVALLELNRPDALNAVNMDVRQKLAASADSLVEDPDIRVIVIAGRGGNFAAGSDVKVFAQTGAGSLLAQRMHRYWESLAHCPKPVIAAVEGYALGGGCELAMHADIIVAARTASFGQPEIKLGLMPGAGGTQRLLRAIGKYKTMLLALTGEMLPATEAEKYGLVSRLSEEGEALEEALKLARKIALMPALAAEQIKEAVMYGEDAPLETALRLERKAFQLLFDTEDKREGIDAFLTKRKPAFKGR

SEQ ID NO: 2782 - DNA, 774 bp, Pseudomonas putida
  CDS (1)..(774): transl_table=11
atggcattcgaaaccatcctgttggacattcacggcaaggtcgggctgattaccctcaaccgcccgcaggcactgaatgcgctgaacgcgcagattgttggcgagatcaaccaggccctggaccagctcgagcgtgatccgagcatcggttgtgtggtgctcacgggttcggccaaggcctttgccgctggcgctgacataaaggaaatggccgacctgcaatacccgcagatctacgtcgatgacctgttcagcgatgctgatcgcattgccaaccggcgcaagccgatcattgctgcggtatccggtttcgccttgggtggcggttgcgagctggcgatgatgtgtgactttatccttgccgcggacaacgccaagtttggtcagccggaaatcaaccttggcgtgctgccgggcatgggcggcacccagcggctcacccgtgcggtgggcaaggccaaggccatggaactgtgcctgaccggtcgcctgatgggggccgaagaggctgagcgtgctggcctggtggcgcgcatcgtgccgcaggcagagttggtggaagaggcgctgaaagtagcggcgaccattgccagcaagtcgattccggtgagcatgatggtcaaggagagcgtcaatcgcgcgttcgaagttacccttagcgagggcgtgcgctttgagcgtcgggtgttccatgcggcgttctctaccgaagaccagaaagaaggcatggccgccttcatcgccaagcgcgaggcgcagttcaagaatcgctga

SEQ ID NO: 2783 - protein, 257 aa, Pseudomonas putida
MAFETILLDIHGKVGLITLNRPQALNALNAQIVGEINQALDQLERDPSIGCVVLTGSAKAFAAGADIKEMADLQYPQIYVDDLFSDADRIANRRKPIIAAVSGFALGGGCELAMMCDFILAADNAKFGQPEINLGVLPGMGGTQRLTRAVGKAKAMELCLTGRLMGAEEAERAGLVARIVPQAELVEEALKVAATIASKSIPVSMMVKESVNRAFEVTLSEGVRFERRVFHAAFSTEDQKEGMAAFIAKREAQFKNR

SEQ ID NO: 2784 - DNA, 771 bp, Thauera aromatica
  CDS (1)..(771): transl_table=11
atgagcgtagtactggtcgagcagccgacacccgatgtcgccgtcgtccgcctgaaccgccccgacgcccgcaacgccctcaaccaggaagtccgcagcgcactggccgagcacttcgaccgtctcggccaggcggccgaagtacgctgcatcgtcctcaccggcggcgagcgctgcttcgccgcggcgcccgacatccgcgcaatggccgacgccggtgcgatcgagatcatgctgcgccagacccagcgcctgtggcaggcgatcgcagcctgtccgaaaccggtcatcgccgcggtcaacggctatgcctggggcggcggctgcgaactcgcaatgcacgccgacatcatcatcgccggagaaggcgcgagtttctgccagcccgaagtcaaggtcggcatcatgcctggcgccggcggcacccagcgcctgactcgcgccgtgggcaagttccaggcgatgaaaatggtcctcaccggcctcccggtgagcgcgcgcgaacgcctggcgatgggcctggccagcgaagtggtggccgatgacgcggtccaggcgcgtgccctcgaactggcccgccacatcgccaccctgccaccgcttgccatcgcccagatcaaggaggtcctccttgccggtcaggatgcctcgctcgacaccgccctgatgctcgagcgcaaggctttccagctgctgttcgcaagcgcggaccagaaagaaggcatgcgcgccttcctggaaaaacgcccccctgtgttccgcggcggctga

SEQ ID NO: 2785 - protein, 256 aa, Thauera aromatica
MSVVLVEQPTPDVAVVRLNRPDARNALNQEVRSALAEHFDRLGQAAEVRCIVLTGGERCFAAAPDIRAMADAGAIEIMLRQTQRLWQAIAACPKPVIAAVNGYAWGGGCELAMHADIIIAGEGASFCQPEVKVGIMPGAGGTQRLTRAVGKFQAMKMVLTGLPVSARERLAMGLASEVVADDAVQARALELARHIATLPPLAIAQIKEVLLAGQDASLDTALMLERKAFQLLFASADQKEGMRAFLEKRPPVFRGG

SEQ ID NO: 2786 - DNA, 777 bp, Acinetobacter sp
  CDS (1)..(777): transl_table=11
atggaaaatgaaatattgaatttagatattcaaagtaatggtgtggccattgttgaactacatcgtccagatactagaaatgcattgaatctggaactgcgccaacagctcgcagcaatgtttgagcagctcgctgcatctgatacagtccgcgcaattgtcattactggtggtgaaaaagtatttgcagcaggtgcggatatccgggacttcaccactgcaaaaaccgtagacatgtatttacgccatacggaacagtactggcgggccattattgattgccctaaaccgattgtggctgctgtgaatggatatgcattgggtggtgggtgtgaacttgcaatgcatgcagacatcattattgccggaaaatcagcccagtttggtcagcctgaagtcaaattggggctgatgccaggtgctggtggtacccaacgcttactgcgtgcggtagggaagtttaaagccatgcaaatagtgttaacaggaaagatcttttctgcagaagaagctgacaaaatggggttggtttccgaagtggttgaggatgatcaaacccttgctaaagcggttgaaattgcgacacagattgcccaactctcaccgattgccgttgaacagatcaaagaagtcacaacactaggtgccaatatgccactcgatggtgctttggcattagagcgtaaagccttccaaattttatttgatacacaagatcaaaaagaaggcgtcaatgcctttttcgaaaagcgaagccctcaatatcaaggaaaataa

SEQ ID NO: 2787 - protein, 258 aa, Acinetobacter sp
MENEILNLDIQSNGVAIVELHRPDTRNALNLELRQQLAAMFEQLAASDTVRAIVITGGEKVFAAGADIRDFTTAKTVDMYLRHTEQYWRAIIDCPKPIVAAVNGYALGGGCELAMHADIIIAGKSAQFGQPEVKLGLMPGAGGTQRLLRAVGKFKAMQIVLTGKIFSAEEADKMGLVSEVVEDDQTLAKAVEIATQIAQLSPIAVEQIKEVTTLGANMPLDGALALERKAFQILFDTQDQKEGVNAFFEKRSPQYQGK

SEQ ID NO: 2788 - DNA, 774 bp, Mycobacterium bovis
  CDS (1)..(774): transl_table=11
atgacgtacgaaaccatcctggtcgagcgcgatcagcgagttggcattatcacgctgaaccgtccccaggcactgaacgcgctcaacagccaggtgatgaacgaggtcaccagcgctgcaaccgaactggacgatgacccggacattggggcgatcatcatcaccggttcggccaaagcgtttgccgccggagccgacatcaaagaaatggccgacctgacgttcgccgacgcgttcaccgccgacttcttcgccacctggggcaagctggccgccgtgcgcaccccgacgatcgccgcggtggcgggatacgcgctcggcggtggctgcgagctggcgatgatgtgcgacgtgctgatcgccgccgacaccgcgaagttcggacagcccgagataaagctgggcgtgctgccaggcatgggcggctcccagcggctgacccgggctatcggcaaggctaaggcgatggacctcatcctgaccgggcgcaccatggacgccgccgaggccgagcgcagcggtctggtttcacgggtggtgccggccgacgacttgctgaccgaagccagggccactgccacgaccatttcgcagatgtcggcctcggcggcccggatggccaaggaggccgtcaaccgggctttcgaatccagtttgtccgaggggctgctctacgaacgccggcttttccattcggctttcgcgaccgaagaccaatccgaaggtatggcagcgttcatcgagaaacgcgctccccagttcacccaccgatga

SEQ ID NO: 2789 - protein, 257 aa, Mycobacterium bovis
MTYETILVERDQRVGIITLNRPQALNALNSQVMNEVTSAATELDDDPDIGAIIITGSAKAFAAGADIKEMADLTFADAFTADFFATWGKLAAVRTPTIAAVAGYALGGGCELAMMCDVLIAADTAKFGQPEIKLGVLPGMGGSQRLTRAIGKAKAMDLILTGRTMDAAEAERSGLVSRVVPADDLLTEARATATTISQMSASAARMAKEAVNRAFESSLSEGLLYERRLFHSAFATEDQSEGMAAFIEKRAPQFTHR

SEQ ID NO: 2790 - DNA, 774 bp, Mycobacterium leprae
  CDS (1)..(774): transl_table=11
atgaagtacgacacaatcctcgttgacggctaccagcgagttggcatcatcacactgaaccggccacaggctctgaacgcactcaatagccagatgatgaacgaaatcactaatgcagcaaaagaattagacatcgatcccgatgttggggcgatcctcattactggttcacccaaggtttttgctgccggcgccgacatcaaagagatggccagtttaacgttcaccgacgcatttgacgctgattttttctccgcatggggcaagctggccgccgtgcgtaccccaatgatcgccgcggtggccggatatgcactcggtggtggctgcgagttagcgatgatgtgcgatctgcttatcgccgccgacacagcgaaattcggtcagccagaaatcaaactcggcgttctgcccggtatgggaggctcccagcgcctaacccgagcgatcggcaaggccaaagcaatggacctgatcttgaccggacgcaccatcgacgcggccgaagccgaacgcagcggcctggtttcgcgggtggtgctggccgacgatttactgcccgaggccaaggctgtcgctactaccatttcgcagatgtctcggtcggctacccggatggccaaggaagcagtcaatcggtctttcgaatccacgctggctgaaggattgctccacgaacgccggcttttccattcgaccttcgtgacagacgaccagtccgagggcatggcggcattcatcgagaaacgcgctccccagtttacccaccgatga

SEQ ID NO: 2791 - protein, 257 aa, Mycobacterium leprae
MKYDTILVDGYQRVGIITLNRPQALNALNSQMMNEITNAAKELDIDPDVGAILITGSPKVFAAGADIKEMASLTFTDAFDADFFSAWGKLAAVRTPMIAAVAGYALGGGCELAMMCDLLIAADTAKFGQPEIKLGVLPGMGGSQRLTRAIGKAKAMDLILTGRTIDAAEAERSGLVSRVVLADDLLPEAKAVATTISQMSRSATRMAKEAVNRSFESTLAEGLLHERRLFHSTFVTDDQSEGMAAFIEKRAPQFTHR

SEQ ID NO: 2792 - DNA, 774 bp, Rhizobium meliloti
  CDS (1)..(774): transl_table=11
atgagttacgagacgttgctggtcgaaacgcagggccgcgtgggcctgatcacgctcaaccgtccgcaggcgctcaatgcgctgaatgcggtgctgatgcgcgagctcgatgccgcgctgaaggccttcgacgccgacagggccgtcggcgccatcgtccttgccggctccgagaaggcctttgccgccggcgccgacatcaaggagatgcaggggctcgatttcgtcgacggttacctcgccgatttccttggcggctgggagcatgtcgcgaacgcccgcaaaccgatgatcgccgccgtatccggtttcgcgctcggcggtggctgcgagctcgccatgatgtgcgacttcatcatcgcctccgaaacggcgaagttcggccagccggagattacgcttggcgtcattcccggcatgggtggatcgcagcgcctgacccgcgcagtcggcaaggcgaaggccatggacctcattctcaccggccgcatgatggacgcggcggaggcggagcgctccgggctggtttcgcgcgtggtggctccggacaggctcctggaggaggcgctcggcgccgcggagaagatcgcgtcattctcgctgccggcggcgatgatggccaaggaggccgtcaaccgctctctggaactgacgctcgccgagggcctgcgcttcgagcggcggctcttccagtcgcttttcgcaacggaggaccagaaagagggcatggccgccttcgtcgccaagcgcaaagccgaattcaaacacagatga

SEQ ID NO: 2793 - protein, 257 aa, Rhizobium meliloti
MSYETLLVETQGRVGLITLNRPQALNALNAVLMRELDAALKAFDADRAVGAIVLAGSEKAFAAGADIKEMQGLDFVDGYLADFLGGWEHVANARKPMIAAVSGFALGGGCELAMMCDFIIASETAKFGQPEITLGVIPGMGGSQRLTRAVGKAKAMDLILTGRMMDAAEAERSGLVSRVVAPDRLLEEALGAAEKIASFSLPAAMMAKEAVNRSLELTLAEGLRFERRLFQSLFATEDQKEGMAAFVAKRKAEFKHR

SEQ ID NO: 2794 - DNA, 1014 bp, Arabidopsis thaliana
  CDS (1)..(1014)
atggcggattccaatgagcttggctcggcgagccgacgactctccgtcgtcaccaatcatctcatccctatcggattcagtccagctcgtgctgactcagtggaactctgtagtgcttcgtcgatggatgatagattccataaggttcacggtgaagttccgacccacgaagtcgtttggaaaaaaactgatttctttggtgaaggagataacaaggagtttgttgatattatttatgagaaagcccttgatgaaggcattgcaaagattactataaaccggccagagagaagaaatgcgttccggcctcagactgtgaaggagcttatgcgtgcgtttaatgatgctagagatgatagctctgtaggagtcatcatactcaccggcaagggaacaaaagcattttgcagtggtggtgatcaggctttgagaacacaagacgggtatgctgatcccaatgacgttggccgccttaatgttcttgatcttcaggttcaaatccgcagattgccaaagccagttattgcaatggtagctggttatgctgttggaggaggacacattttgcacatggtctgcgatctaacaattgcagctgataatgcgatttttggtcaaacgggtcctaaggttggaagttttgatgctggttatggaagttccatcatgtctcgtctggttggtcctaaaaaggcacgagaaatgtggtttatgacgaggttctacacagcttctgaagcagagaaaatgggacttatcaatacagttgtaccgctagaggatttggagaaagaaactgtgaaatggtgcagagaaatcttacggaacagtccaactgcaatccgagtacttaaggcagcacttaatgcagttgatgatggccatgccggccttcagggactcggtggtgatgcgacactcttattctatggaaccgaagaagctactgaagggagaactgcttatatgcaccgccgaccaccggacttctctaaatttcaccggcgaccttaa

SEQ ID NO: 2795 - protein, 337 aa, Arabidopsis thaliana
MADSNELGSASRRLSVVTNHLIPIGFSPARADSVELCSASSMDDRFHKVHGEVPTHEVVWKKTDFFGEGDNKEFVDIIYEKALDEGIAKITINRPERRNAFRPQTVKELMRAFNDARDDSSVGVIILTGKGTKAFCSGGDQALRTQDGYADPNDVGRLNVLDLQVQIRRLPKPVIAMVAGYAVGGGHILHMVCDLTIAADNAIFGQTGPKVGSFDAGYGSSIMSRLVGPKKAREMWFMTRFYTASEAEKMGLINTVVPLEDLEKETVKWCREILRNSPTAIRVLKAALNAVDDGHAGLQGLGGDATLLFYGTEEATEGRTAYMHRRPPDFSKFHRRP

SEQ ID NO: 2796 - DNA, 690 bp, Arabidopsis thaliana
  CDS (1)..(690)
atgttgaaaagtctccagaacgcatttgagtccatacatcaagataattccgctagggttgtgatgatcagaagtctggttccaggagttttctgtgcaggtgcagatcttaaggaacgtagaactatgagtccatctgaggttcacacatatgtcaactcgttgcgctacatgttctcgttcattgaggcactaagtatcccaactattgctgcaatagaaggtgcagcactgggaggtggactcgaaatggctctagcttgtgatcttcgaatctgtggcgaaaatgcggtatttggcttgcctgaaacaggactcgctataatccctggagctggtgggacacagaggctctcaaggctggttgggagatcggtatcaaaggaacttatatttacaggtcgaaagattgatgcaatagaagctgcaaataaagggcttgtgaacatttgtgttacggcaggtgaggctcatgagaaagcaattgaaatggcacagcagataaacgaaaaaggtccattagctataaagatggcgaagaaagcgattgatgaaggaattgaaacaaatatggcttcaggtttggaagtagaagagatgtgttatcagaagcttcttaatactcaagatcgtcttgaaggattagctgcttttgctgagaagcgtaagcctctgtacactggcaattga

SEQ ID NO: 2797 - protein, 229 aa, Arabidopsis thaliana
MLKSLQNAFESIHQDNSARVVMIRSLVPGVFCAGADLKERRTMSPSEVHTYVNSLRYMFSFIEALSIPTIAAIEGAALGGGLEMALACDLRICGENAVFGLPETGLAIIPGAGGTQRLSRLVGRSVSKELIFTGRKIDAIEAANKGLVNICVTAGEAHEKAIEMAQQINEKGPLAIKMAKKAIDEGIETNMASGLEVEEMCYQKLLNTQDRLEGLAAFAEKRKPLYTGN

SEQ ID NO: 2798 - DNA, 996 bp, Oryza sativa
  CDS (1)..(996)
atggacgcggcggggaggaggctcgcccgcgtcacggcccacctcctgcccagctccctcccgctcccgctcgcctccgcccctaccctcgcgccttcccccgccgcgtcgccagcgtcggacagctaccgacgggtccacggcgacgtgccgtcggagcccccggagtggcgcgcggcgacggacgagtccgggaagggcttcgtggacatcctctacgacaaggccgtcggcgagggcatcgccaagatcacaataaaccgccctgatagaaggaatgcattccgacccctgaccgtgaaggagcttatgcgtgctttcgaggatgctagagatgatagttcaatcggagtcatcatactaacagggaaggggacccagtccttctgtagcggcggtgaccaggcgttaagggatgctgatggatatgttgattttgatagctttggcaggctcaacgtcctagacctccaggtgcaaatacggcgccttccaaagcctgttatagcaatggttgctggttatgctgttggaggaggccatgtgttgcacatggtgtgtgatctaacgattgcagctgacaatgcaatttttgggcagacaggtcctaaggttggaagcttcgatgctggctatggcacttcaattatgtctcggttggtaggaccaaagaaagctcgtgagatgtggtttctgtcacggttctacacagctgatgaggcagacagaatgggtctcgtcaatgtagtagtaccactcgctgatttggagcgagaaacggtgaaatggtgccgaaaaatcttgaggaacagtccaacagccatccgggtgctgaaatctgcactcaatgcagctgatgatggccatgctggccttcaggagctcggtggcaatgcgacactgatcttctatggaactgaagaggcaaaagaaggcaaaaatgcatacatggagcgacggcgccctgatttctcaaagttccctcggaagccttaa

SEQ ID NO: 2799 - protein, 331 aa, Oryza sativa
MDAAGRRLARVTAHLLPSSLPLPLASAPTLAPSPAASPASDSYRRVHGDVPSEPPEWRAATDESGKGFVDILYDKAVGEGIAKITINRPDRRNAFRPLTVKELMRAFEDARDDSSIGVIILTGKGTQSFCSGGDQALRDADGYVDFDSFGRLNVLDLQVQIRRLPKPVIAMVAGYAVGGGHVLHMVCDLTIAADNAIFGQTGPKVGSFDAGYGTSIMSRLVGPKKAREMWFLSRFYTADEADRMGLVNVVVPLADLERETVKWCRKILRNSPTAIRVLKSALNAADDGHAGLQELGGNATLIFYGTEEAKEGKNAYMERRRPDFSKFPRKP

SEQ ID NO: 2800 - DNA, 690 bp, Oryza sativa
  CDS (1)..(690)
atgaggctgctgcggggtgtggtcgagaaggttgaggctgacgacaccgtgaaggtcgtcctggtcacgagctccgtgcctggagttttctgcgcaggcgccgatctcaaggaacggaaactaatgagctcttctggagttagagaatatgcaaattccttgagatctacattctcatcctttgaggcactatctattccaacaattgctgtcattgaaggagctgctttgggtggtgggctagaactggcactttcatgcgacctgcgtatatgtggagaaaatgcaactcttggactgccagagacaggacttgctatcattcctggagctgggggcacacagcgtcttcctaggattgttggaaggtccagagcgaaggagatgatattcaccggccgtagatgtaatgcaactgaagctgtaatgatgggactcgcaaactactgcgttccagcaggggaggctcatgaaaaagcccttgaacttgcccgcgagatagcccagaaagggcctctggggataagaatggccaagaaggccattgatcaagggatgcaggcagcagacatgccgtccgcgttggccgtcgaaggggagtgctacgagcagctgctgcacacggaggatcgccttgagggcctagccgcattcgccgagaggaggaaacctgtatactcaggaaagtag

SEQ ID NO: 2801 - protein, 229 aa, Oryza sativa
MRLLRGVVEKVEADDTVKVVLVTSSVPGVFCAGADLKERKLMSSSGVREYANSLRSTFSSFEALSIPTIAVIEGAALGGGLELALSCDLRICGENATLGLPETGLAIIPGAGGTQRLPRIVGRSRAKEMIFTGRRCNATEAVMMGLANYCVPAGEAHEKALELAREIAQKGPLGIRMAKKAIDQGMQAADMPSALAVEGECYEQLLHTEDRLEGLAAFAERRKPVYSGK

SEQ ID NO: 2802 - DNA, 903 bp, Oryza sativa
  CDS (1)..(903)
atgcgcatcctccggggaatcctcgccgtctccggccacctcgccggccgccgcgcgccggcgaacaacgcccacctggcactcttctcccgcgccctccaaatcctcgcccagcaggagcccgtccgcctccagaagctctcggcgcccgactccgggatcgtggagatgaggctggagcggccggaggccaggaacgccatcgggagggagatgctccaggggttgcggagcgcgatcgagaaggtgaaggctgacgcgacggcgaaagtcgtgctgctggcgagctccgtcccgaaggttttctgcgctggcgctgatctcaaggaaaggaggttaatgagcccttgcgaagttcgcgaatttgtcaattccctaagatctacattcctgtcctttgaggcattgtcaattcctacaattgccattgttgagggagctgcttttggcggtgggttagaattggctctttcttgtgatctccgtatatgtggggaaaatgcaacatttagcttgccagaaactggccttgctattattcctggagctgggggaacgcagcgtcttcctaggattgttggaaagtccagagcaaaggaattaatattcactggtcgtagattcgatgcagtagaagctgtaaccatgggagtagtaaactactgtgttcccgctggggaggcttataaaagggctcttgaacttgcccaggagataaatcagaaaggtccgttagcgataagaatggctaagaaggccatcaatcaaggcatggaggtagatctgtccgccggattggctgtcgaagaagaatgctacgagcaagttctgcacactcaagatcgtcttgaaggtctagctgcatttgctgagaaaaggaaacctgtatacacagggaaataa

SEQ ID NO: 2803 - protein, 300 aa, Oryza sativa
MRILRGILAVSGHLAGRRAPANNAHLALFSRALQILAQQEPVRLQKLSAPDSGIVEMRLERPEARNAIGREMLQGLRSAIEKVKADATAKVVLLASSVPKVFCAGADLKERRLMSPCEVREFVNSLRSTFLSFEALSIPTIAIVEGAAFGGGLELALSCDLRICGENATFSLPETGLAIIPGAGGTQRLPRIVGKSRAKELIFTGRRFDAVEAVTMGVVNYCVPAGEAYKRALELAQEINQKGPLAIRMAKKAINQGMEVDLSAGLAVEEECYEQVLHTQDRLEGLAAFAEKRKPVYTGK

SEQ ID NO: 2804 - DNA, 1166 bp, Brassica napus
  CDS (72)..(977)
gaattcccgggtcgacttcgctgtcgacgatttcgtacaaaatcaaaactttggagtaagagacggtgaagatgagctttgtcaagtatctccgccgtgatagtttgctccagttagccggaaaacgatcccttagccgaagttgcatgcttcagacctgccggactctcatcattgaaaccgccccgcctgaatctgtcaagcttaaccgtctctctggttccgattctgggattgtcgaggtcaatctagacaggtctgtggccaaaaattccattaataaagagatgctgaaaggtctccagaccacatttgagaccatacatcatgatagttccgctagagttgtgatgatcacaagtctggttccaggagttttctgtgcaggtgcagatctcaaggaacgtagaactatgagtccatctgaggttcacacatatgtcaactccttgcgctacatgttctccttcatagaggcattgagtatcccaactattgctgcaatagaaggtgtggcactaggaggtggactcgaaatggctttatcctgtgatcttcgaatctgtggcgaaaatgcagtatttggtttgcctgaaacaggactcgctgtaatccctggtgctggtgggacacagagactctcaaggctggttggaagatcagtttcaaaggaacttatattcacaggtcgaaagattgatgcaagagaagctgcaaagaaagggctagttaacttctgtgttgcggcgggtgaggctcataagaaagcaatggaagtggctcagcagataaataataaaggtccaatggcgataaagatggcgaagaaagcgattgatgaaggaatagagacgaatatggcttcaggattagagctagaggagatgtgttatcagaagcttctaaacactgaagatcgtctggaaggattagctgcgtttgctgagaaacgtaagcctcgttacactggcaagtgaagctcttttagtttcaataaccggggggagataaccattgtattggatgttaagaaccgggatggtttaggattataataatgtgtatgacacagaaaccaagtaaaaataaacatttgaatatcactcgttctatttgtgcattcattggcttaataaaattaaattcggatacaaaaaaaaaaaaaa

SEQ ID NO: 2805 - protein, 301 aa, Brassica napus
MSFVKYLRRDSLLQLAGKRSLSRSCMLQTCRTLIIETAPPESVKLNRLSGSDSGIVEVNLDRSVAKNSINKEMLKGLQTTFETIHHDSSARVVMITSLVPGVFCAGADLKERRTMSPSEVHTYVNSLRYMFSFIEALSIPTIAAIEGVALGGGLEMALSCDLRICGENAVFGLPETGLAVIPGAGGTQRLSRLVGRSVSKELIFTGRKIDAREAAKKGLVNFCVAAGEAHKKAMEVAQQINNKGPMAIKMAKKAIDEGIETNMASGLELEEMCYQKLLNTEDRLEGLAAFAEKRKPRYTGK

SEQ ID NO: 2806 - DNA, 831 bp, Brassica napus
  CDS (1)..(831)
atggattcctacaaaaccctagaaatcgttcgcaagaataccgactcctccgtcttccacgtcgtcctcaacaggccgtcgcagctcaacgccctatccctcgacttcttcgacgaattccccatagctctatcgtccctcgaccaaaacccagacgtcgccgtcatcatcctctccggcgccggaaaacacttctgctccggcatcgacctcgcttccctctcctcgatctcggcccaatcgtcctcaggcggcgacagagggcgctcgagtgagggtctacgacgcaggatcaaatcgatgcaggcggcgataaccgccgtggaagagtgccggaagcctgtgatcgcagctgtgcacggcgcgtgtatcggagggggagttgatctcgtcacggcttgtgacgttagatactgctccgaggacgctttcttctcgatcaaggaggttgatctagcgatcgttgcggatctcgggactctccagcggttgccgaggatcgtcgggcacgcgaaggctatggagttggcgttgacggcgagacgattctcgggatgtgaagcgaaggaacttggtcttgtttctcaggtcttcagatctaagtcggagcttgataaaggcatcaccatgatcgctgaaggaatagcagcgaagtctcctttagctgtgacagggacgaaggcagtgttgttaagaagcagagagatgagtgtagaacaaggtcttgactacgtagcaacttggaactcgggtatgcttatatcgaacgatctcaacgaagctgtctctgcgcagatgatgaaaagacaacctcgtttctctaaactgtga

SEQ ID NO: 2807 - protein, 276 aa, Brassica napus
MDSYKTLEIVRKNTDSSVFHVVLNRPSQLNALSLDFFDEFPIALSSLDQNPDVAVIILSGAGKHFCSGIDLASLSSISAQSSSGGDRGRSSEGLRRRIKSMQAAITAVEECRKPVIAAVHGACIGGGVDLVTACDVRYCSEDAFFSIKEVDLAIVADLGTLQRLPRIVGHAKAMELALTARRFSGCEAKELGLVSQVFRSKSELDKGITMIAEGIAAKSPLAVTGTKAVLLRSREMSVEQGLDYVATWNSGMLISNDLNEAVSAQMMKRQPRFSKL

SEQ ID NO: 2808 - DNA, 831 bp, Brassica napus
  CDS (1)..(831)
atggaatcctacaaaaccctcgaaatcgttcgcaagaacaccgactcctccgtgttccacctcatcctcaacaggccgtcgcagctcaacgccctctccctcgacttcttcgacgaactccccgaagccctatcctccctcgaccaaaacccagacgtctccgtcatcatcctctccggcgccggaaaacacttctgctccggcatcgacctcgcttccctctcctcgatctcggcccaagcctcctcaggcggcgacagagggcgctcgagcgagggtctacgccgcaggatcaaatcgatgcaggcggcgataaccgccgtggaggagtgccggaagcctgtgatcgcagctgtgcacggcgcgtgtatcggagggggagtcgatctcgtcacggcgtgtgacgttaggtactgctccgaggaggctttcttctcgatcaaggaggttgatctagcgatcgtcgcggatctcgggactctccagcggttgccgagaatcgtcgggcacgcgaaggctatggagttggcgttgacggcgaggcgattctcggggagtgaagcgaaggatcttggtcttgtttctcaggtttttggatctaagtcggagcttgataaaggcgtcacgatgatcgctgaaagaatagcagcgaagtctcctttagctgtgtcagggacgaaggctgtgttgttgagaagcagagagatgagtgtagaacaaggtcttgattatgtagcaacttggaactcgggtatgcttatatcgaacgatctcaacgaagctgtctctgcgcagatgatgaaaagacaacctcgtttctctaaactgtga

SEQ ID NO: 2809 - protein, 276 aa, Brassica napus
MESYKTLEIVRKNTDSSVFHLILNRPSQLNALSLDFFDELPEALSSLDQNPDVSVIILSGAGKHFCSGIDLASLSSISAQASSGGDRGRSSEGLRRRIKSMQAAITAVEECRKPVIAAVHGACIGGGVDLVTACDVRYCSEEAFFSIKEVDLAIVADLGTLQRLPRIVGHAKAMELALTARRFSGSEAKDLGLVSQVFGSKSELDKGVTMIAERIAAKSPLAVSGTKAVLLRSREMSVEQGLDYVATWNSGMLISNDLNEAVSAQMMKRQPRFSKL

SEQ ID NO: 2810 - DNA, 1020 bp, Glycine max
  CDS (1)..(1020)
atggcggagaacaacaacaaccaccaccttgaaaccgccaccagaaggcttgcctctgtgaccaaccacctcactccttcttcttatcacaacgcacccggcgaactcgccccgtgcctcacttccggtgggaacaacagcttccgccgcgtccacggagaagttccatcccacgacgtcgtttggaggatcgtcgcctccgaccacgacaactccggcaaggacttcaccgacattgtctacgagaaggccgtcggggaaggaatagccaagataagtattaataggccagagagaaggaatgcgttccgaccccacacggtgaaggagcttatgcgtgctttcactgatgccagggatgatagctctattggggtcgtcattctcactggcaagggaaccgaagcattttgtagtggtggtgaccaggctttgaggactaacgatggctattctgataatggaagtttcagtagccttaatgtgttagacttgcaggtgcagatacgccgcctccctaaaccagtgattgcaatggtagcaggttatgctgttggaggagggcatgtattgcatatggtctgtgatctaactattgcagcagataatgctatctttggccaaactggtcccaaggttggaagctttgatgctggttatggaagttctatcatgtcccgtttggtaggtccaaaaaaagcacgtgaaatgtggtttctcacaaggttctatgatgctgttgaagcagagaaaatgggccttgtcaacactgttgtaccacttgagaatttagagaaggaaacgataaaatggtgtcgggagatactgaggaacagtccaactgctattcgggtactcaagtcagctcttaatgcagtggatgatggacattccggacttcaggaaattggtggaaatgcaacactgatatactatggcactgaggaagctaaagagggcaagactgcatatatgcaacgtagacggcctgatttttctaagttcaatcggcgaccttaa

SEQ ID NO: 2811 - protein, 339 aa, Glycine max
MAENNNNHHLETATRRLASVTNHLTPSSYHNAPGELAPCLTSGGNNSFRRVHGEVPSHDVVWRIVASDHDNSGKDFTDIVYEKAVGEGIAKISINRPERRNAFRPHTVKELMRAFTDARDDSSIGVVILTGKGTEAFCSGGDQALRTNDGYSDNGSFSSLNVLDLQVQIRRLPKPVIAMVAGYAVGGGHVLHMVCDLTIAADNAIFGQTGPKVGSFDAGYGSSIMSRLVGPKKAREMWFLTRFYDAVEAEKMGLVNTVVPLENLEKETIKWCREILRNSPTAIRVLKSALNAVDDGHSGLQEIGGNATLIYYGTEEAKEGKTAYMQRRRPDFSKFNRRP

SEQ ID NO: 2812 - DNA, 780 bp, Brassica napus
  CDS (1)..(780)
atggatctcatccaagtgaacaaggaatcaggcgggatcggaaccatcacgatcaaccgtccgagatctctcaactctctcacgagagcgatgatggtggatctcgcgcgtgcgttcaaggagatggacgccgatgaatcgatccaggtcgtgattttcaccggagccggtaaatctttctgctccggcgtcgatttgaccgcggcggagtcggttttcaagggagacgtgaaggatccggagaccgacccggtaattcatatggagcggttgagaaaaccgatcatcggagcaattaacggcttcgccatcaccgcggggttcgagctcgccttggcctgcgatattctggtcgcgtccagaggagctaagttcatggatactcacgctaggtttgggatattcccttcttggggactgtctcagaagctgtcgaggatcatcggagcaaacaaagctcgtgaagtttctttaacgtcgatgccgttgacagctgacgtggctgagaagttagggtttgtaaaccacgtggttgaagaaggagaagctttgaagaaagccagaggaatcgcagaggctatcatcaagaatgaacaaggcatggttctgcgtattaagtccgtcatcaatgatggactcaagcttgatcttggtcatgctcttacactcgaaaaggagcgagctcacgcgtactacagtgggatgacaaaggaacagttcaagaagatgcaggagttcatagctggacgtggttccaagaaaccttcttccaagttgtag

SEQ ID NO: 2813 - protein, 259 aa, Brassica napus
MDLIQVNKESGGIGTITINRPRSLNSLTRAMMVDLARAFKEMDADESIQVVIFTGAGKSFCSGVDLTAAESVFKGDVKDPETDPVIHMERLRKPIIGAINGFAITAGFELALACDILVASRGAKFMDTHARFGIFPSWGLSQKLSRIIGANKAREVSLTSMPLTADVAEKLGFVNHVVEEGEALKKARGIAEAIIKNEQGMVLRIKSVINDGLKLDLGHALTLEKERAHAYYSGMTKEQFKKMQEFIAGRGSKKPSSKL

SEQ ID NO: 2814 - DNA, 1070 bp, Triticum aestivum
  CDS (67)..(981)
gctgactctgcctctgctctttcctccgcccagcaccagtctcccactctcgcccgactctccaccatgcgcagcctacggggcctcctcgccgtctccggccacctcgccgcccgccacgcgccgccgagcggcgcctcctcgtctccccacagcgtcctcttcgcccgtgccctccagatcctctcccagccggagcccgtccgcctccacaagctctcggcgcccgactccgggatcgtggagctgaggctggagcggccggaggccaggaacgccatcgggaaggagatgctcaaggggctgcggagcgccatggacaaggtgaaggccgactcgacggccaacgttgtactggtagcgagctccgtgcccaaggtcttctgcgcgggcgctgacctcaaggaaaggaggttaatgggcccttctgaagtccgggaatttgttaataccttgagagctacattctcatcctttgaggcactccctattcctacaatagctgttgttgaaggagctgcctttggcggtgggctagagttggctctttcatgtgatcttcgtatatgtggggagagtgcaacattcagcttgccagaaaccggccttgctattattcctggagctggagggacacagcgtcttccaaggattgttggaagggccagagcaaaggaattgatattcactggccgtagatttgatgcgacagaagctgtaaatatgggggtagtgaactactgcgttcctggtggcgaggcttatcaaaaggctcttgaacttgcccgggagataaatcagaaaggtccgttagcgataaggatggccaagaaggccatcaacgaaggggtggaggtagacctgtcctctgcgttggctgtcgaagaagagtgctacgagcaagttctgcacactcaggatcgccttgaaggtctagctgcatttgcagagaaaagaagacctttgtacacaggaaagtgaggccgtactgaagtcagccctgttagcctcttatgtcttatctgctgataccctgaagaatgtgtccttgttccaaaaaaaaaaaaaaa

SEQ ID NO: 2815 - protein, 304 aa, Triticum aestivum
MRSLRGLLAVSGHLAARHAPPSGASSSPHSVLFARALQILSQPEPVRLHKLSAPDSGIVELRLERPEARNAIGKEMLKGLRSAMDKVKADSTANVVLVASSVPKVFCAGADLKERRLMGPSEVREFVNTLRATFSSFEALPIPTIAVVEGAAFGGGLELALSCDLRICGESATFSLPETGLAIIPGAGGTQRLPRIVGRARAKELIFTGRRFDATEAVNMGVVNYCVPGGEAYQKALELAREINQKGPLAIRMAKKAINEGVEVDLSSALAVEEECYEQVLHTQDRLEGLAAFAEKRRPLYTGK

SEQ ID NO: 2816 - DNA, 789 bp, Linum usitatissimum
  CDS (1)..(789)
atggatcagtcggatctaatcttggtgacccgagaaccgaacggcgtagccacgatcactatcaaccgtcccaaatcaatgaattccctcaccagagccatgatggcccgcctcgcccgggagttcaacgccctcggccgcgatgaaacggtgaaggtcatcatcttgaccggcgccgggcgatcgttctgctccggcgtcgatctcacggcggcggaggacgttttcaagggggacgtgaaggatgtcgagaccgacctggtggcgcagatggagctgtgcaagaagcctataattggggcgatcaacgggttcgcggtcaccgccggtttcgagatcgcgctcgcctgcgacgttttgatcgcttctcgaggagctaaattcatggacacccacgccaggtttgggatatttccttcatggggtctttcccagaagctgtcacggctaataggggttaacagagctagggaagtgtccttgacagcggggccgataactgcggagcaggctgagaaatgggggctggtgaatcaccttgtagaagaaggagaatcgctaaagaaagcgcatgaagtggcgggagccatattaaagaacaatcaggacttggtgttgaggtacaaagccgtgattaacgacgggcttaaactggatttgggttctgctctttctcttgagaaggaaagggcgcataagtactacgatgggatgacaaaggagcaattcaagaagatgcaggagtttgtagctggccgcagctcgaagaagccttcttctaagttgtaa

SEQ ID NO: 2817 - protein, 262 aa, Linum usitatissimum
MDQSDLILVTREPNGVATITINRPKSMNSLTRAMMARLAREFNALGRDETVKVIILTGAGRSFCSGVDLTAAEDVFKGDVKDVETDLVAQMELCKKPIIGAINGFAVTAGFEIALACDVLIASRGAKFMDTHARFGIFPSWGLSQKLSRLIGVNRAREVSLTAGPITAEQAEKWGLVNHLVEEGESLKKAHEVAGAILKNNQDLVLRYKAVINDGLKLDLGSALSLEKERAHKYYDGMTKEQFKKMQEFVAGRSSKKPSSKL

SEQ ID NO: 2818 - DNA, 810 bp, Zea mays
  CDS (1)..(810)
atgggcaccgcatcaccggactccggcgaccttatcgaggtggggccggcgaggccgggatctccggtagccgtggtgaccatcaaccggccttcggcgctcaacgcgctgacgaagcccatgatgatctccatggcggctgcgttccggcggctgggtgccgacgacgccgtggcagcggtggtgctcgcgggccgcggtcgcgcgttctgctccggggtggacctgacggcggcggcggaggtgttcaagggcgatgtgaaggacgtcgccacggaccccgtcgtgcagatggagctctgccggaagcccatcgtcggcgccatcgccgggttcgccgtcactgccgggttcgagatcgccctcgcctgcgacatcctcgtcgctggacgctccaccaagttcttggacacccacgccaagtttgggatatttccttcctggggtctttcacagaagctttctcgcatcattgggccgaatagagcaagggaagtgtcactaacttgcatgcctgttactgctgaaatggcagagaggtgggggcttgttaaccacgtcgtggatgataatgaggtgctgagtaaggcgatagaggttgctgaggctattgtgaggaacaaccgcaacttagttgtattgtacaaatcggttataaatgatggatttaagctggatttggagcatgctcaagcacttgagaaggaaagaggtcacaactattacaatggaatgacaaaggaacagttcacgaatatgcagaaattcatccagggccggagttctaagaaaacaccatcaaagctgtag

SEQ ID NO: 2819 - protein, 269 aa, Zea mays
MGTASPDSGDLIEVGPARPGSPVAVVTINRPSALNALTKPMMISMAAAFRRLGADDAVAAVVLAGRGRAFCSGVDLTAAAEVFKGDVKDVATDPVVQMELCRKPIVGAIAGFAVTAGFEIALACDILVAGRSTKFLDTHAKFGIFPSWGLSQKLSRIIGPNRAREVSLTCMPVTAEMAERWGLVNHVVDDNEVLSKAIEVAEAIVRNNRNLVVLYKSVINDGFKLDLEHAQALEKERGHNYYNGMTKEQFTNMQKFIQGRSSKKTPSKL

SEQ ID NO: 2820 - DNA, 801 bp, Helianthus annuus
  CDS (1)..(801)
atggataaaccgtcaccggaaaacttaatcgtcgttaaaaaagatcccgacgggatagcttacgtcacaatcaaccgcccaaagtccttaaactcactaacaagaccgatgatggtggatctggcgcgtgctttcaactctctcagctccgacgactccgtgggcgtcatcatactgtccgggtcgggtcgctcgttctgttcgggcgtggatctgacttctgcagaggatgtgttcaaaggagacgtgaaggatgtggaaacggatccggttgctcagatggagcggtgccggaagcccataatcggggcggtttccgggtttgctgttacggcgggttttgagatctcgcttgcttgtgatattttgattgcttctactgatgctaaatttgttgatacgcatgctagatttgggatatttccttcatggggtctgtcgcaaaagctttcacgcataatagggcctaataaagcccgagaagtgtcgctaacagccaccccgttaactgcagagaaagcagagaagtggggattggtgaaccatgtggttgaaagtagtgaattgttaaagaaagcccgtgaagttgcagaggccattatgaaaaacaatcgggatttggtgttgaggtacaaagcggttataaatgatggtggcaagctagatcttcatcatgctcttttactagagaaggagagagcgcatgaatattacaatgggatgacaaaggagcagttcaagaaaatgcaggaatttatagcagctagaagttcttctagaaaacctgcttctaaattatag

SEQ ID NO: 2821 - protein, 266 aa, Helianthus annuus
MDKPSPENLIVVKKDPDGIAYVTINRPKSLNSLTRPMMVDLARAFNSLSSDDSVGVIILSGSGRSFCSGVDLTSAEDVFKGDVKDVETDPVAQMERCRKPIIGAVSGFAVTAGFEISLACDILIASTDAKFVDTHARFGIFPSWGLSQKLSRIIGPNKAREVSLTATPLTAEKAEKWGLVNHVVESSELLKKAREVAEAIMKNNRDLVLRYKAVINDGGKLDLHHALLLEKERAHEYYNGMTKEQFKKMQEFIAARSSSRKPASKL

SEQ ID NO: 2822 - DNA, 1266 bp, Brassica napus
  CDS (68)..(1084)
ggaatctcttgtcatcttcatcatcaatcagtctcatctttctctgtctctcgcgtcttcctctccaatggctgactccaaggaactcggcaccgcgagccgccgtatctccgtcttcaccaatcatctcatccccgtggaaacaattccaactcgcgttcactcagtggaactctctactgcctcgtcgatgaatgacaattaccataaggttcacggtgaagtgccgactcaccaagtcgtttggagaaaagctgatctcgtcggtgacgacggagaaacaaaagagtttgttgacattatatatgagaaagccgtcggtgaagatattgccaagatcactataaaccgtccggagaaaagaaacgcgttccggtctcagactgtgaaggagcttatgcgtgcgtttaacgacgccagagacgatagctctgtaggtgtcatcatactcaccggcaagggaacgaaagcgttttgcagtggtggtgatcaagcgttgaggacaccagatggttatgctgatcccaatgatgttggtcgacttaatgtccttgatctccaggttcaaatccgcagactgccaaaaccagttatcgcaatggctgctggttatgctgttggaggaggacatatcttgcacatggtctgtgatctaaccattgcagctgacaatgctattttcggtcagacgggtcctaaggttggaagttttgatgctggttatggaagttcaatcatgtctcgtctggttggtcctaaaaaggcacgggaaatgtggttcatgacgagattctacacagcttcggaagcagataaaatgggactcatcaatacagttgtaccgctagaggatttggagaaagaaactgtgaaatggtgcagagaaatcttacggaacagccctactgcaatccgtgtgcttaaggcagcactcaatgcagtcgatgatggccatgccggacttcaggggctaggaggtgatgccacgctcttattctatggaaccgaagaaggtatagaaggaagaacagcttatatgcaacgccgaccaccgaacttctctaaatttccccggcgaccttgaactcagttcaggtgttttcatacaaacatttgtcctcatttcaatcatattcctttggtttgtttgccaaattaattctagacttcaactatgataaacaatgaagtgataaaactctatttaaagttcatttggattaataaaaacaagaaaaacattaacgtaaaaaaaaaaaaaaaaaa

SEQ ID NO: 2823 - protein, 338 aa, Brassica napus
MADSKELGTASRRISVFTNHLIPVETIPTRVHSVELSTASSMNDNYHKVHGEVPTHQVVWRKADLVGDDGETKEFVDIIYEKAVGEDIAKITINRPEKRNAFRSQTVKELMRAFNDARDDSSVGVIILTGKGTKAFCSGGDQALRTPDGYADPNDVGRLNVLDLQVQIRRLPKPVIAMAAGYAVGGGHILHMVCDLTIAADNAIFGQTGPKVGSFDAGYGSSIMSRLVGPKKAREMWFMTRFYTASEADKMGLINTVVPLEDLEKETVKWCREILRNSPTAIRVLKAALNAVDDGHAGLQGLGGDATLLFYGTEEGIEGRTAYMQRRPPNFSKFPRRP

SEQ ID NO: 2824 - DNA, 1234 bp, Brassica napus
  CDS (36)..(1052)
tctcatctttctctgtctctcgcgtcttcctctccatggctgactccaaggaactcggcaccgcgagccgccgtatctccgtcttcaccaatcatctcatccccgtggaaacaattccaactcgcgttcactcagtggaactctctactgcctcgtcgatgaatgacaattaccataaggttcacggtgaagtgccgactcaccaagtcgtttggagaaaagctgatctcgtcggtgacgacggagaaacaaaagagtttgttgacattatatatgagaaagccgtcggtgaagatattgccaagatcactataaaccgtccggagaaaagaaacgcgttccggtctcagactgtgaaggagcttatgcgtgcgtttaacgacgccagagacgatagctctgtaggtgtcatcatactcaccggcaagggaacgaaagcgttttgcagtggtggtgatcaagcgttgaggacaccagatggttatgctgatcccaatgatgttggtcgacttaatgtccttgatctccaggttcaaatccgcagactgccaaaaccagttatcgcaatggttgctggttatgctgttggaggaggacatatcttgcacatggtttgtgatctaaccattgcagctgataatgctattttcggtcagacgggtcctaaggttggaagttttgatgctggttatggaagttcaatcatgtctcgtctggttggtcctaaaaaggcacgggaaatgtggttcatgacgagattctacacagcttcggaagcagataaaatgggactcatcaatacagttgtaccgctagaggatttggagaaagaaactgtgaaatggtgcagagaaatcttacggaacagccctactgcaatccgtgtgcttaaggcagcactcaatgcagtcgatgatggccatgccggacttcaggggctaggaggtgatgccacgctcttattctatggaaccgaagaaggtatagaaggaagaacagcttatatgcaacgccgaccaccgaacttctctaaatttccccggcgaccttgaactcagttcaggtgttttcatacaaacatttgtcctcatttcaatcatattcctttggtttgtttgccaaattaattctagacttcaactatgataaacaatgaagtgataaaactctatttaaagttcatttggattaataaaaacaagaaaaacattaacgtaaaaaaaaaaaaaaaaaa

SEQ ID NO: 2825 - protein, 338 aa, Brassica napus
MADSKELGTASRRISVFTNHLIPVETIPTRVHSVELSTASSMNDNYHKVHGEVPTHQVVWRKADLVGDDGETKEFVDIIYEKAVGEDIAKITINRPEKRNAFRSQTVKELMRAFNDARDDSSVGVIILTGKGTKAFCSGGDQALRTPDGYADPNDVGRLNVLDLQVQIRRLPKPVIAMVAGYAVGGGHILHMVCDLTIAADNAIFGQTGPKVGSFDAGYGSSIMSRLVGPKKAREMWFMTRFYTASEADKMGLINTVVPLEDLEKETVKWCREILRNSPTAIRVLKAALNAVDDGHAGLQGLGGDATLLFYGTEEGIEGRTAYMQRRPPNFSKFPRRP

SEQ ID NO: 2826 - DNA, 1345 bp, Zea mays
  CDS (132)..(1049)
gtacccctcgaaggcctggcccgggtttgttaaatattaatggtcgataataatatatgtattattcgtttttatgtaaaaaaaaaaaaaaaaaaaaaaaaaaaaaaaaaaaaaaaaagccggggcccccaatgcgcagtccgcgaggcctcctcaccgcctccggctaccttgcgggccggcacgctccgtcgccctccgtgtccaccactggccacaactccctactcgctcgcaccttccaaatcctagcccagccggagtccgtccgtctgcagaagcacccggcacccaactccgggatcttagagctgaggctggagcggccggaagtcaagaacgccattaattgggatatgatgaggatgctgcggagcgccatagagaagattcaggccgacacgacggcgaaggtcgtccttgttgcgagctccgtgccgggggctttctctgcaggcgccgatctcaaggaaaggaggctaatgagttcttctgacgttggggggtatgctagatccttgaggtctacattttcgtcttttgaggcacttcctattccaacaattgctgtcattgaaggagctgcccttggtggtgggctagaactggctttggcatgcgatcttcgaatatgtggagaaaatgctgaacttggactgccagaaacaagccttgctattatacctggagctggaggtacgcaacgccttcctaggatcatagggaggtccagagcaaaggaactgatattcactggccgcagatgtggtgcagctgaagctgtaacgatggggttagcaaactactgtgttccagcaggagaggcttaccagaaggctcttgacattgcctgtgagataactcagaagggtcccatggggataagaatggcaaagaaggcgatcaatgagggggcagaggttgccgacatgtcctcggcgctggctatcgaaggggagtgctacgagcagctgctttacacgcaggatcgcgttgaggccctagctgcatttgccgagaagaggaagcctgtgtacacaggaaagtagtagtgtcagaaaggatgataatcgtcttgagagtctgctacaagcagagatggtggcaatggataccccaaatccatacatccaatagccgggtgtggaataaattctttatcatagatacgttaatgggtacaatattatacccatcggtagacgggtgcaagatggatgcgggtatagatatgtattagctatctatgggtaatttttacccacctcatctatatatataatctactcaattaagtacaaaaaaaaaaaaattagctaaaaataaaatcaacttacatatctct

SEQ ID NO: 2827 - protein, 305 aa, Zea mays
MRSPRGLLTASGYLAGRHAPSPSVSTTGHNSLLARTFQILAQPESVRLQKHPAPNSGILELRLERPEVKNAINWDMMRMLRSAIEKIQADTTAKVVLVASSVPGAFSAGADLKERRLMSSSDVGGYARSLRSTFSSFEALPIPTIAVIEGAALGGGLELALACDLRICGENAELGLPETSLAIIPGAGGTQRLPRIIGRSRAKELIFTGRRCGAAEAVTMGLANYCVPAGEAYQKALDIACEITQKGPMGIRMAKKAINEGAEVADMSSALAIEGECYEQLLYTQDRVEALAAFAEKRKPVYTGK

SEQ ID NO: 2828 - DNA, 1460 bp, Zea mays
  CDS (125)..(1033)
cggtaccggacttcccgggctgccatggcgacctcgaggcaggccgggaccgcccaatcagtctcccagcatttaccggctcctccgcacctgctgctccagttccagctctcccaacaccaacatgctcggcctccggcgcctccccgctgtctccggccgcctcgcgccggaggtcacctccgtctctgcggcctcctcccacagcgccgtcttctttcgcaccctccaaatcctcgtccagcaggggcccgtccgcctccaaaagctctctgctccggacaccgggatcgtggagctgaggctggagcggccggaggccaagaacgccatagggaaggagatgctccaggggctgcggagcgcgatccaggaggtggaggccgacacggctgcaaacgtcgtcttggtgacgagctcggtgcccaaggttttctgcgcgggcgccgatctcaaggaaaggaggttgatgggtcctagtgaagttcgggacttcgttaattccttaaggtctacattttcatcctttgaggcactgtctattcctacaattgctgttgtcgaaggggttgcttttggtggcgggttagaattggctctgtcatgtgatcttcgcatatgtggcaaggatgcaaaattcagtttgccagagactggccttgctattatcccaggtgctggaggaacacagcgccttcctaggattgttggaaggtcaagagcaaaagaactaatattcactggtcgtagattcgatgcggtggaggctgtaactatgggagtagtaaactactgtgttcctgccggcgacgcttatcaaaaggctcttgaacttgcgcgggagataaaccagaaaggcccgttagcagtaaaaatggctaagaaggccatcgatcaaggggcagaggtagacttgccctcggcattggtcgttgaagaagaatgctaccagcaagtcctgcacactgaggatcgtcttgagggtctagccgcattcgccgagaaaagaaagcctatatataaagggaagtagggccgtgtatggtcttagattcataataatagaaagtcgcattaacatgccatccaataatagtggcatgattgcatgacattgatatgtgcaaattcatgtctctgagtctctctgtaactttcaggaaataagataagatgtatcagcgctgctacctatgtggctatgtgttctgaactgaggtgaatttggctgcggctttaaactttaagatagacagattagacagctaggctgattagagtccatttcccttacgaaaatgtgagatttgagttggacctcaataatcattactgataaaagtaagcccaaataccgctgtgagattgttaaaattagcatcgagacagtgtttaagggcatgcacaatcacattgattctatccatagctcattgattcaaaaaaaaaaaaaaaaaaaa

SEQ ID NO: 2829 - protein, 302 aa, Zea mays
MLGLRRLPAVSGRLAPEVTSVSAASSHSAVFFRTLQILVQQGPVRLQKLSAPDTGIVELRLERPEAKNAIGKEMLQGLRSAIQEVEADTAANVVLVTSSVPKVFCAGADLKERRLMGPSEVRDFVNSLRSTFSSFEALSIPTIAVVEGVAFGGGLELALSCDLRICGKDAKFSLPETGLAIIPGAGGTQRLPRIVGRSRAKELIFTGRRFDAVEAVTMGVVNYCVPAGDAYQKALELAREINQKGPLAVKMAKKAIDQGAEVDLPSALVVEEECYQQVLHTEDRLEGLAAFAEKRKPIYKGK

SEQ ID NO: 2830 - DNA, 1261 bp, Zea mays
  CDS (79)..(996)
ttttttgaccacacatcagactatcagagtcctaccaagtggcaccaaagctcgttctcccgaccccgactgcccccaatgcgcagtccgcgaggcctcctcaccgcctccggctaccttgcgggccggcacgctccgtcggcctccgtgtccaccactggccacaactccctactcgctcgcaccttccaaatcctagcccagccggagtccgtccgtctgcagaagcacccggcacccaactccgggatcttagagctgaggctggagcggccggaagtcaagaacgccattaattgggatatgatgaggatgctgcggagcgccatagagaagattcaggccgacacgacggcgaaggtcgtccttgttgcgagctccgtgccgggggctttctctgcaggcgccgatctcaaggaaaggaggctaatgagttcttctgacgttggggggtatgctagatccttgaggtctacattttcgtcttttgaggcacttcctattccaacaattgctgtcattgaaggagctgcccttggtggtgggctagaactggctttggcatgcgatcttcgaatatgtggagaaaatgctgaacttggactgccagaaacaagccttgctattatacctggagctggaggtacgcaacgccttcctaggatcatagggaggtccagagcaaaggaactaatattcactggcctcagatgtggtgcagctgaagctgtaacgatggggttagcaaactactgtgttccagcaggagaggcttaccagaaggctcttgacattgcctgtgagataactcagaagggtcccatggggataagaatggcaaagaaggcgatcaatgagggggcagaggttgccgacatgtcctcggcgctggctatcgaagaggagtgctacgagcagctgctttacacgcaggatcgcgttgaggccctagctgcatttgccgagaagaggaagcctgtgtacacaggaaagtagtagtgtcagaaaggatgataatcgtcttgagagtctgctacaagcagagatggtggcaatggataccccaaatccatacatccaatagccgggtgtggaataaattctttatcatagatacgttaatgggtacaatattatacccatcggtagacgggtgcaagatggatgcgggtatagatatgtattagctatctatgggtaatttttacccacctcatctatatatataatctactcaattaagtacaaaaaaaaaaaaaaa

SEQ ID NO: 2831 - protein, 305 aa, Zea mays
MRSPRGLLTASGYLAGRHAPSASVSTTGHNSLLARTFQILAQPESVRLQKHPAPNSGILELRLERPEVKNAINWDMMRMLRSAIEKIQADTTAKVVLVASSVPGAFSAGADLKERRLMSSSDVGGYARSLRSTFSSFEALPIPTIAVIEGAALGGGLELALACDLRICGENAELGLPETSLAIIPGAGGTQRLPRIIGRSRAKELIFTGLRCGAAEAVTMGLANYCVPAGEAYQKALDIACEITQKGPMGIRMAKKAINEGAEVADMSSALAIEEECYEQLLYTQDRVEALAAFAEKRKPVYTGK

SEQ ID NO: 2832 - DNA, 1312 bp, Zea mays
  CDS (94)..(1104)
ccacaacccacgcgccacgcgcccacgcccactggccaccgccccacccccacccgtgcccgtcccgtgctagcttagctctcggctctcgccatggacgctgcggagaggaggctggctcgcgtcgctgcccacctcgttccgtccttcccggtcccacacgccaccgggcctcccctcgcgccttctcccgcggcagcgtcctcgtcgtcgtcctcgccggcgggggacagctacaggcgcgtgcacggcgacgtgccgtcggagccaccggagtggcgcaccgccacagacgagtcagggaaggagttcgtcgacatcatctacgagaaggccgtcggagagggcatcgccaagatcaccattaaccggcctgacagaaggaacgccttccgtccgctgaccgtgaaggaactaatgcgcgcgttcaacgatgccagagatgatagttcgattggagtcatcattcttacagggaagggaaccaaggcgttctgcagcggcggtgaccaggcgttaagagattctgatggatatgtggacttcgatagctttggccgcctcaatgtcttagatctccaggtgcagattcgccgtcttccaaagcctgtcattgctatggttgctggttatgctgttggtggtggacatgttttgcacatggtgtgtgatataacaattgcagcagagaacgcgatatttgggcagacagggcccaaggttggaagctttgatgctggttatggatcttcgataatgtcccggttggttggacccaagagagcccgtgaaatgtggtttctgtcacggttctacacagctgacgaagctgacaaaatgggactcgtgaacaccgtagtaccgcttgctgaactggagcaggaaactgtcaaatggtgccgtcagatcttaagaaacagccccatggctattcgcgtgctgaaatctgcactcaacgcggcagatgatggccatgcaggccttcaggagctcggcgggaatgccacgctaatattttacggcacggaggaggcaaaggaagggaagaacgcgtacatggagagacgacgcccagatttctccaagttcccacgcaaaccttgagtttcagctcttgctgaactggccaattattttactgatcccccccccaacttggatcattatgcttactctacattgaggagacggacgataatcattttcactccaatcaattttcatatatatatacacgataaatgtattttgcatgaaaattcagatcaatgaaaagtaaagcttgatgtatttgattcaaaaaaaaaaaaaa

SEQ ID NO: 2833 - protein, 336 aa, Zea mays
MDAAERRLARVAAHLVPSFPVPHATGPPLAPSPAAASSSSSSPAGDSYRRVHGDVPSEPPEWRTATDESGKEFVDIIYEKAVGEGIAKITINRPDRRNAFRPLTVKELMRAFNDARDDSSIGVIILTGKGTKAFCSGGDQALRDSDGYVDFDSFGRLNVLDLQVQIRRLPKPVIAMVAGYAVGGGHVLHMVCDITIAAENAIFGQTGPKVGSFDAGYGSSIMSRLVGPKRAREMWFLSRFYTADEADKMGLVNTVVPLAELEQETVKWCRQILRNSPMAIRVLKSALNAADDGHAGLQELGGNATLIFYGTEEAKEGKNAYMERRRPDFSKFPRKP

SEQ ID NO: 2834 - DNA, 1520 bp, Zea mays
  CDS (182)..(1048)
gtcagaagatgattatccctatccgcctccgcttaccttagatgtctccgagatccaaaaacaagaacaagagcgagcagagcgtggcgacaaatcacccgctgccttttatcccgcaaccagcagcagcgaaggccgcgagaggcaggtagtagccgcacgccacatcaacccaccacggatggccggcggcggcgaccgtgacgcatccgacgcggagctccgcgcggggttcgagaccctggccgtgacgcggccggacccttccgcgggggtctacgaggtccgcctcaaccgcccggcgcagcgcaacgcgctgagcccggccgcgttcgcggagatcccgcgcgccatgtctctgctggaccgcgccccctcggcgcgcgccgtggtgctgtccgccgcgggcccgcacttctgcgcgggcatcgagctcgggggccccggggacccgctgtccgccgcctccgccgatcccgtggccgccgcggaggggctccgccgcgcggtcctcgacatgcaggcggcgctcacggccatcgagcggtgccggaagcccgtcgtcgcggcggtgcacggcgcctgcgtcggcggcggcgtcgacctcgtggccgcctgcgacatcaggtgctgctccagggacgcctccttcgtgctcaaggaggtggacatggccatcgtcgccgacctcggcgcgctgcagcgcctcccgcggatcgtcggctacggcaacgctgctgacctcgcgctcaccggacgcaagatcaacgccatggaggccaaggacatggggttggttaccagggtctttgattccaagcaagacttggatgcgggcgtcgcaaagatcgccaaagaaatagctgacaagtcggcatgggcggtgattggaaccaaggccgttctgctgagaagcagggatgcgaccatagaacaaggcctggagcatgtagccacatggaacgcgggtatgatgaggtcgaacgatctgaaggaggccatcagagccttcctggagaagcggaagcctgtgttctccaagctgtaatgatcagataccatcataccatacctctgtgttacttaacaagtggtgctacgtatctggaaatgcaaaggaataaagtgtgctaggagtagacaattgtcagggaaaaagaaaaaaaaaatgcctgttctcgatggagctgtgaaggcatttttccatgtcagttgagcttaccaaagttgttttggtcggtatggatgaaccgggggtgtttctgttttttttcctgttccagtctgtacgtagattcattttttttgccccgggacaaaaagccaaacaatcatttggagttcaaagtcttttggggctttgagcgaaatgggacattccctcccgtttgtggtgcccaagaaaagaatttgggtccaaactggaaccggtaacaaaaccgtccaaactggaataggtactcaaaaccgtactctctgtcccgaattagattcatatatatatgaataattttttttgg

SEQ ID NO: 2835 - protein, 288 aa, Zea mays
MAGGGDRDASDAELRAGFETLAVTRPDPSAGVYEVRLNRPAQRNALSPAAFAEIPRAMSLLDRAPSARAVVLSAAGPHFCAGIELGGPGDPLSAASADPVAAAEGLRRAVLDMQAALTAIERCRKPVVAAVHGACVGGGVDLVAACDIRCCSRDASFVLKEVDMAIVADLGALQRLPRIVGYGNAADLALTGRKINAMEAKDMGLVTRVFDSKQDLDAGVAKIAKEIADKSAWAVIGTKAVLLRSRDATIEQGLEHVATWNAGMMRSNDLKEAIRAFLEKRKPVFSKL

SEQ ID NO: 2836 - DNA, 21 bp, Artificial sequence
  primer
atgagcgaactgatcgtcagc

SEQ ID NO: 2837 - DNA, 23 bp, Artificial sequence
  primer
ttagcgtcctttaaagtcgggcg

SEQ ID NO: 2838 - protein, 254 aa, Artificial sequence
  consensus sequence
  Variant (4)..(4): Xaa in position 4 is any amino acid
  Variant (5)..(6): Xaa in position 5 to 6 is any or no amino acid
  Variant (10)..(31): Xaa in position 10 to 31 is any amino acid
  Variant (32)..(37): Xaa in position 32 to 37 is any or no amino acid
  Variant (40)..(42): Xaa in position 40 to 42 is any amino acid
  Variant (43)..(44): Xaa in position 43 to 44 is any or no amino acid
  Variant (46)..(46): Xaa in position 46 is any amino acid
  Variant (50)..(50): Xaa in position 50 is any amino acid
  Variant (52)..(78): Xaa in position 52 to 78 is any amino acid
  Variant (79)..(93): Xaa in position 79 to 93 is any or no amino acid
  Variant (96)..(96): Xaa in position 96 is any amino acid
  Variant (101)..(101): Xaa in position 101 is any amino acid
  Variant (103)..(103): Xaa in position 103 is any amino acid
  Variant (109)..(109): Xaa in position 109 is any amino acid
  Variant (113)..(114): Xaa in position 113 to 114 is any amino acid
  Variant (117)..(119): Xaa in position 117 to 119 is any amino acid
  Variant (121)..(123): Xaa in position 121 to 123 is any amino acid
  Variant (125)..(125): Xaa in position 125 is any amino acid
  Variant (128)..(128): Xaa in position 128 is any amino acid
  Variant (131)..(133): Xaa in position 131 to 133 is any amino acid
  Variant (135)..(136): Xaa in position 135 to 136 is any amino acid
  Variant (139)..(139): Xaa in position 139 is any amino acid
  Variant (142)..(142): Xaa in position 142 is any amino acid
  Variant (146)..(146): Xaa in position 146 is any amino acid
  Variant (148)..(149): Xaa in position 148 to 149 is any amino acid
  Variant (151)..(153): Xaa in position 151 to 153 is any amino acid
  Variant (155)..(159): Xaa in position 155 to 159 is any amino acid
  Variant (161)..(165): Xaa in position 161 to 165 is any amino acid
  Variant (167)..(167): Xaa in position 167 is any amino acid
  Variant (170)..(172): Xaa in position 170 to 172 is any amino acid
  Variant (176)..(191): Xaa in position 176 to 191 is any amino acid
  Variant (192)..(192): Xaa in position 192 is any or no amino acid
  Variant (194)..(195): Xaa in position 194 to 195 is any amino acid
  Variant (197)..(207): Xaa in position 197 to 207 is any amino acid
  Variant (208)..(208): Xaa in position 208 is any or no amino acid
  Variant (210)..(224): Xaa in position 210 to 224 is any amino acid
  Variant (225)..(227): Xaa in position 225 to 227 is any or no amino acid
  Variant (229)..(239): Xaa in position 229 to 239 is any amino acid
  Variant (240)..(241): Xaa in position 240 to 241 is any or no amino acid
  Variant (243)..(244): Xaa in position 243 to 244 is any amino acid
  Variant (247)..(248): Xaa in position 247 to 248 is any amino acid
  Variant (251)..(252): Xaa in position 251 to 252 is any amino acid
NRPXXXNALXXXXXXXXXXXXXXXXXXXXXXXXXXXXTGXXXXXFXAGAXDXXXXXXXXXXXXXXXXXXXXXXXXXXXXXXXXXXXXXXXXXXKPXIAAVXGXALGGGXELAXXCDXXXAXXXAXFGXPEXXXGXXPGXGGXQRLXRXXGXXXAXXXXXTXXXXXAXEAXXXGLVXXXXXXXXXXXXXXXXXAXXIXXXXXXXXXXXXKXXXXXXXXXXXXXXXXXXEXXXXXXXXXXXXXDXXEGXXAFXXKR

SEQ ID NO: 2839 - protein, 36 aa, Artificial sequence
  protein pattern
  Variant (2)..(2): Xaa in position 2 is any amino acid
  Variant (4)..(4): Xaa in position 4 is any amino acid
  Variant (6)..(6): Xaa in position 6 is any amino acid
  Variant (7)..(7): Xaa in position 7 is Ala, Cys or Thr
  Variant (8)..(8): Xaa in position 8 is any amino acid
  Variant (12)..(13): Xaa in position 12 to 13 is any amino acid
  Variant (14)..(14): Xaa in position 14 is Ile, Leu, Met or Val
  Variant (15)..(18): Xaa in position 15 to 18 is any amino acid
  Variant (20)..(20): Xaa in position 20 is Phe, Ile, Leu, Met or Val
  Variant (21)..(22): Xaa in position 21 to 22 is any amino acid
  Variant (23)..(23): Xaa in position 23 is Ala, Cys or Val
  Variant (24)..(24): Xaa in position 24 is Ala, Gly or Ser
  Variant (25)..(26): Xaa in position 25 to 26 is any amino acid
  Variant (27)..(27): Xaa in position 27 is Ala or Ser
  Variant (28)..(28): Xaa in position 28 is any amino acid
  Variant (29)..(29): Xaa in position 29 is Phe, Met or Val
  Variant (30)..(30): Xaa in position 30 is Ala, Cys, Gly, Ser or Val
  Variant (31)..(32): Xaa in position 31 to 32 is any amino acid
  Variant (33)..(33): Xaa in position 33 is Glu or Gly
  Variant (34)..(35): Xaa in position 34 to 35 is any amino acid
  Variant (36)..(36): Xaa in position 36 is Phe, Ile, Leu, Met or Val
AXVXGXXXGGGXXXXXXXDXXXXXXXXXXXXXXXXX

SEQ ID NO: 2840 - protein, 15 aa, Artificial sequence
  protein pattern
  Variant (2)..(3): Xaa in position 2 to 3 is any amino acid
  Variant (6)..(7): Xaa in position 6 to 7 is any amino acid
  Variant (10)..(10): Xaa in position 10 is any amino acid
  Variant (11)..(11): Xaa in position 11 is Ala, Asp, Glu, Asn, Gln or Thr
  Variant (14)..(14): Xaa in position 14 is any amino acid
  Variant (15)..(15): Xaa in position 15 is Ala, Gly or Pro
DXXEGXXAFXXKRXX

SEQ ID NO: 2841 - DNA, 372 bp, Escherichia coli
  CDS (1)..(372): transl_table=11
atgaccgttatttatcagaccaccatcacccgtatcggcgcgagtgccattgacgccctcagtgaccagatgctcatcacctttcgtgaaggcgcgcctgcggacctcgaagagtattgcttcattcattgccacggcgagttgaaaggtgcactccatcccggtttgcaattttcactcgggcagcatcgctatccggtgaccgctgttggcagcgtggcggaagacaaccttcgcgaactgggtcatgtcaccctgcgcttcgatggtttaaacgaagcggaatttccgggcactgtccatgtggcaggccctgtccccgacgatatcgcgccgggatcggttttgaagtttgaatctgttaaggagtaa

SEQ ID NO: 2842 - protein, 123 aa, Escherichia coli
MTVIYQTTITRIGASAIDALSDQMLITFREGAPADLEEYCFIHCHGELKGALHPGLQFSLGQHRYPVTAVGSVAEDNLRELGHVTLRFDGLNEAEFPGTVHVAGPVPDDIAPGSVLKFESVKE

SEQ ID NO: 2843 - DNA, 378 bp, Bacillus halodurans C-125
  CDS (1)..(378): transl_table=11
atggagggaacaatgacgtgtatctatgaatccgttattacgggagtcgggtctgaagttcagtactttatagaggaaaatatggtcgtcatttttaacgacacggttccagacgacttaaagtcaatcggtgtcatacacaaacatacagaacttcaggcggacgttgccgcaggtgatgttcttgaagtaaacggtgcttgctttcgaatattgtttgttggagacaaagtgaatgacacgttgcgtgagatcgggcattgcacgattgctttcaatggcgaaacgaatgctgatctgcctggaacgttatgtgtagaaaagaagccacttcctgactttgtaacaggggcaacgattaaatttataaaagaataa

SEQ ID NO: 2844 - protein, 125 aa, Bacillus halodurans C-125
MEGTMTCIYESVITGVGSEVQYFIEENMVVIFNDTVPDDLKSIGVIHKHTELQADVAAGDVLEVNGACFRILFVGDKVNDTLREIGHCTIAFNGETNADLPGTLCVEKKPLPDFVTGATIKFIKE

SEQ ID NO: 2845 - DNA, 372 bp, Pasteurella multocida subsp. multocida str. Pm70
  CDS (1)..(372): transl_table=11
atgaaaactctttatcaaagcagatttattcaaattggtaattttgcagcagaagccttagatgacggcatgctgatcacctttaaacaaggtgtgccggaggaaatagctgattactgttatattcacacccatggcgaattgcacgaaaatttacagcttggtgatctggtgaattttaatgaagaaccttattacattactgcgataggggatgtcgcaaatctaaacttcaaagaacttggacacgtcacttggcgctttgatggtgcagtcgttgctgaatttccagggagcattcatctacaaggtcctccacctgaaagtgtggcaatcaatagtttattcacgatcaaacgtgatgaaaaataa

SEQ ID NO: 2846 - protein, 123 aa, Pasteurella multocida subsp. multocida str. Pm70
MKTLYQSRFIQIGNFAAEALDDGMLITFKQGVPEEIADYCYIHTHGELHENLQLGDLVNFNEEPYYITAIGDVANLNFKELGHVTWRFDGAVVAEFPGSIHLQGPPPESVAINSLFTIKRDEK

SEQ ID NO: 2847 - DNA, 375 bp, Salmonella typhimurium LT2
  CDS (1)..(375): transl_table=11
atgatgatttactgcgcacgtattactgccatcgggctgtttgtcgccgacggcctcaccgacaagatgctcatcaccttcgacagcaacgggccgaaggactgtctcgattactcgctgtcgctggagccgtcgttccgggaagagagcctgatgatactccccggcgaccgcctgctgctggcagggcatgattatctggtgactgccgtcggcaagggggtacagcaggcgctgtttgaactcggtcatctgacgctggtgtttgacggtgacctgaagccctgccacaccggggcgattcatctctccggcccggtgccgaaactccatgacctgcacggcaatctggtgattgaggagggacggccatga

SEQ ID NO: 2848 - protein, 124 aa, Salmonella typhimurium LT2
MMIYCARITAIGLFVADGLTDKMLITFDSNGPKDCLDYSLSLEPSFREESLMILPGDRLLLAGHDYLVTAVGKGVQQALFELGHLTLVFDGDLKPCHTGAIHLSGPVPKLHDLHGNLVIEEGRP

SEQ ID NO: 2849 - DNA, 366 bp, Streptococcus mutans UA159
  CDS (1)..(366): transl_table=11
atgactaaaatttttgaagcaaaagtgctggctgttggaccagaagctctcagcatgattaaagatgctaatatgcttattctctttggagaagaggctcctcaagatctggcagattattgttataaaattgataataaaaatctaagtgggcatattaaaaagggcgggcatcttgttattaatggtaatgactgtcaaattacagctgttggcagtgttgttgaaaagaatttaacaggacttggccatatcactatctcattggatggttcaaaggaaagttcattaccgggaacacttcatatacaagcagaattccctgttcagcttgaagcaggttcccttattcaaatttttgattag

SEQ ID NO: 2850 - protein, 121 aa, Streptococcus mutans UA159
MTKIFEAKVLAVGPEALSMIKDANMLILFGEEAPQDLADYCYKIDNKNLSGHIKKGGHLVINGNDCQITAVGSVVEKNLTGLGHITISLDGSKESSLPGTLHIQAEFPVQLEAGSLIQIFD

SEQ ID NO: 2851 - DNA, 378 bp, Lactobacillus plantarum WCFS1
  CDS (1)..(378): transl_table=11
atgatgacaaaagagagaattatcttttcaacaaaggtcttagaaataggtgcggaatctgctgattttaaatcgattggcatggcagtattatttggtgatgaagctccagacgcattacggccttcttgctttattatcgaagttgtcccaataagtgagcaaatcacagcaggaatgaaacttgaagtcgacaatcaagtctatcaaattacagcagttggtggcgaagtccagactaaccttggaagattaggccatacggctattagttttacgggtgcaaaggaggctaaattgcctgggacgttatatgttgagcagggcgattatcctgattttaaagtcggtagcgtggtacggattatagctgaataa

SEQ ID NO: 2852 - protein, 125 aa, Lactobacillus plantarum WCFS1
MMTKERIIFSTKVLEIGAESADFKSIGMAVLFGDEAPDALRPSCFIIEVVPISEQITAGMKLEVDNQVYQITAVGGEVQTNLGRLGHTAISFTGAKEAKLPGTLYVEQGDYPDFKVGSVVRIIAE

SEQ ID NO: 2853 - DNA, 363 bp, Salmonella enterica subsp. enterica serovar Typhi Ty2
  CDS (1)..(363): transl_table=11
atgagcgtgatttatcaaaccaccatcacccgcatcggccagagcgcgatggaggcgctcggcgaaaagatgctgattacgtttcgggaaggcgcgccggcggatatcgaagaattttgcttcatccattgtcatggcgaactgaccggcgcgctgcagcctggcgcgcggtgtgaactgggccaacattgctatccggtcacggcggtcggcagcgtagccgagcaaaacctgcgtgaactggggcatatcaccttgcgctttgatggtctgcgcgaagcggaatttcccggcaccgtacacgttgcggggcctgtaccggacgatatcgcgccgggctgtattttgacgtttgtcgcttaa

SEQ ID NO: 2854 - protein, 120 aa, Salmonella enterica subsp. enterica serovar Typhi Ty2
MSVIYQTTITRIGQSAMEALGEKMLITFREGAPADIEEFCFIHCHGELTGALQPGARCELGQHCYPVTAVGSVAEQNLRELGHITLRFDGLREAEFPGTVHVAGPVPDDIAPGCILTFVA

SEQ ID NO: 2855 - DNA, 405 bp, Propionibacterium acnes KPA171202
  CDS (1)..(405): transl_table=11
atgacgactacgtccagcacattgtggaatgccgtagtgctccgcatcggcaaaggcgcccaggacatgttggataccggagtcatcgtgctgttcggagagcctgtgcccgatgccttgtctgatatttgcgtaattcacaatcgcggtggtcgttccccgctggcccctcaacgcgagctgctccccggagatgtcctcaatttcgctgacactcgctacaccatcgatgaggtcggagaaaccgcaacatcaaacctgggcgacctcggccacgtcgtgttgtatttcaactcccccgaccaatcgttacttgctggagctatcaagatgtccgggccaccaccgcagctaccggatcagggagctatcctcacctttgagccctcgagtgacaagggctga

SEQ ID NO: 2856 - protein, 134 aa, Propionibacterium acnes KPA171202
MTTTSSTLWNAVVLRIGKGAQDMLDTGVIVLFGEPVPDALSDICVIHNRGGRSPLAPQRELLPGDVLNFADTRYTIDEVGETATSNLGDLGHVVLYFNSPDQSLLAGAIKMSGPPPQLPDQGAILTFEPSSDKG

SEQ ID NO: 2857 - DNA, 369 bp, Propionibacterium acnes KPA171202
  CDS (1)..(369): transl_table=11
atgtctgtcatctatcgcaatcagatctgcgccgtcggctcgcaggccgagtcctttctcagcgagaaaatgcttgtcacattcgggggtaaggcacctgacgaacttcgcgacttctgttacgccctacctgaggcgacctcgagcggcaccatcggtgtcggcgacgtcctcgccatcggcgagcaccgcttccccatcacagcaattggtgccctcgcacagcgcaacctcgactccttaggacacgtcaccctcgtcttcgacggcgccgacgagccacggctcgagggggccctccacgtacgctgtggcggtgagctgcccagaccgcaggccggcagcacaatcctcatcgagtcagcatga

SEQ ID NO: 2858 - protein, 122 aa, Propionibacterium acnes KPA171202
MSVIYRNQICAVGSQAESFLSEKMLVTFGGKAPDELRDFCYALPEATSSGTIGVGDVLAIGEHRFPITAIGALAQRNLDSLGHVTLVFDGADEPRLEGALHVRCGGELPRPQAGSTILIESA

SEQ ID NO: 2859 - DNA, 372 bp, Bacillus licheniformis ATCC 14580
  CDS (1)..(372): transl_table=11
atggtcatgctttatgaaacaaaaataaacagaatcggagctcaagcagcggcgttttcagatgaaaagatgctcatattatttggtgaaggtgctccggatgaattgaaagattattgtttatcaattgatataaagcctgtagaaggcgacttcaatgaaggcgatgagctcatactgggcggcgagacctacaaaattacagccgttggcggagccgttcgtcaaaacttggcgaatctcgggcatataacgctaaaatttgacggatcagtttcagccgaactgccgggaacactgtaccttgaacgaaaagaacaactgccggaggtttcagcaggagactgtattcaagttaaaagattctcataa

SEQ ID NO: 2860 - protein, 123 aa, Bacillus licheniformis ATCC 14580
MVMLYETKINRIGAQAAAFSDEKMLILFGEGAPDELKDYCLSIDIKPVEGDFNEGDELILGGETYKITAVGGAVRQNLANLGHITLKFDGSVSAELPGTLYLERKEQLPEVSAGDCIQVKRFS

SEQ ID NO: 2861 - DNA, 357 bp, Bacillus clausii KSM-K16
  CDS (1)..(357): transl_table=11
atgatttacaaaacaactgtgacaaagttaggcgctcttgctagcgattttttggcagagaatatattgatcttgtttaaaaacaatgcgccagaagagttagcggagtattgtgtccttcatcaggaaaaccaattaatagacaacatccaaccaggcgatacggcgattttagcaggacaagcgtttgtggttacagccgttggcagtgcggttgaaaaaaatttacgctccctcgggcatataacgataaaagccgatggggcgaaggaagcggaattgccagggactttgtcactcgaagcaaagtcgctgccactactaaaagaaggagacaccattacaatttctagataa

SEQ ID NO: 2862 - protein, 118 aa, Bacillus clausii KSM-K16
MIYKTTVTKLGALASDFLAENILILFKNNAPEELAEYCVLHQENQLIDNIQPGDTAILAGQAFVVTAVGSAVEKNLRSLGHITIKADGAKEAELPGTLSLEAKSLPLLKEGDTITISR

SEQ ID NO: 2863 - DNA, 357 bp, Bacillus clausii KSM-K16
  CDS (1)..(357): transl_table=11
atgtatcaaacaatcgtaaaagaaattggacagatggccccctcttttgcagacgacaaaatcgtcattctttttgggatggaagcgccagcagaacttaaggaaatttcattcctccaccaagtagacggggaatttgaagacaaccccattaaagaaggcggtacactcgttattgatgaacaggaatttgtaatcgaaaaagtcggttcggctgcaaatgaaaatttacggacattgggccatatttcgatttactttacagaaccgcaagaagaagtattgcctggtgccgtgtttgccagtccgcatacatttcctgttatagaaaagggtagcaaaatcacatttaagtag

SEQ ID NO: 2864 - protein, 118 aa, Bacillus clausii KSM-K16
MYQTIVKEIGQMAPSFADDKIVILFGMEAPAELKEISFLHQVDGEFEDNPIKEGGTLVIDEQEFVIEKVGSAANENLRTLGHISIYFTEPQEEVLPGAVFASPHTFPVIEKGSKITFK

SEQ ID NO: 2865 - DNA, 366 bp, Haemophilus somnus 129PT
  CDS (1)..(366): transl_table=11
atgacgattatctataaaacaacgtttactaaaatcggcaattttgctcatgatgcactaaacaacaatatgttaatcactttcaaacaaaatgcacctgccgatttagaagattactgtttcttacacaatccatctgaattaagcgacgctttacaagttggcgatattgccgaatttgatggtgttgaatatccgattaccgccattggcagtgtagcgtcggataatttatccgcactcggacacattactttccgttttgatggggcgaccgaagcggaatttccgggaagtgttcatgttgttggtgttccaccaaaaacattaatggaaagttccatcttagttattaaacgtgattaa

SEQ ID NO: 2866 - protein, 121 aa, Haemophilus somnus 129PT
MTIIYKTTFTKIGNFAHDALNNNMLITFKQNAPADLEDYCFLHNPSELSDALQVGDIAEFDGVEYPITAIGSVASDNLSALGHITFRFDGATEAEFPGSVHVVGVPPKTLMESSILVIKRD

SEQ ID NO: 2867 - DNA, 366 bp, Haemophilus somnus 2336
  CDS (1)..(366): transl_table=11
atgacgattatctataaaacaacgtttactaaaatcggcaattttgctcatgatgcactaaacgacaatatgttaatcactttcaaacaaaatgcacctgccgatttagaagattactgtttcttacacaatccatctgaattaagcgacgctttacaagttggcgatattgccgaatttgatggtgttgaatatccgattaccgccattggcagtgtagcgtcggataatttatccgcactcggacacattactttccgttttgatggggcgaccgaagcggaatttccgggaagtgttcatgttgttggtgttccaccaaaaacattaatggaaagttccatcttagttattaaacgtgattaa

SEQ ID NO: 2868 - protein, 121 aa, Haemophilus somnus 2336
MTIIYKTTFTKIGNFAHDALNDNMLITFKQNAPADLEDYCFLHNPSELSDALQVGDIAEFDGVEYPITAIGSVASDNLSALGHITFRFDGATEAEFPGSVHVVGVPPKTLMESSILVIKRD

SEQ ID NO: 2869 - DNA, 372 bp, Erwinia amylovora
  CDS (1)..(372): transl_table=11
atgacgattgtgtatgaatctacttttgttgctggtcggtacatcggcctgcgaatcattggccagatgactttctccatcacctttggtgaaggcgcaccagaagatatcgctgaatattgctttatccaccgtaacgacattaatcaaggtggcttattaggcgctggctcgatgttgaccattggcgaacagcattatccggtgaccgcagtcggcgaggttgcaagggaaaacttgcgcgacctgggtcatatcaccgttcgttttgatggggcaaatcacgccgagtttcccggttcggttcacgtaaccggacagcccccgttggtgattgaacccggccaaaaatttcgtgttgtcagtgaataa

SEQ ID NO: 2870 - protein, 123 aa, Erwinia amylovora
MTIVYESTFVAGRYIGLRIIGQMTFSITFGEGAPEDIAEYCFIHRNDINQGGLLGAGSMLTIGEQHYPVTAVGEVARENLRDLGHITVRFDGANHAEFPGSVHVTGQPPLVIEPGQKFRVVSE

SEQ ID NO: 2871 - DNA, 357 bp, Clostridium difficile
  CDS (1)..(357): transl_table=11
atgaaatatgaagttaagataagtgggataggcagtttagttaaagagttaatggatgaaagcaattgtcttattatatatgatgaaaccattaatgatgacgacttaaaggatatatctgtaattcattcaatagcaacgttaaaaagtgatgttgaaataggagatacacttactatagggaatagagattattgtatagtttcagttggtgatattgctcagaagactcttagagaaattgggcattgtacaatcaaatttgatggaaaatgtgaagtaaatttaccaggagaaatacatgtggaaataggaaatccagatataactattggagatttaataactatttcttaa

SEQ ID NO: 2872 - protein, 118 aa, Clostridium difficile
MKYEVKISGIGSLVKELMDESNCLIIYDETINDDDLKDISVIHSIATLKSDVEIGDTLTIGNRDYCIVSVGDIAQKTLREIGHCTIKFDGKCEVNLPGEIHVEIGNPDITIGDLITIS

SEQ ID NO: 2873 - DNA, 366 bp, Clostridium difficile
  CDS (1)..(366): transl_table=11
atggaattaatatacagtactcaaataaataaaataggagataatgcaaatgaatttttacaacataatatgtttgtaactttcaaagataatgctcctcaagagttagaaaattactgttatatacattctgaaaataatttagtaaaagaaatacttacggatgatgtgctatcaataaataatgttgattacaaaattacttctgttggtgagttagtaaaccaaaatctttcagaattaggtcatataacatttaagtttacaggtgaaaaagatggagcaattggaggaaccttatatcttgaagaaaaagaaatagcacctattggcgtaggtactatactaaaaataattagaaaataa

SEQ ID NO: 2874 - protein, 121 aa, Clostridium difficile
MELIYSTQINKIGDNANEFLQHNMFVTFKDNAPQELENYCYIHSENNLVKEILTDDVLSINNVDYKITSVGELVNQNLSELGHITFKFTGEKDGAIGGTLYLEEKEIAPIGVGTILKIIRK

SEQ ID NO: 2875 - DNA, 23 bp, Artificial sequence
  primer
atgaccgttatttatcagaccac

SEQ ID NO: 2876 - DNA, 26 bp, Artificial sequence
  primer
ttactccttaacagattcaaacttca

SEQ ID NO: 2877 - protein, 100 aa, Artificial sequence
  consensus sequence
  Variant (2)..(8): Xaa in position 2 to 8 is any amino acid
  Variant (10)..(23): Xaa in position 10 to 23 is any amino acid
  Variant (24)..(24): Xaa in position 24 is any or no amino acid
  Variant (26)..(29): Xaa in position 26 to 29 is any amino acid
  Variant (31)..(51): Xaa in position 31 to 51 is any amino acid
  Variant (52)..(56): Xaa in position 52 to 56 is any or no amino acid
  Variant (58)..(72): Xaa in position 58 to 72 is any amino acid
  Variant (74)..(78): Xaa in position 74 to 78 is any amino acid
  Variant (81)..(82): Xaa in position 81 to 82 is any amino acid
  Variant (86)..(86): Xaa in position 86 is any amino acid
  Variant (88)..(89): Xaa in position 88 to 89 is any amino acid
  Variant (91)..(91): Xaa in position 91 is any amino acid
  Variant (93)..(99): Xaa in position 93 to 99 is any amino acid
YXXXXXXXGXXXXXXXXXXXXXXXFXXXXPXXXXXXXXXXXXXXXXXXXXXXXXXXGXXXXXXXXXXXXXXXGXXXXXNLXXLGHXTXXFXGXXXXXXXG

SEQ ID NO: 2878 - protein, 49 aa, Artificial sequence
  protein pattern
  Variant (2)..(5): Xaa in position 2 to 5 is any amino acid
  Variant (6)..(6): Xaa in position 6 is Phe, Ile, Leu or Val
  Variant (7)..(7): Xaa in position 7 is Ala, Asp, Gly or Asn
  Variant (8)..(8): Xaa in position 8 is Glu, Gly, Asn or Gln
  Variant (9)..(12): Xaa in position 9 to 12 is any amino acid
  Variant (13)..(13): Xaa in position 13 is Ile or Val
  Variant (14)..(15): Xaa in position 14 to 15 is any amino acid
  Variant (16)..(16): Xaa in position 16 is Ile or Val
  Variant (18)..(19): Xaa in position 18 to 19 is any amino acid
  Variant (20)..(20): Xaa in position 20 is Ala or Val
  Variant (21)..(21): Xaa in position 21 is Glu, Asn, Gln, Arg or Ser
  Variant (22)..(22): Xaa in position 22 is any amino acid
  Variant (23)..(23): Xaa in position 23 is Ala, Asn or Thr
  Variant (24)..(24): Xaa in position 24 is Phe or Leu
  Variant (25)..(26): Xaa in position 25 to 26 is any amino acid
  Variant (27)..(27): Xaa in position 27 is Ile or Leu
  Variant (30)..(30): Xaa in position 30 is any or no amino acid
  Variant (32)..(35): Xaa in position 32 to 35 is any amino acid
  Variant (36)..(36): Xaa in position 36 is any or no amino acid
  Variant (38)..(43): Xaa in position 38 to 43 is any amino acid
  Variant (44)..(44): Xaa in position 44 is Glu, Pro or Thr
  Variant (46)..(46): Xaa in position 46 is Ala, Glu, Ser or Thr
  Variant (47)..(47): Xaa in position 47 is Ile, Leu or Val
  Variant (48)..(48): Xaa in position 48 is any amino acid
  Variant (49)..(49): Xaa in position 49 is Ile, Leu or Val
GXXXXXXXXXXXXXXXGXXXXXXXXXXGHXTXXXXXGXXXXXXXGXXXX

SEQ ID NO: 2879 - DNA, 1095 bp, Escherichia coli
  CDS (1)..(1095): transl_table=11
atggcacaacagactcctttgtacgaacaacacacgctttgcggcgctcgcatggtggatttccacggctggatgatgccgctgcattacggttcgcaaatcgacgaacatcatgcggtacgtaccgatgccggaatgtttgatgtgtcacatatgaccatcgtcgatcttcgcggcagccgcacccgggagtttctgcgttatctgctggcgaacgatgtggcgaagctcaccaaaagcggcaaagccctttactcggggatgttgaatgcctctggcggtgtgatagatgacctcatcgtctactactttactgaagatttcttccgcctcgttgttaactccgccacccgcgaaaaagacctctcctggattacccaacacgctgaacctttcggcatcgaaattaccgttcgtgatgacctttccatgattgccgtgcaagggccgaatgcgcaggcaaaagctgccacactgtttaatgacgcccagcgtcaggcggtggaagggatgaaaccgttctttggcgtgcaggcgggcgatctgtttattgccaccactggttataccggtgaagcgggctatgaaattgcgctgcccaatgaaaaagcggccgatttctggcgtgcgctggtggaagcgggtgttaagccatgtggcttgggcgcgcgtgacacgctgcgtctggaagcgggcatgaatctttatggtcaggagatggacgaaaccatctctcctttagccgccaacatgggctggaccatcgcctgggaaccggcagatcgtgactttatcggtcgtgaagccctggaagtgcagcgtgagcatggtacagaaaaactggttggtctggtgatgaccgaaaaaggcgtgctgcgtaatgaactgccggtacgctttaccgatgcgcagggcaaccagcatgaaggcattatcaccagcggtactttctccccgacgctgggttacagcattgcgctggcgcgcgtgccggaaggtattggcgaaacggcgattgtgcaaattcgcaaccgtgaaatgccggttaaagtgacaaaacctgtttttgtgcgtaacggcaaagccgtcgcgtaa

SEQ ID NO: 2880 - protein, 364 aa, Escherichia coli
MAQQTPLYEQHTLCGARMVDFHGWMMPLHYGSQIDEHHAVRTDAGMFDVSHMTIVDLRGSRTREFLRYLLANDVAKLTKSGKALYSGMLNASGGVIDDLIVYYFTEDFFRLVVNSATREKDLSWITQHAEPFGIEITVRDDLSMIAVQGPNAQAKAATLFNDAQRQAVEGMKPFFGVQAGDLFIATTGYTGEAGYEIALPNEKAADFWRALVEAGVKPCGLGARDTLRLEAGMNLYGQEMDETISPLAANMGWTIAWEPADRDFIGREALEVQREHGTEKLVGLVMTEKGVLRNELPVRFTDAQGNQHEGIITSGTFSPTLGYSIALARVPEGIGETAIVQIRNREMPVKVTKPVFVRNGKAVA

SEQ ID NO: 2881 - DNA, 1224 bp, Medicago truncatula
  CDS (1)..(1224)
atgagagggggcttgtggcaacttggccaatcaatcactcgccgtctcgcccaaggagataagaaggctgttgctaggagatgtttcgctacggattctgacctgaaaaagactgttctttatgacttccatgttgctcatggtggtaagatggttccatttgctggatggagcatgcctattcagtacaaggactcaatcatggattcaaccttaaactgtagacagaatggtagtctttttgatgttgcccatatgtgtggtttaagcctcaagggaaaagatgctgtttcttttcttgagaaactagtcattgccgatgttgctgcacttgcacctggaactgggacattgactgttttcactaatgaaaagggtggggctatcgatgattccgtcattactaaggtcacggatcatcacatttacttggttgtcaatgctggttgcagagataaagatttggctcatattgaggagcatatgaaggcattcaaggccaaaggtggtgatgtgtcgtggcacattcatgacgagagaactctacttgctctacagggtccccttgctgcccctgttcttcaacatctgacaaaagatgatttgagcaagctatactttggggagttccgtgtgttggacatcaatggctcgcagtgctttctcacacgaacagggtacaccggagaagatggatttgagatctcagttccttcagagcatggagtagatcttgccaaggcaatacttgaaaaatctgaagggaaaataagactgacaggacttggtgctagagatagtttacgccttgaagctggattgtgcctctatggcaatgacatggaacagcacattacaccaattgaggcaggactgacatgggctataggtaagaggagaagagcagaaggtggttttctaggagctgatgttatcttgaaacagctcgcagatggtccttccataaggcgtgtcggtttcatttcatctggtccacctgctagaagccacagtgagattcaagatgaaggaggcaacaacattggtgaagtcactagtggtggattcagtccttgtctcaagaagaacatagctatgggatatgtaaaatctggattgcacaaagcaggtaccaaagtaaagataattattcgaggaaaagcgaatgaaggagttgtcacaaaaatgccattcgtacccactaaatactacaagcctacataa

SEQ ID NO: 2882 - protein, 407 aa, Medicago truncatula
MRGGLWQLGQSITRRLAQGDKKAVARRCFATDSDLKKTVLYDFHVAHGGKMVPFAGWSMPIQYKDSIMDSTLNCRQNGSLFDVAHMCGLSLKGKDAVSFLEKLVIADVAALAPGTGTLTVFTNEKGGAIDDSVITKVTDHHIYLVVNAGCRDKDLAHIEEHMKAFKAKGGDVSWHIHDERTLLALQGPLAAPVLQHLTKDDLSKLYFGEFRVLDINGSQCFLTRTGYTGEDGFEISVPSEHGVDLAKAILEKSEGKIRLTGLGARDSLRLEAGLCLYGNDMEQHITPIEAGLTWAIGKRRRAEGGFLGADVILKQLADGPSIRRVGFISSGPPARSHSEIQDEGGNNIGEVTSGGFSPCLKKNIAMGYVKSGLHKAGTKVKIIIRGKANEGVVTKMPFVPTKYYKPT

SEQ ID NO: 2883 - DNA, 1107 bp, Neisseria meningitidis Z2491
  CDS (1)..(1107): transl_table=11
ttgagaatgattactctgaaaaccaccccatttcatcaagcccatcaagatgcaggcgcgaagctggtagattttgccggctgggagctgcccatccattatggttcgcaaatcgccgaacacgaagccgtgcgcaccgacgcaggtatgtttgacgtatcccatatgcttgttaccgacgtagcaggcgcaaatgccaaagcctttttccgcaaattgattgccaacgatgtcgccaagctcgcttttgtcggcaaagccctttattccgctttgctcaacgacaacggcggcgtgattgacgacttgatcgtttaccgcaccaatgaagccgaaacccaataccgcatcgtgtccaacggcgcgactcgcgaaaaagatacggcacaattccacaaagtcggacaagagttcggtgtttccttcaatccgcgctacgacctcggcatgctcgccgtacaaggccctaaagccattgaaaaactcctgaccgtcaaacccgaatgggcagatgtcgtccataacctcaaaccgttccaaggcgcggatttgggcaacgactggtttgtcgcccgcaccggctacaccggcgaagacggcgtcgaagtcatcctgcccggcaccgaagccgtcgcattcttcaaagccctgcaagcagcaggcgtacaaccttgcggtctcggcgcgcgcgacaccctgcgcatggaagccggcatgaacctctacggcaacgatatggacgacgataccagcccgctcgaagcaggcatgggttggaccgttgatttgaaagacgaaagccgcgattttgtcggcaaagctgccttgttggcattgaaagaaaaaggcgttgccgtcaaacaggtcggtttgctgctcggcaaaggcggcatcctgcgcgcgcatatggaagtgttgaccgacaaaggcaaaggcgaaaccaccagcggcgtattctctccaagtctgaaacaatccatcgccatcgcccgcgtaccgaaagattttgacggcgataccgccaaagtgctgattcgcggcaaggaagcggacgtgcgcgtactgaagctgccgttcgtccgcaacggtcaaaaacagtttgattaa

SEQ ID NO: 2884 - protein, 368 aa, Neisseria meningitidis Z2491
MRMITLKTTPFHQAHQDAGAKLVDFAGWELPIHYGSQIAEHEAVRTDAGMFDVSHMLVTDVAGANAKAFFRKLIANDVAKLAFVGKALYSALLNDNGGVIDDLIVYRTNEAETQYRIVSNGATREKDTAQFHKVGQEFGVSFNPRYDLGMLAVQGPKAIEKLLTVKPEWADVVHNLKPFQGADLGNDWFVARTGYTGEDGVEVILPGTEAVAFFKALQAAGVQPCGLGARDTLRMEAGMNLYGNDMDDDTSPLEAGMGWTVDLKDESRDFVGKAALLALKEKGVAVKQVGLLLGKGGILRAHMEVLTDKGKGETTSGVFSPSLKQSIAIARVPKDFDGDTAKVLIRGKEADVRVLKLPFVRNGQKQFD

SEQ ID NO: 2885 - DNA, 1158 bp, Oceanobacillus iheyensis HTE831
  CDS (1)..(1158): transl_table=11
atgcgcttttctttcatcaaactaaaattaggagtggatggaatgagtgaacaaaaacgtacaccaattttcacagagtatgcatctcatggtgcgaaaacgattgattttggaggatgggatttacctgtacaattctctagtattaaacatgaacatgaagtaacaagaaccaaagcaggtctttttgacgtatctcatatgggagaaatttcagtgaaagggccaaaaagtgaatcttttttgcaatacgtattaacaaatgacatttctaaattggaaccaggtaaagcacaatatacgattatgtgttatgaagatggtggtactgtagatgatttaattgtttacaaattagacgatgaagattatttgttagtagtaaatgctgcaaacacggaaaaagatgcaaattggataaaacagaaaaatacgtattcaaacgatgagattgttattgaagatgtatctaatcagtatgttcagcttgcaatacaaggacctaaagctgtagagattttacagaaatgtacagatgaaaatgtacaagaaattaaattttttagatttaagaacaatgtagctttaaaaggaatagaagctaaggcacttatttcacgcactggatataccggtgaagatggtttcgaaatatatatcgacgcttcctcaggagtagcattgtggaaattgcttttagaaaaaggagaagcaaatggacttgagccaataggattaggggctcgagatactttacgatttgaagctaatttagcattatatggtcaggaattatcaaaagatatttccccaatagaagctggattaggcttcgcagtaaaagttaataaaggaccggattttatcgggaaagaagtattaaagaaccaagtggaaaatgggactgatcgtaagttagtaggaattgaaatgattgataaaggtattccacgtcatgaatatgaggtattaaaagataataaagaaattggatttataacttctggaacccaatctccgactctaaacaagaatgttgggttagctttaattaatatttcgtatacagaaataggcactgaagttgatgtgaaagttcgaaaacgtatattgaaggctaaaatagttccgacaccgttttataaacggggaagataa

SEQ ID NO: 2886 - protein, 385 aa, Oceanobacillus iheyensis HTE831
MRFSFIKLKLGVDGMSEQKRTPIFTEYASHGAKTIDFGGWDLPVQFSSIKHEHEVTRTKAGLFDVSHMGEISVKGPKSESFLQYVLTNDISKLEPGKAQYTIMCYEDGGTVDDLIVYKLDDEDYLLVVNAANTEKDANWIKQKNTYSNDEIVIEDVSNQYVQLAIQGPKAVEILQKCTDENVQEIKFFRFKNNVALKGIEAKALISRTGYTGEDGFEIYIDASSGVALWKLLLEKGEANGLEPIGLGARDTLRFEANLALYGQELSKDISPIEAGLGFAVKVNKGPDFIGKEVLKNQVENGTDRKLVGIEMIDKGIPRHEYEVLKDNKEIGFITSGTQSPTLNKNVGLALINISYTEIGTEVDVKVRKRILKAKIVPTPFYKRGR

SEQ ID NO: 2887 - DNA, 1104 bp, Gloeobacter violaceus PCC 7421
  CDS (1)..(1104): transl_table=11
atggtggcccgtagtctgggtttgatgagcgacctcaagcgtacccctctttgcgcgcagcacctgcaacttggtgcgcgcctcgttcccttcggcggctgggagatgcccctgcagtacagcaccctcacccgcgaacaccgggccgtgcgcaccgctgtgggtcttttcgacatctcccacatgggcaagtacaccctctcggggccggacgtgctggcccagatccagaggctggtgccctcggatctggctcgattgcaacccgggcaagcccagtacaccgtcctgctcaatgagcaagccgggatcatcgacgatctcattttttactgccgcagcccagagcattgggtggtgatcgtcaacggcgccaccaacgacaaagaccgccgctggctcgcagaacacctgcagggcgttcacttcgacgacctgaccggcacccacacgctgctggcgctgcagggaccggcggcggtcgagacgctgcaaccgctggtggacatagaccttgcccggttgggccgctttgagcacgcccaggtctcgctggcgggcaaaccggcttttctggccaggaccggctataccggcgaggacggttttgagatcatgagtctcgagcccgaaggcatcgcgctgtggcaatccctcaccgcagccggtgtgccgccctgcggcctcggtgcccgcgataccttgcgcctcgaggcggcgatgcacctgtacggccaggatatggacgaatcgaccacgccgctcgaggcgtccctgggttgggtgatcgattgggacaagcccgattacttcggccgggagattttgctggcccaaaaggcccagggcaccgagcggcggctggtcgggctcaccgtcgaaggccggcagattgcccgccatggctacggcctttttgacggtgagcagcaggtgggggttgtcaccagcggcaccctcaccccgacggtcgaccggcccattgcgcttgcctacgtgggcaaaccttttgcccccatcggttctaggctcgaagtcgacattcgcggccgccgggccatggccaccgtcgtcaagcgtcccttctaccgccgcgcgctgtaa

SEQ ID NO: 2888 - protein, 367 aa, Gloeobacter violaceus PCC 7421
MVARSLGLMSDLKRTPLCAQHLQLGARLVPFGGWEMPLQYSTLTREHRAVRTAVGLFDISHMGKYTLSGPDVLAQIQRLVPSDLARLQPGQAQYTVLLNEQAGIIDDLIFYCRSPEHWVVIVNGATNDKDRRWLAEHLQGVHFDDLTGTHTLLALQGPAAVETLQPLVDIDLARLGRFEHAQVSLAGKPAFLARTGYTGEDGFEIMSLEPEGIALWQSLTAAGVPPCGLGARDTLRLEAAMHLYGQDMDESTTPLEASLGWVIDWDKPDYFGREILLAQKAQGTERRLVGLTVEGRQIARHGYGLFDGEQQVGVVTSGTLTPTVDRPIALAYVGKPFAPIGSRLEVDIRGRRAMATVVKRPFYRRAL

SEQ ID NO: 2889 - DNA, 1095 bp, Bacillus licheniformis ATCC 14580
  CDS (1)..(1095): transl_table=11
atgcttaaacgtacgcctttatttgacctttataaggaatatggcgggaaaacgattgattttggcggctgggaactgccagtccaattttcttctattaaagaggagcacgaagccgtcaggacgaaagcggggctttttgacgtctcacacatgggagaggtcgaaatcacaggaacggacagccttccgttcttgcaaaagctgttgacaaacgatgtttcgacgctgaaagaaggcggcgcccagtatacggctatgtgctatgaagacggcggaacgatcgacgatctcctcgtctataaaaaagcggccaatgtctatatgctcgtcattaacgcagccaatatcgacaaggacgtcgattggatgaacaagcatataaagggtgacgtgtcggttcgaaacgtatctgacgagattgcgctccttgcccttcaagggccgaaggccgaagcaattttaaaacaggtcgcagatcatgaccttgcagaattaaagccgtttatgttccgggatgatgcagcggttggcagcgtgcaggcgcttgtgtccagaacgggatacacgggagaggacggctttgagatttactgccggaatgaagatgcagcctgcatttggaagctgctccttgaaacgggcaaggattcgggattggtgccgtgcggcctcggggctcgggatacgctgaggtttgaagcgaagctgccgctttacggacaggagctctcaaaagacattacgccgatcgaagccggcatcggatttgccgtcaaaacgaacaaagcctcggatttcatcggaaaagccgtcctggcaagccaaaaggaacatggagcggacagaaagctggttggccttgaaatgatcgataaaggcattccaagacacggatacgccgtctattatcaaggcgaacaagcaggcgaggtgacaaccggcacacagtcgccgactttaaagaaaaacgtcggcctcgcattgctgaaaaaagaagcctgcgccctcgacaccgtagttgaagtggagatcagaaataaacgtttgaaagccaaaatcgtgaaaaccccattttacaaacggcagccgtaa

SEQ ID NO: 2890 - protein, 364 aa, Bacillus licheniformis ATCC 14580
MLKRTPLFDLYKEYGGKTIDFGGWELPVQFSSIKEEHEAVRTKAGLFDVSHMGEVEITGTDSLPFLQKLLTNDVSTLKEGGAQYTAMCYEDGGTIDDLLVYKKAANVYMLVINAANIDKDVDWMNKHIKGDVSVRNVSDEIALLALQGPKAEAILKQVADHDLAELKPFMFRDDAAVGSVQALVSRTGYTGEDGFEIYCRNEDAACIWKLLLETGKDSGLVPCGLGARDTLRFEAKLPLYGQELSKDITPIEAGIGFAVKTNKASDFIGKAVLASQKEHGADRKLVGLEMIDKGIPRHGYAVYYQGEQAGEVTTGTQSPTLKKNVGLALLKKEACALDTVVEVEIRNKRLKAKIVKTPFYKRQP

SEQ ID NO: 2891 - DNA, 1104 bp, Legionella pneumophila subsp. pneumophila str. Philadelphia 1
  CDS (1)..(1104): transl_table=11
gtgataaaaaaaggaaatgcaatgactgctaaaactcctcttcacactacgcacttagcatgtggtgccaaaatggtggatttccatggttgggatatgcctcttcattatggatctcagttaaacgaacatcatgctgtcagaaacgatgctggcatgtttgatgtctcacatatgaccatcgttgatattttaggcgccggtggccgtcaatttctgcgcaaactgctaaccaacgatgtcgatcaaattactcataatggaaaagccctatacagctgtatgtgtaatgaacacggcggaattatagatgacctgattgtatatcaacgcgcttccgataattaccgagtggtacttaattcggcaaccaggcaaaatgatgtggcctggattcgcgcaaaaagtgaaggatttgctgttggcttacaagaaaggcgcgaattatcaatgctcgctgtacaaggtccaaatgccatagcgaaaacattgagtattcttgcacccgcccatgtagatgccgtttcgactcttacctctttcgaatgcgttgatgtggatcactggttttttgctcgcaccggctatacgggggaagatggccttgaaatcattgtccctaatgaatttgttacccaactctggaatgatctcctgcatgctggagtaacgccatgtggattaggggccagagataccctgagattagaggcaggaatgcttctttacggccaggatatggatgaaacaacaaccccactggaatctggtttggcctggacagtaaagtgggagccggaagatagaggatttatcggaatgggcgctttggtttctcaaaagcaacaaggaattaaacgtaaaatggttggtttaaccttgttggacaaaggcattatgcgtcatggccaaaaggttattattgaaggctgccctgatggaattatcacaagcggcagctattctcctaccctgcagcaatctatagctttggcacgagttcccatggaaacaggggaacaagtacttgttgatatacgcggaaagttaatccctgcaaaagtagggaagcctcgctttatcaaacaaggaaaacctgtttaa

SEQ ID NO: 2892 - protein, 367 aa, Legionella pneumophila subsp. pneumophila str. Philadelphia 1
MIKKGNAMTAKTPLHTTHLACGAKMVDFHGWDMPLHYGSQLNEHHAVRNDAGMFDVSHMTIVDILGAGGRQFLRKLLTNDVDQITHNGKALYSCMCNEHGGIIDDLIVYQRASDNYRVVLNSATRQNDVAWIRAKSEGFAVGLQERRELSMLAVQGPNAIAKTLSILAPAHVDAVSTLTSFECVDVDHWFFARTGYTGEDGLEIIVPNEFVTQLWNDLLHAGVTPCGLGARDTLRLEAGMLLYGQDMDETTTPLESGLAWTVKWEPEDRGFIGMGALVSQKQQGIKRKMVGLTLLDKGIMRHGQKVIIEGCPDGIITSGSYSPTLQQSIALARVPMETGEQVLVDIRGKLIPAKVGKPRFIKQGKPV

SEQ ID NO: 2893 - DNA, 1083 bp, Azoarcus sp. EbN1
  CDS (1)..(1083): transl_table=11
gtggcaaaacatacccctcttcacgccgttcatgtcgccgccggcgcccgcatggtcgatttcgccggctgggacatgccggtgaattacggctcgcagatcgaggaacaccacgtcgtgcgccgcgacgcgggaatgttcgacgtctcgcacatgctcggcctcgacctcgaaggcccggacgcgacgacgtggctgcgcggcctgctcgcgaacgatgtggccaagctgcatgagccgggcaaggcgctgtacagctgcatgctcaatcccgacggcggcgtcatcgacgacctgatcgtctattacttctccccgacgtcgtaccgcatcgtcgtcaatgccggcactgccgacaaggacgtcgcctggatgcgccagcacatcgcggcaagcggcgcgaacgtcacgctcgagagccgccgcgacctggcgatgatcgcggtgcaggggccgaacgcacgcgacaagacctgggcggcgctgcccgacacgcacgccgcgagcgaaagcctgaagccgttttcggccgcccgggtcggcgacctgctgatcgcgcgcaccggctataccggcgaggacggtttcgaaatcacgctgccggccgcgcgcgccgaagcagtctggaacgcgcttgccgcggcgggcgtcaagccctgcgggctcggcgcacgcgacacgttgcgcctcgaagccggcatgaacctgtacgggcaggacatggacgagacggtctcgccgctcgacgccggcctcgcctggactgtcgacctgaaagatgaatcgcgcgatttcgtcggtcgcgccgcgctcgtcgcgaaccctgcccgccgcaaggtgctcggcctgatcctcgaggacaaaggcgtgttgcgcgcgcacatgagggtgtttaccgccgccggtgaaggcgaaaccaccagcggcagcttctcgccgtcgctcgaaaaatcgatcgccttcgcgcgcctgccgctcggcgtcgagccgggcgaagtggtcgaagtcgatatccgcggtcgtcgcctgaaagcgcgcacggtcaagctgccgttcgtgcgcaacggcaaggcgctggtctga

SEQ ID NO: 2894 - protein, 360 aa, Azoarcus sp. EbN1
MAKHTPLHAVHVAAGARMVDFAGWDMPVNYGSQIEEHHVVRRDAGMFDVSHMLGLDLEGPDATTWLRGLLANDVAKLHEPGKALYSCMLNPDGGVIDDLIVYYFSPTSYRIVVNAGTADKDVAWMRQHIAASGANVTLESRRDLAMIAVQGPNARDKTWAALPDTHAASESLKPFSAARVGDLLIARTGYTGEDGFEITLPAARAEAVWNALAAAGVKPCGLGARDTLRLEAGMNLYGQDMDETVSPLDAGLAWTVDLKDESRDFVGRAALVANPARRKVLGLILEDKGVLRAHMRVFTAAGEGETTSGSFSPSLEKSIAFARLPLGVEPGEVVEVDIRGRRLKARTVKLPFVRNGKALV

SEQ ID NO: 2895 - DNA, 1101 bp, Neisseria gonorrhoeae FA 1090
  CDS (1)..(1101): transl_table=11
atgactgctctgaaaaccaccccgtttcatcaagcccatcaagatgcaggcgcgaagccggtagattttgccggctgggaactgcccatccattatggttcgcaaatcgccgaacacgaagccgtgcgcaccgacgccggtatgtttgacgtatcccatatgctcgttaccgacgtcgtcggagcgaacgccaaagcctttttccgcaaattgattgccaacgacgttgccaaactcgcttttgtcggcaaagccctttattccgctttgctcaacgacaacggcggcgtgattgacgacttgatcgtttaccgcaccaacgaggccgaaacccaataccgcatcgtgtccaacggtgcgacccgtgaaaaagacacggcacaattccacaaagtcggacaagagttcggcgttgccttcaatccgcgctacgacctcggtatgcttgccgtacaaggtcctaaagccattgaaaaactcctgaccgtcaaacccgaatgggcggatgtgattcacggcctcaaaccgttccaaggcgcggatttgggcaacgactggtttgtcgcccgtacaggctacaccggcgaagacggcgtcgaagtgattctgccggataccgaagccgtcgcattcttcaaagccctgcaaacagcaggcgtacagccttgcggcctcggcgcgcgcgacaccctgcgcatggaagccggtatgaacctctacggcaacgatatggacgacgacaccagcccgctcgaagcaggcatgggccggacggttgatttgaaagacgaaagccgcgattttgtcggtaaagccgccttgttggcattgaaagaaaaaggcgttgccgtcaaacaagtcggtttgctgctcgaaaaaggcggcatcctgcgcgcgcatatggaagtgttgaccgacaaaggaaaaggcgaaaccaccagcggcgtattctcgcccagcctgaaacaatctatcgccatcgcccgcgtaccgaaagattttgacggcgataccgccaaagtcctgattcgcggcaaagaagcggacgtgcgcgtactgaagctgccgttcgtccgcagcggtcaaaaacagtttgattaa

SEQ ID NO: 2896 - protein, 366 aa, Neisseria gonorrhoeae FA 1090
MTALKTTPFHQAHQDAGAKPVDFAGWELPIHYGSQIAEHEAVRTDAGMFDVSHMLVTDVVGANAKAFFRKLIANDVAKLAFVGKALYSALLNDNGGVIDDLIVYRTNEAETQYRIVSNGATREKDTAQFHKVGQEFGVAFNPRYDLGMLAVQGPKAIEKLLTVKPEWADVIHGLKPFQGADLGNDWFVARTGYTGEDGVEVILPDTEAVAFFKALQTAGVQPCGLGARDTLRMEAGMNLYGNDMDDDTSPLEAGMGRTVDLKDESRDFVGKAALLALKEKGVAVKQVGLLLEKGGILRAHMEVLTDKGKGETTSGVFSPSLKQSIAIARVPKDFDGDTAKVLIRGKEADVRVLKLPFVRSGQKQFD

SEQ ID NO: 2897 - DNA, 1083 bp, Pseudomonas syringae pv. syringae B728a
  CDS (1)..(1083): transl_table=11
atgggacagcgtacccccctgttcgacctgcacctcgcccttggcgcgaaaatggtcgattttggtggctgggacatgccgttgcattacggatcgcaggtcgaggaacaccatcaggtgcgtcgcgactgtggggtcttcgatgtctctcacatgaacgtgatcgatgtgctcggccgtcaggcccgagcctggctgcgtcgtctgctggccaatgatgtagacaagctcaaaacccccggtcgtgccttgtacagcgccatgctggacgagagcggcggggtgatcgatgacatgatcgtctacctcacgcctgaaggttatcggctggtcgtcaacgcggcgaccggcgtcaaggatcttgcctggatgcaggctcaactgggtgacttcgacgtgcaactggtcgagcgcagtgaaatggccatgctcgccattcaaggccccaaggccagagcccgtattgccgagctggtttcaagcacccgcgccgaactgattcaccagctcaagccgttcgaagggctcgatgatggcgactggtttatcgcgcgcaccggctacaccggcgaggacggcctggagatcatgctgcctgccgaagaggcccaaagctttttcaatgaattggttggcgcgggtatttccccgatcggcctgggcgctcgcgacacgctgcgccttgaggccggcatgaacctgtatggccaggacatcggcgagcatgtctcgcccttggcctcgaatatggcctggagcatcgcctgggagcctgccgaccgtgattttatcggtcgcaaggcgctggagagcgaacgggctgaaggaactgccttcaagctcgtcggattggtgctcgaagagcgcggtgtcttgcgggcgcatcaggtggtacgtgttgcagaaattggcgaaggagagatcaccagtggtagtttctctcctacgttgagcaaatccattgcactggctcgcgttccgatggcgaccgctgaccgggccgaggtggaaatccgcggcaaatggtacccggtgcgggtggtgcagcctgcgttcgtgcgccatggcaaaaccttgatctaa

SEQ ID NO: 2898 - protein, 360 aa, Pseudomonas syringae pv. syringae B728a
MGQRTPLFDLHLALGAKMVDFGGWDMPLHYGSQVEEHHQVRRDCGVFDVSHMNVIDVLGRQARAWLRRLLANDVDKLKTPGRALYSAMLDESGGVIDDMIVYLTPEGYRLVVNAATGVKDLAWMQAQLGDFDVQLVERSEMAMLAIQGPKARARIAELVSSTRAELIHQLKPFEGLDDGDWFIARTGYTGEDGLEIMLPAEEAQSFFNELVGAGISPIGLGARDTLRLEAGMNLYGQDIGEHVSPLASNMAWSIAWEPADRDFIGRKALESERAEGTAFKLVGLVLEERGVLRAHQVVRVAEIGEGEITSGSFSPTLSKSIALARVPMATADRAEVEIRGKWYPVRVVQPAFVRHGKTLI

SEQ ID NO: 2899 - DNA, 1083 bp, Pseudomonas fluorescens Pf-5
  CDS (1)..(1083): transl_table=11
atgggacagcgtacgcctctgtatgacctgcatctcgccctcggcgcgaaaatggtcgattttggcggttgggatatgcccttgcattacggctcgcaggtcgaggagcaccatcaggtgcgacgtgattgcggtgtgttcgatgtatcccacatgaccgtgatcgatgtcagcggtacccaggccaaggcctggctccagcggttgctggccaatgatgtcgaacgcctgcacaaccccggccaggctctgtacagcaccatgctcaatgagcggggcggcatcgttgacgacatgatcgtctatcgcctcgaagacgcttatcgcctggcgctcaatgccgccacccgtgatcaggacctggcctggatgcaggcgcagctgggggatttccaggtgcagctgcacgagcgcccggaactggcgatgctggcgatccagggccctcaggcgcggcacaagattgccgagctggtgacccagtcccgcggcaccctgatccagcagctcaagccattcgaagccggctttgacggcgactggttcattgcccggaccggctacaccggcgaggacggtctggagatcgtcctccctgccgaccaggccccggccttcttcaacgacctggtgggggcggggatctcgcccatcggcctgggcgcccgggacaccctgcgcctggaggccggcatgaacctctatggccaggacatccatcaggatgtctcgcccctggcggcgaacatggcctggagcattgcctgggaaccggcgtcacgtcagttcatcggtcgcagtgccctggaagccgaacgggcggccggggtgaagcagaaactggtgggcctggtgctcgaagaacgtggggttttacgcgcgcatcaggtggttcgtatcgccgatgttggcgaaggtgagatcaccagtggtagtttctcccctacgctgagtaaatcgatcgcactggcgcgggtgccgatggccaccgccgaccgtgccgaagtggaaatccgcggcaagtggtacccggtccgggtggtcaaaccgaccttcgtgcgccacggcaaaaccctgatctaa

SEQ ID NO: 2900 - protein, 360 aa, Pseudomonas fluorescens Pf-5
MGQRTPLYDLHLALGAKMVDFGGWDMPLHYGSQVEEHHQVRRDCGVFDVSHMTVIDVSGTQAKAWLQRLLANDVERLHNPGQALYSTMLNERGGIVDDMIVYRLEDAYRLALNAATRDQDLAWMQAQLGDFQVQLHERPELAMLAIQGPQARHKIAELVTQSRGTLIQQLKPFEAGFDGDWFIARTGYTGEDGLEIVLPADQAPAFFNDLVGAGISPIGLGARDTLRLEAGMNLYGQDIHQDVSPLAANMAWSIAWEPASRQFIGRSALEAERAAGVKQKLVGLVLEERGVLRAHQVVRIADVGEGEITSGSFSPTLSKSIALARVPMATADRAEVEIRGKWYPVRVVKPTFVRHGKTLI

SEQ ID NO: 2901 - DNA, 1173 bp, Psychrobacter arcticus 273-4
  CDS (1)..(1173): transl_table=11
atgaccgatactcaaaataccaacagccaagcccctcaacgcacgcccctttatcagtctcatgtcgatagtgatggaaagctggtggacttttctggctgggagctgccgattcattatggctcacaaatcgaagagcatgaagcggtgcgtaccgacgccggtatgtttgatgtctctcacatggttattgtcgatattaaaggcttggatgccaaagcatggctacaaaaactattggctaatgacgtcgataaactcaaaacaattggtaaagctctttattcacctatgttgaatgaagaaggcggcattatcgatgacttaatcgtttatttatcgaatagcgaagaaactgaataccgtatcgtatcaaatgccggaacgcgtgataaagatatggcacagtttgaaaaagtagcgaaagactttgatgttaccttaactgagcgtacagaccttgctatgcttgccgttcaaggacctaatgccgttgaaaaattggcaaaaattaaacccagttgggctgataccttagcggcgctaaaaccttttgtcggtgctgacttaaccgatatcgaaggcaaagattggttcgtcgctcgtactggctacactggtgaagatggcgttgaagtcattatgcatggcgatgatgcgccggcgttctttgagcaattaaaagccaatggcataaagcctgccggtcttggcgctcgtgataccttgcgtatggaagcgggtatgaacctttatggtcatgacatgaatgaagatgtcagcccttatgaatgcaacatgggctggacattggcgctaaaagacgagcgtgactttgttggtcgcaaagctatggtcagcaaacgcaagcagtcaaaagatgacaataccgctatgaagcaagtgggcttattgctaaccacacgtggtgtgttacgtgaaggtatgagcgtcaccatcaatcaaggcaccgacaatgagcaaactggtatcattaccagtggcacattctcccctagtctaaaaaattcaatcgctatcgctcgtgttcctgacagcgtgtcagctgaagacaatgtacaagtagatttgcgcggtaaaggcaaattcgtcgatgtgcgcgtacttaagctaccttttgtccgcaatggcaagcagcagtttgactcatag

SEQ ID NO: 2902 - protein, 390 aa, Psychrobacter arcticus 273-4
MTDTQNTNSQAPQRTPLYQSHVDSDGKLVDFSGWELPIHYGSQIEEHEAVRTDAGMFDVSHMVIVDIKGLDAKAWLQKLLANDVDKLKTIGKALYSPMLNEEGGIIDDLIVYLSNSEETEYRIVSNAGTRDKDMAQFEKVAKDFDVTLTERTDLAMLAVQGPNAVEKLAKIKPSWADTLAALKPFVGADLTDIEGKDWFVARTGYTGEDGVEVIMHGDDAPAFFEQLKANGIKPAGLGARDTLRMEAGMNLYGHDMNEDVSPYECNMGWTLALKDERDFVGRKAMVSKRKQSKDDNTAMKQVGLLLTTRGVLREGMSVTINQGTDNEQTGIITSGTFSPSLKNSIAIARVPDSVSAEDNVQVDLRGKGKFVDVRVLKLPFVRNGKQQFDS

SEQ ID NO: 2903 - DNA, 1089 bp, Colwellia psychrerythraea 34H
  CDS (1)..(1089): transl_table=11
atgactaataaaacagtattacatgcaaagcatttagcttcaggcgcaaaaatggttgatttctttggctgggatatgcctatcaactacggctctcaaattgaagagcatcacgcagtaagaaccgatgccggcatgtttgatgtttcacacatgacgattgttgatgtgcaaggcgcagatgcaaaagctttcttacgtcgtttagtaattaacgatgttgctaagttagcaacaccgggtaaagcgttatacacaggtatgttaaatgaagaaggcggcgtgattgatgatttaatcatctacttcttctcagatactgattaccgtttagttgttaactcagcgacacgtgtaaaagatcttgcttggatgactaagcaatctacaggttttgatatcactatcactgaacgtcctgaatttggcatgcttgccgtacagggcccagaagcgaaagcaaaagtagctaaactattaacagcagagcaaatcgaagctgttgaaggcatgaaacctttctttggtgtgcaagtaggtgatttatttattgccactacaggttatactggtgaagacggttacgaaattatagtaccaaataattcagctgaagatttttggcaaaaactattagacgaaggtgtagttccttgtggtctaggtgctcgtgatacactacgtttagaagctggcatgaacctttacggtttagatatggatgaaactgtttcgccattagccgctaacatggcgtggacaatcagctgggaacctacagaccgtgactttatcggtcgtgacgtattaacagctcaaaaagcagcgggtgatcaacctaagcttgttggtttagtactagaagcaaaaggtgtgcttcgttcacatcaagttgttgtgactgaatttggcaatggtgaaattacttctggcacgttctcgccaacgttaggccacagtgttgctttagcacgtgttccacgtagcgtgaaagtaggcgatacaatcgaagttgaaatgcgtaaaaaactgattaaagttcaggttacaaaacctagtttcgttcgtaacggcaaaaaagttttctaa

SEQ ID NO: 2904 - protein, 362 aa, Colwellia psychrerythraea 34H
MTNKTVLHAKHLASGAKMVDFFGWDMPINYGSQIEEHHAVRTDAGMFDVSHMTIVDVQGADAKAFLRRLVINDVAKLATPGKALYTGMLNEEGGVIDDLIIYFFSDTDYRLVVNSATRVKDLAWMTKQSTGFDITITERPEFGMLAVQGPEAKAKVAKLLTAEQIEAVEGMKPFFGVQVGDLFIATTGYTGEDGYEIIVPNNSAEDFWQKLLDEGVVPCGLGARDTLRLEAGMNLYGLDMDETVSPLAANMAWTISWEPTDRDFIGRDVLTAQKAAGDQPKLVGLVLEAKGVLRSHQVVVTEFGNGEITSGTFSPTLGHSVALARVPRSVKVGDTIEVEMRKKLIKVQVTKPSFVRNGKKVF

SEQ ID NO: 2905 - DNA, 1083 bp, Pseudomonas syringae pv. phaseolicola 1448A
  CDS (1)..(1083): transl_table=11
atgggacagcgtacccccctgttcgacctgcacctcgcccttggcgcgaaaatggtcgattttggtggctgggacatgccgttgcattacggatcgcaggtcgaggaacaccatcaggtgcgtcgcgactgtggggtcttcgatgtctcacacatgaacgtgattgatgtggttggccgtcaagccagaacctggctgcgttacctgctggccaacgatgtggaaaaactgaagaccccaggtcgagccttgtacagcgccatgctggacgaaagaggcggggtcatcgatgacatgatcgtctacctcacgcccgaaggttatcggctggtggtcaatgccgcgaccggggtcaaggatcttgcctggatgcagtcgcagctgggcgacttcgatgtacaactgatcgcgcgcagcgaaatggcgatgctcgcgattcaagggccaaaggccagaacccgtatcgccgagctggtttcaagcgcccgcgccgaactgatccaccagctcaagccgtttgaaggtcttgatgatggcgactggttcatcgcgcgcaccggttataccggtgaagacggcctggaaatcatgctgcctgccgaagaggcccagcgttttttcaatgaactggtcggcgcgggtatctcaccgatcggtctgggcgctcgcgatacgttgcgtctggaagcaggcatgaacctgtatggtcaggacatcggcgagcatgtttcaccgctggcgtcgaatatggcctggagcattgcctgggaacctgccgaccgtgattttatcggtcgcgaggcgctggagagcgaacgggctgaaggaaccgccttcaagctcgtgggattggtgctcgaagagcgcggcgttttacgggcgcatcaggtggtacgtgtcgcagaaattggcgaaggagagatcaccagtggtagtttctctcctacgctgagcaaatccattgctctggcgcgcgttccgatggcaaccgctgaccgggccgaggtggaaatccgcggcaagtggtatccggtgcgggtggtgcagccagcgtttgtgcgccacggcaagaccctgatttaa

SEQ ID NO: 2906 - protein, 360 aa, Pseudomonas syringae pv. phaseolicola 1448A
MGQRTPLFDLHLALGAKMVDFGGWDMPLHYGSQVEEHHQVRRDCGVFDVSHMNVIDVVGRQARTWLRYLLANDVEKLKTPGRALYSAMLDERGGVIDDMIVYLTPEGYRLVVNAATGVKDLAWMQSQLGDFDVQLIARSEMAMLAIQGPKARTRIAELVSSARAELIHQLKPFEGLDDGDWFIARTGYTGEDGLEIMLPAEEAQRFFNELVGAGISPIGLGARDTLRLEAGMNLYGQDIGEHVSPLASNMAWSIAWEPADRDFIGREALESERAEGTAFKLVGLVLEERGVLRAHQVVRVAEIGEGEITSGSFSPTLSKSIALARVPMATADRAEVEIRGKWYPVRVVQPAFVRHGKTLI

SEQ ID NO: 2907 - DNA, 1092 bp, Dechloromonas aromatica RCB
  CDS (1)..(1092): transl_table=11
atgctgaagaaaacagttttgaacgccgctcaccgcgcaatgaatgcccggatggtcgatttcggtggttgggacatgccggtcaactacggttcgcagatcgaggagcacaacgcggtccgcaacaactgcggcatgttcgatgtttcgcacatgtgcccggtcgacgtcgttggcgcggattgccgcaccttcctgtcccgcctcgtcgccaacgatgtggccaagctcaaggtttccggcaaggcgctctatgcggccatgctcaatgaagccggcggcgtcatcgacgacctgatcatctatttcctgaccgacacgcgcttccgcatcgtggtcaatgctggcaccgccgagaaggatctggcctggatgcaggccaaggtcgccgaatggaagctcgacgtgaccattacccagcgccgtgacggcgccaacaatctcggcatcatcgccgtccagggcccgaatgcccgtgccaaggtgtgggaagtgctgccgcagaccaaggccgcgaccgcaggcctgaaggctttcttcgccgctgaggtcgatcagtatttcattgccagcaccggctacaccggtgaagacggttacgaaatcatgatgccggccggcgaagcagaggctctgtggaacaagctcaatgctgctggtgttgccccctgcggcctcggtgcccgcgacacgctgcgcctggaagccggcatgaacctgtacggccaggacatggatgagacggtttcgccgctcgacgccggcctggcttggacggtttcgctgaacaccgaccgtgatttcgtcggcaaggctgcgttggtcaccaacggccagcagaagcagttcctcggcctgatcctgctcgacaagggcgtgctgcgcggccaccagaaggtcatgaccaagcaaggcgacggtgaaatcacctccggaagcttctcgccgacgctccagcagtccatcgctctcgcccgcctaccgctcggcgtgcagattggcgacgaagtcgaagtcgatatccgtggcaaggctttgaaagccaaggtcaccaaacccgtattcgcccgcaacggcaaagcagtcatctaa

SEQ ID NO: 2908 - protein, 363 aa, Dechloromonas aromatica RCB
MLKKTVLNAAHRAMNARMVDFGGWDMPVNYGSQIEEHNAVRNNCGMFDVSHMCPVDVVGADCRTFLSRLVANDVAKLKVSGKALYAAMLNEAGGVIDDLIIYFLTDTRFRIVVNAGTAEKDLAWMQAKVAEWKLDVTITQRRDGANNLGIIAVQGPNARAKVWEVLPQTKAATAGLKAFFAAEVDQYFIASTGYTGEDGYEIMMPAGEAEALWNKLNAAGVAPCGLGARDTLRLEAGMNLYGQDMDETVSPLDAGLAWTVSLNTDRDFVGKAALVTNGQQKQFLGLILLDKGVLRGHQKVMTKQGDGEITSGSFSPTLQQSIALARLPLGVQIGDEVEVDIRGKALKAKVTKPVFARNGKAVI

SEQ ID NO: 2909 - DNA, 1119 bp, Prochlorococcus marinus str. NATL2A
  CDS (1)..(1119): transl_table=11
atgaaattactgcaaactcctctttatcaagaatgcaaagaattaggcggtaaaatggtcccttttgcaaattgggaaatgcctgttagtttctctgggttaatagaagaacacaatgcagtaagaaaaaatgttggaatgttcgacatatctcacatgggtgttgtgcaattaaaaggtaaaaatatcaaaagtgcattacaaaatttagttccctcagacgtgtttcgaataggacctagtgaagcgtgttatacagtttttttaaaagaaaatggaggaattcaagacgatctaatcatttatgaccaaggagttttagatacaaatgaagagagtatagttctagttattaatgcggcaagaaaagaatctgacattgaatggttgagttcaaatctttttaaaaaggaaattacaatatccgaattcatgccagagggtgcattaattgcgatccaaggtccagaatctatcagtacacttgagaaaattctcgaagagcctttatctaatttgccacgttttggtcacagaactatcacttcaaatcccaatctaataaactcacaagaatcaatttttattgcacgaactggttatacaggagaggaaggtttcgaattcttgtcatctcctgaaacagcaaagtctatctggaagagtctaattgcgtcgggagttactccatgcggtctaggagcaagagatacactgcggttagaggcttctatgcatttatatggcaacgatatcaacctagatacaactccctttgaagctggcttgggttggttagttcatttagaaatgcctaatgatttcataggtaggaaagctctagaaaaacaagccgaagttggaacgcaaaaaaaacttgttggtattcaagtccttgataaaggaattgcaagaaaaggatatccagttctatacaacagcgaaactgttggaatagtcactagcggaacatggtctccaacattgcaaaaacccatagctcttgcttatgtgccaagcgaaattgcaaaagtcaatactcaaatagaagtagaaattagaagaaaaaaacatcctgcaataatcgtaaaaagacctttctatcgaaaaggtttttga

SEQ ID NO: 2910 - protein, 372 aa, Prochlorococcus marinus str. NATL2A
MKLLQTPLYQECKELGGKMVPFANWEMPVSFSGLIEEHNAVRKNVGMFDISHMGVVQLKGKNIKSALQNLVPSDVFRIGPSEACYTVFLKENGGIQDDLIIYDQGVLDTNEESIVLVINAARKESDIEWLSSNLFKKEITISEFMPEGALIAIQGPESISTLEKILEEPLSNLPRFGHRTITSNPNLINSQESIFIARTGYTGEEGFEFLSSPETAKSIWKSLIASGVTPCGLGARDTLRLEASMHLYGNDINLDTTPFEAGLGWLVHLEMPNDFIGRKALEKQAEVGTQKKLVGIQVLDKGIARKGYPVLYNSETVGIVTSGTWSPTLQKPIALAYVPSEIAKVNTQIEVEIRRKKHPAIIVKRPFYRKGF

SEQ ID NO: 2911 - DNA, 1128 bp, Ralstonia eutropha JMP134
  CDS (1)..(1128): transl_table=11
atgacgctccaggccacgcccctcaatgccatccaccgcgccctcggcgcccgcatggtcgacttcggcggctgggacatgccggtcaactacggctcccagatcgaggaacacaacgcggtgcgcagcgacgccggcatgttcgatgtgtcgcatatgtgcgtggtcgacctgaacggcgccaatacgcgtgcgttcctgcgcggcctgctggccaacaacgtcgataagctgcagacgccgggcaaggctttgtattcctgcatgctcgacgaaaaaggcggcgtgatcgacgacctgatcgtctacttcttcgccgaggatcgcttccgcctggtggtcaatgccagcaccgcgcttggcgatatcgagtggatccgcgcacgcaatgacgcgaccggcagcggcgtgaccatcaccccgcgccgtggcgatgtggcaccggcgggcgcgctgccgctggcgattgtcgccgtgcagggcccgaacgcgcgcaccaaggtgtggaacaccttcccgtccacccagccttccgacgctctcaagccattcaacgccgtcgtggtccacgacccggccatcggcgagatcatggtcgcgcgcaccggctacaccggcgaagacggctttgaactcgtggtgcctgccgagaacgtcgctgccgtgtgggaaaagctcgatgccgccggcgtgcgcccggccggcctcggcgcgcgcgacacgctgcgcctggaagccggcatgaacctgtacggccaggacatggatatcaacacctcgccgctcgacgccggcctggcctggaccgtcgacctgcagagcgagcgcgatttcaccggcaaggcggcgcttgccgccgccggccagcgccagcagttcctgggcctgatcctgcgtgacaagggcggcgtgctgcgcgcgcaccagaaggtcgtcaccgcggccggtgatggcgaaatcacgagcggcaccttcagcccgtcgctgtcgcaatcgatcgctttcgcgcgcctgccgatgggcgtggcggtcggcgacacggtgcaggtggagatccgcgaccgcaaactcgcggcgactgtggttaaactgccgtttgtgcgtaatggcaaggcactcgtgagctga

SEQ ID NO: 2912 - protein, 375 aa, Ralstonia eutropha JMP134
MTLQATPLNAIHRALGARMVDFGGWDMPVNYGSQIEEHNAVRSDAGMFDVSHMCVVDLNGANTRAFLRGLLANNVDKLQTPGKALYSCMLDEKGGVIDDLIVYFFAEDRFRLVVNASTALGDIEWIRARNDATGSGVTITPRRGDVAPAGALPLAIVAVQGPNARTKVWNTFPSTQPSDALKPFNAVVVHDPAIGEIMVARTGYTGEDGFELVVPAENVAAVWEKLDAAGVRPAGLGARDTLRLEAGMNLYGQDMDINTSPLDAGLAWTVDLQSERDFTGKAALAAAGQRQQFLGLILRDKGGVLRAHQKVVTAAGDGEITSGTFSPSLSQSIAFARLPMGVAVGDTVQVEIRDRKLAATVVKLPFVRNGKALVS

SEQ ID NO: 2913 - DNA, 1152 bp, Ralstonia eutropha JMP134
  CDS (1)..(1152): transl_table=11
atgcgcgagacgaacttgcacgctttgcgaaccccgctgtatgagcgccaccgcttgatccgggcccgaatggctgatgtcggtggctgggatctgcccattgcttatggatcccagatcgaagagcatcacaccgtgcgagaggatgccgcgatgttcgatgtgtcgcacatgtgcgcgcttgacgttcgcgggactgacgctcgagcgtttctcggcaggcttcttgccaacgacatcgggaagctgaaatcaccgggaaaggcgctctattcgtgcatgcttaaccgggaagggggcgtaatcgacgatcttgtcgtctactaccttagcgatgaatgctttcgcattgtcttgaatgcgcaggctgcaagccgtgacattgattggatgcgaacgcagatcgttgagagcggatgttccgtgacactggtgccacgtcgacaggatcttgtcactgacgatgtggaggcccttgcgatgatcgccgtgcaaggtcccaatgccagggagaaggtatttcgagccatgccgtcgacgcgcgccgccgacaaggtaaagccattcaattcatgcttcgtgcacgacgctgtcgtcggcgcgctgatgctggcgcgcacgggaaagaccggcgaggatggcttcgagataacgatgctggcgaagcatgccgttcacgtatgggacgcgttgcgttcgtccggcatctgcgcggcgggattccacgcatgggataccctgcggctcgaggccggcatgcacgtgccgggacgggacatgggcccgcagacgtctccatttgacgttggcctgggctggtctgttgatctcggggaaaagcgggactttgttggcaaggcagcgctacaagctcgcgctcaagcgtcgcaactcgtcggactcgcgttcgaaggaagcggtgcggtcgcgcgtacgcagagccccgtgatgagtctggaaggggaggtgatcgggaaggtcaccagcgggacatatagtccgacgcttcaaatggctatcgctctggcgctggtttcgccagacatcaagttgggctcgtctgtgagtgtcgaggtctacagcaagagagtctctgcaaaagtcgttcgtccaccttttgttcgggatggaagcccagtgggaaaacggtag

SEQ ID NO: 2914 - protein, 383 aa, Ralstonia eutropha JMP134
MRETNLHALRTPLYERHRLIRARMADVGGWDLPIAYGSQIEEHHTVREDAAMFDVSHMCALDVRGTDARAFLGRLLANDIGKLKSPGKALYSCMLNREGGVIDDLVVYYLSDECFRIVLNAQAASRDIDWMRTQIVESGCSVTLVPRRQDLVTDDVEALAMIAVQGPNAREKVFRAMPSTRAADKVKPFNSCFVHDAVVGALMLARTGKTGEDGFEITMLAKHAVHVWDALRSSGICAAGFHAWDTLRLEAGMHVPGRDMGPQTSPFDVGLGWSVDLGEKRDFVGKAALQARAQASQLVGLAFEGSGAVARTQSPVMSLEGEVIGKVTSGTYSPTLQMAIALALVSPDIKLGSSVSVEVYSKRVSAKVVRPPFVRDGSPVGKR

SEQ ID NO: 2915 - DNA, 1089 bp, Thiobacillus denitrificans ATCC 25259
  CDS (1)..(1089): transl_table=11
atgtccgatccgctcaaacagacgccactcaatgccacccatcgcgagctcggcgccaggatggtcgacttcggcggctgggacatgccggtcaactacggctcgcagatcgaggaacatcacgcggtccgtagcggctgcggtctcttcgacgtctcgcacatgctgccgctcgacatccggggcacgaacgtgcgtgccttcctgcgccgcctcgtcgcgaacaacgtcgacaagctgcaggttgcgggcaaggcgctctattcgtgcatgctcaacgaggccggcggcgtcatcgacgacctcatcatctatttcatggacgaatcctggttccgcctcgtggtcaacgccggcaccgcggaaaaggacctcgcgtggatggagaagatgaacgccgagtggaacatggggctctcgcttaccccgcgtcgtgacctcgcgatgatcgcgatccaggggccgaacgccacccaggcgctcaacgaagccctgcccggcgtcgaccagatcaccgcgaacctcaaacccttcaacgccgccgcgatgggcgaaatgttcatcgcccgcaccggctacaccggcgaggacggcttcgaagtcatggtgctcgccaagtccgcgcccttcttctggaaggcgctcatggaagccggcggcaagccgatcggcctcggtgcgcgcgacacgttgcgcctcgaagccggcatgaacctctacggccaggacatggacgagacgacctcgccgctcgagtccggcctcgcgtggaccgtcgacctcaagagcgaacgcgacttcgtcggccgcaaggcgctcgaaaccagcgaagtgaccaagcagctcgccggcctcgtgctcgtcgacaagggcgtgctgcgcggccaccagaaggtccacacccggcacggcgacggcgaaatcacctccggcaccttctcgcctacactgcagcagtccatcgccctcgcccgcatcccgctcggcatcgccccgggcgacgaagtcgaagtcgagatccgcgacaagaagctgaaagccaaagtggtgaaatatccgttcgtgcgcaacggcaaagctttgatttga

SEQ ID NO: 2916 - protein, 362 aa, Thiobacillus denitrificans ATCC 25259
MSDPLKQTPLNATHRELGARMVDFGGWDMPVNYGSQIEEHHAVRSGCGLFDVSHMLPLDIRGTNVRAFLRRLVANNVDKLQVAGKALYSCMLNEAGGVIDDLIIYFMDESWFRLVVNAGTAEKDLAWMEKMNAEWNMGLSLTPRRDLAMIAIQGPNATQALNEALPGVDQITANLKPFNAAAMGEMFIARTGYTGEDGFEVMVLAKSAPFFWKALMEAGGKPIGLGARDTLRLEAGMNLYGQDMDETTSPLESGLAWTVDLKSERDFVGRKALETSEVTKQLAGLVLVDKGVLRGHQKVHTRHGDGEITSGTFSPTLQQSIALARIPLGIAPGDEVEVEIRDKKLKAKVVKYPFVRNGKALI

SEQ ID NO: 2917 - DNA, 1131 bp, Anabaena variabilis ATCC 29413
  CDS (1)..(1131): transl_table=11
gtggctaatcaaaaagacactgccgaaaccttagcgagaactcctttgtatcaactgagtctagaactcaacgcccgtttgaccagctttggcgggtgggaaatgccagtacaattcagtgggattacccgcgaacacgaagcagtgagaaatgctgctgggatgtttgacatatctcacatggggaaatttaccctccaaggtaaaaacctgatttctcaactccaaggtttagttccttcagacttgagtaggttgcaaccaggacaagcccaatacaccgtgttgttaaacccccaaggaggaatcattgacgatatcattgtctactaccaaggtgaagacaacagtggtatgcaacaggcatttatcatcgtcaacgcagccaccaccagtaaagacaaagcatggatactgtcacaccttgaccaaaatcaggtgcaattccaagacatatcactagcaaaagtcttaattgccgtccaagggccaaaagccattgactatctccagccttttgtgcagcaaaatttacaaccaatcaaagccttcggacatctaggagccacagtactaggtcaagcaggttttatagcccgtacaggttacaccggggaagatggctttgagattttgttagacccagaagtgggagtggagttatggcgtagtttatctaatgcaggtgtcattccctgtggcttaggtgcaagagataccctgaggctagaagcagctatggcactctacggtcaagacatcaatgacaacaccactcctctagaagctgggttagggtggttagttcatttggataccaaaggagattttattggtcggtcagttttagaacaacaaaaggccacaggagtaaaacgccgcctcataggtttgcaagcccaaggacgtaacatcgcccgtcatggttaccaagttctctcagacggtaaagtagtaggcgaagtgactagcggtactctatcgcctacactaggtcatcccgttgctttagcctacgtccccagcaaactagcaaaagttggtcaacccctagaagtcgaaattcgcggtaaagcatacccagccgttgtagttaagcgaccattttatcgttcaagtcagaagggctag

SEQ ID NO: 2918 - protein, 376 aa, Anabaena variabilis ATCC 29413
MANQKDTAETLARTPLYQLSLELNARLTSFGGWEMPVQFSGITREHEAVRNAAGMFDISHMGKFTLQGKNLISQLQGLVPSDLSRLQPGQAQYTVLLNPQGGIIDDIIVYYQGEDNSGMQQAFIIVNAATTSKDKAWILSHLDQNQVQFQDISLAKVLIAVQGPKAIDYLQPFVQQNLQPIKAFGHLGATVLGQAGFIARTGYTGEDGFEILLDPEVGVELWRSLSNAGVIPCGLGARDTLRLEAAMALYGQDINDNTTPLEAGLGWLVHLDTKGDFIGRSVLEQQKATGVKRRLIGLQAQGRNIARHGYQVLSDGKVVGEVTSGTLSPTLGHPVALAYVPSKLAKVGQPLEVEIRGKAYPAVVVKRPFYRSSQKG

SEQ ID NO: 2919 - DNA, 1083 bp, Pseudomonas fluorescens PfO-1
  CDS (1)..(1083): transl_table=11
atgggacagcgtacgcctctgtatgacctgcatctcgccctcggcgcgaagatggtcgattttggcggttgggacatgcccctgcattacggctcgcaggtcgaggagcaccacgaggtgcgtcgcgattgcggggtgttcgatgtttcccacatgaccgtgatcgatgtcaccggccctcaggccaaggcctggcttcagcatttgctggccaatgacgtcgaacgcctgcacagccccggccgtgcgttgtacagcaccatgctcaacgagcgcggcggtatcgtcgacgacatgatcgtctaccgccttgaggacggttatcgtctggtggtcaacgcctccacccgcgatcaggacctggcctggatgcaggcacaattgggcagcttcgatgttcagatgaccgaacgctccgagctggcgatgctcgccattcaaggtccccatgcccggcacaggattgccgagctggtgacccagtcccgcgccaacctgatccagatgctcaagcctttcgaaggccacgtcgacggcgactggttcattgcgcgcaccggctacaccggtgaggacggtctggaaatcgccctgccggccgatcaggcccccggattcttcaacgatctggtgggcgccggcatttcccccatcggcctcggtgcccgcgacacgctgcgggtcgaggccggcatgaacctctacggtcaggacatccaccaggacgtttcgcctctggcctcgaacatggcctggagcatcgcctgggagccggcaacgcgtcggttcatcggtcgcgatgcgctggaagcggaaaaaaccgccggcgtgcagcacaaactggtcggcctggtgcttgaagagcgcggggttttgcgggcccatcaggtcgttcgtatcgctgatgttggcgaaggggagatcaccagtggtagtttctctcctacgcttagcaagtcgattgccctggcgcgtgtaccgatggcgactgccgaccgcgccgaagtggaaatccgtggcaagtggtatccggtacgcgtggtcaaaccgacctttgtccgtcacggcaaaaccttgatctaa

SEQ ID NO: 2920 - protein, 360 aa, Pseudomonas fluorescens PfO-1
MGQRTPLYDLHLALGAKMVDFGGWDMPLHYGSQVEEHHEVRRDCGVFDVSHMTVIDVTGPQAKAWLQHLLANDVERLHSPGRALYSTMLNERGGIVDDMIVYRLEDGYRLVVNASTRDQDLAWMQAQLGSFDVQMTERSELAMLAIQGPHARHRIAELVTQSRANLIQMLKPFEGHVDGDWFIARTGYTGEDGLEIALPADQAPGFFNDLVGAGISPIGLGARDTLRVEAGMNLYGQDIHQDVSPLASNMAWSIAWEPATRRFIGRDALEAEKTAGVQHKLVGLVLEERGVLRAHQVVRIADVGEGEITSGSFSPTLSKSIALARVPMATADRAEVEIRGKWYPVRVVKPTFVRHGKTLI

SEQ ID NO: 2921 - DNA, 1083 bp, Carboxydothermus hydrogenoformans Z-2901
  CDS (1)..(1083): transl_table=11
atggagaacttgaaaaggacgccgctttatgaggaacatattaagcttggtgcgaaaatggttccctttggcggatgggagatgccggtccagtataccggtattttagaagaacatatggccgttcggaccgatgtaggcatgtttgatgtttcccacatgggggaaatagaaattaccggaaagcaagcggaacggtttgttaattaccttatcaccaatgatgtttcccgccttaattccggcgacgtaatttacactactatgtgctatcccgatggaggtaccgttgacgaccttttggcttataagtattcgaccgaacggtatttgttggtggtaaacgcagccaataaagataaagatttagctcatattctccaatacaggtgggacgatgttactgttaccgatttatccgacgaaaccgccgaaattgctttgcagggtccaagagcccaggagattttgcagaagttaaccgcttttgatttaaatcaaattaaatattttggttttgccgaaattgaggttgcaggcgttccctgtcttgttagccgcaccggatataccggtgaagatggctttgaaatttattttgctccaaatttggctacaaaaatctggaatgaactcttaaatcttggtgtcaagccggcaggtcttggtgcccgggatacgttaagatttgaagcctgtcttcctttatacggccatgaactttccgccgaaatcacacccttagaagccggactgggctgggccgttaagtttaataaggaagattttataggaaaagaagctttacttgcccaaaaaaatgccgggcttaaaagaaaaattgttggtttggaaatgatcggagcaggaattccacgccaaggctacgaaatagtatttaaccaaaggggagtaggttttgtcacctccggtacctttgcaccgttcctcaagaaaaacctggcaatggctatggtggatcttgaggcggcggaaattggtaccgaggtggacgtaatcattcgggggaagggcgtgcgtgcccgcgtaatttcaagaccattttataaaagggggaaataa

SEQ ID NO: 2922 - protein, 360 aa, Carboxydothermus hydrogenoformans Z-2901
MENLKRTPLYEEHIKLGAKMVPFGGWEMPVQYTGILEEHMAVRTDVGMFDVSHMGEIEITGKQAERFVNYLITNDVSRLNSGDVIYTTMCYPDGGTVDDLLAYKYSTERYLLVVNAANKDKDLAHILQYRWDDVTVTDLSDETAEIALQGPRAQEILQKLTAFDLNQIKYFGFAEIEVAGVPCLVSRTGYTGEDGFEIYFAPNLATKIWNELLNLGVKPAGLGARDTLRFEACLPLYGHELSAEITPLEAGLGWAVKFNKEDFIGKEALLAQKNAGLKRKIVGLEMIGAGIPRQGYEIVFNQRGVGFVTSGTFAPFLKKNLAMAMVDLEAAEIGTEVDVIIRGKGVRARVISRPFYKRGK

SEQ ID NO: 2923 - DNA, 1119 bp, Burkholderia sp. 383
  CDS (1)..(1119): transl_table=11
atgactgcactgaatcacaccccgctcaacgccgcgcaccgcgcgctcaatgcccgcatggtcgacttcggcggctgggacatgcccgtcaactacggctcgcagatcgaagagcatgaagccgtgcgcaccgacgccggcatgttcgacgtgtcgcacatgtgcgtggtcgatttcaccggcagccgcgtgcgcgcgttcttcgagcacgcgatcgcgaacaacgtcggcaagctcaagacgcccggcaaggccctctactcgtgcctgctcaatccgcagggcggcgtcatcgacgacctgatcgtctactacttcaccgaggaattcttccgcgtcgtcgtcaacgccggcacggccgagaaagacatcgcgtggttcaaccagctgaacgagcaaggcggcttcggcgtcacgatcacgccgcgccgcgatttcgcgatcgtcgccgtacagggcccgaacgcccgcgaaaaagcgtggtcgacggtgcccgccgcgcgcgccgccaccagcgaactgaagccgttcaacgccgcgcaggtcgccggcacgccgttcggcgatctcaccgtcgcgcgcaccggctacaccggtgaagacggtttcgaagtgatcgtcccggccgtgcacgtcgaagcgctgtggaacgcgctgcagcaaaacggcgtgcgcccgtgcgggctcggcgcgcgcgacacgctgcgcctcgaggccggcatgaacctgtacggccaggacatggacgacaccgtgtcgccgctcgacgcgggcctcgcgtggacggtcgaccttaccgcgccgcgcgacttcgtcggccgcgccgcactggaagccaacggcacccgcgccgcattcgtcggcctgatcctgcagaaggaaaacggcaaggccggcggcgtgctgcgcgcgcaccagaaggtcgtcacgccgcacggcgaaggcgagatcacgagcggcacgttctcgccgtcgatgcaggaatcgatcgcgttcgcgcgcgtgccggcggccgtccagatcggcgacctggtccaggtgcaaattcgcgacaagaatcttcccgcgcgcgtggtaaaactgccgttcgtgcgcaacggcaaggtcctcgctgcgtaa

SEQ ID NO: 2924 - protein, 372 aa, Burkholderia sp. 383
MTALNHTPLNAAHRALNARMVDFGGWDMPVNYGSQIEEHEAVRTDAGMFDVSHMCVVDFTGSRVRAFFEHAIANNVGKLKTPGKALYSCLLNPQGGVIDDLIVYYFTEEFFRVVVNAGTAEKDIAWFNQLNEQGGFGVTITPRRDFAIVAVQGPNAREKAWSTVPAARAATSELKPFNAAQVAGTPFGDLTVARTGYTGEDGFEVIVPAVHVEALWNALQQNGVRPCGLGARDTLRLEAGMNLYGQDMDDTVSPLDAGLAWTVDLTAPRDFVGRAALEANGTRAAFVGLILQKENGKAGGVLRAHQKVVTPHGEGEITSGTFSPSMQESIAFARVPAAVQIGDLVQVQIRDKNLPARVVKLPFVRNGKVLAA

SEQ ID NO: 2925 - DNA, 1128 bp, Synechococcus sp. CC9605
  CDS (1)..(1128): transl_table=11
atgcgcttcccatcggccgcccccatgtccctgcagcgcactcccctgttcgagtcctgccgcagcgccgggggccgcatggtgccgtttgccggctgggagatgccggttcagttcagcggcctgatccaggaacacaaggccgttcgcgaacgggtcggcatgttcgacatctcccacatgggagtgctgcgcctcgaaggtgccaatcccaaggatgcgctgcaacggctgctccccagcgatctgcaccgcatcgggcccggcgaagcctgctactccgttctgctgaacgagcgtggcggcatccgcgacgacctcatcgtttacgactgcggggccatcgatgccgaacggggtgcgctgatgctggtgatcaatgccgcctgcgccgacagcgacaccgcctggatccgtgaacagatggagcccgctggcctgaaggtgaccgacatcaaaaaggacggcgtgctgctcgctctacaaggccctgaagccataggggtgcttcaggagctgagcggcgaagagctcagcggcttgccccgcttcggccaccggatgctcaacctcaaaggacttagacaaccggtgtttagtgctcgcacgggctacaccggcgaagacggtgccgagctgctgctcaacgccgatgacggacaaaagctctggcagctcttgctcgatcgcggtgtcaccccctgcggcctgggggcgcgggacaccttgcggctggaggccgctatgcacctttacggccaggatatgaacgacgaaaccaaccccttcgaggcgggattgggttggctcgtgcacctggaaatgcccgtgaattttgtgggccggcaggcactggagcaagctgcggaatccggacccaccaaacgcctcgtggggctcaagctgcagggtcgtgccatcgcccgccacgactaccccgttgtccataacggtgagacggtgggcatcgtcaccagcggcacctggtcccccaccctggaagaagcgatcgccctggcctacgttccgccgtccctcgccaagctcggcacagaactgagcgtggagatccgcggtaaggcccaaccggcaacggtcgttcgcaagcccttctacaaacgcgcctga

SEQ ID NO: 2926 - protein, 375 aa, Synechococcus sp. CC9605
MRFPSAAPMSLQRTPLFESCRSAGGRMVPFAGWEMPVQFSGLIQEHKAVRERVGMFDISHMGVLRLEGANPKDALQRLLPSDLHRIGPGEACYSVLLNERGGIRDDLIVYDCGAIDAERGALMLVINAACADSDTAWIREQMEPAGLKVTDIKKDGVLLALQGPEAIGVLQELSGEELSGLPRFGHRMLNLKGLRQPVFSARTGYTGEDGAELLLNADDGQKLWQLLLDRGVTPCGLGARDTLRLEAAMHLYGQDMNDETNPFEAGLGWLVHLEMPVNFVGRQALEQAAESGPTKRLVGLKLQGRAIARHDYPVVHNGETVGIVTSGTWSPTLEEAIALAYVPPSLAKLGTELSVEIRGKAQPATVVRKPFYKRA

SEQ ID NO: 2927 - DNA, 1101 bp, Moorella thermoacetica ATCC 39073
  CDS (1)..(1101): transl_table=11
gtggccgatttaaaaaagacgcccctctacggggagcacgtggctgccggggccaaaatggtggaattcggcggctggttgatgcccgtccagtacagcagcattattgaggaacatcagcgggtgcgtaactgtgccgggctctttgacgtctcccatatgggggagattaccataaagggacctgacgccctggcgctggtccagaagctgcttaccaacgatgccgaccgggccaccggggacagggtcatctacagccctatgtgttacccggacgggggcgtagtcgacgacctgctggtctatccccggggagaaggggaatatctcctggtagtcaacgccggtaacattgacaaggactttgcctggatccaggagaacgctagcggtttccgggttgaggtcagcaatatctccgcagctacagctcaactggccctccaggggccacgagccctggaaattctccggcccctgacgagggtcgacctggcctccctgggttattaccgctggaccgagggccaggttctgggggttcattgcctgatctcccgcaccggctacaccggcgaagacggtttcgagctttactttgaggcggccgcagcccctaccatgtggcggaatatcctggccgccggcagggaggcaggcctggtcccggccggactgggggccagggatactctaaggctggaggcggccctgcccctttacggccacgagttgggcccggacatcagccccctggaggccggtttgcaccgctttgtccgcctggagaagggcgaatttaacgggagggaggccctggcagcccagcgggaagccggggtcaggaggcaactggtgggactgaccatgatcgaccgggggatcccccggccggaataccccgtcctggcggcaggcaaggagattggttacgttacctcaggttccctggcgccaaccctgggacaaaatatcgctctggccctggtggcggcaggaactgtctctaccggcggcgaagtagaagtgagcatccgcggccgtgtcaaccgcgcccgggtggtgaaactccccttctatcgccgccccaaaaagtaa

SEQ ID NO: 2928 - protein, 366 aa, Moorella thermoacetica ATCC 39073
MADLKKTPLYGEHVAAGAKMVEFGGWLMPVQYSSIIEEHQRVRNCAGLFDVSHMGEITIKGPDALALVQKLLTNDADRATGDRVIYSPMCYPDGGVVDDLLVYPRGEGEYLLVVNAGNIDKDFAWIQENASGFRVEVSNISAATAQLALQGPRALEILRPLTRVDLASLGYYRWTEGQVLGVHCLISRTGYTGEDGFELYFEAAAAPTMWRNILAAGREAGLVPAGLGARDTLRLEAALPLYGHELGPDISPLEAGLHRFVRLEKGEFNGREALAAQREAGVRRQLVGLTMIDRGIPRPEYPVLAAGKEIGYVTSGSLAPTLGQNIALALVAAGTVSTGGEVEVSIRGRVNRARVVKLPFYRRPKK

SEQ ID NO: 2929 - DNA, 1098 bp, Desulfitobacterium hafniense Y51
  CDS (1)..(1098): transl_table=11
gtgacggaactaaaaagaacaccactgtatgagcagcaccgccgggccggtgcgaagctcattgatttcggcggctgggaaatgccggttcaatacgccggagtcattgaggagcacaaggccgtgcgcagcaaagcggggctttttgatgtctctcatatgggtgaggtggagttgaagggaaaggatagccttgcttttttgcagtacctattgaccaatgatgtgtcgcgaattcaggataaccagattcagtattcccccatgtgcacctctgctgggggtgtggtggatgatctgctggtctatcgttatagccgggagcattttttgctggtggtcaatgccgccaatacggataaggattttgcctggatgcaggctcaagctgagggcttcgaaataagtctggaaaatcgctccggggactttgcccaattggctttgcaaggcccttgggcggagaaaatcctgcaaaagctgacaagtatggatttagcacagatcaactactattggtttaagcatggggaagtggacggagtcctttgcctgatttccaggacaggttataccggggaagacggctttgaaatttacctgcctcccgagcatgctccccggatgtgggaaagaattctcgaggttggagggtcggagggagttcagcccattggtctgggcgcccgggatactctccgttttgaagccaggctgcctttatacggcaatgaactggggccggatatcacacctttggaggccgggctagggttttttgtcaagctggagaaggataactttatcggtaaagaggcgttatcagcccagaaggaaaagggagtgccgagaaagttggtaggcctggaaatgatcgaacggggcatagcccgctcccattatccccttcagaaagagggtaaagaaatcggctttattacttcaggttctttttcacctactttaaacaaaaacattgcccttggcttgattcccccggagtatgctcaaataggggaaaccttggatgtgatcattcgtgggaaagccgttaaagcccggattattccttcactgttctacaaacggcaggggtaa

SEQ ID NO: 2930 - protein, 365 aa, Desulfitobacterium hafniense Y51
MTELKRTPLYEQHRRAGAKLIDFGGWEMPVQYAGVIEEHKAVRSKAGLFDVSHMGEVELKGKDSLAFLQYLLTNDVSRIQDNQIQYSPMCTSAGGVVDDLLVYRYSREHFLLVVNAANTDKDFAWMQAQAEGFEISLENRSGDFAQLALQGPWAEKILQKLTSMDLAQINYYWFKHGEVDGVLCLISRTGYTGEDGFEIYLPPEHAPRMWERILEVGGSEGVQPIGLGARDTLRFEARLPLYGNELGPDITPLEAGLGFFVKLEKDNFIGKEALSAQKEKGVPRKLVGLEMIERGIARSHYPLQKEGKEIGFITSGSFSPTLNKNIALGLIPPEYAQIGETLDVIIRGKAVKARIIPSLFYKRQG

SEQ ID NO: 2931 - DNA, 1092 bp, Saccharophagus degradans 2-40
  CDS (1)..(1092): transl_table=11
atgcttaatgaaacagttttagcgccactacaccgcgaaattggtggcaagatggtcgattttggtggctgggatatgccattgcattacgggtcgcaggttgaagagcatcaaaaagtgcgtaccgatgccggtatgtttgatgtttctcacatgactgtagtggatgtgaccggcgctggtgctaagacgtttttacagtatgtgttggctaacgatgtggccaagcttaccaagaatggtaaggcgttgtattcgggcatgcttaaccatgagggtggcgtggttgatgatttgattgtgtaccttatggagtgggggtaccgcgttgtagtgaactgcgctacccgcgaaaaagatttagcctggatggtcgagcacgcaaaagggtttgaggttgcgctaaacgagcgcgacgatttggcgatgattgcggtgcaaggccctgctgcacgcgagaaaacggcgcaaattttgcccgaattgttaactatggatttagatatattccaaggcgccgatgtagccgcgctgggcgatgtaactttttttgtggcgcgcactggttacaccggtgaagacggttacgaaattatgctgcccactagcgatgccgatgcgttttggcgtgcgcttatggcggtgggtgtagcgccttgcggtttgggtgcgcgcgatacattgcgtttagaggcgggtatgaatttgtacggccacgagatggacgataacacctcgccgctggtggccaatatggcgtggacgattgcttggcagccagaagagcgcaattttattggtcgcgaggcgattagcgccgagaaagcggcgggcgttacccataagttggtgggcctagtgttgcaagatcgcggtgtgctgcgcgcagagcaggttgtaacctgtgaaggcgtagagggcgagggtgtaattaccagcggtactttttcgcctacattaagtaaatctgtggcgcttgcgcgcgtaccggtggcttttagcggtgagtgcacagtggctgtgcgcaataagcagttaaaagcgttggtggttaagcctagttttgtgcgtttgggtaaggctttggtttaa

SEQ ID NO: 2932 - protein, 363 aa, Saccharophagus degradans 2-40
MLNETVLAPLHREIGGKMVDFGGWDMPLHYGSQVEEHQKVRTDAGMFDVSHMTVVDVTGAGAKTFLQYVLANDVAKLTKNGKALYSGMLNHEGGVVDDLIVYLMEWGYRVVVNCATREKDLAWMVEHAKGFEVALNERDDLAMIAVQGPAAREKTAQILPELLTMDLDIFQGADVAALGDVTFFVARTGYTGEDGYEIMLPTSDADAFWRALMAVGVAPCGLGARDTLRLEAGMNLYGHEMDDNTSPLVANMAWTIAWQPEERNFIGREAISAEKAAGVTHKLVGLVLQDRGVLRAEQVVTCEGVEGEGVITSGTFSPTLSKSVALARVPVAFSGECTVAVRNKQLKALVVKPSFVRLGKALV

SEQ ID NO: 2933 - DNA, 1155 bp, Burkholderia xenovorans LB400
  CDS (1)..(1155): transl_table=11
atggccttttttgtttcgcgagatgcccgaggccccatgaccgaactcaaacacaccccgctcaacgccacccaccgtgcgctcaatgcccgcatggtcgatttcggcggctgggacatgcccgtcaactacggctcgcagatcgacgaacatcgcgccgtgcgcaccgacgccggcatgttcgacgtctcgcacatgtgcgtggtcgatttcaccggcgagcgcgtacgcgccttcttcgaatatgcgctggccaataacgtcgccaagctgcaaacgcccggccgcgcgctgtactcctgcctgctgaacccgaacggcggcgtgatcgacgacctgatcgtttattacttcggcgaagatcacttccgcgtggtcgtcaacgccggcaccgccgacaaggacatcgcctggttcggccagctcaacgccgaaggcggcttcggcctgaccatcacgccgcgccgagactacgcgatcgtcgccgtgcaaggcccgaacgctcgcgaaaaagtctggcaaaccgtgccggctacgcgcgccgccaccgaggcgttgaagccgttcaacgccgcccgtatcgcagacacgccgttcggcgaattgaccgttgcccgcaccggctacaccggcgaagacggcttcgaaatcatcgtgccggcggatcacgtggaagcgctgtggaacgcgctgcgcgcgcaaggtgtgcgcccggccggcctcggcgcgcgcgacacgttgcgcctcgaagccggcatgaacctgtacggccaggacatggacgacaatgtctcgccgctcgacgccggcctcgcctggacagtcgacctcacctcgccgcgcgacttcgtcggcaagagcaagctggaggcgggcggttcccaagccgcgttcgtcggcctgatcctgctgaaggaaaacggcaaggcggcaggcgtgctgcgtgctcatcagaaagtcgtcacaccgcaaggcgaaggcgaaatcaccagcggcactttttccccgaccatgcaggaatcgatcgcctttgcgcgcgtgccgaaaggcgtgcagccgggcgacaccgttcacgttcagattcgtgacaaaaacgttcccgcaagcgtggtaaaactgccgttcgtgcgcaatggcaaagtgctcgcggtttaa

SEQ ID NO: 2934 - protein, 384 aa, Burkholderia xenovorans LB400
MAFFVSRDARGPMTELKHTPLNATHRALNARMVDFGGWDMPVNYGSQIDEHRAVRTDAGMFDVSHMCVVDFTGERVRAFFEYALANNVAKLQTPGRALYSCLLNPNGGVIDDLIVYYFGEDHFRVVVNAGTADKDIAWFGQLNAEGGFGLTITPRRDYAIVAVQGPNAREKVWQTVPATRAATEALKPFNAARIADTPFGELTVARTGYTGEDGFEIIVPADHVEALWNALRAQGVRPAGLGARDTLRLEAGMNLYGQDMDDNVSPLDAGLAWTVDLTSPRDFVGKSKLEAGGSQAAFVGLILLKENGKAAGVLRAHQKVVTPQGEGEITSGTFSPTMQESIAFARVPKGVQPGDTVHVQIRDKNVPASVVKLPFVRNGKVLAV

SEQ ID NO: 2935 - DNA, 1128 bp, Ralstonia metallidurans CH34
  CDS (1)..(1128): transl_table=11
atgacgctccaggccacgcccctcaacgccatccaccgcgccctcggcgcccgcatggtcgacttcggcggttgggacatgcccgtcaactacggctcccagatcgaggaacacaacgcggtacgcgccgacgccggcatgtttgacgtctcccacatgtgcgtggtggacctgagcggcatccacgcgcgcgccttcctgcgcggtctgctggccaacaacatcgacaagctgcaaacgccgggcaaggcgctctattcgtgcatgctcgatgagaaaggcggcgtcatcgacgacctgatcgtctacttctttgccgaggaccggttccgcctggtggtcaacgccagcactgccgtcggcgacatcgaatggatccagtcccgcaacacggccaccggcagcggcgtgacgatcaccccgcgccgtggcgacctggccccggcctgcgtgagcaagctggcgattgttgcagtgcagggcccgaacgcgcgccagaaggtgtacgacgcattcccgtcgacccagcccgccgacacgctcaagccgttcaacgcggtggtggtgcacgacgccgagatgggtgaactgatggtggcccgtaccggctacaccggcgaagacggcttcgaactcgttgtgccggcggagaacgtcgcgggcatctgggaaaagctgtccgcctcgggtgtgcgtcccgccggactcggcgcgcgcgacacgctgcggctggaagccggcatgaacctgtacggccaggacatggatatccacacttcaccgctcgatgcaggactgtcgtggaccgtcgacctgcaaagcgagcgcgacttcatcggcaagtcggcgctgctggccagcggccagcaaaagaccttcgccggcctgatcctgcgagacaagggtggcgtgctgcgcgcgcaccagaaggtcatcactccggccggcgacggcgaaatcaccagcggcacattcagcccgtcgctgtcgcagtcgatcgcctttgcccgccttccccgcgacattgcccccggcaccgaggtgcaggtggagattcgcgaccgcaaactgaccgcgactgtggttaaactgccgtttgtgcgcaatggcaaggcactcgtgagctga

SEQ ID NO: 2936 - protein, 375 aa, Ralstonia metallidurans CH34
MTLQATPLNAIHRALGARMVDFGGWDMPVNYGSQIEEHNAVRADAGMFDVSHMCVVDLSGIHARAFLRGLLANNIDKLQTPGKALYSCMLDEKGGVIDDLIVYFFAEDRFRLVVNASTAVGDIEWIQSRNTATGSGVTITPRRGDLAPACVSKLAIVAVQGPNARQKVYDAFPSTQPADTLKPFNAVVVHDAEMGELMVARTGYTGEDGFELVVPAENVAGIWEKLSASGVRPAGLGARDTLRLEAGMNLYGQDMDIHTSPLDAGLSWTVDLQSERDFIGKSALLASGQQKTFAGLILRDKGGVLRAHQKVITPAGDGEITSGTFSPSLSQSIAFARLPRDIAPGTEVQVEIRDRKLTATVVKLPFVRNGKALVS

SEQ ID NO: 2937 - DNA, 1119 bp, Rubrobacter xylanophilus DSM 9941
  CDS (1)..(1119): transl_table=11
gtggtagcggtggcgaggggaaccctgcgccgcaccccgctctacgaggagcacagggccctgggcgcccggctcgtggacttcgcgggctgggagatgccggtgcagtacgcggggataaaggccgagcacgaggcggtgcgcacccgcgccgggctcttcgacgtctcgcacatgggggaggtggccttccgcggcccggacgccgagagggcgctgcagcgcctcctcacccgcgacgtctcccggctgggtgaggggcaggcgggctatgccgccgtctgcctggagagcggggggacggtggacgacgtgatcgcctaccgccgcggggagggcttcctcgtggtggtgaacgccgccaaccgcgagaaagacctcgcccacttccgcaggcacaccgcagacctcgacgtagagatctccgacgagacggaggagtgggcgctgctcgcgctgcagggcccggaggccgagcggctcctgcagccgttcgtcgcgggagacctctccgccctcgggcgctaccgcttcctcgagacgcacgtggacgggggggaggcgatcgtggcccgcaccggctacaccggagaggacggcttcgaggtctttctccgccccgcagaggccccctccctgtggcggcgcctcgtcgaggcgggggctgctccggccgggctcggggcgcgcgacacgctgcgcctggaggcggggatgtgcctctacggcaacgagctggacgaggagaccacgccgcttgaggccgggatctccttcgccgtccacctacacaaggaggaggagttcgtcgggcagcgggccctgcagagacagcgggagcgcgggctgcgcaaaaagctagtcggcttcgagctggaggggcggggcatagcccgccacggctacccggtcgccgtgggcggcgagcgggcgggcgtggtcaccagcgggacgatgtccccgacgctgggccgcgccatcgggctcgcctacgtcccccccgagacggagggcggcttcgaagtgctcatccgggagcggccggtcccggccaggatcgtcccgctccccttctaccggcgcaagagaaacgaccccgagggaggagccagtggctga

SEQ ID NO: 2938 - protein, 372 aa, Rubrobacter xylanophilus DSM 9941
MVAVARGTLRRTPLYEEHRALGARLVDFAGWEMPVQYAGIKAEHEAVRTRAGLFDVSHMGEVAFRGPDAERALQRLLTRDVSRLGEGQAGYAAVCLESGGTVDDVIAYRRGEGFLVVVNAANREKDLAHFRRHTADLDVEISDETEEWALLALQGPEAERLLQPFVAGDLSALGRYRFLETHVDGGEAIVARTGYTGEDGFEVFLRPAEAPSLWRRLVEAGAAPAGLGARDTLRLEAGMCLYGNELDEETTPLEAGISFAVHLHKEEEFVGQRALQRQRERGLRKKLVGFELEGRGIARHGYPVAVGGERAGVVTSGTMSPTLGRAIGLAYVPPETEGGFEVLIRERPVPARIVPLPFYRRKRNDPEGGASG

SEQ ID NO: 2939 - DNA, 1116 bp, Rhodococcus sp. RHA1
  CDS (1)..(1116): transl_table=11
atgaccctcaccacgacgcccgcgtccccgctgctcggcgagcacggcgcactgggggcccatttcaccgacttcgcgggctggcagatgccgctgaagtacgacagcgaactcgccgagcaccacgccgtccgcaagaccgccggactgttcgacctctcacacatgggcgagatcgcggtcaccggccctgaatccggagcggtcctggattacgctctggccggcgaactctcgaagatcggcgtcggcagggccaagtactccctcttgtgcaatgcgggcggcggagtcatcgacgatctggtcgtctaccgtctcgccaacgagcatttcctcgtcgtggccaacgcggccaacgccccgacggtgcaccgcgaactggcggcacgcgtcgagggcttctccgccagggtcgacgaccaatcctcggagaccgcgctgatcgcggtgcagggaccggccgcgcaggacgtcgtgcagtccctcgttcccgccgagcaggtcgagacggtggcggagttgaagtactacgcggtcacgcgcgcggtggtcgccggcatcgacgtcctcctcgcccgcaccggatacaccggggaggacgggttcgagctgtacgtgccgaacgaactgtccgtgcagttgtggcgcgcactgctcgacgccaccaccgcccgcggcggcgtccccgccggcctcgcgtgccgcgacaccctccgcctcgaggccggaatggccctgtacggccacgaactgaccctcgacacgaatccgtacgaagccgggctcggcaaggtggtccggctgaacaaggacttcgtcggccgcgatgcgctgcagacgttgtcggatcaggccccgcagcgggtgctcgtcggcctcgccggaggcgggcgccgggccgcccgcgccgagtacaccgtgttggacgcggccggtgagtcggcggtcggcaccatcacgtccggggcgttgtctccgacactcgggcatccgatcgcgctcgccttcgtggacgtcgcgttccgcgaaccgggcaccgaactgacggtcgacatccgcggcaagaaggaaccgttcgtggtcaccccatcgccgttctaccgccgctcctga

SEQ ID NO: 2940 - protein, 371 aa, Rhodococcus sp. RHA1
MTLTTTPASPLLGEHGALGAHFTDFAGWQMPLKYDSELAEHHAVRKTAGLFDLSHMGEIAVTGPESGAVLDYALAGELSKIGVGRAKYSLLCNAGGGVIDDLVVYRLANEHFLVVANAANAPTVHRELAARVEGFSARVDDQSSETALIAVQGPAAQDVVQSLVPAEQVETVAELKYYAVTRAVVAGIDVLLARTGYTGEDGFELYVPNELSVQLWRALLDATTARGGVPAGLACRDTLRLEAGMALYGHELTLDTNPYEAGLGKVVRLNKDFVGRDALQTLSDQAPQRVLVGLAGGGRRAARAEYTVLDAAGESAVGTITSGALSPTLGHPIALAFVDVAFREPGTELTVDIRGKKEPFVVTPSPFYRRS

SEQ ID NO: 2941 - DNA, 1146 bp, Trichodesmium erythraeum IMS101
  CDS (1)..(1146): transl_table=11
gtggccaaatcaacagaatctaatacacaacctctttctcgtacacctctatatgacttaagcactgaacttaaggctagaatggtagaattttctgggtgggagatgccggtacaatacactagtatcagcaacgaacatgaggcagtacggacaaaagcaggaatgtttgacatttctcatatgggcaagttcattgctcaaggccatgatttaattgagaaaattcaatatttagtaccttcggacctgagcggcttagaacctggtaaagctcaatatactgtcttattaaattctcaaggaggcattattgatgacttcattttctatcgtcaaagtgatgaccctctaactaatgaagcacggggttttatgattgttaatgctgccactaaagctaatgataaaggatggatattaagtcatctagaaaatagtggtgttaaattccaagatatctctgaggaaaaagtgttattagctgtccaaggtccggatgcagagtcttatatacagcagtttgtcaaggaaaatttggcatcaattggattttttgggcatgcagatattactgtattggataaacctggtttcattgctagaactggttacactggggaagatgggtttgaaattatggttgaccccccggtgggtgtagagttatggcgcagtttgttgaatgctggggtgactccctgcggtttgggagcaagagatactttgcgtttagaagctgctatggcgctttatggtcaagatattgatattaagactactcctttagaagcaggtttaagttggttagttcacttggataaaaagggggagtttattgctcgtgaggtattagaaacacaaaagagggaaggagtatcaaaacgtttagtgggtttggaaatgctcgatcgcggtattgctcgtcatggttatcctgttttgagtgatggcaaagtggtaggggaagttactagcggtactaagtctcctactttagggaaagcgatcgctctggcttatgtacctaaaaaattagctaaggtaggtcaaaagttagaggtggaaattaggggtaaaaattatgcagctattgttgttaagcgccccttttatagaagtcaaaagtcaaaagttaaaagttaa

SEQ ID NO: 2942 - protein, 381 aa, Trichodesmium erythraeum IMS101
MAKSTESNTQPLSRTPLYDLSTELKARMVEFSGWEMPVQYTSISNEHEAVRTKAGMFDISHMGKFIAQGHDLIEKIQYLVPSDLSGLEPGKAQYTVLLNSQGGIIDDFIFYRQSDDPLTNEARGFMIVNAATKANDKGWILSHLENSGVKFQDISEEKVLLAVQGPDAESYIQQFVKENLASIGFFGHADITVLDKPGFIARTGYTGEDGFEIMVDPPVGVELWRSLLNAGVTPCGLGARDTLRLEAAMALYGQDIDIKTTPLEAGLSWLVHLDKKGEFIAREVLETQKREGVSKRLVGLEMLDRGIARHGYPVLSDGKVVGEVTSGTKSPTLGKAIALAYVPKKLAKVGQKLEVEIRGKNYAAIVVKRPFYRSQKSKVKS

SEQ ID NO: 2943 - DNA, 1110 bp, Synechococcus sp. CC9311
  CDS (1)..(1110): transl_table=11
atggaccaaaactgcacaccgctccatgacctctgcatcgcggcaggcggtcgaatggtctccttcgctggatgggaaatgcccgttcagttttcagggctcatggctgaacacaaggccgtacgcagcgacagcggcatgtttgatatttcccacatgggagttctgcggattgaaggtgccaatcccaaagatgcgttgcaacaacttgtaccgagtgatcttcaccgaatcggtcctggccaagcctgctattcggtgttgctgaatgaacaaggtggaattattgatgacttaatcatttatgaccttgggccatcgttattagacgaaagccacgaaaccctgctggttgtgatcaatgcagcttgcgcagagaccgacacagcctggattcgtcaacatcttgaaagggctgatctgcaggtgctcgacgaaaagaaggatggcgtattgctcgctcttcaagggccaaaggcaatcggcctactggagcgattgagtggcagcgatctcagcgaactgccgcgcttcggccactgcagtctcaatattcacggactccaagctccggtcttcacagcacgcacgggctacaccggagaggatggcgtggagttgctgctcaaggcagacgacggacgacagctgtggcagctactactcgaggagggggtgacaccctgcggcctcggcgctcgcgacaccctgcgactagaggcagccatgcatctctacggccaagacatggacgctgccaccactcccttcgaggcgggattggggtggctggtgcatctggaaatgcccgccctgttcatcggacgacaagccctcgagcaagcagccgaacaggggccttccaagcgtctcgtaggactgaaactgcagggccgttcgattgcccgccacgactaccccgtcatccacaacggagcgactgtgggcgtggtgacaagcggcagctggtctcccactctccaagagcccattgctctcgcctcgcttcccccagccctggccaagctcggcacggaacttagtgtggagatccgcgggcaactgcaaccggccactgtcgtgaaacgtcccttctatcgccgttcctag

SEQ ID NO: 2944 - protein, 369 aa, Synechococcus sp. CC9311
MDQNCTPLHDLCIAAGGRMVSFAGWEMPVQFSGLMAEHKAVRSDSGMFDISHMGVLRIEGANPKDALQQLVPSDLHRIGPGQACYSVLLNEQGGIIDDLIIYDLGPSLLDESHETLLVVINAACAETDTAWIRQHLERADLQVLDEKKDGVLLALQGPKAIGLLERLSGSDLSELPRFGHCSLNIHGLQAPVFTARTGYTGEDGVELLLKADDGRQLWQLLLEEGVTPCGLGARDTLRLEAAMHLYGQDMDAATTPFEAGLGWLVHLEMPALFIGRQALEQAAEQGPSKRLVGLKLQGRSIARHDYPVIHNGATVGVVTSGSWSPTLQEPIALASLPPALAKLGTELSVEIRGQLQPATVVKRPFYRRS

SEQ ID NO: 2945 - DNA, 1095 bp, Shewanella sp. MR-4
  CDS (1)..(1095): transl_table=11
atggctaataaaactgttctgtttaacaagcacttagaatcaaacgctaagatggtcgacttccacggttgggatatgcccctcaactatggttcacaaatcgaagaacaccacgccgtgcgtcaagacgcaggtatgttcgacgtgtcccacatgactgtggttgatgtgaccggaaccgacgcttgtgcattcctccgtaagttgctggcaaacgatgtggccaaacttaaagttcctggtaaagccttatacggcggcatgttagatgacaatgccggcatcatcgacgacctgatcacttactacctgaccgacactttctaccgtgttgtcgtcaacagcgcgacccgcgaaaaagacttagcgtggatcgccaaacaatcccaaggttttgatgtcacagtgactgagcgtcctgagctggcgatgatcgccgttcaaggtcctaacgctaaggctaaagccgccgccgtattcagtagcgatcaaaatgccgccatcgaaggcatgaaacctttcttcggtaagcaagcaggctctctgtttattgcgaccactggttacacaggtgaagtgggctacgagatcatcgtgccagaaactgaagccgaagccctgtggcaagctctgttagatcaaggcgttaaaccatgtggtttaggcgctcgcgatacattacgtctcgaagccggtatgaacctctacggcttagatatggacgaaaccatcaacccactggccgccaacatgggctggaccatcgcatgggagccaactgaccgtgactttatcggtcgtaaggcgcttgaagccctgcgcgatgcgggtaccgacaaattagtcggtctggtgatggaagaaaaaggcgtgttacgccatgatatgccagtatttttcaccgatgcagcgggtgttgagcagcaaggtgtgattaccagcggtactttctcgccaacattgggctattctattgcgatggcgcgtgttcctaactcgattggggatacggcggaagtcgaaatgcgtaaaaagcgcgtggctgttagagtagtagcgccaaactttgtgcgcaacggtaaacaagcattttaa

SEQ ID NO: 2946 - protein, 364 aa, Shewanella sp. MR-4
MANKTVLFNKHLESNAKMVDFHGWDMPLNYGSQIEEHHAVRQDAGMFDVSHMTVVDVTGTDACAFLRKLLANDVAKLKVPGKALYGGMLDDNAGIIDDLITYYLTDTFYRVVVNSATREKDLAWIAKQSQGFDVTVTERPELAMIAVQGPNAKAKAAAVFSSDQNAAIEGMKPFFGKQAGSLFIATTGYTGEVGYEIIVPETEAEALWQALLDQGVKPCGLGARDTLRLEAGMNLYGLDMDETINPLAANMGWTIAWEPTDRDFIGRKALEALRDAGTDKLVGLVMEEKGVLRHDMPVFFTDAAGVEQQGVITSGTFSPTLGYSIAMARVPNSIGDTAEVEMRKKRVAVRVVAPNFVRNGKQAF

SEQ ID NO: 2947 - DNA, 1095 bp, Shewanella sp. MR-7
  CDS (1)..(1095): transl_table=11
atggctaataaaactgttctgtttaacaagcacttagaatcaaacgctaagatggtcgacttccacggttgggatatgcccctcaactatggttcacaaatcgaagaacaccacgccgtgcgtcaagacgcaggtatgttcgacgtgtcccacatgactgtggttgatgtgaccggaaccgacgcttgtgcattcctccgtaagttgctggcaaacgatgtggccaaacttaaagttcctggtaaagccttatacggcggcatgttagatgacaatgccggcatcatcgacgacctgatcacttactacctgaccgacactttctaccgtgttgtcgtcaacagcgcgacccgcgaaaaagacttagcgtggatcgccaaacaatcccaaggttttgatgtcacagtgactgagcgtcctgagctggcgatgatcgccgttcaaggtcctaacgctaaggccaaagccgccgccgtattcagtagcgagcaaaatgccgccatcgaaggcatgaaacctttcttcggtaagcaagctggctctctgtttattgcgaccactggttacacaggtgaagtggggtacgagatcatcgtgccagaaactgaagccgaagccctgtggcaagctctgttagatcaaggcgttaaaccatgtggtttaggcgctcgcgatacattacgtctcgaagccggtatgaacctctatggcttagatatggacgaaaccatcaacccgctggccgccaacatgggctggaccatcgcatgggagccaactgaccgtgactttatcggtcgtaaggcactcgaagccctgcgcgatgcgggtaccgacaaattagtcggtctggtgatggaagaaaaaggcgtgttacgccatgatatgccagtatttttcaccgatgcagcgggtgttgagcagcaaggtgtgattaccagcggtactttctcgccaacattgggctattctattgcgatggcgcgtgttcctaactcgattggggatacggcggaagtcgaaatgcgtaaaaagcgcgtggctgttagagtagtagcgccaaactttgtgcgcaacggtaaacaagcattttaa

SEQ ID NO: 2948 - protein, 364 aa, Shewanella sp. MR-7
MANKTVLFNKHLESNAKMVDFHGWDMPLNYGSQIEEHHAVRQDAGMFDVSHMTVVDVTGTDACAFLRKLLANDVAKLKVPGKALYGGMLDDNAGIIDDLITYYLTDTFYRVVVNSATREKDLAWIAKQSQGFDVTVTERPELAMIAVQGPNAKAKAAAVFSSEQNAAIEGMKPFFGKQAGSLFIATTGYTGEVGYEIIVPETEAEALWQALLDQGVKPCGLGARDTLRLEAGMNLYGLDMDETINPLAANMGWTIAWEPTDRDFIGRKALEALRDAGTDKLVGLVMEEKGVLRHDMPVFFTDAAGVEQQGVITSGTFSPTLGYSIAMARVPNSIGDTAEVEMRKKRVAVRVVAPNFVRNGKQAF

SEQ ID NO: 2949 - DNA, 1095 bp, Alkalilimnicola ehrlichei MLHE-1
  CDS (1)..(1095): transl_table=11
atgcaacgcaccccgctctatcgccgtcatcaggaagccggcgcccgcctggtggaatttgccggctggcagatgccgctggattacggctccgccctggccgaacaccgcgccgtgcgcgaggactgcggcctgttcgacgtctcccacatggccatcaccgatctcgagggccagggggcccgcgacgccctgcgcctgatcctcgccgccgatgtggcccggctcgacgaggccgcccccggcaaggccctctacggttgcctgctgaatgaggccggcggcatcatcgacgacctcatcgtcttccgccgcggcgcggaacgctaccgcatcgtctccaacgccgccacccggggcagcgtccagcgctggctggagcggctcactgcggccttcggcctgcagccggaggctcgtaccgacctggcaatgatcgcgctgcaggggccggccgcccccagtctcatcgaacagctgccggaggcagccgccgccgtgggcctgggcgccttcgaggccctggatggggagcggatcttcgtcagccgcaccggctacaccggcgaagacggcttcgaactgatcctgcccggcccccgggccagccaaacctgggaccacctggtggccgccggcgcccgaccctgcgggctggcggcccgggacagcctgcgcctggaggcgggcctgaacctgaacggccaggacatgaccccggagaccacgccgctggagtgcggcctgggctggaccgtgcactggacgccggaggatcgtgacttcatcggccgccatccgctggaggcccaacgccgggagggggcgccatggtgccggcagggcctggtcctgcgcgagcgcggcgtgccccgccacgggcatgcggtgctggacgccgccgaccgggtgatcggtgaggtcaccagcggcggctggtcgccggtattgcaacggggcattgccctggcccgggtgcccaacggcaccggggggccgctacgggtccgggtccgcgaccgcgccctgagcgccgagccggtccggccgcccttcgtccgcaatggcaagccgcgggtggacgtccccgactag

SEQ ID NO: 2950 - protein, 364 aa, Alkalilimnicola ehrlichei MLHE-1
MQRTPLYRRHQEAGARLVEFAGWQMPLDYGSALAEHRAVREDCGLFDVSHMAITDLEGQGARDALRLILAADVARLDEAAPGKALYGCLLNEAGGIIDDLIVFRRGAERYRIVSNAATRGSVQRWLERLTAAFGLQPEARTDLAMIALQGPAAPSLIEQLPEAAAAVGLGAFEALDGERIFVSRTGYTGEDGFELILPGPRASQTWDHLVAAGARPCGLAARDSLRLEAGLNLNGQDMTPETTPLECGLGWTVHWTPEDRDFIGRHPLEAQRREGAPWCRQGLVLRERGVPRHGHAVLDAADRVIGEVTSGGWSPVLQRGIALARVPNGTGGPLRVRVRDRALSAEPVRPPFVRNGKPRVDVPD

SEQ ID NO: 2951 - DNA, 1083 bp, Pseudomonas aeruginosa UCBPP-PA14
  CDS (1)..(1083): transl_table=11
atgggattgcgcaccccgctttacgagctgcacgtcgcgctcggcgccaagatggtcgatttcggcggttgggacatgccgctgcactacggttcgcaggtcgaggagcaccatcaggtccggcgtgactgcggcgtcttcgacgtgtcccacatgaccgtggtcgacgtcgccggcgagcaggccacggcctatctgcagcatctcctggcgaacgacgtggcgcgcctcggcgagaccggcaaggcgctctacagcgcgatgctcaacgaagagggcggggtggtcgacgacctgatcgtctacctgaccgagaacggctaccgggtggtggtcaacgcctccacccgcgacaaggacatcgcctggatgcaggcgcaggccgccggcttcaaggtcgacctgcaggaacgcggcgacctggcgatgctcgccatccagggccccaacgcccgcgtgcacagctccgaactggtatccccggcacgcgccgcgctgatacgcgaactcaagccgttccagggccgtgccgagggcgactggttcatcgcccgcaccggctacaccggcgaggacggcctggagatcatgctgccggccgccgaggcgccgggcttcctcaacgagctggttggcgccgggatctccccggcgggcctgggggcgcgcgatacgctgcgcctggaggccgggctcaatctctacggccaggacatggacgaaagcgtttccccgcttgccgccaacatgggctggaccgtagcctgggagccggttgcgcgggacttcgtcggccgccgcgcgctggaagcgcagaaggccgccggcgaccagccgaagctggtcggcctggttctggaggagcgcggcgtgctgcgcgcccaccaggtggtgcgggtagctggcattggtgagggggagatcaccagcggcagcttttcgcctaccctgaacaagtccatcgcgctggcccgcgtgccggccgccaccggcgaccgcgccgaggtggaaatccgcggcaagtggtacccggtacgggtggtccagcccagtttcgtgcgtcacggcaagcccctgatctaa

SEQ ID NO: 2952 - protein, 360 aa, Pseudomonas aeruginosa UCBPP-PA14
MGLRTPLYELHVALGAKMVDFGGWDMPLHYGSQVEEHHQVRRDCGVFDVSHMTVVDVAGEQATAYLQHLLANDVARLGETGKALYSAMLNEEGGVVDDLIVYLTENGYRVVVNASTRDKDIAWMQAQAAGFKVDLQERGDLAMLAIQGPNARVHSSELVSPARAALIRELKPFQGRAEGDWFIARTGYTGEDGLEIMLPAAEAPGFLNELVGAGISPAGLGARDTLRLEAGLNLYGQDMDESVSPLAANMGWTVAWEPVARDFVGRRALEAQKAAGDQPKLVGLVLEERGVLRAHQVVRVAGIGEGEITSGSFSPTLNKSIALARVPAATGDRAEVEIRGKWYPVRVVQPSFVRHGKPLI

SEQ ID NO: 2953 - DNA, 1104 bp, Solibacter usitatus Ellin6076
  CDS (1)..(1104): transl_table=11
atgccagcagagcccgctcttcgttccacacccctaaactctgtccatcgaggcctcaaggcgaagatggtcgatttcggcgggtgggacatgcccgtccagtattcgggcatcatcgatgagcacaacgcggtccgtaacgccgtcggcgtcttcgatgtcagccacatgggcgaaatcgagatccgcggacccgaggcggcgaaactgaccgaccacgtcaccaccaacgccgttcacaaactcaagctgggccaggcccattattccggcctgctctacgagcacggcggcttcgtggacgacattctggtacataaggtcgctgacgatcacttcttcctctgcgtcaacgcctctaatcaggacaaggacttcgaacacatccgcgcccacaacaagttcgacgccgtggtggagaacaacggcgaccgctacgcgcagattgcgatccagggcccgaaggccgcggccactctgcagaagctgacgcccgtggatcttggcgcgatcaagtattactggttcaccgatggcgaggtctccggcaccccggcccgcatcgcgcacaccggctataccggcgaagacggcttcgaaatctacgtgccgccctcggaggctgtgcgcatgtggcagctggtgatggacgccggcgccgaattcggcatcaagccgtgcggcctgggcgcccgcaacaccctgcggctggaggccaagatggcgctctacggccatgaaatcgacgcctcgatttcaccgctcgaggccgatctcggctggatcgtaaagctcgataagggcgagttcgtgggcagcgcggcgctacgcaaacagaaagagagcggcatccagcgcaaattgatcggctttgaaatgtgcgcccgcggcatcggccgcgacggctacgaagtcttcctcgatggcgccgccgccgggtgggttaccagtggttcgccttccccgaccctgaataagaacatcgggatgtgttatctacctacggcacagtcggtacctggcaagtcgattcagataatgatccgcaaccagccagtggatgcggtgacggtggaaaccccgttttacaaacgagcgaaataa

SEQ ID NO: 2954 - protein, 367 aa, Solibacter usitatus Ellin6076
MPAEPALRSTPLNSVHRGLKAKMVDFGGWDMPVQYSGIIDEHNAVRNAVGVFDVSHMGEIEIRGPEAAKLTDHVTTNAVHKLKLGQAHYSGLLYEHGGFVDDILVHKVADDHFFLCVNASNQDKDFEHIRAHNKFDAVVENNGDRYAQIAIQGPKAAATLQKLTPVDLGAIKYYWFTDGEVSGTPARIAHTGYTGEDGFEIYVPPSEAVRMWQLVMDAGAEFGIKPCGLGARNTLRLEAKMALYGHEIDASISPLEADLGWIVKLDKGEFVGSAALRKQKESGIQRKLIGFEMCARGIGRDGYEVFLDGAAAGWVTSGSPSPTLNKNIGMCYLPTAQSVPGKSIQIMIRNQPVDAVTVETPFYKRAK

SEQ ID NO: 2955 - DNA, 1116 bp, Magnetococcus sp. MC-1
  CDS (1)..(1116): transl_table=11
atgcataggagtaaacccatgtcccaacagacccctctctacccctaccatgtcgaggccggtgccaagatggtggatttcgcgggttggatgatgcccgtgagctatggctcacagttgcaagagcatcatcaagtgcggcaacatgtgggtatgtttgatgtgtgccatatggggcatgtacaggtaagcggccctcaggccaccgcctatttgcaatttttgttgtgtaatgatgtggccaagctccgtgaagcagggcaggccatctataccggcatgctcaacagctctggtggggtgattgatgatctcatcgtctaccgggatgacgaacagcactaccatgtggtggttaatgccgccaaccgggaaggggatgtgcagtggatgcaggatcgcgcccaggattttgaaggggttacggttacgctggatccccagttgggcatgatcgcggtgcaggggcctgaggctcagcaacgggtggcagaactcttcgctggggtggagctggaggcgctcaagacgtttcgctcgatcataatcgaggggggacgcattgcccgcaccggttataccggggaggatggttttgagctgatctttcccgcgcagaccatcataaccctatggacgcgcttgcaggcgatgcaggtgccccccatcggtttgggggcgcgggataccctgcggctggaagcagggttaaatctgtacggttcggatatggaccacaagattgatccgctggcctgtggtatgggttggacggtagcttgggagcccaccacccgcatgtttttagggcgggactatctggagctgctgcgggagtcggggggctccagccagcaacgggtggggttgattttgaccgataaaggggttttgcgggctggtcagcctgtgctgtttcatgggcgtcccagtgggcacgtcaccagcggtacgtggtccccaaccctagagcagggtatcgccatggcccgtgtggatgccagcatcgaaatcggccagatggtggatgtggtgattcgtaatcgtagcatgccagcccgcgtggtgggcttgccctttgtgcggcatgggcaggtggtttataaagcctcctaa

SEQ ID NO: 2956 - protein, 371 aa, Magnetococcus sp. MC-1
MHRSKPMSQQTPLYPYHVEAGAKMVDFAGWMMPVSYGSQLQEHHQVRQHVGMFDVCHMGHVQVSGPQATAYLQFLLCNDVAKLREAGQAIYTGMLNSSGGVIDDLIVYRDDEQHYHVVVNAANREGDVQWMQDRAQDFEGVTVTLDPQLGMIAVQGPEAQQRVAELFAGVELEALKTFRSIIIEGGRIARTGYTGEDGFELIFPAQTIITLWTRLQAMQVPPIGLGARDTLRLEAGLNLYGSDMDHKIDPLACGMGWTVAWEPTTRMFLGRDYLELLRESGGSSQQRVGLILTDKGVLRAGQPVLFHGRPSGHVTSGTWSPTLEQGIAMARVDASIEIGQMVDVVIRNRSMPARVVGLPFVRHGQVVYKAS

SEQ ID NO: 2957 - DNA, 1095 bp, Shewanella sp. ANA-3
  CDS (1)..(1095): transl_table=11
atggctaataaaactgttctgtttaacaagcacttagaatcaaacgctaagatggtcgacttccacggttgggatatgcccctcaactatggttcacaaatcgaagaacaccacgccgtgcgtcaagacgcaggtatgttcgacgtgtcccacatgactgtggttgatgtgaccggaaccgacgcttgtgcattcctccgtaagttgctggcaaacgatgtggccaaacttaaagttcctggtaaagccttatacggcggcatgttagatgacaatgccggcatcatcgacgacctgatcacttactacctgaccgacactttctaccgtgttgtcgtcaacagcgcgacccgcgaaaaagacttagcgtggatcgccaaacaatcccaaggttttgatgtcacggtgactgagcgtcctgagctggcgatgatcgccgttcaaggtcctaacgctaaggccaaagccgccgccgtattcagtgccgatcaaaatgccgccatcgaaggcatgaaacctttcttcggtaagcaagcaggttctctgtttattgctaccactggttatacaggtgaagtgggttacgagattatcgtgccagaaactgaagccgaagccctgtggcaagcactgttagatcaaggcgttaaaccatgtggtttaggcgctcgcgatacattacgtctcgaagccggtatgaacctctacggcttagatatggacgaaaccatcaacccgctggccgccaacatgggctggaccatcgcatgggagccaactgaccgtgactttatcggtcgtcaggcacttgaagccctgcgcgatgcgggtaccgacaaattagtcggtctggtgatggaagaaaaaggcgtgttacgccatgatatgccagtatttttcaccgatgcagcgggtgttgagcagcaaggcgtgatcactagcggtactttctcgccaacattgggctattctattgcgatggcgcgtgttcctaactcgattggggatacggcggaagtcgaaatgcgtaaaaagcgcgtggctgttagagtagtagcgccaaactttgtgcgcaacggtaaacaagcattttaa

SEQ ID NO: 2958 - protein, 364 aa, Shewanella sp. ANA-3
MANKTVLFNKHLESNAKMVDFHGWDMPLNYGSQIEEHHAVRQDAGMFDVSHMTVVDVTGTDACAFLRKLLANDVAKLKVPGKALYGGMLDDNAGIIDDLITYYLTDTFYRVVVNSATREKDLAWIAKQSQGFDVTVTERPELAMIAVQGPNAKAKAAAVFSADQNAAIEGMKPFFGKQAGSLFIATTGYTGEVGYEIIVPETEAEALWQALLDQGVKPCGLGARDTLRLEAGMNLYGLDMDETINPLAANMGWTIAWEPTDRDFIGRQALEALRDAGTDKLVGLVMEEKGVLRHDMPVFFTDAAGVEQQGVITSGTFSPTLGYSIAMARVPNSIGDTAEVEMRKKRVAVRVVAPNFVRNGKQAF

SEQ ID NO: 2959 - DNA, 1179 bp, Nostoc punctiforme PCC 73102
  CDS (1)..(1179): transl_table=11
atgcctaaaggcaagttgctccgcatctacgcaaaattacctgtggctaatcaagaagacaacacccaatctctggcgcgaacccctttatatcaagtgggtgtagaactcaaagcccgctttaccagctttggtggttgggaaatgcccgtgcaatttagtggcattagccgagaacatgaggctgtaagaaatgcagccggaatgttcgatatttcccacatgggtaaatttaccctccaaggtaaaaatctcatttcccaactccagtctctagtgccttcagacttgagccgattgcaacccggtcaagcacaatacaccgtattgttaaaccaccaagcgggaattattgacgacatcattgtttattaccaaggtgaagacaccactggtatacaaaaggcatttattatcgtcaatgcagcaacctctggtaaagataaagcatggattttacaacatcttgacctggataaagtgcaattccaagacctttcaccagataaagtcttaattgcggtgcaagggacaaaagcgattaaatatctccaacctttagtgcaagaagacttacaaccaatcaaagccttcggacatttagaagcaaccttactaggtaaacctgccttcctggcccgcacaggttacaccggagaagatggctttgaggtgatggtagacctagatgtgggagtagaattgtggcgaagtctccataaaagtggtgttatcccctgtggacttggtgcgagagacactctgcgcctagaagcagcaatggcactttacggacaagatattgatgacaccaccacacccttagaagcaggtttggggtggctagtccacttagataccaaaggtgattttattggaagagaagttttagcagagcaaaaatccaagggagtgaagcgtcgattggtaggtttacaaacccaaggacgcaatattgcccgtcatggctaccaagtgttatccacaggtaaagttgtgggagaagtttctagtggcactctgtcgcctacactgggttatcccattgctttagcttacgttcctacccaattagcaaccgttggtcaacagctagaagtcgaaattcgcggcaaagcttacccagcagttgtagttaaacgtcccttttatcggtcaaaaaatcgtgctgccaactga

SEQ ID NO: 2960 - protein, 392 aa, Nostoc punctiforme PCC 73102
MPKGKLLRIYAKLPVANQEDNTQSLARTPLYQVGVELKARFTSFGGWEMPVQFSGISREHEAVRNAAGMFDISHMGKFTLQGKNLISQLQSLVPSDLSRLQPGQAQYTVLLNHQAGIIDDIIVYYQGEDTTGIQKAFIIVNAATSGKDKAWILQHLDLDKVQFQDLSPDKVLIAVQGTKAIKYLQPLVQEDLQPIKAFGHLEATLLGKPAFLARTGYTGEDGFEVMVDLDVGVELWRSLHKSGVIPCGLGARDTLRLEAAMALYGQDIDDTTTPLEAGLGWLVHLDTKGDFIGREVLAEQKSKGVKRRLVGLQTQGRNIARHGYQVLSTGKVVGEVSSGTLSPTLGYPIALAYVPTQLATVGQQLEVEIRGKAYPAVVVKRPFYRSKNRAAN

SEQ ID NO: 2961 - DNA, 1119 bp, Burkholderia vietnamiensis G4
  CDS (1)..(1119): transl_table=11
atgactgccctgaatcacaccccgctcaacgccgcgcaccgcgcgctcaatgcccgcatggtcgacttcggcggctgggacatgcccgtcaactacggctcgcagatcgaagagcacgaagccgtgcgcaccgacgccggcatgttcgacgtgtcgcacatgtgcgtcgtcgatttcaccggcagccgcgtgcgcgcgttcttcgagcatgcgctcgcgaacaacgtcggcaagctcaagacgcccggcaaggcgctctactcgtgcctgctcaatccgcaaggcggcgtcatcgacgatctgatcgtctattacttcaccgaagacttcttccgcgtggtggtcaacgccggcacggccgagaaagacatcgcgtggttcaaccagctcaacgaacaaggcggatacggcctgacgatcgcgccgcgccgcgatttcgcgatcgtggccgtccaaggcccgaacgcccgtgaaaaagtctgggccaccgtgcccgccgcgcgcgccgcgacgagcgagctcaagccgttcaacgccgcgcaggtcgccggcacgccgttcggcgatctcaccgtcgcgcgcaccggctacaccggcgaagacggcttcgaagtgatcgtccccgccgtgcacgtcgtcgcgctctggaacgcgctgcagcaaaacggcgtgcgcccgtgcgggctcggcgcgcgcgacacgctgcgcctcgaggccggcatgaacctgtacggccaggacatggacgaaaccgtgtccccgctcgacgccggcctcgcatggacggtcgatctctccgccccgcgcgaattcgtcggccgccccgcgctcgagcgcgacggcacgcgcgccgcgttcgtcggcctgatcctgcagaaggaaaacggcaaggcgggcggcgtgctgcgcgcgcaccagaaagtcgtcacgccgcacggcgaaggcgagatcacgagcggcacgttctcgccgtcgatgcaggagtcgatcgcgttcgcgcgcgtgccggccgccgtccagctcggcgacatcgtccatgtgcagattcgagacaagcaacttcccgcgcgcgtggtaaaactgccgttcgtgcgcaacggcaaggtcctcgctgcgtaa

SEQ ID NO: 2962 - protein, 372 aa, Burkholderia vietnamiensis G4
MTALNHTPLNAAHRALNARMVDFGGWDMPVNYGSQIEEHEAVRTDAGMFDVSHMCVVDFTGSRVRAFFEHALANNVGKLKTPGKALYSCLLNPQGGVIDDLIVYYFTEDFFRVVVNAGTAEKDIAWFNQLNEQGGYGLTIAPRRDFAIVAVQGPNAREKVWATVPAARAATSELKPFNAAQVAGTPFGDLTVARTGYTGEDGFEVIVPAVHVVALWNALQQNGVRPCGLGARDTLRLEAGMNLYGQDMDETVSPLDAGLAWTVDLSAPREFVGRPALERDGTRAAFVGLILQKENGKAGGVLRAHQKVVTPHGEGEITSGTFSPSMQESIAFARVPAAVQLGDIVHVQIRDKQLPARVVKLPFVRNGKVLAA

SEQ ID NO: 2963 - DNA, 1095 bp, Crocosphaera watsonii WH 8501
  CDS (1)..(1095): transl_table=11
gtggctaattctcttttgcgcactcctttatacgatctcattgtagaacagaaagcgaaaatgacagcgttttctggttgggaaatgccggtacagtttactgggctaaagttagaacatcaaacggtaaggaacgaggtgggaatgtttgatatttctcacatggctaagtttagcttggagggagagggttggctttctctcttacagtctcttgttccttcggacttgagccgtttaaaccctggtcaagctcaatataccgtactattgaacccagatgggggcattatcgatgatattatcgtttactgtcaagggccagataaagctgtgattatcgctaatgcagccactaaagataaggataaacagtggatattatcgcatttagggacacacaaggttaattttagcgacttatctccagaaaaggttttattagccgtacaaggtccccaaacggtggaaaaattacagcccttcgtagaagcggatctaacgcaactatctttcttcggccacatagaaacccaggtattaggataccctgcttttatcgctcgcacgggatacactggagaggacggttttgaggtgatgatcgcctcggaaggtggacaagagttatggcgatcgctaattgaagccaatgtctctccttgtggtttaggggccagggataccctacgtttagaagcagctatgtgtctctatggacaagatatcgacgatcgcaccactcccttagaagctggtttaaaatggctggtgcatttggataaaaaagagcaatttatcgggcgagaggtattggaaaaacaagccacagaaggggttaaacggcgtttagtgggcttacaaatggaaggacgacatatcgcccgtcatgactatccggtggcttctgggggcaaaattgtcggggaggtgacaagcggtactatcggacccacattgggaaaggcgatctctttagcttatcttcctactgagttaagcaaaaaaggaacaactgttgaggtagaaatcagaggaaaattgtaccctgcgaaagtagttaaaaagcctttttatcggtcggaaaatcgttaa

SEQ ID NO: 2964 - protein, 364 aa, Crocosphaera watsonii WH 8501
MANSLLRTPLYDLIVEQKAKMTAFSGWEMPVQFTGLKLEHQTVRNEVGMFDISHMAKFSLEGEGWLSLLQSLVPSDLSRLNPGQAQYTVLLNPDGGIIDDIIVYCQGPDKAVIIANAATKDKDKQWILSHLGTHKVNFSDLSPEKVLLAVQGPQTVEKLQPFVEADLTQLSFFGHIETQVLGYPAFIARTGYTGEDGFEVMIASEGGQELWRSLIEANVSPCGLGARDTLRLEAAMCLYGQDIDDRTTPLEAGLKWLVHLDKKEQFIGREVLEKQATEGVKRRLVGLQMEGRHIARHDYPVASGGKIVGEVTSGTIGPTLGKAISLAYLPTELSKKGTTVEVEIRGKLYPAKVVKKPFYRSENR

SEQ ID NO: 2965 - DNA, 1107 bp, Xylella fastidiosa Dixon
  CDS (1)..(1107): transl_table=11
atgatcaaaaagaccattctcaatgacacccatcgagcactcggtgccaagatggtcgacttcagcggctgggaaatgcccattcactacggctcacagattgatgagcatcatcacgtcaggcgtaacgccggcatattcgacgtcagtcatatgaccgtcattgatttgcacgggacacaggtacgccccctcttgcgtcgactattagctaattcggtagataagctcaaagtacccggaaaagcactgtatagctgcatgttgaatccgcaaggcggtgtaatcgacgatttgatcgtctattacctacgtgaagattactttcgttttatcgtcaacgccgctacacgagaaaaggatttagcatggatcaatacacaagcatctgcgttcaacgtacgcgttgaagagcgtgcagacttggcaatgctcgccgtacaggggcctgccgcgcgcgcgcaggtcaccaacctattggccgagactcaccgcgacgcagtggaaaagctcggacgtttcgctgcactagaagtcgcatcgcactcgaaaaaaaccctctttatttcacgtactggatataccggtgaggacggctttgagatcttacttccacaagaagaaacgataacgttatggaatgcgctgttgaagacaggcgtgaaaccaatcggactaggcgcacgcgatacgttacgtctagaggcagggatgaatctctacggccaggatatggacgagcaggtttcaccctacgaagcagcactgggctggactgtcatgcttgatgaaggtcgcaacttcatcggtcgcaacgtgctggaacagcaaaagactaacggcgtatcacggcagatgataggcctactcatggatgagaagggagtgcttcgccatggtcagaaagtattgaccgcacaaggcgagggccacatcctttccggtacgttttcaccaaccttgaacaaggctatcggattcgcgcgcgtgccagccggaaaaccaagtgaggtccgggtcaacatacgtgaccgtgcaatccctgtgcgggttgtcaaattcccctttgtacgtgaaggccagacgcaaccaaacatttttgattga

SEQ ID NO: 2966 - protein, 368 aa, Xylella fastidiosa Dixon
MIKKTILNDTHRALGAKMVDFSGWEMPIHYGSQIDEHHHVRRNAGIFDVSHMTVIDLHGTQVRPLLRRLLANSVDKLKVPGKALYSCMLNPQGGVIDDLIVYYLREDYFRFIVNAATREKDLAWINTQASAFNVRVEERADLAMLAVQGPAARAQVTNLLAETHRDAVEKLGRFAALEVASHSKKTLFISRTGYTGEDGFEILLPQEETITLWNALLKTGVKPIGLGARDTLRLEAGMNLYGQDMDEQVSPYEAALGWTVMLDEGRNFIGRNVLEQQKTNGVSRQMIGLLMDEKGVLRHGQKVLTAQGEGHILSGTFSPTLNKAIGFARVPAGKPSEVRVNIRDRAIPVRVVKFPFVREGQTQPNIFD

SEQ ID NO: 2967 - DNA, 1107 bp, Xylella fastidiosa Ann-1
  CDS (1)..(1107): transl_table=11
atgattaaaaagaccattctcaatgacacccatcgagcactcggtgccaagatggtcgacttcagcggctgggaaatgcccattcactacggctcacagattgatgagcatcatcacgtcaggcgtaacgccggcatattcgacgtcagtcatatgactgtcattgatttgcacgggacgcaggtacgccccctcttgcgtcgactattagctaattcggtagataagctcaaagtaccaggaaaagcactgtatagctgcatgttgaatccgcaaggcggtgtaatcgacgatttgatcctctattacctacgtgaagattactttcgttttatcgtcaacgccgctacacgagaaaaggatttagcatggatcaatacacaagcatctgcgttcaacgtacgcgttgaagagcgtgcagacttggcaatgctcgccgtacaggggcctgccgcgcgcgcgcaggtcaccaacctattggccgagactcaccgcgacgcagtggaaaagctcggacgtttcgccgcactagaagtcgcatcgcactcgaaaaaacccctctttatttcacgtactggatataccggtgaggacggctttgagatcttacttccacaagaagaaacgataacgttatggaatgcgctgttgaagacaggcgtgaaaccaatcggactaggcgcacgcgatacgttacgtctagaggcagggatgaatctctacggccaggatatggacgagcaggtttcaccctacgaagccgcactgggctggactgtcatacttgatgaaggtcgcaacttcatcggtcgcaacgtgctggaacagcaaaagactaacggcgtatcacgacagatgataggcctactcatggatgagaagggagtgcttcgccatggtcagaaagtattgaccgcacaaggtgagggccacatcctttccggtacgttttcaccaaccttgaacaaggctatcggattcgcgcgcgtgccagccggaaaaccaagtgaggtccgagtcaacatacgtgaccgtgaaatccctgtgcgggttgtcaaattcccctttgtacgtgaaggccagacgcaaccaaacatttttgattga

SEQ ID NO: 2968 - protein, 368 aa, Xylella fastidiosa Ann-1
MIKKTILNDTHRALGAKMVDFSGWEMPIHYGSQIDEHHHVRRNAGIFDVSHMTVIDLHGTQVRPLLRRLLANSVDKLKVPGKALYSCMLNPQGGVIDDLILYYLREDYFRFIVNAATREKDLAWINTQASAFNVRVEERADLAMLAVQGPAARAQVTNLLAETHRDAVEKLGRFAALEVASHSKKPLFISRTGYTGEDGFEILLPQEETITLWNALLKTGVKPIGLGARDTLRLEAGMNLYGQDMDEQVSPYEAALGWTVILDEGRNFIGRNVLEQQKTNGVSRQMIGLLMDEKGVLRHGQKVLTAQGEGHILSGTFSPTLNKAIGFARVPAGKPSEVRVNIRDREIPVRVVKFPFVREGQTQPNIFD

SEQ ID NO: 2969 - DNA, 1134 bp, Prochlorococcus marinus str. MIT 9211
  CDS (1)..(1134): transl_table=11
atggtcagcaaacgaactcctctatatgaaaactttcggaaagaaggtgctcacatggtttctttcgcaggatgggaaatgcctattcatttctctggactagtacttgagcatcatgcagtaagaaaaaaagctggaatattcgacatttctcatatgggtgttctacttattcaaggaaaaagcgtcaaagataatttacaaaagttggtgccatccgatctttatcaaattggctctggagaagcatgctacacagtcctactcaacaagcatggaggaatcattgatgatttaattatttacgatttgggcgtaaatgatcaaaacatagaatctctgatgcttgtgatcaacgcttcctgtagtgattcagatactaattggataaaagctaatcttcagaatcaatccatttcaattaacgatgcaaaaaaagatggcgttttattagctgtacaaggtcctgattcagaaaaaagccttaacaaaatttttggttcaacctttgaagaatcaatcagtaatctgcctcggtttggacatagaaagttgaaattacaatttcaaagaactaaaaaaccgtgcccggtatttattgcaaaaactggctacacaggagaagaaggctatgaactcctcctagagaaggagatgggtataactctttgggaagaattagtaaaatcaggtgtcactccttgcggactgggcgcaagagatacgctgagactggaagctgcaatgcatttatatggaaatgatttaaacgaagaaactaccccctttgaagcaggtctaggatggttagttcatctagaaatgcccaaaacatttattggtagagaggccctagaaaaacaaattgagaaaggagtatccaaacttttagttggattagtaattcaagatgaacgcgctattgctcgtaaaggctatgaggtaatttatgaaaataaacctatcggtaagataaccagcggaagttggtctcctactcttgaaaaagctattgcactagcatatatacccaaacaaatggcccaaataggaaccgaggtgtatgtgaaaatcagaaacaagctacatcccgctaaagttgtaaagaaaccgttttatcgcaggatttcctga

SEQ ID NO: 2970 - protein, 377 aa, Prochlorococcus marinus str. MIT 9211
MVSKRTPLYENFRKEGAHMVSFAGWEMPIHFSGLVLEHHAVRKKAGIFDISHMGVLLIQGKSVKDNLQKLVPSDLYQIGSGEACYTVLLNKHGGIIDDLIIYDLGVNDQNIESLMLVINASCSDSDTNWIKANLQNQSISINDAKKDGVLLAVQGPDSEKSLNKIFGSTFEESISNLPRFGHRKLKLQFQRTKKPCPVFIAKTGYTGEEGYELLLEKEMGITLWEELVKSGVTPCGLGARDTLRLEAAMHLYGNDLNEETTPFEAGLGWLVHLEMPKTFIGREALEKQIEKGVSKLLVGLVIQDERAIARKGYEVIYENKPIGKITSGSWSPTLEKAIALAYIPKQMAQIGTEVYVKIRNKLHPAKVVKKPFYRRIS

SEQ ID NO: 2971 - DNA, 1101 bp, Synechococcus sp. RS9917
  CDS (1)..(1101): transl_table=11
atggacctgaagcgcacgcccctgcacgacctctgtctggcggccggggctcgcatggttcccttcgcgggctgggagatgcccctgcaattctccggtctgctggcggagcaccgggctgtccgcgaggcggcgggcctgttcgacatctcccatatgggcgtggtgcgcctggacgggaccaaccccaaggatgcgctccaagggctggtgccaagcgacctgcaccggatcgggcctggccaggcctgctacaccgtgctgctcaacgccaacggcggcattctcgacgatctgatcgtgtacgacctcgaggatggcgcccttctcctggtgatcaatgcggcctgcgcagcccgtgacaccgcctggttgcgcgaccacctggaaccggccgggatccacctcagcgatgtcaaaggggatggcctcctgctcgccctgcagggaccggaggccaggcaacatctcgaagcattgtccggtaacgatctgcaggaactgccacgcttcggccaccgctggctacagatcagcggcctgacacccgagcccacccgggtgctggcagcacgcacgggttacacgggtgaagacggttttgaactgctgctgccgcgcgaagcgggtcgggccctctggtcacagctcctggagcggggggtgcgcccctgcgggctgggtgcacgcgacagcctgcgcctggaagcggcgatgcatctctatggtcaagacatggatcagaacaccagccccctgcaagcggggctcggctggctggtgcacctggagaacccggtgccgttcatcggccgcgatgccttggagcgagaggtcgagcagggcagcgagcgacgtctggtgggcctgcgcctggagggacgggcgattccgcgccatggctatccgatcctgcacgacggccaacccgtgggcaccatcaccagcggcggctggtcaccaacgctggaagcgggcatcggcctcggctacgtgagccgctctctggcccgcgcaggcaccgatctggcggtggagatccgaggccaacagcagcccgccacggtggtgaagcgacccttctacaggcgcccgggctga

SEQ ID NO: 2972 - protein, 366 aa, Synechococcus sp. RS9917
MDLKRTPLHDLCLAAGARMVPFAGWEMPLQFSGLLAEHRAVREAAGLFDISHMGVVRLDGTNPKDALQGLVPSDLHRIGPGQACYTVLLNANGGILDDLIVYDLEDGALLLVINAACAARDTAWLRDHLEPAGIHLSDVKGDGLLLALQGPEARQHLEALSGNDLQELPRFGHRWLQISGLTPEPTRVLAARTGYTGEDGFELLLPREAGRALWSQLLERGVRPCGLGARDSLRLEAAMHLYGQDMDQNTSPLQAGLGWLVHLENPVPFIGRDALEREVEQGSERRLVGLRLEGRAIPRHGYPILHDGQPVGTITSGGWSPTLEAGIGLGYVSRSLARAGTDLAVEIRGQQQPATVVKRPFYRRPG

SEQ ID NO: 2973 - DNA, 1137 bp, Synechococcus sp. WH 5701
  CDS (1)..(1137): transl_table=11
atggcggactccctgaagcgaacgcctctgcatggggcctgccgcgacgccggcgcccgcctggtgcccttcgagggctgggagatgcccgtgcagttccagggcctggtgcaggaacacaaggccgtgcgtcaggcctgcggcgtcttcgacatctcccacatgggtgtgctgcgcctgcggggtgatggcgccaaggacgccctgcaggctctggtgcccagcgatctgttccggattggcccgggtgaggccacctacaccgtgctgctcaacgaggccggcggcatccgcgacgatctgatcgtctacgacctcggccggcctgaagacgacgaaggcccagccgatgaagtgctgctgatcatcaacgccggctgcgccgaggccgacaccgcctggctgcgcagccagctggagccctctggtctggtgatcaccgaccgcaaggccgatggggtgctgctggccctgcagggccccgaggcgatcgcccggctggaggctctggccgcaaccgatctgggcggcctgccccgcttcgggcaccgcagcatccagctggccggcaccgcggcggcggaagccgccggcgccaccgccttcgtggcccgcaccggctacaccggcgaagacggcgtggagctgctgctggatcgcgccgccggcgtggccctctgggcccagctgctggcggagggggtgaccccctgcggcctcggtgcccgcgacaccctgcgcctggaggcggccatgcacctctatggcagcgacatgaacagcaccaccactcctctggaggcctccctgggctggctggtgcacctggagatgccggcggcgttcatcggccgggaggtgctggagcgccagagcgccgagggggtgagccggcgcctggtggggctgaagctgcagggccgggcgattgcgcgccatggctatccggtgctgcgcgctggccaggtggtgggggaggtcaccagcggcacctggtcgcccaccctgggggaggcgatcgccctggcctacgtgccggccgacgccacccgggtgggcaccgaactggcggtggagatccgcggaaaggcggagccagccgtggtggtgaagcggcccttttaccggcgcgcctga

SEQ ID NO: 2974 - protein, 378 aa, Synechococcus sp. WH 5701
MADSLKRTPLHGACRDAGARLVPFEGWEMPVQFQGLVQEHKAVRQACGVFDISHMGVLRLRGDGAKDALQALVPSDLFRIGPGEATYTVLLNEAGGIRDDLIVYDLGRPEDDEGPADEVLLIINAGCAEADTAWLRSQLEPSGLVITDRKADGVLLALQGPEAIARLEALAATDLGGLPRFGHRSIQLAGTAAAEAAGATAFVARTGYTGEDGVELLLDRAAGVALWAQLLAEGVTPCGLGARDTLRLEAAMHLYGSDMNSTTTPLEASLGWLVHLEMPAAFIGREVLERQSAEGVSRRLVGLKLQGRAIARHGYPVLRAGQVVGEVTSGTWSPTLGEAIALAYVPADATRVGTELAVEIRGKAEPAVVVKRPFYRRA

SEQ ID NO: 2975 - DNA, 1110 bp, Synechococcus sp. WH 7805
  CDS (1)..(1110): transl_table=11
atggatctgcaccgcaccccgctccatgacctctgcgtaactaacggtggccggatggtgccgtttgccggctgggacatgcctgttcagttctcgggtctgatcaacgagcacacagcggtgcggcagaagatggggctgttcgacatctcccatatgggagtgctgcgcatccacggcatcaaccccaaggacgccctgcaaaccctggtaccgaccgacctgcatcgcattggccctgggcaggcctgctattccgtgcttctcaacgaatccggagggatccgcgacgacctgatcatctacgacctgggcgaatcgaccgcagaccatgggaaagcaagtttgatcgtggtgatcaacgccgcctgtgctgcagccgataccgcctggattacagaacagctcacgccctggggactgcagatcaccgatgaaaaggctgatggtgtcttgctcgccctccaaggacctgaagccttggcatggatgcagcacctcagcggcgtcgacctgaagaagttgccccgcttcgcgcaccgcacgtttgaagtcccgggtctgtctcgtcctgttttctgtgcccgaaccggatacaccggggaagacggcgtggagctgctgctcggacgtgatgacgggcggagcctctggaaccgtctggttgccgaaggagtgaccccctgcggcctcggtgcacgggacactcttcgcctggaggccgccatgcatctctacggccaagatatggatgctgacaccacgccattcgaggcgggcctgggctggctcgtgcacctggagatgcccgcgaccttcaccggccgttctgcccttgagcgggctgttgaaaccggaccatcccgtcgactggtgggcctgaagctgaagggacgcgccattgctcgccacggttacccggtgatccacaacggtgaacaggccggttcgatcaccagcggcagctggtcacccacactccaggaagcgattgccctcgcctacgttccaaacaacctggccaaggtggggcaggaacttggcgtggaaatccgcggccagattcaaagcgccacggtcgtcaaacgtccgttttaccgccatccctaa

SEQ ID NO: 2976 - protein, 369 aa, Synechococcus sp. WH 7805
MDLHRTPLHDLCVTNGGRMVPFAGWDMPVQFSGLINEHTAVRQKMGLFDISHMGVLRIHGINPKDALQTLVPTDLHRIGPGQACYSVLLNESGGIRDDLIIYDLGESTADHGKASLIVVINAACAAADTAWITEQLTPWGLQITDEKADGVLLALQGPEALAWMQHLSGVDLKKLPRFAHRTFEVPGLSRPVFCARTGYTGEDGVELLLGRDDGRSLWNRLVAEGVTPCGLGARDTLRLEAAMHLYGQDMDADTTPFEAGLGWLVHLEMPATFTGRSALERAVETGPSRRLVGLKLKGRAIARHGYPVIHNGEQAGSITSGSWSPTLQEAIALAYVPNNLAKVGQELGVEIRGQIQSATVVKRPFYRHP

SEQ ID NO: 2977 - DNA, 1080 bp, Pseudoalteromonas tunicata D2
  CDS (1)..(1080): transl_table=11
atgacaaataaaacagttcttcacgctaagcacatcgaagctggcgctaaaatggtagattttcacggttgggaaatgccaatcaactacggttctcaaatcgaagagcacaacgcagtgcgcaccgatgcgggcatgtttgacgtatctcacatgacaatcgttgatgtgaaaggggccgatgccaaagcattcttacgcaaattagttgcaaacgatgttgctaaattaactgtaccgggtaaagcgctttacactggcatgttaaaccacgaaggtggtgtgattgacgacctaatcatttatttcttcagcgaaacagattaccgcttagttgtaaactcagccacacgcgaaaaagacttagcatggattgcacaaatctctgctgattttgccgttgaagtgactgagcgcccagagtttgcaatgattgcggtacaaggccctaatgcaaaagcaaaaacagccaccgtattaagtgcagcgcaaaacgctgcaattgaaggtatgaagccattttttggtgttcaagccgacaacttatttatagcaaccacgggttataccggtgaagcgggttatgaaattgttgttcataacgacgaagctgctgatttatggcaaaaattattagatgcgggtgttgcacctgctggtttaggcgcacgtgatacgctacgtttagaagcgggtatgaacctatatggtttagatatggatgaaactgtatcaccacttgctgctaatatggggtggaccattacatgggaaccagaagatcgtgatttcatcggccgcgctgctttagttaaacaaaaagcagaaggtgtcgataaattggttggtttagtctatgaagataaaggtgtattacgctcaggcagtaaagtcatcgtagaaggtggcgaaggtgtaatcacttctggtacattctcaccaaccttaggttacagtatcgcgcttgctcgcgtaccaaataccgttggtgagactgcgcaagtagaaatgcgtaaaaaattagttgacgtaaaagtggtggcaccatcatttgtacgttttggtaaaaaaataatttaa

SEQ ID NO: 2978 - protein, 359 aa, Pseudoalteromonas tunicata D2
MTNKTVLHAKHIEAGAKMVDFHGWEMPINYGSQIEEHNAVRTDAGMFDVSHMTIVDVKGADAKAFLRKLVANDVAKLTVPGKALYTGMLNHEGGVIDDLIIYFFSETDYRLVVNSATREKDLAWIAQISADFAVEVTERPEFAMIAVQGPNAKAKTATVLSAAQNAAIEGMKPFFGVQADNLFIATTGYTGEAGYEIVVHNDEAADLWQKLLDAGVAPAGLGARDTLRLEAGMNLYGLDMDETVSPLAANMGWTITWEPEDRDFIGRAALVKQKAEGVDKLVGLVYEDKGVLRSGSKVIVEGGEGVITSGTFSPTLGYSIALARVPNTVGETAQVEMRKKLVDVKVVAPSFVRFGKKII

SEQ ID NO: 2979 - DNA, 1107 bp, Oceanospirillum sp. MED92
  CDS (1)..(1107): transl_table=11
atgggtaataaaaccgcactgtacgataagcaccaggaaatgggtgcgaagctggttgattttggcggctgggatatgccgatccattacggttcacaagttgatgagcaccataaggtccgccaggaagcgggcatgtttgacgtctcccatatgacggttgtagacgtaaccggtactgatgcaaaagaatatttaagatacttgctggccaacgatgttgctaaactgcagcagaaaggtaaagcaatgtatagcggcatgctcaatgaagatgccggggtcattgatgacctcatcgtttatctgatgactgagccaggtgttgctggtgaatggttccgagtagtggtgaactgtgcaacacgagagaaagatctgcgctggatgtcagatcaaacagcgagctttgatgacgttgcgctgactgagcagcctgatctggcgatggtagcggttcagggccctaaagcacttgaactggctaagcagtctgtatctgaatcccgtgcaacgctcattgatcagttaagcgtatttcagggcttagaatccgaaggctggtttattgccagaactggctatactggtgaggatggccttgagatcatgctgccggaagatgaggttgctgatttttggcaagcactcgctgatgcgggtgtaagcccgtgcggcctgggggcgcgagacacgcttcgtttggaagccggtatgaacctctacggtgctgatatggatgaaacggtatccccgttagccgctaacatggggtggaccattgcctgggaaccgcaggagcgtatttttatcggccgcgaagcgttacaggcgaaaaaagaggctgggatatctgagaaattagttggcctggtcatggaatcccgtggtgtgcttcgagcgcatcaaaaggtcgttgtgagtggtgttggcgaaggtgagattaccagtggtactttttcgcctacactaggatgtgcaattgcgatggcaagagtgccatctgcgactgcagatcaagccgaagtggatatcagaggaaaattagtccctgtgcgggttattcgtccctcttttgttcgtaatggcaaaaaagtttttgactga

SEQ ID NO: 2980 - protein, 368 aa, Oceanospirillum sp. MED92
MGNKTALYDKHQEMGAKLVDFGGWDMPIHYGSQVDEHHKVRQEAGMFDVSHMTVVDVTGTDAKEYLRYLLANDVAKLQQKGKAMYSGMLNEDAGVIDDLIVYLMTEPGVAGEWFRVVVNCATREKDLRWMSDQTASFDDVALTEQPDLAMVAVQGPKALELAKQSVSESRATLIDQLSVFQGLESEGWFIARTGYTGEDGLEIMLPEDEVADFWQALADAGVSPCGLGARDTLRLEAGMNLYGADMDETVSPLAANMGWTIAWEPQERIFIGREALQAKKEAGISEKLVGLVMESRGVLRAHQKVVVSGVGEGEITSGTFSPTLGCAIAMARVPSATADQAEVDIRGKLVPVRVIRPSFVRNGKKVFD

SEQ ID NO: 2981 - DNA, 1089 bp, Rickettsiella grylli
  CDS (1)..(1089): transl_table=11
atggaaaataaaacaattcttcacggacagcataaaaaaaatggggcgatactcgtcaattttgccggctgggaaatgccgttgcattatggttcacaaatacaagaacatcatgttgtcagacaagacagtggtttatttgatgtttcgcacatgcttgctgtcgatattataggtcaagccgcattaccctatcttagttttttattcgctaacaatccgcaacgtcttattccgggaaaagccttatatacctgcatgttaaatgatgccggtggagtcttagacgatttaattgtgtatcaactttctgaacacatttatcgtatcgtcattaacgccgcgaatcggcactctgatctggattggatgaaaaaacaagcgcagaatttcccgacgatttcgatcgttgaacggaccgatctcgccattattgccattcaaggtcctcatgcgataacaaaaacgctacaagccttcaatgcgcatcaacagtccttaataagcgcattaaagccgtttcattgtctccacgataatcattggtttatcgcaagaaccggttataccggtgaggatgggctcgaggttattttacccctgcatgaagcggaaaatttctggcaacgtctcattgaattagggagtaaaccatgcggattaggcgcacgggataccttgcgactcgaagcaggattaaatttacaaggttcagatatggatatcaccacgactcctttagaatccaacctggcgtggaccgtggcgtgggatccgattgatcgcagttttatcggccgtcaagcactcaaccaacaaaaagaaaatctcacgcgcaaacttgttgggttggtactcgaagaaaaaggacgtattctacgtaaccatcaaaaaattattacaccaaaaggagaaggtgaaatcaccagcgggagttactcaccgacgttaggtacttccattgcgttgggtagaatcccttacgcacaccatgaagattattgtgatgttatcatgggcacgaagcaatacaccgcacgtatcgttaaacctccttttatacgaaaaggaaaaaaaacgtttcactaa

SEQ ID NO: 2982 - protein, 362 aa, Rickettsiella grylli
MENKTILHGQHKKNGAILVNFAGWEMPLHYGSQIQEHHVVRQDSGLFDVSHMLAVDIIGQAALPYLSFLFANNPQRLIPGKALYTCMLNDAGGVLDDLIVYQLSEHIYRIVINAANRHSDLDWMKKQAQNFPTISIVERTDLAIIAIQGPHAITKTLQAFNAHQQSLISALKPFHCLHDNHWFIARTGYTGEDGLEVILPLHEAENFWQRLIELGSKPCGLGARDTLRLEAGLNLQGSDMDITTTPLESNLAWTVAWDPIDRSFIGRQALNQQKENLTRKLVGLVLEEKGRILRNHQKIITPKGEGEITSGSYSPTLGTSIALGRIPYAHHEDYCDVIMGTKQYTARIVKPPFIRKGKKTFH

SEQ ID NO: 2983 - DNA, 1098 bp, Oceanobacter sp. RED65
  CDS (1)..(1098): transl_table=11
atgggccacaaaacgccgttatatcaagcgcacatcgatgctcaaggcaaaatcgtcgactttggtggctgggatatgccaatccactatggttcacagatccaagagcataacgctgttcgcgaagatgcaggcatgttcgacgtgagtcacatgacagtggttgacatcacaggcagtgatgcgactgcttatttgcaatatctactggcgaacgatgtagccaaactcaaaaccgaaggtaaggcgctatatacaggaatgctcaatgagcaaggcggtgtcattgatgacctcatcgtctataaggctgagcatcttggtggttaccgcttggtagtgaactgcgctacacgtgaaaaagatttggcttggatggaaaaacacagccataaattcaatgttgccctatcagagcaaccagaattagccatgatcgctgtacaaggtcccaatgcgatcgagaaagcaaagcaggcagcttcagaaaaagtcgccgctgtaattgaacagttggcagtattccaaggcctgccttgtggtgattggttcatcggccgcacgggttacaccggtgaagatggtcttgaaatcatggttcctgccgacgaagcagtagcgttctggaatgcgcttttagaagcagacgtgaagcctgcaggcttgggcgcccgcgataccttgcgcttagaagcaggcatgaatctatatggtaatgacatggacgaaactgtttcgccttggcaagccgctatgggttggactctagccttaaaagacgaccgcgaatttatcggtaaaaaggcattgctggccgaaaaagaagccggtatcgagtacaagcttgttggtttagtactggaaacccgtggcgtaatgcgtagccatcaaaaagttattttcacaggtagcgacaagactggcgaaatcacctctggcacgttcagcccgacactgcagcagtctattgcgttagctcgagttccgcgcgatacaggcacagagtgcgcggttgatatgcgaggcaaagcggtgcctgtacgcatggttagcgtaccatttgtgcgcaatggcgaaaaagtttacaaacccgtttaa

SEQ ID NO: 2984 - protein, 365 aa, Oceanobacter sp. RED65
MGHKTPLYQAHIDAQGKIVDFGGWDMPIHYGSQIQEHNAVREDAGMFDVSHMTVVDITGSDATAYLQYLLANDVAKLKTEGKALYTGMLNEQGGVIDDLIVYKAEHLGGYRLVVNCATREKDLAWMEKHSHKFNVALSEQPELAMIAVQGPNAIEKAKQAASEKVAAVIEQLAVFQGLPCGDWFIGRTGYTGEDGLEIMVPADEAVAFWNALLEADVKPAGLGARDTLRLEAGMNLYGNDMDETVSPWQAAMGWTLALKDDREFIGKKALLAEKEAGIEYKLVGLVLETRGVMRSHQKVIFTGSDKTGEITSGTFSPTLQQSIALARVPRDTGTECAVDMRGKAVPVRMVSVPFVRNGEKVYKPV

SEQ ID NO: 2985 - DNA, 1098 bp, Desulfitobacterium hafniense DCB-2
  CDS (1)..(1098): transl_table=11
gtgacggaactaaaaagaacaccactgtatgagcagcaccgccgggccggtgcgaagctcattgatttcggcggctgggaaatgccggttcaatacgccggagtcattgaggagcacaaggccgtgcgcagcaaagcggggctttttgatgtctctcatatgggtgaggtggagttgaagggaaaggatagccttgcttttttgcagtacctattgaccaatgatgtgtcgcgaattcaggataaccagattcagtattcccccatgtgcacctctgctgggggtgtggtggatgatctgctggtctatcgttatagccgggagcattttttgctggtggtcaatgcctccaatacggataaggattttgcctggatgcaggctcaagctgagggcttcgaaataagtctggaaaatcgctccggggactttgcccaattggctttgcaaggcccttgggcggagaaaatcctgcaaaagctgacaagtatggatttagcacagatcaactactattggtttaagcatggggaagtggacggagtcctttgcctgatttccaggacaggttataccggggaagacggctttgaaatttacctgcctcccgagcatgctccccggatgtgggaaagaattctcgaggttggagggtcggagggagttcagcccattggtctgggcgcccgggatactctccgttttgaagccaggctgcctttatacggcaatgaactggggccggatatcacacctttggaggccgggctagggttttttgtcaagctggagaaggataactttatcggtaaagaggcgttatcagcccagaaggaaaagggagtgccgagaaagttggtaggcctggaaatgatcgaacggggcatagcccgctcccattatccccttcagaaagagggtaaagaaatcggctttattacttcaggttctttttcacctactttaaacaaaaacattgcccttggcttgattcccccggagtatgctcaaataggggaaaccttggatgtgatcattcgtgggaaagccgttaaagcccggattattccttcactgttctacaaacggcaggggtaa

SEQ ID NO: 2986 - protein, 365 aa, Desulfitobacterium hafniense DCB-2
MTELKRTPLYEQHRRAGAKLIDFGGWEMPVQYAGVIEEHKAVRSKAGLFDVSHMGEVELKGKDSLAFLQYLLTNDVSRIQDNQIQYSPMCTSAGGVVDDLLVYRYSREHFLLVVNASNTDKDFAWMQAQAEGFEISLENRSGDFAQLALQGPWAEKILQKLTSMDLAQINYYWFKHGEVDGVLCLISRTGYTGEDGFEIYLPPEHAPRMWERILEVGGSEGVQPIGLGARDTLRFEARLPLYGNELGPDITPLEAGLGFFVKLEKDNFIGKEALSAQKEKGVPRKLVGLEMIERGIARSHYPLQKEGKEIGFITSGSFSPTLNKNIALGLIPPEYAQIGETLDVIIRGKAVKARIIPSLFYKRQG

SEQ ID NO: 2987 - DNA, 1083 bp, Alteromonadales bacterium TW-7
  CDS (1)..(1083): transl_table=11
atgacttctaaaactgtactccatgctaagcacctagaagcgggcgcaaaaatggttgattttcatggctgggaaatgccaatcaactacggctcacaaatagaagaacataatgcagtgcgtaacgatgcaggcatgtttgacgtatcacacatgaccattgttgatattgaaggcgaccaagctaaagcatttttacgaaaacttgtagcaaacgacgtggctaaattaaccgtaccaggtaaagcactttacaccggcatgcttaacgagcaaggcggcgtaattgacgaccttattatttactttttcagcgaaacgttttaccgcttagtggttaactcggctacgcgcgaaaaagacttagcgcacttagctaatgtatcgagcgattttgccgttacagtgactgagcgtccagagtttgcaatgattgcagtgcaaggccctaacgcacgcgaaaaaacaggcacgcttttaaatgcagagcaacaagctgcagttgaaggcatgaagccgttttttggtgttcaagtgggtgatttatttattgctacaacgggttatactggcgaagacggttacgaaattgtagtaccaaacgaccaagcagccgatttatggcaacaactgctagacgcaggtgtagcgccagctggtttaggtgcacgtgacacgctacgtttagaagcaggtatgaacctttacggcctagatatggacgaaagcgtatcgccacttgcagctaacatggcatggaccattgcatgggaaccagaagatcgtgactttattggccgtgacgtactggttaaacaacgcgctgaaaaaagcaccgacaagcttgttggtttagtacttgaagaaaaaggcgtattgcgtagcggttcaaaagtaattgttgacggtggagaaggggttattacctcaggtactttttcacctacacttggttttagtgtagcccttgcacgtgtaccacgttcaacaggcgacactgctcaagtagaaatgcgcaaaaaattagttaacgttaaagtagtgaagcctagctttgtacgtaacggtaaatcaataatttaa

SEQ ID NO: 2988 - protein, 360 aa, Alteromonadales bacterium TW-7
MTSKTVLHAKHLEAGAKMVDFHGWEMPINYGSQIEEHNAVRNDAGMFDVSHMTIVDIEGDQAKAFLRKLVANDVAKLTVPGKALYTGMLNEQGGVIDDLIIYFFSETFYRLVVNSATREKDLAHLANVSSDFAVTVTERPEFAMIAVQGPNAREKTGTLLNAEQQAAVEGMKPFFGVQVGDLFIATTGYTGEDGYEIVVPNDQAADLWQQLLDAGVAPAGLGARDTLRLEAGMNLYGLDMDESVSPLAANMAWTIAWEPEDRDFIGRDVLVKQRAEKSTDKLVGLVLEEKGVLRSGSKVIVDGGEGVITSGTFSPTLGFSVALARVPRSTGDTAQVEMRKKLVNVKVVKPSFVRNGKSII

SEQ ID NO: 2989 - DNA, 1131 bp, Anabaena sp
  CDS (1)..(1131): transl_table=11
gtggctaatcaaaaagatactgccgaaaccttagcgagaacccctttgtatcaactgggtgtagaactcaaagcccgcttgaccagctttggcgggtgggaaatgccagtacaatttagtgggatcacccgcgaacacgaagcagtaagaaacgctgctgggatgtttgacatttctcacatgggtaaattcaccctccaaggtaaaaacctcatttctcaactccaaggtttagttccttcagatttaagtaggttgcaaccaggacaagcccaatataccgtgttgttaaacccccaaggaggaatcatcgacgatattattgtctactaccaaggtgaagacaacactggtacacaacaggcatttattatcgtcaatgcagccaccactagtaaagacaaagcatggatactgtcacacctcgaccaaaatcaggtgcaattccaagacatatcaccagcaaaagtcttaatcgccattcaagggccaaaagctatcggctatctccagccttttgtgcagcaaaacttacaaccaatcaaagcctttggacatctagaagcaacagtactaggtcaagcaggttttatagcccgtacaggttataccggggaagatggctttgagattttggtagacccagaagtaggggtagagttatggcgtagtttatatgatgcaggtgtcattccctgtggcttaggtgcaagagataccctgaggctagaagcagctatggcgctttacggtcaagacatcgatgacaacaccactcctctagaagctgggttagggtggttagttcatttggataccaaaggagattttattggtcggtcggttttagaacaacaaaaggctacaggagtacaacgccgacttataggtttgcaaacccaaggacgtaacatcgcccgtcatggctaccaagttctctcagacggtaaagtagtaggcggagtgactagcggcactctatcacctacactgggttatcctgttgctttagcctacgtccctagcaaactagcgaaagttggtcaaccgctagaagtcgaaattcgtggtaaagcatacccagctgttgtagttaagcgacccttttatcgttcaagtaataagggttag

SEQ ID NO: 2990 - protein, 376 aa, Anabaena sp
MANQKDTAETLARTPLYQLGVELKARLTSFGGWEMPVQFSGITREHEAVRNAAGMFDISHMGKFTLQGKNLISQLQGLVPSDLSRLQPGQAQYTVLLNPQGGIIDDIIVYYQGEDNTGTQQAFIIVNAATTSKDKAWILSHLDQNQVQFQDISPAKVLIAIQGPKAIGYLQPFVQQNLQPIKAFGHLEATVLGQAGFIARTGYTGEDGFEILVDPEVGVELWRSLYDAGVIPCGLGARDTLRLEAAMALYGQDIDDNTTPLEAGLGWLVHLDTKGDFIGRSVLEQQKATGVQRRLIGLQTQGRNIARHGYQVLSDGKVVGGVTSGTLSPTLGYPVALAYVPSKLAKVGQPLEVEIRGKAYPAVVVKRPFYRSSNKG

SEQ ID NO: 2991 - DNA, 1098 bp, Bacillus halodurans
  CDS (1)..(1098): transl_table=11
atgacagaattaaagaaaacaccattatttgacctttacgaacagtatggcggtaaggtcattgactttggcggctgggctttaccagttcagttttcaagcatcaaagaagagcatgaagcagttcgaacaaaagcaggactgtttgacgtatctcatatgggtgaagtagaggtgacaggtgcccaggctcttaactacttgcagcgcttagtaacaaacgatgtgtcaaaaatcaaagacggtcaggcacaatatacagcgatgtgttatgaaaatggaggaactgtcgatgacttgctcatttatcggcggagcgaagatcagtaccttcttgttataaacgcggccaacattgacaaagacatagcatggatggagaagcatgcgatcgacggcgtttcgattaccaacgtatcaaatcaaacggcacagcttgctctacaagggccggttgctgagaatgtattgcaaacactcaccgaagaacctctagcagacattaaattttttcgatttgtcgatggcgtcaacattgcaggtgtgaatgttcttctttcgcgaactggctatacaggtgaggatggttttgaactttattgcttagctgaagatgcgcctgtcctatggaaaaaactaattgaagcagggaaagaacatggggtcgttccttgtggtctgggagcgagagatacccttcgttttgaagccaaattacctttatacggccaggaattgacgaaggatatttcgccaattgaagcgggtattggttttgcagttaaagtcgataaagaagattttatcggaaaagagatcctaaaaaaacaaaaggagcaaggggctccccggaaactcgttggacttgaaatggttgataaaggaatcccgcgcacgggctatgaggtttatgtggataatcagaagattggctttgtgacaacaggcacacaatcaccaacgttgaaaaaaaatgtggggctggccttgctgcaagctgagcacagtgagctagggactgaagtcatcgttcacgtacgcaaaagacagttaatagcaaaggttgtcgccaccccgttttataaaagaggaaactaa

SEQ ID NO: 2992 - protein, 365 aa, Bacillus halodurans
MTELKKTPLFDLYEQYGGKVIDFGGWALPVQFSSIKEEHEAVRTKAGLFDVSHMGEVEVTGAQALNYLQRLVTNDVSKIKDGQAQYTAMCYENGGTVDDLLIYRRSEDQYLLVINAANIDKDIAWMEKHAIDGVSITNVSNQTAQLALQGPVAENVLQTLTEEPLADIKFFRFVDGVNIAGVNVLLSRTGYTGEDGFELYCLAEDAPVLWKKLIEAGKEHGVVPCGLGARDTLRFEAKLPLYGQELTKDISPIEAGIGFAVKVDKEDFIGKEILKKQKEQGAPRKLVGLEMVDKGIPRTGYEVYVDNQKIGFVTTGTQSPTLKKNVGLALLQAEHSELGTEVIVHVRKRQLIAKVVATPFYKRGN

SEQ ID NO: 2993 - DNA, 1083 bp, Bdellovibrio bacteriovorus
  CDS (1)..(1083): transl_table=11
atgaaaaagacacctttagcagacacacatgaaaagctgggcgcccgcatggtcgactttgccggttggtatatgcccgttcaatacatcggtcttcgtgaagagcacaacaacgtgcgcacgaacgtgggcctattcgacgtctcccacatgggcgaagttcgcgtcaagggacctaaagccctggagactctggagtggctgaccaccaacgacgtttccaagctgaacgacggcgaagctcagtattctctgctgccgaatgatcagggcggtctggttgacgatatcatcgtttactgcctgtctaaagattccgactatctggtgtgtgtgaacgcctctaacaaagacaaagactttgcctggatgaccaaacacaacaagggtgccgacatcaccgacgaatccgacctttggggtcagatcgccatccaaggcccgaaagccctggaactgtgtgaccgcgtctttgacatcaaagtcagcgaaatgaagtccttcacggtcaaatccggcacgttcaagggccacaagatcatgatcgccaccaccggctacaccggcgaaaaaggctgtgaagtctttgtcgaggcggcgggcacggcggacctgtggatgactttgctggaaaaaggcaaggacctgggctgcatgggcatcggtttgggcgctcgtgacaccctaagaaccgaaatgaagtactccctgtatggccacgaaatcgatgacacgacgaatccatacgaagcgggccttggctgggttattaaaccggctaaaaaggacttcatgaacaaagcccaaatcgtgggcaaaaaagaagccggcctaaccagaaatcttgtgggatttaagatgcttgagaagggcatcccccgtcagggatacagcctgttttcttttgacaacaaagaaatcggcaaggtaactagtggtacacactcaccgaccctggacgagcctatcggtattgcttttatcgatgtggcttacgcgaaagaaggaactgaattccttctggatatccgcggccgtaaagtgaaagccgtggtttgcaaaacaccgtttgtaacgaaataa

SEQ ID NO: 2994 - protein, 360 aa, Bdellovibrio bacteriovorus
MKKTPLADTHEKLGARMVDFAGWYMPVQYIGLREEHNNVRTNVGLFDVSHMGEVRVKGPKALETLEWLTTNDVSKLNDGEAQYSLLPNDQGGLVDDIIVYCLSKDSDYLVCVNASNKDKDFAWMTKHNKGADITDESDLWGQIAIQGPKALELCDRVFDIKVSEMKSFTVKSGTFKGHKIMIATTGYTGEKGCEVFVEAAGTADLWMTLLEKGKDLGCMGIGLGARDTLRTEMKYSLYGHEIDDTTNPYEAGLGWVIKPAKKDFMNKAQIVGKKEAGLTRNLVGFKMLEKGIPRQGYSLFSFDNKEIGKVTSGTHSPTLDEPIGIAFIDVAYAKEGTEFLLDIRGRKVKAVVCKTPFVTK

SEQ ID NO: 2995 - DNA, 1101 bp, Bordetella bronchiseptica
  CDS (1)..(1101): transl_table=11
atgtccgcaccgctcaaacgcacccccttggccgaagaacatcttgccgccggcgcccgcatggtcgacttcggtggctgggacatgccgctggcctatggctcgcaactggaagagcaccacgcggtgcgccaggacgccggcatgttcgacgtctcgcacatgctcaacgtcgatgtcggcggcgccgacgccaccgccttcctgcgccgcctggtggccaacgacgtggcccgcctggccacgccgggcaaggccctgtacagctgcatgctgaacccgcagggcggcatcatcgacgacctcatcatctactacttcgcgcccgaccaatggcgcgtggtggtcaacgccggcacggccgacaaggacatcgcctggatgcagcgcgtggccgccgccgacggcttcgatgtcgcgatcgcgccgcgccgcgacctggccatggtggcggtgcagggccccaacgcccgcgccaaggtgtgggcggcccgtcccgcgtggcaggcggcgtccgagccgttggcgccgttctcggccgcggccgtcgaggccggcacgctggtggcgcgcaccggctataccggcgaggacgggttcgaaatcgtgctgcccgccgacgcggtggtccagctgtggcgcgacctgctggcgcagggcgtgcggccctgcggcctgggcgcgcgcgacacgctgcgcctggaggcgggcatgaatctctacggccaggacatggacgaactcgtccatcccgaccaggccggcctgagctggaccgttgcgctcaaggacgaggcgcgccgcttcgtgggacgcgatgccatcgagcagttcgccgtgccgcgcgccttcgtcggcctgaagctgcaggagcgcggcgtgatgcgcgcccacatgccggtgcgctgcgcgcagggcatgggcgagctcaccagcggcaccatgtcgcccaccctgggcgtgtcggtgggctttgcccgcgtgccggtgggcgtgcagcccggcgacgccgtcgaggtggaaatccgcggcaagtgggtgcccgccctggtatgcaaattgccgttcgtgcgtcacggcaaagccgtcgaacactcgtaa

SEQ ID NO: 2996 - protein, 366 aa, Bordetella bronchiseptica
MSAPLKRTPLAEEHLAAGARMVDFGGWDMPLAYGSQLEEHHAVRQDAGMFDVSHMLNVDVGGADATAFLRRLVANDVARLATPGKALYSCMLNPQGGIIDDLIIYYFAPDQWRVVVNAGTADKDIAWMQRVAAADGFDVAIAPRRDLAMVAVQGPNARAKVWAARPAWQAASEPLAPFSAAAVEAGTLVARTGYTGEDGFEIVLPADAVVQLWRDLLAQGVRPCGLGARDTLRLEAGMNLYGQDMDELVHPDQAGLSWTVALKDEARRFVGRDAIEQFAVPRAFVGLKLQERGVMRAHMPVRCAQGMGELTSGTMSPTLGVSVGFARVPVGVQPGDAVEVEIRGKWVPALVCKLPFVRHGKAVEHS

SEQ ID NO: 2997 - DNA, 1101 bp, Bordetella parapertussis
  CDS (1)..(1101): transl_table=11
atgtccgcaccgctcaaacgcacccccttggccgaagaacatcttgccgccggcgcccgcatggtcgacttcggtggctgggacatgccgctggcctatggctcgcaactggaagagcaccacgcggtgcgccaggacgccggcatgttcgacgtctcgcacatgctcaacgtcgatgtcggcggcgccgacgccaccgccttcctgcgccgcctggtggccaacgacgtggcccgcctggccacgccgggcagggccctgtacagctgcatgctgaacccgcagggcggcatcatcgacgacctcatcatctactacttcgcgcccgaccaatggcgcgtggtggtcaacgccggcacggccgacaaggacatcgcctggatgcagcgcgtggccgccgccgacggcttcgatgtcgcgatcgcgccgcgccgcgacctggccatggtggcggtgcagggccccaacgcccgcgccaaggtgtgggcggcccgtcccgcgtggcaggcggcgtccgagccgttggcgccgttctcggccgcggccgtcgaggccggcacgctggtggcgcgcaccggctataccggcgaggacgggttcgaaatcgtgttgcccgccgacgcggtggtccagctgtggcgcgacctgctggcgcagggcgtgcggccctgcggcctgggcgcgcgcgacacgctgcgcctggaggcgggcatgaatctctacggccaggacatggacgaactcgtccatcccgaccaggccggcctgagctggaccgttgcgctcaaggacgaggcgcgccgcttcgtgggacgcgatgccatcgagcagttcgccgtgccgcgcgccttcgtcggcctgaagctgcaggagcgcggcgtgatgcgcgcccacatgccggtgcgctgcgcgcagggcatgggcgagctcaccagcggcaccatgtcgcccaccctgggcgtgtcggtgggctttgcccgcgtgccggtgggcgtgcagcccggcgacgccgtcgaggtggaaatccgcggcaagtgggtgcccgccctggtatgcaaattgccgttcgtgcgtcacggcaaagccgtcgaacactcgtaa

SEQ ID NO: 2998 - protein, 366 aa, Bordetella parapertussis
MSAPLKRTPLAEEHLAAGARMVDFGGWDMPLAYGSQLEEHHAVRQDAGMFDVSHMLNVDVGGADATAFLRRLVANDVARLATPGRALYSCMLNPQGGIIDDLIIYYFAPDQWRVVVNAGTADKDIAWMQRVAAADGFDVAIAPRRDLAMVAVQGPNARAKVWAARPAWQAASEPLAPFSAAAVEAGTLVARTGYTGEDGFEIVLPADAVVQLWRDLLAQGVRPCGLGARDTLRLEAGMNLYGQDMDELVHPDQAGLSWTVALKDEARRFVGRDAIEQFAVPRAFVGLKLQERGVMRAHMPVRCAQGMGELTSGTMSPTLGVSVGFARVPVGVQPGDAVEVEIRGKWVPALVCKLPFVRHGKAVEHS

SEQ ID NO: 2999 - DNA, 1101 bp, Bordetella pertussis
  CDS (1)..(1101): transl_table=11
atgtccgcaccgctcaaacgcacccccttggccgaagaacatcttgccgccggcgcctgtatggtcgacttcggcggctgggacatgccgctggcctatggctcgcaactggaagagcaccacgcggtgcgccaggacgccggcatgttcgacgtctcgcacatgctcaacgtcgatgtcggcggcgccgacgccaccgccttcctgcgccgcctggtggccaacgacgtggcccgcctggccacgccgggtaaggccctgtacagctgcatgctgaacccgcagggcggcatcatcgacgacctcatcatctactacttcgcgcccgaccaatggcgcgtggtggtcaacgccggcacggccgacaaggacatcgcctggatgcagcgcgtggccgccgccgacggcttcgatgtcgtgatcgcgccgcgccgcgacctggccatggtggcggtgcagggccccaacgcccgcgccaaggtgtgggcggcccgtcccgcgtggcaggcggcgtccgagccgctggcgccgttctcggccgcggccgtcgaggctggcacgctggtggcgcgtaccggctataccggcgaggacgggttcgaaatcgtgctgcccgccgacgcggtggtccagctgtggcgcgacctgctggcgcagggcgtgcggccctgcggcctgggcgcgcgcgacacgctgcgcctggaggcgggcatgaatctctacggccaggacatggacgaactcgtccatcccgaccaggccggcctgagctggaccgttgcgctcaaggacgaggcgcgccgcttcgtggggcgcgatgccatcgagcagttcgccgtgccgcgcgccttcgtcggcctgaagctgcaggagcgcggcgtgatgcgcgcccacatgccggtgcgctgcgcgcagggcatgggcgagctcaccagcggcaccatgtcgcccaccctgggcgtgtcggtgggctttgcccgcatgccggtgggcgtgcagcccggcgacgccgtcgaggtggaaatccgcggcaagtgggtgcccgccctggtatgcaaattgccgttcgtgcgtcacggcaaagccgtcgaacactcgtaa

SEQ ID NO: 3000 - protein, 366 aa, Bordetella pertussis
MSAPLKRTPLAEEHLAAGACMVDFGGWDMPLAYGSQLEEHHAVRQDAGMFDVSHMLNVDVGGADATAFLRRLVANDVARLATPGKALYSCMLNPQGGIIDDLIIYYFAPDQWRVVVNAGTADKDIAWMQRVAAADGFDVVIAPRRDLAMVAVQGPNARAKVWAARPAWQAASEPLAPFSAAAVEAGTLVARTGYTGEDGFEIVLPADAVVQLWRDLLAQGVRPCGLGARDTLRLEAGMNLYGQDMDELVHPDQAGLSWTVALKDEARRFVGRDAIEQFAVPRAFVGLKLQERGVMRAHMPVRCAQGMGELTSGTMSPTLGVSVGFARMPVGVQPGDAVEVEIRGKWVPALVCKLPFVRHGKAVEHS

SEQ ID NO: 3001 - DNA, 1119 bp, Burkholderia mallei
  CDS (1)..(1119): transl_table=11
atgaccgttctcaaaaccaccccgcttcatgccgcgcatcgcgccctcaacgcccgcatggtcgatttcggcggctgggacatgcccgtcaactacggctcgcagatcgaagagcaccaggcggtgcgcaccgatgccggcatgttcgacgtgtcgcacatgtgcgtcgtcgatttcacgggcccgcgcgtgcgcgcgttcttcgaacacgcgatcgcgaacaacgtcgcgaagctgcaaacgcccggcaaggcgctctactcgtgcctgctgaacccgcaaggcggcgtgatcgacgatctgatcgtctactacttcaccgaggaattcttccgcgtcgtcgtcaacgccggcactgcggaaaaggacatcgcgtggttcaaccagctcaacgagcaaggcggcttcggcctcacgatcgcgccgcgtcgcgacttcgcgatcgtcgccgcccaaggcccgaacgcgcgcgcgaaggtgtgggacaccgtcccctgcgcgcgcgcagcgacgagcgagctcaagccgttcaacgccgcgcaggtcgcgggcacgccgttcggcgatctcaccgtcgcgcgcaccggctacaccggcgaggacggcttcgagatcatcgtcccggcgacgcacgtggaagcgctgtggaacgcgctcgccgagcgcggcgtgcgcccgtgcgggctcggcgcgcgcgacacgctgcggctcgaggccggcatgaacctgtacggccaggacatggacgaaagcgtttccccgctcgacgcgggcctcgcgtggacggtcgacctgtccgcaccgcgcgcgttcgtcggccgcgacgcgctcgaagcgcacggctcgcgcgcggcattcgtcggcctgatcctgcagaaggagaacggccgcgcgggcggcgtgctgcgcgcgcaccagaaggtcgccacgccgcacggcgaaggcgagatcacgagcggcacgttctcgccgtcgatgcaggaatcgatcgcctttgcgcgcgtgccgaaggacgtcgcgatcggcgacacggtgcacgtgcagatccgcgacaagcaacttcccgcgcgcgtggtaaaactgccgttcgtgcgcaacggcaaggtcctcgctgcgtaa

SEQ ID NO: 3002 - protein, 372 aa, Burkholderia mallei
MTVLKTTPLHAAHRALNARMVDFGGWDMPVNYGSQIEEHQAVRTDAGMFDVSHMCVVDFTGPRVRAFFEHAIANNVAKLQTPGKALYSCLLNPQGGVIDDLIVYYFTEEFFRVVVNAGTAEKDIAWFNQLNEQGGFGLTIAPRRDFAIVAAQGPNARAKVWDTVPCARAATSELKPFNAAQVAGTPFGDLTVARTGYTGEDGFEIIVPATHVEALWNALAERGVRPCGLGARDTLRLEAGMNLYGQDMDESVSPLDAGLAWTVDLSAPRAFVGRDALEAHGSRAAFVGLILQKENGRAGGVLRAHQKVATPHGEGEITSGTFSPSMQESIAFARVPKDVAIGDTVHVQIRDKQLPARVVKLPFVRNGKVLAA

SEQ ID NO: 3003 - DNA, 1089 bp, Chromobacterium violaceum
  CDS (1)..(1089): transl_table=11
atgacggccccgaaacgtaccccgctgtttgatgcccatatcgccgccggcgccaagatggtcgatttcgccggttgggaaatgcccatccactatggttcccagctgaaagagcacgaaatcgtccgcagcgacgcgggcatgttcgacgtctcgcacatgacggtgatcgacatcaccggcgccgacgccaaggcctggctgcaaaaactgatcgctaacgacgtggccaagctcggcttcgagggcaaggcgctgtattccggcatgctgaccccggaaggcaccgtcgtcgacgacctgatcgtctacctcactgcctacggctaccgcatggtggtcaacgccggcaccaccgagaaagacttggcctggatggaaagccagaaggccggcttcgacgtggcgctgaaggtgcgccgcgacctggcgatgctggcggtgcagggccccaaggcgattcaaaaagtctgttccatcaagccggagctggccgaggccatccgcgcgctgaaagtgttccagggcctgccgcagggcgagtggttctacgcccgcaccggctataccggcgaagacggcctggaaatcatggtcccggccgatcaggccatttccttcttccatcaattgcaagccgccggcgtgtcgccgatcggcctgggcgcgcgcgacacgctgcgcttggaagccggcatgaacctgtacggccacgacatggacgagaccgtgtcgccgctggaagccggcatgggctggaccatcgcctgggagccggccgagcgcaagttcaacggccgcgaggcgctggaagcgcaaaaggccgccggcgtgaagatgaagcaggtgggcctggtgctggaaggccgcggcgtgctgcgcgaaggcctgaaggtggtggtggagagcgtcggcgaaggcgtgatcaccagcggcaccttctcgcctacgctgaagcattccatcgccatcgcccgcgtgccggccgccaccggcgccgccgcccaggtggacctgcgcggcacgctgaccgacgtccgcgtggtgaagatgcccttcgtccgcaacggcaagaaagtattcgaataa

SEQ ID NO: 3004 - protein, 362 aa, Chromobacterium violaceum
MTAPKRTPLFDAHIAAGAKMVDFAGWEMPIHYGSQLKEHEIVRSDAGMFDVSHMTVIDITGADAKAWLQKLIANDVAKLGFEGKALYSGMLTPEGTVVDDLIVYLTAYGYRMVVNAGTTEKDLAWMESQKAGFDVALKVRRDLAMLAVQGPKAIQKVCSIKPELAEAIRALKVFQGLPQGEWFYARTGYTGEDGLEIMVPADQAISFFHQLQAAGVSPIGLGARDTLRLEAGMNLYGHDMDETVSPLEAGMGWTIAWEPAERKFNGREALEAQKAAGVKMKQVGLVLEGRGVLREGLKVVVESVGEGVITSGTFSPTLKHSIAIARVPAATGAAAQVDLRGTLTDVRVVKMPFVRNGKKVFE

SEQ ID NO: 3005 - DNA, 1092 bp, Coxiella burnetii
  CDS (1)..(1092): transl_table=11
atggcaagacattcacccctctacgaagaacacgctaaagcgaaagcccactttgtggatttcgcggggtgggaaatgcctttgcattatggatcacagattgaagaacatcaccaagtgcgccaacgagcgggtatttttgatgtttctcacatgggcgttatcgacctcgaaggtgaagaagctactgcttttttgcgttatcttttagccaatgatgttgcaaaactcagtgacgtcggacgtgctttgtatacctgtatgcttaacccacaaggcggcgttatcgatgatcttattgtttatcgagtggcgccgacgggttatcggttagtagtgaacgctgcaacgcgcgataaagacatcgcttggataaaagaaaaaggcgctggctacaaggtttcaatttctgaacgccctgaaatgtgcattcttgccgttcaaggcccacaagccatcgctgcggctaaatccatttttgatgaagcgctgtatgcgcaattggaagcccttaaacctttccactttatttcatcaccgacgcgagatttgcaaatagcccgaacaggctacacgggtgaagatggacttgaaataattgtccccgcttctcgcgcgacggatctttgggcgcgcttcgttcaccagggagtgaaaccttgtggtttaggagcacgcgataccttgcgcttagaagccggtttaaatttatatgggacagatatggacgaaacgacttctcctttaatttccaatctcagctggacggtgtcctggaacgacgcggatcgcaattttataggtcggcgcgccttggaaaaacaattggacgagaatgtcaaagaacgacttatcggtttagtgatggaagaacccggcatattacgcaatcaccaaaaagtttggttgacagaggatggggaaggaataattaccagcggcggtttttcgcctacattgggtcacgccattgcattggctcgcgtacctgttggagaagtggaaaaagcaactgtggagcgtcgtggtaaaaaaattcctgtaaaaataattaaaccgccctttgttcgacgtggtaaaaaaacattttga

SEQ ID NO: 3006 - protein, 363 aa, Coxiella burnetii
MARHSPLYEEHAKAKAHFVDFAGWEMPLHYGSQIEEHHQVRQRAGIFDVSHMGVIDLEGEEATAFLRYLLANDVAKLSDVGRALYTCMLNPQGGVIDDLIVYRVAPTGYRLVVNAATRDKDIAWIKEKGAGYKVSISERPEMCILAVQGPQAIAAAKSIFDEALYAQLEALKPFHFISSPTRDLQIARTGYTGEDGLEIIVPASRATDLWARFVHQGVKPCGLGARDTLRLEAGLNLYGTDMDETTSPLISNLSWTVSWNDADRNFIGRRALEKQLDENVKERLIGLVMEEPGILRNHQKVWLTEDGEGIITSGGFSPTLGHAIALARVPVGEVEKATVERRGKKIPVKIIKPPFVRRGKKTF

SEQ ID NO: 3007 - DNA, 1095 bp, Escherichia coli O157
  CDS (1)..(1095): transl_table=11
atggcacaacagactcctttgtacgaacaacacacgctttgcggcgctcgcatggtggatttccacggctggatgatgccgctgcattacggttcgcaaatcgacgaacatcatgaggtacgtaccgatgccggaatgtttgatgtgtcacatatgaccatcgtcgatcttcgcggcagccgcacccgggagtttctgcgttatctgctggcgaacgatgtggcgaagctcaccaaaagcggcaaagccctttactcggggatgttgaatgcctctggcggtgtgatagatgacctcatcgtctactactttactgaagatttcttccgcctcgttgttaactccgccacccgcgaaaaagacctctcctggattacccaacacgctgaacctttcggcatcgaaattaccgttcgtgatgacctttccatgatcgccgtacaagggccgaatgcgcaggcaaaagctgccacactgtttaatgatgctcagcgtcaggcggtggaagggatgaaaccgttctttggcgtgcaggcgggcgatctgtttattgccaccactggttataccggtgaagcgggctatgaaattgcgctgcccaatgaaaaagcggccgatttctggcgtgcgctggtggaagggggcgttaagccatgcggtctgggcgcgcgtgacacgctgcgtctggaagcgggcatgaatctttatggtcaggagatggacgaaaccatctctccgttagccgccaacatgggctggactatcgcctgggaaccggcagatcgtgacttcatcggtcgtgaagccctggaagtgcagcgtgagcatggcacagaaaaactggttggtctggtgatgaccgaaaaaggcgtgctgcgtaatgaactgccggtacgttttaccgatgcgcagggcaaccagcatgaaggcattatcaccagcgggactttctccccgacgctgggttacagcattgcgctggcacgcgtgccgaaaggtattggcgaaacggcgattgtgcaaattcgcaaccgtgaaatgccggttaaagtgacaaaacctgtttttgtgcgtaacggcaaagccgtcgcgtga

SEQ ID NO: 3008 - protein, 364 aa, Escherichia coli O157
MAQQTPLYEQHTLCGARMVDFHGWMMPLHYGSQIDEHHEVRTDAGMFDVSHMTIVDLRGSRTREFLRYLLANDVAKLTKSGKALYSGMLNASGGVIDDLIVYYFTEDFFRLVVNSATREKDLSWITQHAEPFGIEITVRDDLSMIAVQGPNAQAKAATLFNDAQRQAVEGMKPFFGVQAGDLFIATTGYTGEAGYEIALPNEKAADFWRALVEGGVKPCGLGARDTLRLEAGMNLYGQEMDETISPLAANMGWTIAWEPADRDFIGREALEVQREHGTEKLVGLVMTEKGVLRNELPVRFTDAQGNQHEGIITSGTFSPTLGYSIALARVPKGIGETAIVQIRNREMPVKVTKPVFVRNGKAVA

SEQ ID NO: 3009 - DNA, 1095 bp, Escherichia coli O6
  CDS (1)..(1095): transl_table=11
atggcacaacagactcctttgtatgaacaacacacgctttgcggcgctcgcatggtggatttccacggctggatgatgccgctgcattacggttcgcaaatcgacgaacatcatgcggtacgtaccgatgccggaatgtttgatgtgtcacatatgaccatcgtcgatcttcacggcagccgcacccgggagtttctacgttatctgctggcgaacgatgtggcgaagctcaccaaaagcggcaaagccctttactcggggatgttgaatgcctctggcggtgtgatagatgatctcatcgtctactactttactgaagatttcttccgcctcgttgttaactccgccacccgcgaaaaagacctctcctggattacccaacacgctgaacctttcggcatcgaaattactgttcgtgatgacctttccatgatcgccgtacaagggccgaatgcgcaggcaaaagctgccacactgtttaatgacgcccagcgtcaggcggtggaagggatgaaaccgttctttggcgtgcaggcgggcgatctgtttattgccaccaccggttacaccggtgaagcgggctacgaaattgcgctgcccaatgaaaaagcggccgatttctggcgcgcgctggtggaagcgggcgttaagccatgtggcctgggcgcgcgtgacacgctgcgtctggaagcgggcatgaatttgtatagccaggagatggacgaaactatttctcctttagccgccaatatgggctggactatcgcctgggaaccggcagatcgtgactttatcggtcgtgaagctctggaagcgcagcgtgaacatggcacagaaaaactggttggtctggtgatgaccgaaaaaggcgtgctgcgtaatgaactgccggtacgttttactgatgcgcagggcaaccagcatgaaggcattatcaccagcggtactttctccccaacgctgggttatagcattgcgctggcgcgcgtgccggaaggtattggtgaaacggcgattgtgcaaattcgcaaccgtgaaatgccggttaaagtgacgaaacctgtttttgtgcgtaacggcaaagccgtcgcgtga

SEQ ID NO: 3010 - protein, 364 aa, Escherichia coli O6
MAQQTPLYEQHTLCGARMVDFHGWMMPLHYGSQIDEHHAVRTDAGMFDVSHMTIVDLHGSRTREFLRYLLANDVAKLTKSGKALYSGMLNASGGVIDDLIVYYFTEDFFRLVVNSATREKDLSWITQHAEPFGIEITVRDDLSMIAVQGPNAQAKAATLFNDAQRQAVEGMKPFFGVQAGDLFIATTGYTGEAGYEIALPNEKAADFWRALVEAGVKPCGLGARDTLRLEAGMNLYSQEMDETISPLAANMGWTIAWEPADRDFIGREALEAQREHGTEKLVGLVMTEKGVLRNELPVRFTDAQGNQHEGIITSGTFSPTLGYSIALARVPEGIGETAIVQIRNREMPVKVTKPVFVRNGKAVA

SEQ ID NO: 3011 - DNA, 1116 bp, Erwinia carotovora subsp
  CDS (1)..(1116): transl_table=11
atggcaaagcagactccgttgtaccaacaacatctggccgatggcgccaaaatggtggattttcatggctggatgatgccactgcattacggctcccaactggatgagcaccacattgtgcgtcgggacgctggcatttttgatgtctcccacatgactattgtcgatttgcatggtgtgagaacccgtgaattcctgcgttacctgctggcgaatgatgtcgccaaactcacacagccaggaaaagcactttataccggcatgttgaatgcttccggcggcgtgatcgacgatctgattgtttattttctgacggaagactatttccgtttggtagtgaactccgcgacgcgtgagaaagatcttgcctggatcgagcagcatgctgccgcgttcggtgtcgacatccgtgagcgtgacgagctggcgctcgtcgcggtacaaggtccgcaggcgcaggaaaaagttcaaggcctcctgaaggcaaaaggcctgagtgatgaggacgtagctgcggttgccagcatgaagccgttttttggcaaacaggcgggggacttcttcgtcgccacgacgggatatacgggcgaagcgggttatgaaattgcgctgccaaatgagcaggtggtcgatttctggcagcaactgctggcggttggcgtgaagccttgtgggctgggcgcacgcgatacgctgcggctggaagctgggatgaacctgtacggtcaggatatggatgaggggatttcgccgctggcggctaatatgggctggacgatcgcctggcagccggaagatcgccaatttatcgggcgtgaggcgttagtgcaccagcgtgaaaaaggcactgagcaactggttggtttggtgctgacggaaaaaggcgtattgcgcaatgatttatctgtgcgctttactgatagtgatggcgtaatgcgcgaaggggtgatcaccagcggatcgttctcgccgacgctcggcgtcagtatcgcgctggcgcgtgttccggcgggaattggtgaacaggcaatcgtgcagattcgtaaccgcgaactgcccgtgcgcgtgaccaaacccggctttgtccgtgccggaaaagccatcgttcagtattaa

SEQ ID NO: 3012 - protein, 371 aa, Erwinia carotovora subsp
MAKQTPLYQQHLADGAKMVDFHGWMMPLHYGSQLDEHHIVRRDAGIFDVSHMTIVDLHGVRTREFLRYLLANDVAKLTQPGKALYTGMLNASGGVIDDLIVYFLTEDYFRLVVNSATREKDLAWIEQHAAAFGVDIRERDELALVAVQGPQAQEKVQGLLKAKGLSDEDVAAVASMKPFFGKQAGDFFVATTGYTGEAGYEIALPNEQVVDFWQQLLAVGVKPCGLGARDTLRLEAGMNLYGQDMDEGISPLAANMGWTIAWQPEDRQFIGREALVHQREKGTEQLVGLVLTEKGVLRNDLSVRFTDSDGVMREGVITSGSFSPTLGVSIALARVPAGIGEQAIVQIRNRELPVRVTKPGFVRAGKAIVQY

SEQ ID NO: 3013 - DNA, 1077 bp, Francisella tularensis subsp
  CDS (1)..(1077): transl_table=11
atgctgaaaactcctctttatgaatcacatatggcagcaaatgctaagatggttgatttctcaggctggtcaatgccaattaactatggttcacaaattcaagagcataataatgttagagaagattgtggtatttttgatgtatcacatatgttagcagttgatattcaaggttctgaagctgagaagtttttacgctatcttttagccaatgatgttgctaaattacaggagaataaagctcaatatggctgtatgttaaatcatgatgctggtattgttgatgatttgattacttataaagttacagatgagcattttagaatagttgtcaatgctggtaatagagagtcagatgttgcatggtttaatcaaaatgctcaaaattttgatgttgcgataaccccacagactgatttagctatagttgcagtacagggaccaaaagctgttgccgttattaagcgtgttgttaccaaagaaattgctactgaaattgaagcgctattgcctttttcatttaagttttttagtaaatggatggtagcacgtactggttatactggtgaagatggttttgaggtgattctccctgcaacacaggtcaaaaaattctgggatagtctgcttgaaaatggagcacaacctgcagggttaggcgctcgtgatacattaagattagaagctgggatgcatctatatggtgctgatatggatacctctacgacaccgctagaaagaggcttgggctggagcgttgatttatctgacgaacatagggactttattggtaagaaagcatactttgctaaaaaagcacaaggagttgatactaaatgggtcggtgtagtactaaaaacaaaaggtgtccttagagcaggtcaagaaattgattttgataatggtgaaaaaggctatataaccagtgggagtttttcaccaactttgaaagtagctattggattagcttatgtgcctaagcaagctgataatcctgtggtaaatattagaggtaaggagctcgaagtcgagctagttaaacctaagtttgttaaaaatggtaaatctttgatataa

SEQ ID NO: 3014 - protein, 358 aa, Francisella tularensis subsp
MLKTPLYESHMAANAKMVDFSGWSMPINYGSQIQEHNNVREDCGIFDVSHMLAVDIQGSEAEKFLRYLLANDVAKLQENKAQYGCMLNHDAGIVDDLITYKVTDEHFRIVVNAGNRESDVAWFNQNAQNFDVAITPQTDLAIVAVQGPKAVAVIKRVVTKEIATEIEALLPFSFKFFSKWMVARTGYTGEDGFEVILPATQVKKFWDSLLENGAQPAGLGARDTLRLEAGMHLYGADMDTSTTPLERGLGWSVDLSDEHRDFIGKKAYFAKKAQGVDTKWVGVVLKTKGVLRAGQEIDFDNGEKGYITSGSFSPTLKVAIGLAYVPKQADNPVVNIRGKELEVELVKPKFVKNGKSLI

SEQ ID NO: 3015 - DNA, 1095 bp, Geobacillus kaustophilus
  CDS (1)..(1095): transl_table=11
atgctaaagcgcacgcccctattctcggtgtacgcccgttgcggcgccaaaacgattgaatttggcggctgggaaatgccggtgcagttttccagcatcaaggaagaacatgaggctgtaagaacgcgcgccgggctgtttgacgtctcccatatgggggaaattgtcgtccgcggccgtgggagcctcgcgtttttgcaaaagctcatgaccaatgacgtcgccaaactgcggcccggccgggcgcaatatacgctcatgtgctatgaggacggcggcacagtcgatgatttgctcatctatcaaaaaggagagaatgactacttgctggtcgtcaacgcagcgaatacggaaaaagacttcgcttggctaagcgggcatgttgagggcgacgtcgagcttcaagatgtatcgtccgaaacggctcagcttgccttgcaagggccggcagcggagcgcgtcttgcagcgattgacggattttgatttggcggcgctgcgcccgttttcattcgccgacggcgtcgaagtctcgggcgtgaaggcgctcgtttcgcgcaccggctatacgggggaagacgggtttgagctatattgtaaagcggaagacgccgccgcgctatgggaggcgatcctagcggccggagctcgtgacagcgttctcccatgcggactgggggcgcgcgatacgctccgctttgaagcatgcctgccgctttacggtcaagagctgtccgactcgatttcaccagttgaagccgggcttggttttgccgtcaaaacggaaaaagagacgccgtttatcggccaagctgtattgaaacggcaaaaagaggaagggccgccgcgccggctcgtcggcattgaaatgatcgacagaggcattccgcgccacggataccttgtatttgccgacggcgaagaggtcgggttcgtcacgaccggcacgcagtcgccgacgctgaagaaaaacatcggcttggccttggtgaaagcggatgtggctgccatcggccgggaggtggaggtggacatccgcggcaagcggctgaaagcgaacatcgtgccgattccgttttacaggcgggccaagtga

SEQ ID NO: 3016 - protein, 364 aa, Geobacillus kaustophilus
MLKRTPLFSVYARCGAKTIEFGGWEMPVQFSSIKEEHEAVRTRAGLFDVSHMGEIVVRGRGSLAFLQKLMTNDVAKLRPGRAQYTLMCYEDGGTVDDLLIYQKGENDYLLVVNAANTEKDFAWLSGHVEGDVELQDVSSETAQLALQGPAAERVLQRLTDFDLAALRPFSFADGVEVSGVKALVSRTGYTGEDGFELYCKAEDAAALWEAILAAGARDSVLPCGLGARDTLRFEACLPLYGQELSDSISPVEAGLGFAVKTEKETPFIGQAVLKRQKEEGPPRRLVGIEMIDRGIPRHGYLVFADGEEVGFVTTGTQSPTLKKNIGLALVKADVAAIGREVEVDIRGKRLKANIVPIPFYRRAK

SEQ ID NO: 3017 - DNA, 1080 bp, Idiomarina loihiensis
  CDS (1)..(1080): transl_table=11
atgggtagcagaacgccactgtacgaagcacacgtaaaagcgggtgcaaagatggttgattttcacggctgggacatgccgctgaactacggttcacaaattgaagagcaccatgctgtacgccgtgactgcggtgttttcgatgtgtcgcacatgaccattgttgacgtagaaggctctcaggctcaggcgtttttgcgttacctgctggctaacgacgttgccaagctaaaaaccgaaggcaaagcacaatacaccagtatgttgaatgaaaacggcggtgttattgatgaccttattgtgtatttcttctcagaaaatgcctaccgcatggtcgttaactcagcaacccgtgaccgcgatctggcatggattgaaaaagttgcggccgattttgatgtcaccaccaaagagcgtgacgacatgggtatgctggctttgcagggccctaaagccgctgacaaaatccagggtgtattaaccgcagagcagtacgcagaaattgacggcatgaagccttttgtcgggaaagacgttggtgattactttattgcgaccacaggttacaccggcgaaaaaggctacgaaattgtggttccggctgagcagcttgaagccctgtggaatgacttgctaaaagccgatgttgctccatgtggactgggtgctcgtgatacactgcgcttagaagctggcatgaacctgtatggtcaggacatggatgagaacatcacgccgctggaagccaatatgggctggagcgtagcgtttgaaccggctgatcgcgactttattggtcgtaaagcattagagcagaaaaaagctgaaggtcacgacaagttagtcggccttgtgatggaagagaaaggtgtactgcgtcacggtcaaaaagtaaccgttgagggtggcgaaggtatcatcacttctggtacattctcgcctacacttggtttctcagttgcaatggctcgcgttccatcaagtgttggtgatacagcggaagtggaaatgcgtaaaaaacaaatgccggtgaaggtagttaagccaggtttcgtcagaaacggtcaatctgttttataa

SEQ ID NO: 3018 - protein, 359 aa, Idiomarina loihiensis
MGSRTPLYEAHVKAGAKMVDFHGWDMPLNYGSQIEEHHAVRRDCGVFDVSHMTIVDVEGSQAQAFLRYLLANDVAKLKTEGKAQYTSMLNENGGVIDDLIVYFFSENAYRMVVNSATRDRDLAWIEKVAADFDVTTKERDDMGMLALQGPKAADKIQGVLTAEQYAEIDGMKPFVGKDVGDYFIATTGYTGEKGYEIVVPAEQLEALWNDLLKADVAPCGLGARDTLRLEAGMNLYGQDMDENITPLEANMGWSVAFEPADRDFIGRKALEQKKAEGHDKLVGLVMEEKGVLRHGQKVTVEGGEGIITSGTFSPTLGFSVAMARVPSSVGDTAEVEMRKKQMPVKVVKPGFVRNGQSVL

SEQ ID NO: 3019 - DNA, 1089 bp, Listeria innocua
  CDS (1)..(1089): transl_table=11
atgacggaattacttaaaacaccgattcatccactatatgcaaaatatggtgcgaaaaccattgattttggcggatgggatttaccagtacaatttgctggaataaaagcagaacatgaggccgtgcgaactgatgcagggttatttgacgtgtcccatatgggcgaaattttggtggaaggtcctgacagtacttcttatttacagtatttgttatctaacgacatagagaaaataaaaatagggaaagcacaatataatattatgtgctatgaaacgggcggaacagtagatgatttagttgtttataagaaatcagaaaccgaatacatacttgtcgtcaatgcggcaaatacagaaaaagattatgagtggatggttcaaaatattgttggggatgttacagttaaaaatgcctcttcagagtttggacagttagctttacagggaccaaatgcagaaaaaatcctttctaaattaacagatgcggacttaagctctataagcttctttggttttatagaagatgctgatgttgctggagtgaaaacaattatatcgagaagtggatacactggagaagatggttttgaaatatacatgcaaagtgcggatgctggaaaagtattcgaggcaatcttggctgaaggtgtagcgccaatcggtcttggagctcgtgatacgctacgtctagaagcagttcttgcactttacggtcaagaattgagtaaagatattactccacttgaagccggtcttaattttgcagtgaaattaaaaaaagaagcagattttatcggaaaacaagcacttatcaagcaaaaagaagcgggactaacgagaaaattagttgggattgaattgattgagcgaggcataccgcgtcacgactatccagtatttctaaatgataaagaaattggagttatcacttctggcacccaatctccaactcttggcaccaatatcggtttagcgttaatagatactgcttatactgaattagaccaagaactagaagtcggaattcgaaataagaaagtaaaagcaaaagtagtacaaacaccattttataaacgcgcaaagtaa

SEQ ID NO: 3020 - protein, 362 aa, Listeria innocua
MTELLKTPIHPLYAKYGAKTIDFGGWDLPVQFAGIKAEHEAVRTDAGLFDVSHMGEILVEGPDSTSYLQYLLSNDIEKIKIGKAQYNIMCYETGGTVDDLVVYKKSETEYILVVNAANTEKDYEWMVQNIVGDVTVKNASSEFGQLALQGPNAEKILSKLTDADLSSISFFGFIEDADVAGVKTIISRSGYTGEDGFEIYMQSADAGKVFEAILAEGVAPIGLGARDTLRLEAVLALYGQELSKDITPLEAGLNFAVKLKKEADFIGKQALIKQKEAGLTRKLVGIELIERGIPRHDYPVFLNDKEIGVITSGTQSPTLGTNIGLALIDTAYTELDQELEVGIRNKKVKAKVVQTPFYKRAK

SEQ ID NO: 3021 - DNA, 1089 bp, Listeria monocytogenes serotype 4b
  CDS (1)..(1089): transl_table=11
atgacagagttactaaaaacaccgattcatccactttatgcaaaatatggtgcgaaaaccattgattttggtggatgggatttaccggtacaatttgctggtataaaagcagaacatgaggccgtgcgaactgatgcagggctatttgatgtgtctcacatgggagaaattctagtaaaaggaccggatagtacttcttatttacagtatttgttaaccaatgacattgaaaaaataaaaatcggaaaagcacaatataatattatgtgctatgaaactggtggaacagtggacgatttagtagtttacaagaaatcagaaacggaatacatacttgttgtcaatgcagcaaatacggacaaggattttgaatggatggttaaaaatattcgcggggatgtttctgttaccaatgtatcttcggaatatggacaattagcacttcaagggccaagcgcagaaaaaattctcgcaaaactaacggatgtagatttaagttcgattagcttctttggatttgtggaggatgcggatgtagcaggagtgaaaacaatcatttcaagaagtggctatactggagaagatggatttgaaatttatatgccaagcgctgatgcaggaaaagtttttgaggcaattttagctgaaggagtagctccaattggtttaggtgcacgggatacattgcgcttagaggcggtacttgcgctttatgggcaagaattgagcaaggacattacaccacttgaagcagggcttaattttgctgttaaattaaaaaaagaagcagattttataggtaaagaagcgcttattaaacaaaaagaagcagggctgaatagaaaactagttggtattgaattaattgaacgaggtattccgcgtcacgattatccagtatttctaaatgaggaagaaattggcattgtgacttctggtacccaatcacccacacttggaacaaatattggtcttgctctaattgatacagcttacacagaaataggtcaagaagtagaagtaggtataagaaacaaaaaaataaaagcgaaaatagtaccaacaccattttataaacgcgcaaagtaa

SEQ ID NO: 3022 - protein, 362 aa, Listeria monocytogenes serotype 4b
MTELLKTPIHPLYAKYGAKTIDFGGWDLPVQFAGIKAEHEAVRTDAGLFDVSHMGEILVKGPDSTSYLQYLLTNDIEKIKIGKAQYNIMCYETGGTVDDLVVYKKSETEYILVVNAANTDKDFEWMVKNIRGDVSVTNVSSEYGQLALQGPSAEKILAKLTDVDLSSISFFGFVEDADVAGVKTIISRSGYTGEDGFEIYMPSADAGKVFEAILAEGVAPIGLGARDTLRLEAVLALYGQELSKDITPLEAGLNFAVKLKKEADFIGKEALIKQKEAGLNRKLVGIELIERGIPRHDYPVFLNEEEIGIVTSGTQSPTLGTNIGLALIDTAYTEIGQEVEVGIRNKKIKAKIVPTPFYKRAK

SEQ ID NO: 3023 - DNA, 1083 bp, Methylococcus capsulatus
  CDS (1)..(1083): transl_table=11
atgggcagatgcaccgcactccacgaagaacacctggcgctgggagcgcggatgaccgagttttcgggctgggaactgccgctccattacggctcgcagatcgccgaacaccatgccgtacgccgggccgccggcatgttcgacgtctcccatctgggagtggtcgacgtcgaggggcttcaggcagccccattcctgcgccgagtcctcgccaacgacgtcgcccggctcgccgagccgggacgaatgctctacggctgcatgctcaaccaggacggcggcatcgtcgacgacctcgtcgtgggcttcatcgacgatcggcgcttccgcctcattctcaatgccgggacaagggaaaaagacctgagctggctccaccgccaggctgcgcctttttctgtgaccgtcactccccgtgacgatctggccatgatcgccctccaaggcccggactccccccgcatcgccgacgccgtcgtcgccgccgggagctccggactgaaacccttcaccgccacgcagcgaggcgaccgcttcatcgcccgtacgggttataccggcgaggacggcttcgaaatcatcctgcctcacgccgaagcaggctcgctgtggcgccagcttttccaggccggtgcccggccctgcggactcggcgcccgcgacaccctcaggctggaagccggcatgcgcctctacgggcaggacatggacgagacggtcacgcccctcgcctgtggcctcggctggacggttgcctgggaacccgaagagcgcgatttcatcggccgcgcagccctggaacgggaacgcatcgggggctcgccttcgaaattcgtcggattgatcctggaggaaccgggaatccttcgcagcgggcagaaggtggccgtcgcgaacgtcggcgagggcgtcgtgaccagcggcggcttctcccccaccctacggcgctcgatcggcctggcgcgggtacccgcggcgaccgggcgcgagtgccgggtggaaatccgcggcagcctcaagcgcgcaacggtggtgaaaccgcgcttcgtccgccgcagcacatcgctgatcgatatctgctag

SEQ ID NO: 3024 - protein, 360 aa, Methylococcus capsulatus
MGRCTALHEEHLALGARMTEFSGWELPLHYGSQIAEHHAVRRAAGMFDVSHLGVVDVEGLQAAPFLRRVLANDVARLAEPGRMLYGCMLNQDGGIVDDLVVGFIDDRRFRLILNAGTREKDLSWLHRQAAPFSVTVTPRDDLAMIALQGPDSPRIADAVVAAGSSGLKPFTATQRGDRFIARTGYTGEDGFEIILPHAEAGSLWRQLFQAGARPCGLGARDTLRLEAGMRLYGQDMDETVTPLACGLGWTVAWEPEERDFIGRAALERERIGGSPSKFVGLILEEPGILRSGQKVAVANVGEGVVTSGGFSPTLRRSIGLARVPAATGRECRVEIRGSLKRATVVKPRFVRRSTSLIDIC

SEQ ID NO: 3025 - DNA, 1101 bp, Neisseria meningitidis serogroup A
  CDS (1)..(1101): transl_table=11
atgattactctgaaaaccaccccatttcatcaagcccatcaagatgcaggcgcgaagctggtagattttgccggctgggagctgcccatccattatggttcgcaaatcgccgaacacgaagccgtgcgcaccgacgcaggtatgtttgacgtatcccatatgcttgttaccgacgtagcaggcgcaaatgccaaagcctttttccgcaaattgattgccaacgatgtcgccaagctcgcttttgtcggcaaagccctttattccgctttgctcaacgacaacggcggcgtgattgacgacttgatcgtttaccgcaccaatgaagccgaaacccaataccgcatcgtgtccaacggcgcgactcgcgaaaaagatacggcacaattccacaaagtcggacaagagttcggtgtttccttcaatccgcgctacgacctcggcatgctcgccgtacaaggccctaaagccattgaaaaactcctgaccgtcaaacccgaatgggcagatgtcgtccataacctcaaaccgttccaaggcgcggatttgggcaacgactggtttgtcgcccgcaccggctacaccggcgaagacggcgtcgaagtcatcctgcccggcaccgaagccgtcgcattcttcaaagccctgcaagcagcaggcgtacaaccttgcggtctcggcgcgcgcgacaccctgcgcatggaagccggcatgaacctctacggcaacgatatggacgacgataccagcccgctcgaagcaggcatgggttggaccgttgatttgaaagacgaaagccgcgattttgtcggcaaagctgccttgttggcattgaaagaaaaaggcgttgccgtcaaacaggtcggtttgctgctcggcaaaggcggcatcctgcgcgcgcatatggaagtgttgaccgacaaaggcaaaggcgaaaccaccagcggcgtattctctccaagtctgaaacaatccatcgccatcgcccgcgtaccgaaagattttgacggcgataccgccaaagtgctgattcgcggcaaggaagcggacgtgcgcgtactgaagctgccgttcgtccgcaacggtcaaaaacagtttgattaa

SEQ ID NO: 3026 - protein, 366 aa, Neisseria meningitidis serogroup A
MITLKTTPFHQAHQDAGAKLVDFAGWELPIHYGSQIAEHEAVRTDAGMFDVSHMLVTDVAGANAKAFFRKLIANDVAKLAFVGKALYSALLNDNGGVIDDLIVYRTNEAETQYRIVSNGATREKDTAQFHKVGQEFGVSFNPRYDLGMLAVQGPKAIEKLLTVKPEWADVVHNLKPFQGADLGNDWFVARTGYTGEDGVEVILPGTEAVAFFKALQAAGVQPCGLGARDTLRMEAGMNLYGNDMDDDTSPLEAGMGWTVDLKDESRDFVGKAALLALKEKGVAVKQVGLLLGKGGILRAHMEVLTDKGKGETTSGVFSPSLKQSIAIARVPKDFDGDTAKVLIRGKEADVRVLKLPFVRNGQKQFD

SEQ ID NO: 3027 - DNA, 1101 bp, Neisseria meningitidis serogroup B
  CDS (1)..(1101): transl_table=11
atgactgctctgaaaaccaccccatttcatcaagcccatcaagatgcaggcgcgaagctggtcgattttgccggctgggagctgcccatccattatggttcacaaatcgccgaacacgaagccgtgcgcaccgacgccggtatgtttgacgtatcccatatgctcgttaccgacgtagcaggcgcaaatgccaaagcctttttccgcaaattgattgccaacgatgtcgccaagctcgcttttgtcggcaaagccctttattccgctttgctcaacgacaacggcggtgtgattgacgacttaatcgtttaccgcaccaatgaagccgaaacccaataccgcatcgtgtccaacggcgcgacccgcgaaaaagacacggcgcaattccacaaagtcggacaagagttcggcgtcgccttcaatccgcgctacgacctcggcatgctcgccgtacaaggccctaaagccattgaaaaactcctgaccgtcaaacccgaatgggcagatgtcgtccataacctcaaaccgttccaaggcgcggatttgggcaacgactggtttgtcgcccgcaccggctacaccggcgaagacggcgtcgaagtcatcctgcccggcaccgaagccgtcgcattcttcaaagccctgcaacaagccggcgtacagccctgcggcctcggcgcgcgcgacaccctgcgcatggaagccggcatgaacctctacggcaacgatatggacgacgacaccagcccgctcgaagcaggtatgggttggaccgttgacttgaaagacgaaagccgcgacttcgtcggcaaagccgccttgctggcattgaaagaaaaaggcgttgccgtcaaacaggtcggcctgttgctcgaaaaaggcggcatcctgcgcgcgcatatggaagtgttgaccgacaaaggccaaggcgaaaccaccagcggcgtattctccccaagcctgaaacaatccatcgccatcgcgcgcgtaccgaaagattttgacggcgataccgccaaagtgctgatgcgtggcaaagaagtggacgtgcgtgtactgaagctgccgtttgtccgcaacggacagaaacagtttgattga

SEQ ID NO: 3028 - protein, 366 aa, Neisseria meningitidis serogroup B
MTALKTTPFHQAHQDAGAKLVDFAGWELPIHYGSQIAEHEAVRTDAGMFDVSHMLVTDVAGANAKAFFRKLIANDVAKLAFVGKALYSALLNDNGGVIDDLIVYRTNEAETQYRIVSNGATREKDTAQFHKVGQEFGVAFNPRYDLGMLAVQGPKAIEKLLTVKPEWADVVHNLKPFQGADLGNDWFVARTGYTGEDGVEVILPGTEAVAFFKALQQAGVQPCGLGARDTLRMEAGMNLYGNDMDDDTSPLEAGMGWTVDLKDESRDFVGKAALLALKEKGVAVKQVGLLLEKGGILRAHMEVLTDKGQGETTSGVFSPSLKQSIAIARVPKDFDGDTAKVLMRGKEVDVRVLKLPFVRNGQKQFD

SEQ ID NO: 3029 - DNA, 1092 bp, Nitrosomonas europaea
  CDS (1)..(1092): transl_table=11
atgctgaagacaacccctttgaatgcggcgcaccgggccatgaatgccaaaatggtcgattttggcggctgggatatgcccctgcactatggctcccaactggatgagcaccactctgtcaggcgtgatgccggtatgttcgatgtgtctcatatgttgaccgtcgatattcacggcgaaaacgtacgccagtttctgcgaggactggtggccaacaatgtcgataaactgaccctcccgggcaaagcgctctacacctgcatgctgacccccacaggtggaatcatcgacgatctgatcatttacttcctgtccgagtcctggttccgtctggtagtcaatgccggtacggctgataaggatatcgactggatcaccgggcaatcccgccagcttgctcccgctctgaccattaccccgcgtcgtgatcttgccatgatcgcagtacagggacccaatgcgcgtacgaaagtctggaatgtcattcctgattcccaggcgatttcagaaaacctgaaaccatttcagtctgtgatgctgggtgactatttcatcgcacgtaccggttataccggtgaggatggttttgaaatcacgttacccgccggccaggctgctgatttctggcaaaaactgcatgcagcgggtgttgctccggccggactgggtgcacgtgataccctgcgcctggaagcaggtatgaatctttatggccaggatatggacgagaccgtcaacccgcttgaatcagggcttgcatggactgtggatctgaaaagcgagcgtgacttcaccggtaaacagacactgctggaaacgccggtcaatcggcagctggttggcctggtattgctggataaaggagtactgcgtaatcatcagaaagtcattacacggcaggaaggtgaagcaggagaaggagagattaccagtggcgggttttccccaacgttgaaccagtcgattgcgctggcgcgtattcctgcaggcatcgctgctggtgagcaggtacatgtcgtcgtgcgggataaacagcttgcggcaaaagtcgtcaaatatccgtttgttcgcaatggtcaggcactggtctga

SEQ ID NO: 3030 - protein, 363 aa, Nitrosomonas europaea
MLKTTPLNAAHRAMNAKMVDFGGWDMPLHYGSQLDEHHSVRRDAGMFDVSHMLTVDIHGENVRQFLRGLVANNVDKLTLPGKALYTCMLTPTGGIIDDLIIYFLSESWFRLVVNAGTADKDIDWITGQSRQLAPALTITPRRDLAMIAVQGPNARTKVWNVIPDSQAISENLKPFQSVMLGDYFIARTGYTGEDGFEITLPAGQAADFWQKLHAAGVAPAGLGARDTLRLEAGMNLYGQDMDETVNPLESGLAWTVDLKSERDFTGKQTLLETPVNRQLVGLVLLDKGVLRNHQKVITRQEGEAGEGEITSGGFSPTLNQSIALARIPAGIAAGEQVHVVVRDKQLAAKVVKYPFVRNGQALV

SEQ ID NO: 3031 - DNA, 1095 bp, Photorhabdus luminescens subsp
  CDS (1)..(1095): transl_table=11
atggcaaaacaaaccccattgtatgaccagcatctggcttgtggtgcacgtatggtagattttcatggctggatgatgcctttgcattatggttcacaaatggatgaacatcacattgtccgcactcatgctggtatgtttgatgtttcccacatgacgattgtggatctgcatggtactggttgccgtgatttcctgcgttatttgttggcaaatgacattgctaaactgacagaaaagggtaaagccttatacaccgggatgcttaatgcttctggtggtgtaattgatgacctgattgtttattaccttagcaatgatttttatcggttggtggtcaattctgcgactcgtgagaaagatctggcttggattaatgaacatgtcgccaattacccggttgatattcaggttcgtgatgatctggcattgattgcggttcaggggcctgacgctcaggcaaaagtagagtctctattgaatgatgaacaaaaacagactattgccggaatgaaacctttctttggtgttcaggcgggggatctgtttatcgcaacaacgggttataccggtgaggcgggttatgaagtggcattaccaaaagagcaagcagccgatttctggcaaaaattgctgagtgtcggcgttaagcctgcgggattaggtgcgcgtgatacgctgcgacttgaagccggtatgaacctctatggacaggaaatggatgaaaccatttctccccttgtggctaacatgggttggacaatcgcttggaaacccgaagatcgccagtttatcggccgtgaagcgctagaaaaacagcgtgaagagggcactgaacagttggttggtttggtgatgagagaaaagggtgtgttacgcggtggtttagcggttagttttactgatgagatgggcaccttacattctggcgttattaccagtggtacgttctctccaacattaggattcagtattgcccttgcccgtgtgccgcaaggaattggtgaacaggcggttgtccaaatccgcaatcgtgaaatgccggttcaggtagtcaaacccagctttgtacgggcgggcaaacctctcgtatag

SEQ ID NO: 3032 - protein, 364 aa, Photorhabdus luminescens subsp
MAKQTPLYDQHLACGARMVDFHGWMMPLHYGSQMDEHHIVRTHAGMFDVSHMTIVDLHGTGCRDFLRYLLANDIAKLTEKGKALYTGMLNASGGVIDDLIVYYLSNDFYRLVVNSATREKDLAWINEHVANYPVDIQVRDDLALIAVQGPDAQAKVESLLNDEQKQTIAGMKPFFGVQAGDLFIATTGYTGEAGYEVALPKEQAADFWQKLLSVGVKPAGLGARDTLRLEAGMNLYGQEMDETISPLVANMGWTIAWKPEDRQFIGREALEKQREEGTEQLVGLVMREKGVLRGGLAVSFTDEMGTLHSGVITSGTFSPTLGFSIALARVPQGIGEQAVVQIRNREMPVQVVKPSFVRAGKPLV

SEQ ID NO: 3033 - DNA, 1122 bp, Prochlorococcus marinus
  CDS (1)..(1122): transl_table=11
atgaaatcaaaaaacactcctctttatgaaacttgcctaaatgagggcgctcgaatggtggagttcgctggctggaacatgccaatacaattctcaggactaattaatgaacacaatgcagtaagaaaaaattccggaatatttgatatttctcatatgggagttttttctattcaaggaaaaaaccctaaagatgctttgcaaacattagttccttccgatctacaccgaattggaccaggagaagcatgctatacagtcttgcttaataatgatggcggaattattgatgacctaatcgtttatgacctaggcactaatgatccaaataatgaagaatgcattttaatagttataaatgcaggttgtacgcaagctgatattgattggatcaaggaacatctttcggataagaatcttaaggtttgcaatgcaaagggtgatggagtactgcttgcattacaaggacctgactccacaaatcaactacgtaatgtcttaggtgaatctttaacgaatattcccaaatttgggcatcgagaaatacaagtacaactaaaaactcatccagtaagtttctcaatatttatcgcacgaacaggttatacaggtgaagacggttatgaaatccttctcaacacaaatgcaggaaaatcactctggcgcgaattaatagaaaacggagtcaccccttgtggtcttggtgctagagacacattaagacttgaagcaggaatgcctctttatggcaatgatataaacaatacaaccactccttttgaagcaggtttaggatggttagttcacttagaaaccccagacgaatttattggaaaagctgcacttgtaaaacaaactaacgaaggtataaacaagaaattagtcgctctaaagattgaagggagagcaatagctcgaaaaggttatcaaataatgtttaagaataaatttgttggagaaattaccagtggaagctggtccccgactttgaatgaagggattgcactcgcatatttaccaatcgatttaacaaaaataggaacagcagtaagtgtacaaatacgcgataagctacatacagcgatcgtggccaaaaagcccttttatcgcagagtttcctga

SEQ ID NO: 3034 - protein, 373 aa, Prochlorococcus marinus
MKSKNTPLYETCLNEGARMVEFAGWNMPIQFSGLINEHNAVRKNSGIFDISHMGVFSIQGKNPKDALQTLVPSDLHRIGPGEACYTVLLNNDGGIIDDLIVYDLGTNDPNNEECILIVINAGCTQADIDWIKEHLSDKNLKVCNAKGDGVLLALQGPDSTNQLRNVLGESLTNIPKFGHREIQVQLKTHPVSFSIFIARTGYTGEDGYEILLNTNAGKSLWRELIENGVTPCGLGARDTLRLEAGMPLYGNDINNTTTPFEAGLGWLVHLETPDEFIGKAALVKQTNEGINKKLVALKIEGRAIARKGYQIMFKNKFVGEITSGSWSPTLNEGIALAYLPIDLTKIGTAVSVQIRDKLHTAIVAKKPFYRRVS

SEQ ID NO: 3035 - DNA, 1083 bp, Pseudomonas aeruginosa
  CDS (1)..(1083): transl_table=11
atgggattgcgcaccccgctttacgagctgcacgtcgcgctcggcgccaagatggtcgatttcggcggttgggacatgccgctgcactacggttcgcaggtcgaggagcaccatcaggttcggcgtgactgcggcgtcttcgacgtgtcccacatgaccgtggtcgacgtcgccggcgagcaggccacggcctatctgcagcatctcctggcgaacgacgtggcgcgtctcggcgaaaccggcaaggcgctctacagcgcgatgctcaacgaagagggcggggtggtcgacgacctgatcgtctacctgaccgagcacggctaccgggtggtggtcaatgcttccacccgcgacaaggacatcgcctggatgcaggcgcaggccgccggcttcaaggtcgacctgcaggaacgcggcgacctggcgatgctcgccatccagggccccaacgcccgcgtgcacagctccgaactggtgtccccggcacgcgccgcgctgatacgcgaactcaagccgttccagggccgtgccgagggcgactggttcatcgcccgcaccggctacaccggcgaggacggcctggaaatcatgctgccggccgccgaggcgccgggtttcctcaatgagctggttggcgccgggatctccccggcgggcctgggtgcgcgcgatacgctgcgcctggaggccgggctcaatctctacggccaggacatggacgaaagcgtttccccgcttgccgccaacatgggctggaccgtagcctgggagccggttgcgcgggacttcgtcggccgccgcgcgctggaagcgcagaaggccgccggcgaccagccgaagctggtcggcctggtactggaggagcgcggcgtgctgcgcgcccaccaggtggtgcgggtagctggcattggtgagggggagatcaccagcggcagcttttcgcctaccctgaacaagtccatcgcgctggcccgcgtgccggccgccaccggcgaccgcgccgaggtggaaatccgcggcaagtggtacccggtacgggtggtccagcccagtttcgtgcgtcacggcaagcccctgatctaa

SEQ ID NO: 3036 - protein, 360 aa, Pseudomonas aeruginosa
MGLRTPLYELHVALGAKMVDFGGWDMPLHYGSQVEEHHQVRRDCGVFDVSHMTVVDVAGEQATAYLQHLLANDVARLGETGKALYSAMLNEEGGVVDDLIVYLTEHGYRVVVNASTRDKDIAWMQAQAAGFKVDLQERGDLAMLAIQGPNARVHSSELVSPARAALIRELKPFQGRAEGDWFIARTGYTGEDGLEIMLPAAEAPGFLNELVGAGISPAGLGARDTLRLEAGLNLYGQDMDESVSPLAANMGWTVAWEPVARDFVGRRALEAQKAAGDQPKLVGLVLEERGVLRAHQVVRVAGIGEGEITSGSFSPTLNKSIALARVPAATGDRAEVEIRGKWYPVRVVQPSFVRHGKPLI

SEQ ID NO: 3037 - DNA, 1083 bp, Pseudomonas putida
  CDS (1)..(1083): transl_table=11
atgggacagcgcacgcttttgtatgacctgcacctggcgctaggcgccaagacggtcgatttcggtggctgggacatgcccctgcactatggctcgcaggtcgaggagcaccatcaggtgcgcagcgattgcggcgtcttcgatgtttctcatatgaccgtgatcgatgtcgacggcactgatgccacagtttggctgcagcgcctgctggccaacgacgtggcccgcctcgacgaccccggcaaggcgctgtatagcccgctgctgaacgaacagggcggggtgatcgatgatctgattgtctaccgcactgaaaccggctatcgcctggtcaccaatgccgccacccgtgccaaggtgctcgattggctgcaattgcaacgtgccggtttttccgtggacttccaggtccgccctgatctggccatccttgccatccaggggccgcgtgcccgcgaaaaggtggcggccctgctcagccccgcgcgcgctgcactcatccgcgaactgcgcccgttcgagggcgttgccgacggcgactggttcattgcccgcaccggctataccggtgaggacggcctggagatcatcttcccgggcgatcaggcggtggccttcttcaacgacctggtcggcgccggtatcgccccaagcggcctgggcgcccgcgataccctgcgcctggaagccggcatgaacctgtacggccaggacatcgacgaaaaccacaccccgctcacctccaacctgggctggagcatcgcctgggaaccggccgagcgcaacttcatcggccgtgtcggcctgcttgcggaaatcgagcacggcgtgcaggaaaagctggtgggtctggtgctggaagagcgcggtgtactgcgcgcccatcaggtcgtgcgtgtagccggcattggcgaaggggagatcaccagtggtagtttctcgcctacgctgagcaagtccattgcgttggcgcgtgtgcctatggctaccggggatcgggccgaggtggaaattcgcggcaagtggtacccggtgcgggtggtcaaaccgaccttcgtgcgccacggcaagattctgatctga

SEQ ID NO: 3038 - protein, 360 aa, Pseudomonas putida
MGQRTLLYDLHLALGAKTVDFGGWDMPLHYGSQVEEHHQVRSDCGVFDVSHMTVIDVDGTDATVWLQRLLANDVARLDDPGKALYSPLLNEQGGVIDDLIVYRTETGYRLVTNAATRAKVLDWLQLQRAGFSVDFQVRPDLAILAIQGPRAREKVAALLSPARAALIRELRPFEGVADGDWFIARTGYTGEDGLEIIFPGDQAVAFFNDLVGAGIAPSGLGARDTLRLEAGMNLYGQDIDENHTPLTSNLGWSIAWEPAERNFIGRVGLLAEIEHGVQEKLVGLVLEERGVLRAHQVVRVAGIGEGEITSGSFSPTLSKSIALARVPMATGDRAEVEIRGKWYPVRVVKPTFVRHGKILI

SEQ ID NO: 3039 - DNA, 1083 bp, Pseudomonas syringae pv
  CDS (1)..(1083): transl_table=11
atgggacagcgtacccccctgttcgacctgcacctcgcccttggcgcgaaaatggtcgattttggtggctgggacatgccgttgcattatggatcgcaggttgaggagcaccaccaggtgcgccgcgactgtggggtcttcgacgtctcccacatgaacgtcattgatgtgctcggccgtgaggccaaagcctggctgcgccggttgctggccaacgacgtcgacaagctcaagacccctggtcgcgccctgtacagcgccatgctggatgagcaggccggtgtcattgatgacatgatcgtctacctcaccgccgatggttaccggctggtcgtcaacgccgcgaccggtgccaaggaccttgcctggatgcagtcgcagttgggcgatttcgatgtgcagttgctcgcacgcagcgaaatggcgatgctggcaattcaagggccacaggccagaaaccggattgcccagctggtttccagcgctcgcgcagaactgatccgccagcttaagccgtttgaaggcctcgatgatggcgactggttcattgcgcgcaccggttacaccggcgaagacggtctggaaatcatgctgcctgccgacgaagcccagcgttttttcaatgaactggttggcgcgggtatttcgcccatcggtctgggcgcgcgtgacacgctgcgccttgaggcaggcatgaacctctacggtcaggacatcggcgaacatgtttcgccgctggcctcgaatatggcctggagcatcgcctgggagcctgccgagcgtgatttcatcggccgtcaggcgctggaaagcgaacgggctgaaggaaccgccttcaaactcgtaggattggtgctcgaagagcgcggcgttttacgggcgcatcaggtggtacgtgtcgcagaaattggcgaaggagagatcaccagtggtagtttctctcctacgttgagcaaatccattgcactggctcgcgttccgatggcgactgccgaccgggccgaggtggaaatccgcggcaaatggtacccggtgcgggtggtgcagcctgcgttcgtgcgccatggcaaaaccttgatctaa

SEQ ID NO: 3040 - protein, 360 aa, Pseudomonas syringae pv
MGQRTPLFDLHLALGAKMVDFGGWDMPLHYGSQVEEHHQVRRDCGVFDVSHMNVIDVLGREAKAWLRRLLANDVDKLKTPGRALYSAMLDEQAGVIDDMIVYLTADGYRLVVNAATGAKDLAWMQSQLGDFDVQLLARSEMAMLAIQGPQARNRIAQLVSSARAELIRQLKPFEGLDDGDWFIARTGYTGEDGLEIMLPADEAQRFFNELVGAGISPIGLGARDTLRLEAGMNLYGQDIGEHVSPLASNMAWSIAWEPAERDFIGRQALESERAEGTAFKLVGLVLEERGVLRAHQVVRVAEIGEGEITSGSFSPTLSKSIALARVPMATADRAEVEIRGKWYPVRVVQPAFVRHGKTLI

SEQ ID NO: 3041 - DNA, 1128 bp, Ralstonia solanacearum
  CDS (1)..(1128): transl_table=11
atgacgctccaacacacgccgctcaatgccatccaccgctcgctgggcgcccgcatggtcgactttggcggctgggacatgccggtcaactacggctcccagatcgaggaacatcacgccgtgcgccgcgatgccggcatcttcgacgtctcgcacatgtgcgtggtcgacctgaccggtgcgcgggtgcgcgatttcctgcgcgggctgctcgccaacaacatcgacaagctgcagaccccgggcaaagcgctctacacctgcatgctcaaccccaagggcggcgtgatcgatgacctgatcgtctatttcttccgcgaggactggttccgcctggtggtcaacgccggcaccgcgccgaccgacatcgagtggatcaccgcgcagaacgccgccgccggcacgggcgtggccatcacgccgcgccgctccgacaacaacgcgggcgcggaacccctcggcatcgtggccgtgcagggcccgaacgcgcgcgccaaggcctacgccgccttgccgggcacgcaggcggtgggcgaggcgctcaagccgttcaacgctggcttcgccaccatcgacggcgtgggcgagatcatggtcgcgcgcaccggctacacgggggaagacggcttcgagctggtggtgcccgccgcgcagatcgccggcgtctgggagcgcctgctgcaggccggcgtgcgcccctgcggcctgggcgcgcgcgacacgctgcgcctggaagccggcatgaacctctacggccaggacatggacgagcacgtctcgccgctggacgcgggcctggcctggacggtcgacctgcaaagcgagcgcgacttcaacggcaaggcggcgctcgccgccaacggccagcgcgaccagttcgtcggcctgctgctgcgcgacaagggcggcgtgctgcgcgcccaccagaaagtcatcacggccgccggtgacggcgaaatcaccagcggcaccttcagccccagcctgtcgcagtcgatcgcgctggcgcgcctgcccaaggacgtggccatcggcgcggacgtgcaggtcgagatccgcgaccgcaggctgaccgcgactgtggttaaactgccgttcgtgcgcaatggcaaggcgctggtcagctga

SEQ ID NO: 3042 - protein, 375 aa, Ralstonia solanacearum
MTLQHTPLNAIHRSLGARMVDFGGWDMPVNYGSQIEEHHAVRRDAGIFDVSHMCVVDLTGARVRDFLRGLLANNIDKLQTPGKALYTCMLNPKGGVIDDLIVYFFREDWFRLVVNAGTAPTDIEWITAQNAAAGTGVAITPRRSDNNAGAEPLGIVAVQGPNARAKAYAALPGTQAVGEALKPFNAGFATIDGVGEIMVARTGYTGEDGFELVVPAAQIAGVWERLLQAGVRPCGLGARDTLRLEAGMNLYGQDMDEHVSPLDAGLAWTVDLQSERDFNGKAALAANGQRDQFVGLLLRDKGGVLRAHQKVITAAGDGEITSGTFSPSLSQSIALARLPKDVAIGADVQVEIRDRRLTATVVKLPFVRNGKALVS

SEQ ID NO: 3043 - DNA, 1095 bp, Salmonella paratyphi
  CDS (1)..(1095): transl_table=11
atggcccaacagacgcctttgtacgaacaacacacgctatgcggcgcccgcatggtcgattttcatggctggatgatgcccctgcattacggctctcagcttgatgaacaccacgctgtgcgcaccgatgccgggatgtttgatgtatcgcatatgaccattgtcgatcttcatggtagccgcacacgagagtttctacgttatctgctggcaaacgacgtcgcgaagctaacgaagacgggtaaagccctctactccggtatgcttaacgcatcgggcggcgtgattgatgaccttatcgtctactacttcactgaagatttcttccgtctcgttgttaactccgccacccgcgaaaaagacctctcctggattacccaacacgctgaaccttatgccatcgacattaccgttcgtgacgacctgtcgctgattgcggtacaggggccgaatgcgcaggaaaaagcggcgactctgtttactgaccaacagcgccatgcagtagaaggtatgaagccgttcttcggcgttcaggcaggtgatctgtttatcgccaccaccggttataccggcgaagcgggatatgaaatcgccatgccgaatgaaaaagcggcggatttctggcgtgcgctggtggaggcgggcgtgaagccgtgcggtcttggcgcgcgcgacacgctgcgtctggaagcaggcatgaacctgtacggtcaggagatggatgaaggtatctctccgctggcggctaatatgggatggactatcgcctgggaacctgctgaccgcgactttattggccgtgaggcgctggagatgcagcgtgaaaaaggccatgagcagcttgtcggtctggtgatgaccgagaaaggcgtattgcgtaatgaactgccggtgcgttttaccgatgcgcagggcaatcagcaagaaggcattatcaccagcgggacgttttccccaacgttgggctacagcattgcgctggcgcgcgttccggcgggcatcggcgagacggcgattgtacaaattcgtaaccgtgaaatgccggtaaaagtgactaaacctgtttttgtgcgtaacggcaaagccgtcgcgtga

SEQ ID NO: 3044 - protein, 364 aa, Salmonella paratyphi
MAQQTPLYEQHTLCGARMVDFHGWMMPLHYGSQLDEHHAVRTDAGMFDVSHMTIVDLHGSRTREFLRYLLANDVAKLTKTGKALYSGMLNASGGVIDDLIVYYFTEDFFRLVVNSATREKDLSWITQHAEPYAIDITVRDDLSLIAVQGPNAQEKAATLFTDQQRHAVEGMKPFFGVQAGDLFIATTGYTGEAGYEIAMPNEKAADFWRALVEAGVKPCGLGARDTLRLEAGMNLYGQEMDEGISPLAANMGWTIAWEPADRDFIGREALEMQREKGHEQLVGLVMTEKGVLRNELPVRFTDAQGNQQEGIITSGTFSPTLGYSIALARVPAGIGETAIVQIRNREMPVKVTKPVFVRNGKAVA

SEQ ID NO: 3045 - DNA, 1095 bp, Shewanella oneidensis
  CDS (1)..(1095): transl_table=11
atggctaataaaactgttctttttaacaagcacttagaatcaaacgctaagatggtcgacttccacggttgggatatgcccctcaactatggttcacaaatcgaagaacaccatgccgtgcgtcaagacgcaggtatgttcgacgtatcccacatgactgtagttgatgtgaccggaaccgacgcttgtgcattcctgcgtaagttgctcgccaacgatgtggccaaacttaaagttcctggtaaagccttatacggcggcatgttagatgacaatgccggcatcatcgacgatctcatcacttactacctcaccgacactttctaccgtgttgttgtcaacagcgcgacccgcgaaaaagacttagcctggatcgccaaacaatcccaaggttttgatgtcacagtgaccgagcgtcctgagctggcgatgatcgccgttcaaggtcctaacgctaaggccaaagccgccgccgtattcagtagcgagcaaaatgccgccatcgaaggcatgaaacccttcttcggtaagcaagcgggttcactgtttattgcgaccacaggttacacaggtgaagcgggctacgagattatcgtgccagaaactgaagccgaagcactgtggcaagcactgttagatcaaggcgttaaaccttgtggtttaggcgctcgcgatacattacgtctcgaagctggtatgaacctctacggcttagatatggatgaaaccatcaacccactggccgccaacatgggctggaccatcgcatgggagcccaccgaccgtgactttatcggccgcaaggcgcttgaagcattgcgcgatgcgggaaccgacaaattagtcggtctagtgatggaagaaaaaggcgtgttacgccatgatatgccagtatttttcaccgatgcagcgggtgttgagcagcaaggcgtgatcactagcggtactttctcacccacattgggctattctattgcgatggcgcgtgttcctagttcaattggggatactgcggaagtcgagatgcgtaaaaagcgcgtggctgttagagtagtagcgccaaactttgtgcgcaacggtaaacaagcattttaa

SEQ ID NO: 3046 - protein, 364 aa, Shewanella oneidensis
MANKTVLFNKHLESNAKMVDFHGWDMPLNYGSQIEEHHAVRQDAGMFDVSHMTVVDVTGTDACAFLRKLLANDVAKLKVPGKALYGGMLDDNAGIIDDLITYYLTDTFYRVVVNSATREKDLAWIAKQSQGFDVTVTERPELAMIAVQGPNAKAKAAAVFSSEQNAAIEGMKPFFGKQAGSLFIATTGYTGEAGYEIIVPETEAEALWQALLDQGVKPCGLGARDTLRLEAGMNLYGLDMDETINPLAANMGWTIAWEPTDRDFIGRKALEALRDAGTDKLVGLVMEEKGVLRHDMPVFFTDAAGVEQQGVITSGTFSPTLGYSIAMARVPSSIGDTAEVEMRKKRVAVRVVAPNFVRNGKQAF

SEQ ID NO: 3047 - DNA, 1095 bp, Shigella flexneri
  CDS (1)..(1095): transl_table=11
atggcacaacagactcctttgtacgaacaacacacgctttgcggcgctcgcatggtggatttccacggctggatgatgccgctgcattacggttcgcaaatcgacgaacatcatgcggtacgtaccgatgccggaatgtttgatgtgtcgcatatgaccatcgtcgatctccgcggcagccgcacccgggagtttctgcgttatctgctggcgaacgatgtggcgaagctcaccaaaagcggcaaagccctttactcggggatgttgaatgcctctggcggtgtgatagatgatctcatcgtctactactttactgaagatttcttccgcctcgttgttaactccgccacccgcgaaaaagacctctcctggattacccaacacgctgaacctttcggcatcgaaattaccgttcgtgatgacctttccatgattgccgtgcaagggccgaatgctcaggcaaaagctgccacactgtttaatgatgctcagcgtcaggcggtggaagggatgaaaccgttctttggcgtgcaggtgggcgatctgtttattgccaccactggttataccggtgaagcgggctatgaaattgcgctgcccaatgaaaaagcggccgatttctggcgtgcgctggtggaagcgggcgttaagccctgcggtctgggggcgcgtgacacgctgcgtctggaagcgggcatgaatctttatggtcaggagatggacgaaactatttctcctttagccgccaacatgggctggactatcgcctgggaaccgacagatcgtgactttatcggtcgtgaagccctggaagtgcagcgtgagcatggtacagaaaaactggttggtctggtgatgaccgaaaaaggcgtgctgcgtaatgaactgccggtacgctttaccgatgcgcagggcaaccagcatgaaggcattatcaccagcggtactttctccccgacgctgggttacagcattgcgctggcgcgcgtgccggaaggtattggcgaaacggcgattgtgcaaattcgcaaccgtgaaatgccggttaaagtgacaaaacctgtttttgtgcgtaacggcaaagccgtcgcgtga

SEQ ID NO: 3048 - protein, 364 aa, Shigella flexneri
MAQQTPLYEQHTLCGARMVDFHGWMMPLHYGSQIDEHHAVRTDAGMFDVSHMTIVDLRGSRTREFLRYLLANDVAKLTKSGKALYSGMLNASGGVIDDLIVYYFTEDFFRLVVNSATREKDLSWITQHAEPFGIEITVRDDLSMIAVQGPNAQAKAATLFNDAQRQAVEGMKPFFGVQVGDLFIATTGYTGEAGYEIALPNEKAADFWRALVEAGVKPCGLGARDTLRLEAGMNLYGQEMDETISPLAANMGWTIAWEPTDRDFIGREALEVQREHGTEKLVGLVMTEKGVLRNELPVRFTDAQGNQHEGIITSGTFSPTLGYSIALARVPEGIGETAIVQIRNREMPVKVTKPVFVRNGKAVA

SEQ ID NO: 3049 - DNA, 1092 bp, Staphylococcus aureus
  CDS (1)..(1092): transl_table=11
atgtcaagtgatttaaaacaaacacctttatatcaaaattatgttgatagaggtgcaaaaattgtggaattcggaggatgggcgatgcctgttcaattttcaagtattaaagaggagcataatgctgttcgatacgaaattggcctgtttgatgttagtcatatgggtgaaattgaagtaacaggtaaagatgctagtcagtttgtgcaatatttattatcaaatgatactgataatttaactacttcaaaagcattatatactgctttatgtaatgaagaaggcggtattattgatgatttagtaatatataaattagctgacgacaattatttattagttgttaatgctgctaatactgaaaaagattttaattggattttaaaacacaaagagaaatttgatgttgaagtacaaaatgtatcaaaccaatatggtcaattagcaatacaaggaccaaaagctagagatttaattaatcaattagttgatgaagatgtaactgaaatgaaaatgtttgaatttaaacagggtgtcaaattatttggagcaaacgtcattttatctcagtcaggttacacaggtgaagatgggtttgaaatttattgtaatatcgatgatactgaaaaaatttgggatggtttattagagtataatgttatgccatgtgggttaggcgctcgtgatacattaagattagaggctggattgccattacatggacaagatttaactgaatcaattacaccatatgaaggtggtatcgcttttgcaagtaaaccattaattgatgctgattttattggtaaatctgtattaaaagatcaaaaagaaaatggtgcaccaagaagaacagtgggattagaattacttgaaaaaggaattgcaagaactggttatgaagttatggatttagatggaaatattattggagaagtaacttcaggaacacagtctccatcatcaggaaaatcaattgcacttgcaatgataaaaagagatgagtttgaaatgggtagagagttgcttgttcaagttcgtaagcgtcaattaaaagcgaaaattgttaagaaaaatcaaattgataaataa

SEQ ID NO: 3050 - protein, 363 aa, Staphylococcus aureus
MSSDLKQTPLYQNYVDRGAKIVEFGGWAMPVQFSSIKEEHNAVRYEIGLFDVSHMGEIEVTGKDASQFVQYLLSNDTDNLTTSKALYTALCNEEGGIIDDLVIYKLADDNYLLVVNAANTEKDFNWILKHKEKFDVEVQNVSNQYGQLAIQGPKARDLINQLVDEDVTEMKMFEFKQGVKLFGANVILSQSGYTGEDGFEIYCNIDDTEKIWDGLLEYNVMPCGLGARDTLRLEAGLPLHGQDLTESITPYEGGIAFASKPLIDADFIGKSVLKDQKENGAPRRTVGLELLEKGIARTGYEVMDLDGNIIGEVTSGTQSPSSGKSIALAMIKRDEFEMGRELLVQVRKRQLKAKIVKKNQIDK

SEQ ID NO: 3051 - DNA, 1092 bp, Staphylococcus aureus
  CDS (1)..(1092): transl_table=11
atgtcaagtgatttaaaacaaacacctttatatcaaaattatgttgatagaggtgcaaaaattgtggaattcggaggatgggcgatgcctgttcaattttcaagtattaaagaggagcataatgctgttcgatacgaaattggcctgtttgatgttagtcatatgggtgaaattgaagtgacaggtaaagatgctagtcagtttgtgcaatatttattatcaaatgatactgataatttaactacttcaaaagcattatatactgctttatgtaatgaagaaggcggtattattgatgatttagtaatatataaattagctgacgacaattatttattagttgttaatgctgctaatactgaaaaagattttaattggattttaaaacacaaagagaaatttgatgttgaagtacaaaatgtatcaaaccaatatggtcaattagcaatacaaggaccaaaagctagagatttaattaatcaattagttgatgaagatgtaactgaaatgaaaatgtttgaatttaaacagggtgtcaaattatttggagcgatcgtcattttatctcagtcaggttacacaggtgaagatgggtttgaaatttattgtaatatcgatgatactgaaaaaatttgggatggtttattagagtataatgttatgccatgtgggttaggcgctcgtgatacattaagattagaggctggattgccattacatggacaagatttaactgaatcaattacaccatatgaaggtggtatcgcttttgcaagtaaaccattaattgatgctgattttattggtaaatctgtattaaaagatcaaaaggaaaatggtgcaccaagaagaacagtgggattagaattacttgaaaaaggaattgcaagaactggttatgaagttatggatttagatggaaatattattggagaagtaacttcaggaacacagtctccatcatcaggaaaatcaattgcacttgcaatgataaaaagagatgagtttgaaatgggtagagagttgcttgttcaagttcgtaagcgtcaattaaaagcgaaaattgttaagaaaaatcaaattgataaataa

SEQ ID NO: 3052 - protein, 363 aa, Staphylococcus aureus
MSSDLKQTPLYQNYVDRGAKIVEFGGWAMPVQFSSIKEEHNAVRYEIGLFDVSHMGEIEVTGKDASQFVQYLLSNDTDNLTTSKALYTALCNEEGGIIDDLVIYKLADDNYLLVVNAANTEKDFNWILKHKEKFDVEVQNVSNQYGQLAIQGPKARDLINQLVDEDVTEMKMFEFKQGVKLFGAIVILSQSGYTGEDGFEIYCNIDDTEKIWDGLLEYNVMPCGLGARDTLRLEAGLPLHGQDLTESITPYEGGIAFASKPLIDADFIGKSVLKDQKENGAPRRTVGLELLEKGIARTGYEVMDLDGNIIGEVTSGTQSPSSGKSIALAMIKRDEFEMGRELLVQVRKRQLKAKIVKKNQIDK

SEQ ID NO: 3053 - DNA, 1119 bp, Streptomyces avermitilis
  CDS (1)..(1119): transl_table=11
atgagcagcaacgcaccccgtcacaccgcgctcgatgccctgcatcgctcgctgggcgcgacgatgaccgacttcgcagggtgggacatgcccctgcgctacggctccgagcgcgacgagcacctcgccgtccgcagcaaggccggtctcttcgacctctcccacatgggcgagatcaccgtcaccggccccggggccgccgcgctcctgaactacgcgctggtcggcaacatcgcctccgtcggcgtcggccgcgcccgctacaccatgatctgccgggccgacggcggcatcctcgacgacctgatcgtgtaccggctccaggagcagacgtacctggtcgtggccaacgcctccaacgcccaggtcgtcctggacgcgctcaccgagcgggccggcggcttcgacgcggtcgtgcgcgacgaccgtgacgcgtacgcgctgatcgccgtgcagggcccggagtcccccggcatcctcaagtcgctgaccgacgcggacctggacggcctcaagtactacgcgggtctgccgggcacggtcgcgggcgtcccggcgctcatcgcccgcaccggctacacgggtgaggacggcttcgagctgttcgtcgaccccgcggacgccgagaagctgtggcaggcgctgaccgaggcgggcgccccggccgggctcgtcccctgcggtctgtcctgccgggacacgctgcgcctggaggcgggcatgccgctgtacgggcatgagctgagcacctcgctcacccccttcgacgcggggctcgggcgggtcgtgaagttcgagaaggagggtgacttcgtggggcgcgaggcgctcaccgaggccgccgccctggccgagaagaacccgccgcgcgtcctcgtcggactgatcgccgagggccgccgggtgccgcgtgccgggtaccccgtcgtcgtcggcggcgaggtgatcggcgaggtcacctccggcgccccctcccccacgctgggcaggccgatcgcgatggcgtacgtcgacgccgcgcacgcggcgccgggcacggccggggtcggcgtggacatccggggcagccacgagccgtacgaggtcgtggcgctgccgttctaccggcgccagaagtga

SEQ ID NO: 3054 - protein, 372 aa, Streptomyces avermitilis
MSSNAPRHTALDALHRSLGATMTDFAGWDMPLRYGSERDEHLAVRSKAGLFDLSHMGEITVTGPGAAALLNYALVGNIASVGVGRARYTMICRADGGILDDLIVYRLQEQTYLVVANASNAQVVLDALTERAGGFDAVVRDDRDAYALIAVQGPESPGILKSLTDADLDGLKYYAGLPGTVAGVPALIARTGYTGEDGFELFVDPADAEKLWQALTEAGAPAGLVPCGLSCRDTLRLEAGMPLYGHELSTSLTPFDAGLGRVVKFEKEGDFVGREALTEAAALAEKNPPRVLVGLIAEGRRVPRAGYPVVVGGEVIGEVTSGAPSPTLGRPIAMAYVDAAHAAPGTAGVGVDIRGSHEPYEVVALPFYRRQK

SEQ ID NO: 3055 - DNA, 1119 bp, Streptomyces coelicolor
  CDS (1)..(1119): transl_table=11
atgagcagtaccgaactgcgccgtaccgcgctcgatgccacgcatcgcgcgctgggcgcgacgatgaccgacttcgccggctgggacatgccgctgcgctacggctccgagcgcgaggagcacgtcgcggtgcgcacccgcgccggtctcttcgacctgtcgcacatgggtgagatcaccgtcaccggcccgcaggcggccgagctgctgaacttcgcgctggtcggcaacatcggcaccgtgaagccgggccgggcgcgctacaccatgatctgccgcgaggacggcggcatcctggacgacctgatcgtctatcggctcgaagaggccgagtacatggtcgtcgccaacgcctccaacgcccaggtcgtcctggacgcgctgaccgagcgggcggccgggttcgacgccgaggtgcgcgacgaccgggacgcctacgcgctgctcgccgtgcagggccccgagtccccgggcatcctcgcgtcgctcaccgacgccgatctggacggcctgaagtactacgccggtctgcccggaacggtcgccggcgtcccggcgctgatcgcgcgcaccggctacaccggcgaggacggcttcgagctgttcgtgaagccggagcacgccgtcgggctgtggcaggcactgaccggggcgggcgaggccgcggggctgatcccgtgcggtctgtcctgccgggacacgctccgcctggaggcgggcatgccgctgtacggcaacgagctgtcgaccgcgctgacgccgttcgacgccggtctgggccgggtggtgaagttcgagaaggagggcgacttcgtcgggcgcgccgcgctgaccgaggccgccgagcgcgccgcttcccggccgccccgcgtcctggtcggcctggtcgccgagggccgccgggtcccgcgctccgggtaccgggtcgtcgcgggcggcgaggtgatcggcgaggtcacctccggcgctccgtccccgacgctgggcaggccgatcgccatggcgtacgtcgaccccgcacacgcggccccgggcaccgagggcgtgggcgtggacatccggggcagccacgagccgtacgaggtcgtggcgctgccgttctacaagcgccagaagtag

SEQ ID NO: 3056 - protein, 372 aa, Streptomyces coelicolor
MSSTELRRTALDATHRALGATMTDFAGWDMPLRYGSEREEHVAVRTRAGLFDLSHMGEITVTGPQAAELLNFALVGNIGTVKPGRARYTMICREDGGILDDLIVYRLEEAEYMVVANASNAQVVLDALTERAAGFDAEVRDDRDAYALLAVQGPESPGILASLTDADLDGLKYYAGLPGTVAGVPALIARTGYTGEDGFELFVKPEHAVGLWQALTGAGEAAGLIPCGLSCRDTLRLEAGMPLYGNELSTALTPFDAGLGRVVKFEKEGDFVGRAALTEAAERAASRPPRVLVGLVAEGRRVPRSGYRVVAGGEVIGEVTSGAPSPTLGRPIAMAYVDPAHAAPGTEGVGVDIRGSHEPYEVVALPFYKRQK

SEQ ID NO: 3057 - DNA, 1128 bp, Symbiobacterium thermophilum
  CDS (1)..(1128): transl_table=11
gtgaacgagtcgctgaaacggacgcccctgtacgagctgcatctgaagctgggcgcccgcatggtgcccttcggcggctgggagatgcccgtgcagtactccagcgtcatcgaggagcaccgggccgtgcgtgaggcggcgggcctcttcgacgtgtcgcacatgggcgagtttgaggtgagggggccccaggccctggacctcatccagctggtgagcaccaacgacgccgccaaactggcggtcgggcgggttcagtacgcgctgatgtgctacgagaacggcaccgtggtcgacgacatcctcatctaccggctggacgagcaccgctactggctggtggtcaacgccgggaacacccagaaggactgggaatggatcaacaccgcccgggagcgggccggcctgcacaacctggagctcatcgaccggtcggcggagatcgccctgctggccctgcaggggccgaaggcggaggagatcctgcagccgctcgcgaccggcgtcgtgctgtcgcagctggagcccttcagcctggcgaagaacgtcacggtatccggggtgccgaccctggtgctctcccgcacggggtacaccggcgaggacggcttcgagatctacgtgaaggccgaagacgtcgccgccctctgggaggccttgctggaggcgggcgacgagcaggggctcctgccctgcggcctcggcgcccgggacaccctgcggttcgaggcgaagctgcccctttacggccacgagatcagcgaccagcacaacccgctggaggcggggctgggcttcgccgtcaagctgaagaagggcgtggacttcatcggccgggacgccctggccaggatcaaagagcaggggccgacccggaagctggtgggcatcgagatgatcgaccggggcgtgccccggcagggttaccccgtcgccgtggggggcgaggtggtcggcgaggtgaccacgggaagcttctcgcccacgctggagaagaacattgcattggcctacgtgcccgtcgcccacagcgccgtgggcaccgaggtggaggtcatcatccggggccgggcgctgaaggcgcgggtcgtggagacccccttctaccggtcgccgcacagacgataa

SEQ ID NO: 3058 - protein, 375 aa, Symbiobacterium thermophilum
MNESLKRTPLYELHLKLGARMVPFGGWEMPVQYSSVIEEHRAVREAAGLFDVSHMGEFEVRGPQALDLIQLVSTNDAAKLAVGRVQYALMCYENGTVVDDILIYRLDEHRYWLVVNAGNTQKDWEWINTARERAGLHNLELIDRSAEIALLALQGPKAEEILQPLATGVVLSQLEPFSLAKNVTVSGVPTLVLSRTGYTGEDGFEIYVKAEDVAALWEALLEAGDEQGLLPCGLGARDTLRFEAKLPLYGHEISDQHNPLEAGLGFAVKLKKGVDFIGRDALARIKEQGPTRKLVGIEMIDRGVPRQGYPVAVGGEVVGEVTTGSFSPTLEKNIALAYVPVAHSAVGTEVEVIIRGRALKARVVETPFYRSPHRR

SEQ ID NO: 3059 - DNA, 1101 bp, Synechococcus elongatus
  CDS (1)..(1101): transl_table=11
atgatctctatggctgaagcattgcaacgtacccccctctatcctctacatcagggagcacggtttaccccctttggcgattgggagatgcccctccagtacagcagtattttgcaggaacaccaagccgtacggcagcaggtggggatgtttgatatttcccacatgggcaagttggtgctgcggggagagggagtactaggggcgctgcaaaccttagtgcccacgaatctgagccagctacagcccggccaagcaaaatacaccgttctcctgaacgaggccgggggcattgtcgatgatgtcattctctacatgggtgatggccaagtccgctgtattgtgaatgcggctaccactgccaaggactgggcatggtttcaaaagtatttacccgccagtattgaggtgattgatgagtcggcgagccaggtgttgattgctctccaagggccggcggcgacggcaacgctgtctcccttgtgcgatcgccccctaggggagatcaagacctatcgccatgctccagtgaacctactgggacagcctgcttggatagcgcgcaccggctacacaggtgaagatggttgggaaattcttgtccccgccgaactggggcaacagttgtggcaaaccctgttggcggcaggtgtgactccctgtgggttgggggcgcgcgatacgctgcggttggaggccgccatgctcctctacggccaggatatggatgagcaaactacccccctagaggcgggtctcgatgggttaattgattggcaaaagcccgattttgtgggtcgtgctgcccttttagctcaaaagcagcagggcattgagcggcaattggtggggttagaactactgggcaaaggcattgctcgccacggctacccaatctacgcaggagcccaggccgtgggggaggttaccagtggcaccctatctcccacgttggggaaggcgatcgcccttggctatgtctttccagagtttgcccacataggtcgtgaactggcggtgcaggtgcgcgatcgctgggtgccagcggtggtggtgcctcgacccttttatcgccggccgcggtcaacggctaaaatttga

SEQ ID NO: 3060 - protein, 366 aa, Synechococcus elongatus
MISMAEALQRTPLYPLHQGARFTPFGDWEMPLQYSSILQEHQAVRQQVGMFDISHMGKLVLRGEGVLGALQTLVPTNLSQLQPGQAKYTVLLNEAGGIVDDVILYMGDGQVRCIVNAATTAKDWAWFQKYLPASIEVIDESASQVLIALQGPAATATLSPLCDRPLGEIKTYRHAPVNLLGQPAWIARTGYTGEDGWEILVPAELGQQLWQTLLAAGVTPCGLGARDTLRLEAAMLLYGQDMDEQTTPLEAGLDGLIDWQKPDFVGRAALLAQKQQGIERQLVGLELLGKGIARHGYPIYAGAQAVGEVTSGTLSPTLGKAIALGYVFPEFAHIGRELAVQVRDRWVPAVVVPRPFYRRPRSTAKI

SEQ ID NO: 3061 - DNA, 1119 bp, Synechococcus sp
  CDS (1)..(1119): transl_table=11
gtgactctgactgtgaccgtttctctcttgtcttcccctctgcattcagtgtgcacttcagcgggagctcggttcacggggtttgcaggctgggagttacccctgcagtttcaagggctcatgcaagagcatctcgctgttcgtgagcgagcagggctatttgatatttcccacatgggcaagtttcagttgcgcggctccggccttcgggcggctttgcaacgtctgctgcccagtgatttgacgactctgttgccggggcaggctcaatactcagtgcttttgaatgaagcaggaggctgccttgatgacctgattgtctactggcagggaattgtcgatggtgtcgaacaggcgtttttgattgtcaacgctgcgacgactgacagcgatcgcctctggctgacagagcatttaccgcccgcaatcgccctcctagatctcagtcaagacttggcgttagttgcgattcaaggtccccaagcgatcgctttccttcagcctcttgtcagttgcgatctggcagaactgccgcgctttagccacacggtgacttcgatcgctggtcaaccggcctttgttgcccgcaccggctacacgggcgaagatggctgcgaggtgatgctgccgcccgcagccgcgatcactctctggcaacagctgaccgccgctggggttgtgccctgtggactgggggctcgcgatacgctgcggctggaagccgctatgccgctctacggtcatgagctggacactgacaccaatcctctcgaagctggattgggctgggtagttcatctcgaccggaatcctgacttcctcgggcgcgatcgccttgtgcaagcgaaaaccaacggtctcgaacgtcgcttggtcggcctcgagctgcctggccggaatattgcccgacatggctatcctgttgcgatcgctgataccacggtcggaattgttaccagtggcagttggtcgcccaccctcagcaaagcgatcgcccttgcctacgtccctcccgccttggccaatcttgggcaggaactctgggtcgaaattcggggcaaacaggtgcccgccacagtcgtcaagcgccccttctaccgtggcagccagttccgttaa

SEQ ID NO: 3062 - protein, 372 aa, Synechococcus sp
MTLTVTVSLLSSPLHSVCTSAGARFTGFAGWELPLQFQGLMQEHLAVRERAGLFDISHMGKFQLRGSGLRAALQRLLPSDLTTLLPGQAQYSVLLNEAGGCLDDLIVYWQGIVDGVEQAFLIVNAATTDSDRLWLTEHLPPAIALLDLSQDLALVAIQGPQAIAFLQPLVSCDLAELPRFSHTVTSIAGQPAFVARTGYTGEDGCEVMLPPAAAITLWQQLTAAGVVPCGLGARDTLRLEAAMPLYGHELDTDTNPLEAGLGWVVHLDRNPDFLGRDRLVQAKTNGLERRLVGLELPGRNIARHGYPVAIADTTVGIVTSGSWSPTLSKAIALAYVPPALANLGQELWVEIRGKQVPATVVKRPFYRGSQFR

SEQ ID NO: 3063 - DNA, 1104 bp, Synechococcus sp
  CDS (1)..(1104): transl_table=11
atgaccctgcagcgcacgccactccatcagctctgccaggacggcggcggccgcatggtgcccttcgccggttgggagatgccggtgcagttcagcggcctgatccaggagcacaaggccgtacgggaacaggtggggatgttcgacatctcccacatgggcgtcttgaggctggaaggtccgaatccgaaagatgcgctgcaacagcttgtgccgagcgatctgcatcgcatcggacccggcgaagcctgctacaccgtcttgctcaacgagagcggtggcatccgcgatgacctgatcgtttacgactgcggcgccgttgatgccgaacggggtgccctggtgctggtgatcaatgcagcctgcgcagaggcggacaccgcctggatccgtgaccaaatggaaccggctggcctcacggtgagcgacctcaaggcgggtggcgtactgctggccctgcaaggcccgcagtccatccctctgctggaggagctgtccggcgaaagcctcagcgacttgccccgcttcggacatcgcaccctgagcctgaaagatattgcccatcccgtgtttacgggccgcacgggctacaccggtgaggacggtgccgagttgctgctgaccgccgccgacggacaaaagctctggcagattctgctggatcgcggcgtcagcccctgtggcctgggcgcacgggacaccctgcgtctcgaagctgccatgcatctctacggcatggacatgaatgccgaaaccaccccttttgaagcagggctcggctggctggtgcatctggagatgcccgtggatttcgtcggtcggcaggccctagagcaagccgcagagtccggtcccaccaaacgactcgtgggcctcaagttgcagggacgcgccatcgcccgtcacgactaccccgtgctccacaacggcgagaccgtcggtgtggtgaccagcggcacctggtctccaaccctggaggagcccatcgcgctggcttacgtccccacagccctggccaaactcggcgcagaactcagcgttgaaatccgcggtaaggcccaacccgcctgcgtagtgaaacgccccttctaccgccggtcctga

SEQ ID NO: 3064 - protein, 367 aa, Synechococcus sp
MTLQRTPLHQLCQDGGGRMVPFAGWEMPVQFSGLIQEHKAVREQVGMFDISHMGVLRLEGPNPKDALQQLVPSDLHRIGPGEACYTVLLNESGGIRDDLIVYDCGAVDAERGALVLVINAACAEADTAWIRDQMEPAGLTVSDLKAGGVLLALQGPQSIPLLEELSGESLSDLPRFGHRTLSLKDIAHPVFTGRTGYTGEDGAELLLTAADGQKLWQILLDRGVSPCGLGARDTLRLEAAMHLYGMDMNAETTPFEAGLGWLVHLEMPVDFVGRQALEQAAESGPTKRLVGLKLQGRAIARHDYPVLHNGETVGVVTSGTWSPTLEEPIALAYVPTALAKLGAELSVEIRGKAQPACVVKRPFYRRS

SEQ ID NO: 3065 - DNA, 1119 bp, Synechocystis sp
  CDS (1)..(1119): transl_table=11
gtggccaatcttttccctgccttgcgtactcccctttacaacctcattacggaacaaactaccaagctcacaacctttgggggttgggaaatgccggtacaatttgctgggctaaaacaggaacaccaagcggtgcgggaaaaggtggggatgtttgatatttcccatatggggaagtttgtcctgactggacagaaggttttggcagcattgcaaagtttagtgccttcagatttagaccgtttaactcccggtaaagcccagtacactgtgttgttgaatgcccaagggggaatcattgatgacattattgtttatgaccagggcaaaaacccagaaggacaagaacgggtaactttaattgttaatgccgccacgacggtcaaggataagcagtggttactggagcatttacctgaagagattgattttcaagatttatccagggaaaaggttttaattgccctccaaggcccagaggcacttacaattttgcagcctttagtggatcagaatttaggtgaattacccgcctttggccatttggaagcagaatttctcagggaaaaagccttcattgcccgtactggttataccggggaagatggcttcgaaattatggtttccccagaagtgggaaaacaactctggcaaactttcgggtcaaaaggtgttactccctgcggtttaggagccagggataccttacggttggaagctggcatgggtttgtatggacaggatatgaatgacgaaacaacgcccctggaagcaggtttgggttggttggtacaccttgatagtaaaggggatttcattggtcgtgcggtgttgacagaacaaaaagccaatggagtggaaaaacgtttagtgggcttggagatgttggcaaaacaaattgcccgccatgattatcctattctccacaacggcgaaattatgggcattgtcaccagtggcaccctttctcctaccctgcaaaaggcgatcgccttgggttacgtccccacggaactggccaaagtgggccaggaattggaagtggaagttcggggtaaaacttatggcataaaagttgtgaaaaagctcttttatcgttccgagcaaaaacctcgttaa

SEQ ID NO: 3066 - protein, 372 aa, Synechocystis sp
MANLFPALRTPLYNLITEQTTKLTTFGGWEMPVQFAGLKQEHQAVREKVGMFDISHMGKFVLTGQKVLAALQSLVPSDLDRLTPGKAQYTVLLNAQGGIIDDIIVYDQGKNPEGQERVTLIVNAATTVKDKQWLLEHLPEEIDFQDLSREKVLIALQGPEALTILQPLVDQNLGELPAFGHLEAEFLREKAFIARTGYTGEDGFEIMVSPEVGKQLWQTFGSKGVTPCGLGARDTLRLEAGMGLYGQDMNDETTPLEAGLGWLVHLDSKGDFIGRAVLTEQKANGVEKRLVGLEMLAKQIARHDYPILHNGEIMGIVTSGTLSPTLQKAIALGYVPTELAKVGQELEVEVRGKTYGIKVVKKLFYRSEQKPR

SEQ ID NO: 3067 - DNA, 1050 bp, Thermus thermophilus
  CDS (1)..(1050): transl_table=11
atgaagaagacccccctttacgaggcccaccttcgcctgggcgcccggatggtggacttcgccgggtacctcctccccctccagtacacctccatcgtggaggagcacctggccgtgcgccgggcggtcggggtttttgacgtgagccacatgggggagtttctggtccggggcgaggaggccctggccttcctccagtgggccacggcgaacgacgcaggcaagctcaaggtgggaagggcccagtactccatgctccccaacgagcggggcggggtggtggacgacatctacctctaccgcctgggggaagaggagtacctcatggtggtgaacgccgccaacatcgccaaggacctcgcccacctccaggccttggccaaggggttcagggtggagcttgaggacgcctccgaaaggaccgccctcctcgccctccagggccccaaggcccaggccctcctccagggcctcgtggacgtggatctctccacgaagcggaagaacgacgtcttccccgcccgggtggcgggccggcccgcccgcctcgcccgcacggggtacacgggggaggatgggtttgagctcttcctcgccccggaggacgccgagcccgtctttctggccctggtggaggccggggccaagcccgcgggcctcggggcccgggactccttgaggctcgaggcgggcttccccctctacggccacgagctcaccgaggagaccaaccccctctgcaccccctgggcctgggtggtgaagaaggaaaaggcgtttttgggcaaggaggccatgctggcccaggcctgccgggagcgcctcgtgggcctcgttctggaagggggcatcccccgggagggctaccgggtgctctctgggggctgccccgtgggccgggtgacgagcggcgggtattcgcccctgctgcagaggggcatcgccctcgcctacgtggaggaaggggcggaggggcctttccaggtggaggtccggggccgggcggtccccgccgcccttagccccctcccctttgtgccgctaaaatag

SEQ ID NO: 3068 - protein, 349 aa, Thermus thermophilus
MKKTPLYEAHLRLGARMVDFAGYLLPLQYTSIVEEHLAVRRAVGVFDVSHMGEFLVRGEEALAFLQWATANDAGKLKVGRAQYSMLPNERGGVVDDIYLYRLGEEEYLMVVNAANIAKDLAHLQALAKGFRVELEDASERTALLALQGPKAQALLQGLVDVDLSTKRKNDVFPARVAGRPARLARTGYTGEDGFELFLAPEDAEPVFLALVEAGAKPAGLGARDSLRLEAGFPLYGHELTEETNPLCTPWAWVVKKEKAFLGKEAMLAQACRERLVGLVLEGGIPREGYRVLSGGCPVGRVTSGGYSPLLQRGIALAYVEEGAEGPFQVEVRGRAVPAALSPLPFVPLK

SEQ ID NO: 3069 - DNA, 1125 bp, Thermoanaerobacter tengcongensis
  CDS (1)..(1125): transl_table=11
atgaaagggtgtgatagtttggataatctcaaaaaaaccccattgtatgaaatttatcctaagtacaatgcaaaaataatagactttgccggctgggcaatgccagttcaattcgaaagcataatatcagaacacgaagctgtcagaaatgcagcaggccttttcgatgtatcccatatgggagaaataattgtaaaaggaaaagatgcgtttcctttcctccagaacctcctcacaaatgacctttccaagttaaatgacaatcaggtgctttacactttcatgtgcaatcacaacggaggagtaattgacgaccttctagtctacaagtattccaacaactactatcttttagtagttaatgcagcaaacatagaaaaggattacaaatggatgctgaacaatgcaggaatatacaaagtggaaattgaaaatgtgtcagataagatagcagaactagcaattcagggtccaaaagcagaagaaatccttcaaaaattgactgatgaggacctatcacagatcaagttcttctacttcaaagataaagtaaaaattgctggtgtagaatgcttagtttcccgcacaggttacactggtgaagacggatttgaaatttatatgccaaatgaacatgctgtcaccctttgggagaaaattttagaggcgggcaaagattacggcctcaagccggcaggtcttggcgcaagagatacacttcgctttgaagcaggtttgcctctttatggaaatgaattaggagaggacataactcctttagaagcaggtttaggattttttgtgaagtttgacaaaggaaattttattggaaaagacgctcttttaaaacagaaggaacaaggattaaagagaaaactggtaggatttgaaatgataggcaatggaattccaagacacgggtatgaagtacaggctgataatcaaaaaattggctatgtgactacgggttatttctctccaactcttaaaaagaacataggactcgctttgattgactcaaaatacgcccaaataggaaatcaaattgaggtaataataagaaataagccgcttaaagcggtgatagtagataagaatttctacaagaaaaattacaaaaaatag

SEQ ID NO: 3070 - protein, 374 aa, Thermoanaerobacter tengcongensis
MKGCDSLDNLKKTPLYEIYPKYNAKIIDFAGWAMPVQFESIISEHEAVRNAAGLFDVSHMGEIIVKGKDAFPFLQNLLTNDLSKLNDNQVLYTFMCNHNGGVIDDLLVYKYSNNYYLLVVNAANIEKDYKWMLNNAGIYKVEIENVSDKIAELAIQGPKAEEILQKLTDEDLSQIKFFYFKDKVKIAGVECLVSRTGYTGEDGFEIYMPNEHAVTLWEKILEAGKDYGLKPAGLGARDTLRFEAGLPLYGNELGEDITPLEAGLGFFVKFDKGNFIGKDALLKQKEQGLKRKLVGFEMIGNGIPRHGYEVQADNQKIGYVTTGYFSPTLKKNIGLALIDSKYAQIGNQIEVIIRNKPLKAVIVDKNFYKKNYKK

SEQ ID NO: 3071 - DNA, 1110 bp, Xanthomonas axonopodis pv
  CDS (1)..(1110): transl_table=11
atgacccagaagaccatcctcaacgacacccatcgtgcgcttggcgccaagatggtcgacttcggcggctgggacatgccgatccactacggctcgcaactggacgagcaccaccaggtgcgtcgcgacgccggcatgttcgacgtcagccacatgacggtggtcgacctgcacggcgcgcgggtgcgcgagtttctgcgctacctgctcgccaactcggtggacaagctcaaggtctccggcaaggcgctgtacacctgcatgctcaatccgcagggtggggtgatcgacgacctcatcgtctattacatgacagaagacttcttccgtctggtggtcaacgccgccacccgcgaaaaggacctgcagtggatcggcgagcaggccgcgcgcttcgacgtgcgcgtcgaagagcgcagcgacttcgccatgattgccgtgcaaggtcccagcgcgcgtaccaaggtcatcgacctgctcgaccctgccgacactgcagcggcgagcaagctcggccggttcgccgcgctgcagacgcgttcgcgcgatggcatcgagttgttccttgcgcgcaccggctacaccggcgaagacggtttcgaaatcgtgttgccgcagcaggccgccgtcgcattctggaatgcgttgctcgcgcagggcgtcaaaccggccggcctgggcgcacgcgacaccctgcgtctggaagcgggcatgaatctttacgggcaggacatggacgatggcgtcaccccttacgaggcagggctggcctggacgatcgccctggacgaaggacgcgacttcatcggtcgcagcgtgctcgaatcgcaaaaggcgcagggcgcaccgcgtcagctgatcggtgtggtgatggacgagaagggcgtgttacggcatggccagaccgtgctcaccgccaacggcgaaggcgagatcctgtccggcacgttctcgccgacgctgggcaaggcgatcgccttcgcgcgcgtgccggccggcagcatcgagcagctgcgcgtggacatccgcggcaaacaggtgccgttgagagcggtgaagtttccgttcgtgcgcgatggccaggcacagcccggcgtgctcggcgactga

SEQ ID NO: 3072 - protein, 369 aa, Xanthomonas axonopodis pv
MTQKTILNDTHRALGAKMVDFGGWDMPIHYGSQLDEHHQVRRDAGMFDVSHMTVVDLHGARVREFLRYLLANSVDKLKVSGKALYTCMLNPQGGVIDDLIVYYMTEDFFRLVVNAATREKDLQWIGEQAARFDVRVEERSDFAMIAVQGPSARTKVIDLLDPADTAAASKLGRFAALQTRSRDGIELFLARTGYTGEDGFEIVLPQQAAVAFWNALLAQGVKPAGLGARDTLRLEAGMNLYGQDMDDGVTPYEAGLAWTIALDEGRDFIGRSVLESQKAQGAPRQLIGVVMDEKGVLRHGQTVLTANGEGEILSGTFSPTLGKAIAFARVPAGSIEQLRVDIRGKQVPLRAVKFPFVRDGQAQPGVLGD

SEQ ID NO: 3073 - DNA, 1110 bp, Xanthomonas campestris pv
  CDS (1)..(1110): transl_table=11
atgacccagaagaccatcctcaacgacacccatcgcgcgctcggcgccaagatggtcgacttcggcggttgggacatgccgatccactacggctcgcagatcgacgaacaccaccaggtgcgtcgcgacgccggcatgttcgacgtcagccacatgaccgtggtcgatctgcacggcgtgcgcgtgcgcgagttcttgcgctacctgctggccaattcggtcgacaagctcaaggtctccggcaaggccttgtacacctgcatgctcaacccgcagggtggcgtgatcgacgacctgatcgtgtacttcatgcaggaagagtttttccgcctggtggtcaacgccgccacccgcgacaaggacctgcagtggatcggcgaacaggccgcacgcttcgaggtgcgcgtgaaagaacgcgccgacttcgccatgatcgcggtgcagggaccgaacgcgcgcagcaaggtgatcgacctgctcgaccccgccgacgctagcgctgcgagcaagctcggccgcttcgctgcgctgcagacgcgcacgcgcgatggcgttgcgttgttcctcgcgcgcaccggctacaccggtgaggacggttttgaaattgtgttgccgcaggctgatgcggtcgcgttctggaatgcgctgctcgcgcatggcgtggcgcctgccggcctgggcgcgcgcgacaccttgcgtctggaagcgggcatgaatctctacggccaggacatggacgacaacgtcactccgtacgaagccgcgctggcctggaccatcacgctcgacgaaggccgcgacttcatcggccgcagcgtgctggagtcgcagaaagcgcagggcgcaccccgccagatgatcggcgtggtcatggacgagaagggcgtgctgcgtcacggccagaaggtgctcagcgcaggcggcgaaggcgagatcctgtccggcacgttctcgcccaccctgggcaaggccattgcctttgcacgcgtgccggccggcagcatcgacgacctgcgcgtggacatccgtggcaagcaggtgcccttgcgcgcggtgaagtttccgtttgtgcgcgatggccaggcccagcccggcgtactcggcgcgtaa

SEQ ID NO: 3074 - protein, 369 aa, Xanthomonas campestris pv
MTQKTILNDTHRALGAKMVDFGGWDMPIHYGSQIDEHHQVRRDAGMFDVSHMTVVDLHGVRVREFLRYLLANSVDKLKVSGKALYTCMLNPQGGVIDDLIVYFMQEEFFRLVVNAATRDKDLQWIGEQAARFEVRVKERADFAMIAVQGPNARSKVIDLLDPADASAASKLGRFAALQTRTRDGVALFLARTGYTGEDGFEIVLPQADAVAFWNALLAHGVAPAGLGARDTLRLEAGMNLYGQDMDDNVTPYEAALAWTITLDEGRDFIGRSVLESQKAQGAPRQMIGVVMDEKGVLRHGQKVLSAGGEGEILSGTFSPTLGKAIAFARVPAGSIDDLRVDIRGKQVPLRAVKFPFVRDGQAQPGVLGA

SEQ ID NO: 3075 - DNA, 1107 bp, Xylella fastidiosa
  CDS (1)..(1107): transl_table=11
atgatcaaaaagaccattctcaatgacactcatcgggcactcggtgccaagatggtcgacttcagcggctgggaaatgcccattcactacggctcacagattgatgagcatcatcacgtcaggcgtaacgccggcatattcgacgtcagtcatatgaccgtcattgatttgcacgggacacaggtacgccccctcttgcgtcgactattagctaattcggtagataagctcaaagtacccggaaaagcactgtatagctgcatgttgaatccgcaaggcggtgtgatcgacgatttgatcgtctattacctacgtgaagattactttcgttttatcgtcaacgccgctacacgagaaaaggatttagcatggatcaatacacaagcatctgcgttcaacgtacgcgttgaagagcgtgcagacttggcaatgctcgccgtacaggggcctgccgcgcgcgcgcaggtcaccaacctattggccgagactcaccgcgacgcagtggaaaagctcggacgtttcgctgcactagaagtcgcatcgcactcgaaaaaaatcctctttatttcacgtactggatataccggtgaggacggctttgagatcttacttccacaagaagaaacgataacgttatggaatgcgctgttgaagacaggcgtgaaaccaatcggactaggcgcacgcgatacgttacgtctagaggcagggatgaatctctacggccaggatatggacgagcaggtttcaccctacgaagccgcactgggctggactgtcatgcttgatgaaggtcgcaacttcatcggccgcaacgtgctggaacagcaaaagactaacggcgtatcacggcagatgataggcctactcatggatgagaagggagtgcttcgccatggtcagaaagtattgaccgcacaaggcgagggccacatcctttccggtacgttttcaccaaccttgaacaaggctatcggattcgcgcgcgtgccagccggaaaaccaagtgaggtccgggtcaacatacgtgaccgtgaaatcccggtgcgggttgtcagattcccctttgtacgtgaaggccagacgcaaccaaacatttttgattga

SEQ ID NO: 3076 - protein, 368 aa, Xylella fastidiosa
MIKKTILNDTHRALGAKMVDFSGWEMPIHYGSQIDEHHHVRRNAGIFDVSHMTVIDLHGTQVRPLLRRLLANSVDKLKVPGKALYSCMLNPQGGVIDDLIVYYLREDYFRFIVNAATREKDLAWINTQASAFNVRVEERADLAMLAVQGPAARAQVTNLLAETHRDAVEKLGRFAALEVASHSKKILFISRTGYTGEDGFEILLPQEETITLWNALLKTGVKPIGLGARDTLRLEAGMNLYGQDMDEQVSPYEAALGWTVMLDEGRNFIGRNVLEQQKTNGVSRQMIGLLMDEKGVLRHGQKVLTAQGEGHILSGTFSPTLNKAIGFARVPAGKPSEVRVNIRDREIPVRVVRFPFVREGQTQPNIFD

SEQ ID NO: 3077 - DNA, 1107 bp, Xylella fastidiosa
  CDS (1)..(1107): transl_table=11
atgatcaaaaagaccattctcaatgacacccatcaagcactcggtgccaagatggtcgacttcagcggctgggaaatgcccattcactacggctcacagattgatgagcatcatcacgtcaggcgtaacgccggcatattcgacgtcagtcatatgactgtcattgatttgcacgggacacaggtacgccccctcttgcgtcgactattagctaattcggtagataagctcaaagtaccaggaaaagcactgtatagctgcatgttgaatccgcaaggcggtgtaatcgacgatttgatcgtctattacctacgtgaagattactttcgttttatcgtcaacgccgctacacgagaaaaggatttagcatggatcaatacacaagcatctgcgttcaacgtacgtgttgaagagcgtgcagacttggcaatgctcgccgtacaggggcctgccgcgcgcgcgcaggtcaccaacctattggccgagactcaccgcgacgcagtggaaaagctcggacgtttcgccgcactagaagtcgcatcgcactcgaaaaaacccctctttatttcacgtactggatataccggtgaggacggctttgagatcttacttccacaagaagaaacgataacgttatggaatgcgctgttgaagacaggcgtgaaaccaatcggactaggcgcacgcgatacgttacgtctagaggcagggatgaatctctacggccaggatatggacgagcaggtttcaccctacgaagcagcactgggctggactgtcatgcttgatgaaggtcgcaacttcatcggtcgcaacgtgctggaacagcaaaagactaacggcgtatcacgacagatgataggcctactcatggatgagaagggagtgcttcgccatggtcagaaagtattgaccgcacaaggtgagggccacatcctttccggtacgttttcaccaaccttgaacaaggctatcggattcgcgcgcgtgccagccggaaaaccaagtgaggtccgagtcaacatacgtgaccgtgaaatcccggtgcgggttgtcaaattcccctttgtacgtgaaggccagacgcaaccaaacatttttgattga

SEQ ID NO: 3078 - protein, 368 aa, Xylella fastidiosa
MIKKTILNDTHQALGAKMVDFSGWEMPIHYGSQIDEHHHVRRNAGIFDVSHMTVIDLHGTQVRPLLRRLLANSVDKLKVPGKALYSCMLNPQGGVIDDLIVYYLREDYFRFIVNAATREKDLAWINTQASAFNVRVEERADLAMLAVQGPAARAQVTNLLAETHRDAVEKLGRFAALEVASHSKKPLFISRTGYTGEDGFEILLPQEETITLWNALLKTGVKPIGLGARDTLRLEAGMNLYGQDMDEQVSPYEAALGWTVMLDEGRNFIGRNVLEQQKTNGVSRQMIGLLMDEKGVLRHGQKVLTAQGEGHILSGTFSPTLNKAIGFARVPAGKPSEVRVNIRDREIPVRVVKFPFVREGQTQPNIFD

SEQ ID NO: 3079 - DNA, 1098 bp, Yersinia pestis
  CDS (1)..(1098): transl_table=11
atggctaagcagaccccgctgtatgaccaacatgtcgcgtgcggtgcgcgtatggtagattttcatggttggatgatgccattgcattatggctcccaaattgacgaacaccattttgtgcggcaggacgcaggcatgtttgatgtctcccacatgaccatcgttgatttgcacggtaaccgtacccgtgagtttttgcgctatctgttggctaacgatgtagccaaactgacccaaccgggcaaagccctttacaccgggatgctgaatgaatccggcggtgttatcgatgatttgattgtttacttcctcagcgaagattatttccgtttagtggttaactccgccacccgtgataaagacctcgcttggataagtcagcatgctgaaccttatcaggtcgaggtcacggtgcgtgacgatctggcactgattgcagtacaaggcccacaagcccaacaaaaagttgccacgttactgaccaccgagcagcaacaggctattgcgggcatgaagccattctttggtattcaaaccggcgatttatttattgctaccacgggttataccggtgaagccgggtatgaaattgcgttgccgaaacagcaggttgttgcgttctggcagcaactattggccgccggtgtgaagcccgcaggtcttggtgcgcgtgatacgctgcgcttagaagcggggatgaacttatatggtcaggaaatggatgaaaaaacgtctccgttagccgctaatatggggtggacagtggcctggcaaccagaagatcgtcagtttattggtcgtgctgcgttggaaaggcagcgaatgaaggggactgagcaattggttggtctgatcatgacggaaaaaggcgtgttacgtaatgaattgccggtgtatttttttgatgccgcaggcaatcagcatgttggggtgataaccagcggttcattttcgccaacactgggtttcagtattgcgctagcccgtgtacccgcaggtatcggtgaacatgctgtggtacaaatccgtaaccgtgaaatgccggtacgggtaacaaaacccggttttgtgcgagcgggcaaagccatcgtattgtaa

SEQ ID NO: 3080 - protein, 365 aa, Yersinia pestis
MAKQTPLYDQHVACGARMVDFHGWMMPLHYGSQIDEHHFVRQDAGMFDVSHMTIVDLHGNRTREFLRYLLANDVAKLTQPGKALYTGMLNESGGVIDDLIVYFLSEDYFRLVVNSATRDKDLAWISQHAEPYQVEVTVRDDLALIAVQGPQAQQKVATLLTTEQQQAIAGMKPFFGIQTGDLFIATTGYTGEAGYEIALPKQQVVAFWQQLLAAGVKPAGLGARDTLRLEAGMNLYGQEMDEKTSPLAANMGWTVAWQPEDRQFIGRAALERQRMKGTEQLVGLIMTEKGVLRNELPVYFFDAAGNQHVGVITSGSFSPTLGFSIALARVPAGIGEHAVVQIRNREMPVRVTKPGFVRAGKAIVL

SEQ ID NO: 3081 - DNA, 1098 bp, Yersinia pseudotuberculosis
  CDS (1)..(1098): transl_table=11
atggctaagcagaccccgctgtatgaccaacatgtcgcgtgcggtgcgcgtatggtagattttcatggttggatgatgccattgcattatggctcccaaattgacgaacaccatcttgtgcggcaggacgcaggcatgtttgatgtctcccacatgaccatcgttgatttgcacggtaaccgtacccgtgagtttttgcgctatctgttggctaacgatgtagccaaactgacccaaccgggcaaagccctttacaccgggatgctgaatgaatccggcggtgttatcgatgatttgattgtttacttcctcagcgaagattatttccgtttagtggttaactccgccacccgtgataaagacctcgcttggataagtcagcatgctgaaccttatcaggtcgaggtcacggtgcgtgacgatctggcactgattgcagtacaaggcccacaagcccaacaaaaagttgccacgttactgaccaccgagcagcaacaggctattgcgggcatgaagccattctttggtattcaaaccggcgatttatttattgctaccacgggttataccggtgaagccgggtatgaaattgcgttgccgaaacagcaggttgttgcgttctggcagcaactattggccgccggtgtgaagcccgcaggtcttggtgcgcgtgatacgctgcgcttagaagcggggatgaacttatatggtcaggaaatggatgaaaaaacgtctccgttagccgctaatatggggtggacagtggcctggcaaccagaggatcgtcagtttattggtcgtgctgcgttggaaaggcagcgaatgaaggggactgagcaattggttggtctgatcatgacggaaaaaggtgtgttacgtaatgaattgccagtgtatttttttgatgccgcaggcaatcagcatgttggggtgataaccagcggttcattttcgccaacactgggtttcagtattgcgctagcccgtgtacccgcaggtatcggtgaacatgctgtggtacaaatccgtaaccgtgaaatgccggtacgggtaacaaaacccggttttgtgcgagcgggcaaagccatcgtattgtaa

SEQ ID NO: 3082 - protein, 365 aa, Yersinia pseudotuberculosis
MAKQTPLYDQHVACGARMVDFHGWMMPLHYGSQIDEHHLVRQDAGMFDVSHMTIVDLHGNRTREFLRYLLANDVAKLTQPGKALYTGMLNESGGVIDDLIVYFLSEDYFRLVVNSATRDKDLAWISQHAEPYQVEVTVRDDLALIAVQGPQAQQKVATLLTTEQQQAIAGMKPFFGIQTGDLFIATTGYTGEAGYEIALPKQQVVAFWQQLLAAGVKPAGLGARDTLRLEAGMNLYGQEMDEKTSPLAANMGWTVAWQPEDRQFIGRAALERQRMKGTEQLVGLIMTEKGVLRNELPVYFFDAAGNQHVGVITSGSFSPTLGFSIALARVPAGIGEHAVVQIRNREMPVRVTKPGFVRAGKAIVL

SEQ ID NO: 3083 - DNA, 1227 bp, Arabidopsis thaliana
  CDS (1)..(1227)
atgagaggtgggagtctatggcagctagggcaatcaataacccgtcgtcttgctcaatctgacaagaaggttgtgtcacgtcgctactttgcctctgaagctgacctgaaaaagactgctctttacgacttccatgttgcccatggaggaaagatggttccttttgctggttggagtatgccaattcagtacaaagattcgattatggactcaacggttaactgcagggaaaatgggagtttgtttgatgttgcacatatgtgtggtttgagccttaagggtaaagattgtgttccttttcttgagacacttgtggttgctgatgtggctggtttggctcctggaactgggagcttaactgtgttcacaaacgagaaaggaggtgccattgatgactcggtgattaccaaagtgacagatgaacatatctatttggtggtcaatgctggctgtagggataaggatttggctcacattgaagaacacatgaaggctttcaaatccaaaggaggtgatgtctcgtggcatatccacgacgagagatctcttcttgcccttcagggtcctttggctgctccagtgcttcaacacctgactaaagaagacttgagcaagctttactttggcaatttccagattctggacattaatggttccacatgtttccttaccaggactgggtataccggggaagatgggtttgagatttcggttccagatgagcatgctgtggatctagcaaaagcaatcttggagaagtccgagggtaaggtaaggcttacgggtctaggagcaagagacagtctcaggttagaagcaggactttgtctatatggaaacgacatggagcaacacatttctcctgttgaagctgggctcacatgggccatagggaagcgtagaagagccgaaggtggatttcttggcgcggatgtgattctccagcagcttaaagatggacctacaatcagaagggtcggtttcttctcctcaggaccacccgcaaggtcgcatagcgaggttcatgatgagagtgggaacaagattggagagatcacaagtggagggtttagcccgaacctgaagaagaacatagccatgggatatgtgaagtcaggtcagcacaagactgggactaaagtcaagatcttggtccgtgggaaaccatatgaaggcagcatcacgaagatgccattcgtggccaccaaatactacaaaccaacatga

SEQ ID NO: 3084 - protein, 408 aa, Arabidopsis thaliana
MRGGSLWQLGQSITRRLAQSDKKVVSRRYFASEADLKKTALYDFHVAHGGKMVPFAGWSMPIQYKDSIMDSTVNCRENGSLFDVAHMCGLSLKGKDCVPFLETLVVADVAGLAPGTGSLTVFTNEKGGAIDDSVITKVTDEHIYLVVNAGCRDKDLAHIEEHMKAFKSKGGDVSWHIHDERSLLALQGPLAAPVLQHLTKEDLSKLYFGNFQILDINGSTCFLTRTGYTGEDGFEISVPDEHAVDLAKAILEKSEGKVRLTGLGARDSLRLEAGLCLYGNDMEQHISPVEAGLTWAIGKRRRAEGGFLGADVILQQLKDGPTIRRVGFFSSGPPARSHSEVHDESGNKIGEITSGGFSPNLKKNIAMGYVKSGQHKTGTKVKILVRGKPYEGSITKMPFVATKYYKPT

SEQ ID NO: 3085 - DNA, 1227 bp, Oryza sativa
  CDS (1)..(1227)
atgagagggctactcgcgtgcgccacgctcgcccgccgcgccgccggcgcgacgtcgacggcgcggcggcacctggcgggcgcggccgaggcggcggaggcggagctgaagaagacggcgctgtacgacttccacgtcgcgcacggcgggaagatggtgccgttcgccgggtggagcatgcccatccagtacaaggacaccatcatggactccaccctcaactgccgcgccaacggcagcctcttcgacgtctcccacatgtgcggcctcagcctccacggccgccaggccatccccttcctcgagtccctcgtcgtcgccgacgtcgcggcgctcaaggacggcaccgggacgctcaccgtcttcaccaacgaccgcggcggcgccatcgacgactccgtcgttaccaaggtcaccgaccagcacatctacctcgtcgtcaacgccgggtgcagggacaaggatctcgcccacattggggagcacatggaggccttcaacaagaagggcggcgacgtcaagtggcacgtccacgatgagcgctcgcttcttgcattgcagggacctcttgctgcaccaactctccagttgctgacaaaagaagatttaagcaaaatgtatttcagtgacttcaagatgattgacatcaatggatatgcttgctttctcaccagaactggttataccggtgaagatgggtttgaaatctctgttccatcagagaatgcagttgatcttgcaaaggccctcctggagaaatctgaaggcaaggtgagactgactggtttaggtgcccgtgacagtctccgcttggaggctggcctctgcctgtacggcaacgacatggagcaacacatcacaccagttgaggctggtctctcatgggcaattggcaagaggaggaaagcagaaggcggcttcctgggagcagatgtgatcctcaagcagctccaggaaggcccaaagatcaggcgtgtcggtctcctctcgcaaggaccgcctcctcggagtcatagtgagattgtgagcaactccggggagaacattggtgaggttaccagtggagggttcagcccctgcttgaagaagaacatcgccatgggctacgtaaaatccggtttgcacaaggctgggacagagttcaaggttgtcgtccgtgggaagtcctacgatgccgtcgtcaccaagatgccgttcgtgccgaccaagtactacaaaccctcatag

SEQ ID NO: 3086 - protein, 408 aa, Oryza sativa
MRGLLACATLARRAAGATSTARRHLAGAAEAAEAELKKTALYDFHVAHGGKMVPFAGWSMPIQYKDTIMDSTLNCRANGSLFDVSHMCGLSLHGRQAIPFLESLVVADVAALKDGTGTLTVFTNDRGGAIDDSVVTKVTDQHIYLVVNAGCRDKDLAHIGEHMEAFNKKGGDVKWHVHDERSLLALQGPLAAPTLQLLTKEDLSKMYFSDFKMIDINGYACFLTRTGYTGEDGFEISVPSENAVDLAKALLEKSEGKVRLTGLGARDSLRLEAGLCLYGNDMEQHITPVEAGLSWAIGKRRKAEGGFLGADVILKQLQEGPKIRRVGLLSQGPPPRSHSEIVSNSGENIGEVTSGGFSPCLKKNIAMGYVKSGLHKAGTEFKVVVRGKSYDAVVTKMPFVPTKYYKPS

SEQ ID NO: 3087 - DNA, 1224 bp, Oryza sativa
  CDS (1)..(1224)
atgagggggggcttgtggcaacttgggcaatcgatcactcgccgtcttgcccatggagataagaaggctgttgctcgtcgatgttttgcctcagaagctgagctgaaaaagacagtgtttcatgacttccatgttgctcatggtgggaagatggttccatttgctgggtggagcatgccaatccaatacaaggactcaatcatggactctaccatcaactgtagggagaatggtagcctctttgatgtttcccatatgtgtgggctgagcctcaaagggaaggacgctgccccattccttgaaaagctggtcattgccgatgttgctgggcttgcccctggaactgggacgttgactgttttcacaaatgaaaagggaggtgcaattgatgattcagtaattactaaggtgacggatgaccacatatatttggttgtgaatgctggctgcagggataaagatctggctcatattgaggaacacatgaaagcattcaaggccaaaggtggtgatgtgtcttggcacatccacgatgagagatccctacttgctctgcagggtcctcttgctgcccccgttcttcaacacctgacaaaagaggatttgagcaagctctactttggggagttccgtgtgttggacatcaatggctcagagtgttttcttaccaggacagggtatactggggaagatggatttgagatctcagttccttcagagcatggagtagatcttgccaaagcaatactggaaaaatctgaagggaaggtaagattgacaggattgggagctagagatagtctgcgacttgaagctggattgtgcttatatggaaatgacatggaacagcacattacacctattgaggcaggactaacatgggctatagggaagaggaggagagcagaaggtggttttctaggagctgatgttatcctgaaacagcttgaagaaggtcctaaaatcaggcgtgttggtttcttttcttctggtccacctcccagaagccacagtgagattcaagatgaaggaggcaacaacattggggaaatcaccagtggtggattcagtccttgcctccagaagaacatagccatgggatatgtgaaatctggattgcacaaggcagccaccaaagtaaagattattattcggggaaaacccaatgaaggagtcgttacaaaaatgccatttgtaccaacaaaatactataagccttcctga

SEQ ID NO: 3088 - protein, 407 aa, Oryza sativa
MRGGLWQLGQSITRRLAHGDKKAVARRCFASEAELKKTVFHDFHVAHGGKMVPFAGWSMPIQYKDSIMDSTINCRENGSLFDVSHMCGLSLKGKDAAPFLEKLVIADVAGLAPGTGTLTVFTNEKGGAIDDSVITKVTDDHIYLVVNAGCRDKDLAHIEEHMKAFKAKGGDVSWHIHDERSLLALQGPLAAPVLQHLTKEDLSKLYFGEFRVLDINGSECFLTRTGYTGEDGFEISVPSEHGVDLAKAILEKSEGKVRLTGLGARDSLRLEAGLCLYGNDMEQHITPIEAGLTWAIGKRRRAEGGFLGADVILKQLEEGPKIRRVGFFSSGPPPRSHSEIQDEGGNNIGEITSGGFSPCLQKNIAMGYVKSGLHKAATKVKIIIRGKPNEGVVTKMPFVPTKYYKPS

SEQ ID NO: 3089 - DNA, 1224 bp, Glycine max
  CDS (1)..(1224)
atgagggggggcttatggcaactcgggcaatcaatcactcgccgtcttgcccagggtgataagaaggctgttgctcgtaggtattttgcctcagatgctgagctgaaaaagacagtcgtttatgacttccatgttgctaatggagggaagatggtgccatttgctggatggagcatgccaattcaatataaggactcaattatggactcaacccttaactgtagggagaatggtagcctttttgatgtttcccatatgtgcgggctaagcctcaagggaaaggactctgttccgttccttgaaaagcttgtcattgctgatgttgctgggcttgcccctggaactggttcattgactgtcttcacaaatgaaaaaggaggggcaattgatgattcagttattaccaaggtgaaggatgatcacatatacttggttgtgaatgctggatgtagggataaagatctggctcatattgaggagcatatgaaggcattcaaggccaaaggtggtgatgtgtcatggcacatccatgatgagagatctcttcttgctctgcagggtcctcttgctgctccggttcttcaacacctgacaaaagcagatttaagcaagatgtactttgggggtttccaagtgttggacatcaatggtgtgcagtgctttctcacacggacagggtatactggggaagatggatttgagatatcaattccctcagagagtgcagtggatcttgccaaggcaattcttgaaaaatctgaagggaagataagattgacaggattaggtgctcgagatagtctacgccttgaagctggattgtgtttatatggcaatgacttggaacagcacattacacctattgaggcaggactgacatgggccatagggaagagaaggagagcagaagggggttttctaggtgctgatgttatactaaaacagcttgaagaaggccctaagatcaggcgtgttggtttcttttcttctggccctcctcccagaagccacagtgagattcaagatgaaggagggaacaacattggggaagtcacaagtggcggattcagtccttgcctcaagaagaacatagccattggatatgtgaaatcaggattgcacaaagcaggcaccaaagtaaagattattattcgaggaaagtctaatgaaggagttgttacaaagatgccatttgtaccaacaaaatactataagccgtcctaa

SEQ ID NO: 3090 - protein, 407 aa, Glycine max
MRGGLWQLGQSITRRLAQGDKKAVARRYFASDAELKKTVVYDFHVANGGKMVPFAGWSMPIQYKDSIMDSTLNCRENGSLFDVSHMCGLSLKGKDSVPFLEKLVIADVAGLAPGTGSLTVFTNEKGGAIDDSVITKVKDDHIYLVVNAGCRDKDLAHIEEHMKAFKAKGGDVSWHIHDERSLLALQGPLAAPVLQHLTKADLSKMYFGGFQVLDINGVQCFLTRTGYTGEDGFEISIPSESAVDLAKAILEKSEGKIRLTGLGARDSLRLEAGLCLYGNDLEQHITPIEAGLTWAIGKRRRAEGGFLGADVILKQLEEGPKIRRVGFFSSGPPPRSHSEIQDEGGNNIGEVTSGGFSPCLKKNIAIGYVKSGLHKAGTKVKIIIRGKSNEGVVTKMPFVPTKYYKPS

SEQ ID NO: 3091 - DNA, 1251 bp, Linum usitatissimum
  CDS (1)..(1251)
atgatgagagggggaggtctatggcaatcaatggcgcgacacctctctcgccgcccggacaacaaaaaatccgccgcctccgccgtcgccaccggcggccggagatacctagcgtccgatgctgccgatctgaagaagacagtcctgtacgatttccacgtgtcccacggcgggaagatggtccctttcgcagggtggagcatgccgattcagtacaaggattcaatcatggactcgaccaccaactgcagggagaatgggagcttgttcgacgtgtctcacatgtgtgggctgagtctcaaggggaaagacgccatttctttccttgagaagcttgtgattgctgatgttgcctcgcttgctcctggcactggctctttgactgttttcactaatgagaaaggtggagccattgatgactctgtcattactaaagtgaccgatgaccacctttacttggtggttaatgctgggtgtagggacaaggatctggctcacattgaggagcatatgaaggcttttaaggctaaaggtggtgatgttgcttggcatattcatgatgagcgatcccttcttgccctccagggtcctctagcagcaccagttcttcaacacttgactaaggatgatttgagcaaaatgtactttggtgagttccgtatcttggacatcaatggctcttcctgctacctcactcggacagggtacactggcgaagacggtttcgagatctcggtcccttcagagaacgcagtggacttagccaaagcactcctcgaaaagtctgagggcaagataaggctgacagggctaggtgctcgtgacagtcttcgtctggaagctgggctgtgtctgtacggtaatgacatggaacagcacattactccagtggaggcaggattgacttgggccatagggaagaggagaagagctgaaggtggattccttggcgcggaagtgattctgaagcagctcgaggaaggtccgaagatcaggcgtgttgggttcacatcttcaggtccgcccccgaggtcccacagcgagatccaggacacaaacggggcgaacattggggaggtgactagcggagggtttagtccgtgcctcaagaagaacatttccatggggtacgtgaaatccgggctgcacaaggccggaaccactgtgaagttggtggtaagggggaaagcttatgatggtgttgttactaagatgccttttgtacctaccaaatactacaagcctacctaa

SEQ ID NO: 3092 - protein, 416 aa, Linum usitatissimum
MMRGGGLWQSMARHLSRRPDNKKSAASAVATGGRRYLASDAADLKKTVLYDFHVSHGGKMVPFAGWSMPIQYKDSIMDSTTNCRENGSLFDVSHMCGLSLKGKDAISFLEKLVIADVASLAPGTGSLTVFTNEKGGAIDDSVITKVTDDHLYLVVNAGCRDKDLAHIEEHMKAFKAKGGDVAWHIHDERSLLALQGPLAAPVLQHLTKDDLSKMYFGEFRILDINGSSCYLTRTGYTGEDGFEISVPSENAVDLAKALLEKSEGKIRLTGLGARDSLRLEAGLCLYGNDMEQHITPVEAGLTWAIGKRRRAEGGFLGAEVILKQLEEGPKIRRVGFTSSGPPPRSHSEIQDTNGANIGEVTSGGFSPCLKKNISMGYVKSGLHKAGTTVKLVVRGKAYDGVVTKMPFVPTKYYKPT

SEQ ID NO: 3093 - DNA, 1479 bp, Brassica napus
  CDS (72)..(1301)
aggaatctggaagcagttccagaggcaaaaacaaagtctcaatctttgttgaggaggaggaggaggagaagatgagaggagggagtctatggcagctaggccaatccataacccgtcgtcttgctcaatccgacaagaaacctctgtcaccacgccgctacttcgcctccggcgctgaccttaaaaaaaccgccctttacgacttccacgtcgcccacggcggaaagatggttcctttcgccggttggagcatgccgattcagtacaaagactccatcatcgactcgactgttaactgcagggtcaacgggagtttgtttgatgttgcgcatatgtgtggtctgagcctcaagggcaaagactgtgttccttttctcgagacgctagtggttgctgacgtggcgggtttggctcctggaaccgggagcttgactgtgtttacgaatgagaagggtggtgctattgatgactcggtgattactaaagtgactgatgagcatatctacttggtggtgaatgctggttgtagggataaggatttggctcatattgaagagcacatgaaggcttttaaatccaaaggaggtgatgtctcttggcatattcatgatgagagatctcttctcgcccttcagggtcctttggctgctccggtgcttcaacacctcactaaagaagacttgagcaagctttactttgggcagttccagatcctggacattaatggttccacctgcttccttaccaggaccgggtatactggggaagatgggtttgagatctcggttccatccgagcatgcagttgatttagccaaagcaatcttggagaaatccgagggaaaagtaagactcacaggtctaggagcaagagacagtctcaggctagaagcagggctttgtctctacggcaacgacatggagcaacacatttctcctgttgaagctgggctcacatgggccatagggaagcgtagaagagccgaaggagggtttcttggagctgatgtgatcctcaaacagcttcaagatggacctactatcagaagagttggattcttctcttcgggaccaccagcaaggtcgcatagcgaggtgcatgatgagagtggtaacaagattggagagatcacgagtggtgggtttagccccaacttgaagaagaacatagctatggggtatgtgaagtcaggtcagcacaagaatgggactaaagtcaagatcttggtccgtgggaaaccttatgaaggtaacatcaccaagatgccgttcgttgccaccaaatactacaagccatcataatgtgtgtgtcctcttcttctatgacctctgtctcttgcttatgttaaatgacttctgtttcctttgaagtgtacgctcttttgccaagagggcattgcttatttcactcttattgaaataaatcttttaacacataaaacgtaaaaaaaaaaaaaaaaaacgccgctctagaggatcc

SEQ ID NO: 3094 - protein, 409 aa, Brassica napus
MRGGSLWQLGQSITRRLAQSDKKPLSPRRYFASGADLKKTALYDFHVAHGGKMVPFAGWSMPIQYKDSIIDSTVNCRVNGSLFDVAHMCGLSLKGKDCVPFLETLVVADVAGLAPGTGSLTVFTNEKGGAIDDSVITKVTDEHIYLVVNAGCRDKDLAHIEEHMKAFKSKGGDVSWHIHDERSLLALQGPLAAPVLQHLTKEDLSKLYFGQFQILDINGSTCFLTRTGYTGEDGFEISVPSEHAVDLAKAILEKSEGKVRLTGLGARDSLRLEAGLCLYGNDMEQHISPVEAGLTWAIGKRRRAEGGFLGADVILKQLQDGPTIRRVGFFSSGPPARSHSEVHDESGNKIGEITSGGFSPNLKKNIAMGYVKSGQHKNGTKVKILVRGKPYEGNITKMPFVATKYYKPS

SEQ ID NO: 3095 - DNA, 1450 bp, Glycine max
  CDS (51)..(1274)
ccctctcgtttgcaccattctatgttacttcacacactatgtaacagaaaatgagggggggcttatggcaacttgtgcaatcaatcactcgccgtgttgcccagggtgataagaaggctgctgctcgtaggtattctgcctcaaatgctgagctgaaaaagacagtcgctgatgacttccatgttgctaatggagggaagatggtgccatttgctggatggagcatgccaatccaatataaggactcaattattgactcaacccttaactgtagggagaatggtagcctttttgatgtttcccatatgtgtgggctgagcctcaaggggaaggatgctgtcccattccttgaaaagctagtcattgctgatgttgccgggcttgcccctggaactgggacattgactgttttcacaaatgaaaaaggaggggcaattgatgattcagtaattactaaggtgacggatgaccacatatatttggttgtgaatgctggttgcagggataaagatctggctcatattgaggaacatatgaaggcattcaaggccaaaggtggtgatgtgtcttggcacatccacgatgaaagatccctacttgctctgcagggtcctcttgctgctcccgttcttcaacacctaacaaaagaggatttgagcaagctattctttggggagttccgtgtgttggacatcaatggctcacagtgctttcttacccggacagggtatactggagaagatggatttgagatctcagttccttcagagcatggactagatcttgccaaggcaatactggaaaaatctgaagggaaggtaagattgacaggattgggagctagagatagtctgcgacttgaagctggattgtgcttatatggaaatgacatggaacagcacattacacctattgaggcaggactcacatgggctatagggaagaggaggagagcagaaggtggttttctaggagctgatgttatcttgaaacagctcgaagaaggtcctaaaatcaggcgtgttggtttcttttcttctggtccacctcccagaagccacagtgagattcaagatgaaggaggcaacaacattggggaaatcaccagtggtggattcagtccttgcctccagaagaacatagccatgggatatgtgaaatctggattgcacaaggcaggcaccaaagtaaagattattattcgaggaaaacccaatgaaggagtccttacaaaaatgccatttgtaccaacaaaatactataagccatcctgatctacttctgtatttatatcttaagcatttcctaatcattctcccttgttgacaaattttcccataatcaagtgttacagccactgctaatgtcattgtcttaaatataaggctttcagttgcattcataactcgggatcaattttcagacatgtatgagtttaatttggccggtt

SEQ ID NO: 3096 - protein, 407 aa, Glycine max
MRGGLWQLVQSITRRVAQGDKKAAARRYSASNAELKKTVADDFHVANGGKMVPFAGWSMPIQYKDSIIDSTLNCRENGSLFDVSHMCGLSLKGKDAVPFLEKLVIADVAGLAPGTGTLTVFTNEKGGAIDDSVITKVTDDHIYLVVNAGCRDKDLAHIEEHMKAFKAKGGDVSWHIHDERSLLALQGPLAAPVLQHLTKEDLSKLFFGEFRVLDINGSQCFLTRTGYTGEDGFEISVPSEHGLDLAKAILEKSEGKVRLTGLGARDSLRLEAGLCLYGNDMEQHITPIEAGLTWAIGKRRRAEGGFLGADVILKQLEEGPKIRRVGFFSSGPPPRSHSEIQDEGGNNIGEITSGGFSPCLQKNIAMGYVKSGLHKAGTKVKIIIRGKPNEGVLTKMPFVPTKYYKPS

SEQ ID NO: 3097 - DNA, 1545 bp, Glycine max
  CDS (91)..(1314)
gcacgagaagccttcctctctgcagagtgcagagctttctctccccgttgcttcattcattctcaacaacaaaccaatctttcttagaaaatgagggggggcttgtggcaacttgggcaatcgatcactcgccgtcttgcccatggagataagaaggctgttgctcgtcgatgttttgcctcagaagctgagctgaaaaagacagtgtttcatgacttccatgttgctcatggtgggaagatggttccatttgctgggtggagcatgccaatccaatacaaggactcaatcatggactctaccatcaactgtagggagaatggtagcctctttgatgtttcccatatgtgtgggctgagcctcaaagggaaggacgctgccccattccttgaaaagctggtcattgccgatgttgctgggcttgcccctggaactgggacgttgactgttttcacaaatgaaaagggaggtgcaattgatgattcagtaattactaaggtgacggatgaccacatatatttggttgtgaatgctggctgcagggataaagatctggctcatattgaggaacacatgaaagcattcaaggccaaaggtggtgatgtgtcttggcacatccacgatgagagatccctacttgctctgcagggtcctcttgctgcccccgttcttcaacacctgacaaaagaggatttgagcaagctctactttggggagttccgtgtgttggacatcaatggctcagagtgttttcttaccaggacagggtatactggggaagatggatttgagatctcagttccttcagagcatggagtagatcttgccaaagcaatactggaaaaatctgaagggaaggtaagattgacaggattgggagctagagatagtctgcgacttgaagctggattgtgcttatatggaaatgacatggaacagcacattacacctattgaggcaggactaacatgggctatagggaagaggaggagagcagaaggtggttttctaggagctgatgttatcctgaaacagcttgaagaaggtcctaaaatcaggcgtgttggtttcttttcttctggtccacctcccagaagccacagtgagattcaagatgaaggaggcaacaacattggggaaatcaccaggggtggattcagtccttgcctccagaagaacatagccatgggatatgtgaaatctggattgcacaaggcagccaccaaagtaaagattattattcggggaaaacccaatgaaggagtcgttacaaaaatgccatttgtaccaacaaaatactataagccttcctgatttacttctgtatttatatcttaaacatttcctaattgctctctcccttgttgacaaattttcccataatcgagtgttacagtcactgttaatgacttaatgtcattgtcttaaatacaaggctttcaattgcattcaaaaaaaaaaaaaaaaaaataaaaaaaaaaaaaaaaaaaaaaaaaaaaaaaagaaaaaaaaaaaaaaaaaaaaaaaaaaaaaaaatgaataaaa

SEQ ID NO: 3098 - protein, 407 aa, Glycine max
MRGGLWQLGQSITRRLAHGDKKAVARRCFASEAELKKTVFHDFHVAHGGKMVPFAGWSMPIQYKDSIMDSTINCRENGSLFDVSHMCGLSLKGKDAAPFLEKLVIADVAGLAPGTGTLTVFTNEKGGAIDDSVITKVTDDHIYLVVNAGCRDKDLAHIEEHMKAFKAKGGDVSWHIHDERSLLALQGPLAAPVLQHLTKEDLSKLYFGEFRVLDINGSECFLTRTGYTGEDGFEISVPSEHGVDLAKAILEKSEGKVRLTGLGARDSLRLEAGLCLYGNDMEQHITPIEAGLTWAIGKRRRAEGGFLGADVILKQLEEGPKIRRVGFFSSGPPPRSHSEIQDEGGNNIGEITRGGFSPCLQKNIAMGYVKSGLHKAATKVKIIIRGKPNEGVVTKMPFVPTKYYKPS

SEQ ID NO: 3099 - DNA, 1712 bp, Zea mays
  CDS (180)..(1409)
gaccaattcggcacgaggcaccatcgaccacccacacccgcacgcctccacccccacccccacccgatcccgatctcaccgtctccaccccgaccccctcccaccagtctcccgcagaccaacagcatctaatcaatcaagacagccccgtgctagctcacccgccggggctcgccacgatgagaggcctcctcgcgtgcgccaccctcgcccgccgcgccgccgcctcctccgcgcccgcgcgcgtccgccacctggcgggcgccgcggaggcggcggaggccgagctcaagaggacggcgctctacgacttccacgtcgcccacggcggcaagatggtgccgttcgccggctggagcatgcccatccagtacagggactccatcatggactccaccgtcaactgccgcgccaacggcagcctcttcgacgtcgcccacatgtgcggcctcagcctcaagggccgcggggccatccccttcctcgagtccctcgtcgtcgccgacgtcgccgcgctcagggacggcaccggcaccctcaccgtcttcaccaacgagcagggcggcgccatcgacgactccgtcatcgccaaggtcaccgaccaccacatctacctcgtcgtcaacgccggatgcagggacaaggacctcgcccacatcgaggcgcacatggaggccttcaacaagaagggcggggacgtcaagtggcacatccacgacgaccgatcgctgctcgcattgcagggtcctcttgctgcacctactctgcagttgctgacgaaagaagatttgagcaaaatgtacttcagtgacttcaagatgattgacatcaatggatatgcatgctttctgacgagaactggctacaccggcgaagatggttttgagatctctgttccgtcagagaatgcagtggatcttgcagaggccatcctagagagatcggaaggcaaggtgcggctgaccggcttgggcgcccgtgacagtctccgactggaggcaggcctgtgcctgtacggcaacgacatggagcagcacatcacgccggtggaagccggcctctcatgggcgatcggcaagaggaggagggcagagggcggtttcctgggcgcagacgtgatcctgaagcagctccaggaagggccaaagatcaggcgcgtgggcatggtcacgcaggggccgcccgcgcggagccacagcgagctggtgagcggctcgggggagaggatcggcgaggtgaccagcggagggttcagcccgtgcctgaagaagaacatcgctatgggctacgtgaagtcgggaatgcacaaggctgggacggagttgaaggtggtcgttcgcgggaagtcctacgacgccgtggtcaccaagatgccgttcgtgcccaccaagtactacaagccctcgtagattatattcttgtacagagggacgccttgcgtttctcttttgtcgttgcggcttgttcttggcagattggttaagcattgcaactgtaacttctgtgagattgtcttacggttcacatttcatgtatgcctgcctaataagccttcttttcccaaatacaaagcatgcatgtgcctatgtgaagaatcgaatcttgctggttggacaattcatttttgtgctcgtatagtgaggagaggacatgtatagatccaaaaaaaaaaaaaggcggccgccggataatagagcgtggcgaaaagaatt

SEQ ID NO: 3100 - protein, 409 aa, Zea mays
MRGLLACATLARRAAASSAPARVRHLAGAAEAAEAELKRTALYDFHVAHGGKMVPFAGWSMPIQYRDSIMDSTVNCRANGSLFDVAHMCGLSLKGRGAIPFLESLVVADVAALRDGTGTLTVFTNEQGGAIDDSVIAKVTDHHIYLVVNAGCRDKDLAHIEAHMEAFNKKGGDVKWHIHDDRSLLALQGPLAAPTLQLLTKEDLSKMYFSDFKMIDINGYACFLTRTGYTGEDGFEISVPSENAVDLAEAILERSEGKVRLTGLGARDSLRLEAGLCLYGNDMEQHITPVEAGLSWAIGKRRRAEGGFLGADVILKQLQEGPKIRRVGMVTQGPPARSHSELVSGSGERIGEVTSGGFSPCLKKNIAMGYVKSGMHKAGTELKVVVRGKSYDAVVTKMPFVPTKYYKPS

SEQ ID NO: 3101 - DNA, 24 bp, Artificial sequence
  primer
atggcacaacagactcctttgtac

SEQ ID NO: 3102 - DNA, 23 bp, Artificial sequence
  primer
ttacgcgacggctttgccgttac

SEQ ID NO: 3103 - protein, 412 aa, Artificial sequence
  consensus sequence
  Variant (2)..(2): Xaa in position 2 is any amino acid
  Variant (4)..(9): Xaa in position 4 to 9 is any amino acid
  Variant (10)..(11): Xaa in position 10 to 11 is any or no amino acid
  Variant (13)..(14): Xaa in position 13 to 14 is any amino acid
  Variant (16)..(16): Xaa in position 16 is any amino acid
  Variant (18)..(18): Xaa in position 18 is any amino acid
  Variant (21)..(21): Xaa in position 21 is any amino acid
  Variant (24)..(31): Xaa in position 24 to 31 is any amino acid
  Variant (32)..(32): Xaa in position 32 is any or no amino acid
  Variant (35)..(36): Xaa in position 35 to 36 is any amino acid
  Variant (39)..(41): Xaa in position 39 to 41 is any amino acid
  Variant (43)..(43): Xaa in position 43 is any amino acid
  Variant (50)..(55): Xaa in position 50 to 55 is any amino acid
  Variant (57)..(62): Xaa in position 57 to 62 is any amino acid
  Variant (64)..(65): Xaa in position 64 to 65 is any amino acid
  Variant (67)..(69): Xaa in position 67 to 69 is any amino acid
  Variant (71)..(73): Xaa in position 71 to 73 is any amino acid
  Variant (75)..(78): Xaa in position 75 to 78 is any amino acid
  Variant (79)..(81): Xaa in position 79 to 81 is any or no amino acid
  Variant (83)..(83): Xaa in position 83 is any amino acid
  Variant (85)..(91): Xaa in position 85 to 91 is any amino acid
  Variant (94)..(95): Xaa in position 94 to 95 is any amino acid
  Variant (98)..(100): Xaa in position 98 to 100 is any amino acid
  Variant (102)..(109): Xaa in position 102 to 109 is any amino acid
  Variant (110)..(118): Xaa in position 110 to 118 is any or no amino acid
  Variant (120)..(120): Xaa in position 120 is any amino acid
  Variant (122)..(127): Xaa in position 122 to 127 is any amino acid
  Variant (129)..(151): Xaa in position 129 to 151 is any amino acid
  Variant (152)..(163): Xaa in position 152 to 163 is any or no amino acid
  Variant (165)..(165): Xaa in position 165 is any amino acid
  Variant (169)..(169): Xaa in position 169 is any amino acid
  Variant (171)..(187): Xaa in position 171 to 187 is any amino acid
  Variant (188)..(196): Xaa in position 188 to 196 is any or no amino acid
  Variant (198)..(209): Xaa in position 198 to 209 is any amino acid
  Variant (210)..(221): Xaa in position 210 to 221 is any or no amino acid
  Variant (230)..(230): Xaa in position 230 is any amino acid
  Variant (232)..(245): Xaa in position 232 to 245 is any amino acid
  Variant (247)..(249): Xaa in position 247 to 249 is any amino acid
  Variant (250)..(253): Xaa in position 250 to 253 is any or no amino acid
  Variant (255)..(256): Xaa in position 255 to 256 is any amino acid
  Variant (258)..(258): Xaa in position 258 is any amino acid
  Variant (271)..(273): Xaa in position 271 to 273 is any amino acid
  Variant (277)..(284): Xaa in position 277 to 284 is any amino acid
  Variant (286)..(287): Xaa in position 286 to 287 is any amino acid
  Variant (289)..(289): Xaa in position 289 is any amino acid
  Variant (290)..(291): Xaa in position 290 to 291 is any or no amino acid
  Variant (293)..(299): Xaa in position 293 to 299 is any amino acid
  Variant (300)..(303): Xaa in position 300 to 303 is any or no amino acid
  Variant (305)..(305): Xaa in position 305 is any amino acid
  Variant (307)..(309): Xaa in position 307 to 309 is any amino acid
  Variant (311)..(319): Xaa in position 311 to 319 is any amino acid
  Variant (320)..(326): Xaa in position 320 to 326 is any or no amino acid
  Variant (330)..(336): Xaa in position 330 to 336 is any amino acid
  Variant (337)..(342): Xaa in position 337 to 342 is any or no amino acid
  Variant (344)..(347): Xaa in position 344 to 347 is any amino acid
  Variant (349)..(354): Xaa in position 349 to 354 is any amino acid
  Variant (355)..(359): Xaa in position 355 to 359 is any or no amino acid
  Variant (361)..(362): Xaa in position 361 to 362 is any amino acid
  Variant (366)..(367): Xaa in position 366 to 367 is any amino acid
  Variant (370)..(370): Xaa in position 370 is any amino acid
  Variant (372)..(374): Xaa in position 372 to 374 is any amino acid
  Variant (377)..(377): Xaa in position 377 is any amino acid
  Variant (379)..(388): Xaa in position 379 to 388 is any amino acid
  Variant (389)..(393): Xaa in position 389 to 393 is any or no amino acid
  Variant (395)..(396): Xaa in position 395 to 396 is any amino acid
  Variant (398)..(409): Xaa in position 398 to 409 is any amino acid
  Variant (410)..(411): Xaa in position 410 to 411 is any or no amino acid
TXLXXXXXXXXAXXVXFXGWXMPXXXXXXXXXEHXXVRXXXGXFDVSHMXXXXXXGXXXXXXLXXLXXXDXXXLXXXXXXXAXYXXXXXXXGGXXDDXXXYXXXXXXXXXXXXXXXXXVXNXXXXXXDXXXXXXXXXXXXXXXXXXXXXXXXXXXXXXXXXXXAXQGPXAXXXXXXXXXXXXXXXXXXXXXXXXXXFXXXXXXXXXXXXXXXXXXXXXXXXTGYTGEDGXEXXXXXXXXXXXXXXLXXXXXXXGXXPXGLGARDTLRLEAXXXLYGXXXXXXXXPXXAXXXWXXXXXXXXXXXFXGXXXLXXXXXXXXXXXXXXXXVGLXXXXXXXXXXXXXRXXXXVXXXXXXXXXXXGXXTSGXXSPXLXXXIAXAXXXXXXXXXXXXXXXVXXRXXXXXXXXXXXXXXF

SEQ ID NO: 3104 - protein, 27 aa, Artificial sequence
  protein pattern
  Variant (10)..(10): Xaa in position 10 is Phe, Leu or Met
  Variant (13)..(13): Xaa in position 13 is any amino acid
  Variant (14)..(14): Xaa in position 14 is Leu or Met
  Variant (15)..(15): Xaa in position 15 is any amino acid
  Variant (17)..(17): Xaa in position 17 is His or Tyr
  Variant (19)..(19): Xaa in position 19 is any amino acid
  Variant (20)..(20): Xaa in position 20 is Asp or Glu
  Variant (21)..(21): Xaa in position 21 is Ile, Leu or Met
  Variant (22)..(26): Xaa in position 22 to 26 is any amino acid
GLGARDTLRXEAXXXLXGXXXXXXXXP

SEQ ID NO: 3105 - protein, 26 aa, Artificial sequence
  protein pattern
  Variant (3)..(3): Xaa in position 3 is Ala or Ser
  Variant (5)..(5): Xaa in position 5 is Leu or Met
  Variant (6)..(9): Xaa in position 6 to 9 is any amino acid
  Variant (10)..(10): Xaa in position 10 is Phe, Ile, Leu or Val
  Variant (11)..(11): Xaa in position 11 is any amino acid
  Variant (13)..(14): Xaa in position 13 to 14 is any amino acid
  Variant (15)..(15): Xaa in position 15 is Ala, Cys, Gly, Ser, Thr or Val
  Variant (16)..(21): Xaa in position 16 to 21 is any amino acid
  Variant (22)..(22): Xaa in position 22 is Ala, Ile, Leu or Val
  Variant (23)..(25): Xaa in position 23 to 25 is any amino acid
  Variant (26)..(26): Xaa in position 26 is Ala, Asp, Asn or Ser
DVXHXXXXXXXGXXXXXXXXXXXXXX

SEQ ID NO: 3106 - protein, 18 aa, Artificial sequence
  protein pattern
  Variant (2)..(2): Xaa in position 2 is Asp, Glu, Asn, Pro or Ser
  Variant (4)..(4): Xaa in position 4 is any amino acid
  Variant (6)..(6): Xaa in position 6 is Trp or Tyr
  Variant (7)..(7): Xaa in position 7 is any amino acid
  Variant (8)..(8): Xaa in position 8 is Leu or Met
  Variant (10)..(10): Xaa in position 10 is Ile, Leu or Val
  Variant (11)..(11): Xaa in position 11 is any amino acid
  Variant (12)..(12): Xaa in position 12 is Phe or Tyr
  Variant (13)..(13): Xaa in position 13 is any amino acid
  Variant (14)..(14): Xaa in position 14 is Asp, Gly, Ser or Thr
  Variant (15)..(17): Xaa in position 15 to 17 is any amino acid
  Variant (18)..(18): Xaa in position 18 is Asp or Glu
VXFXGXXXPXXXXXXXXX

SEQ ID NO: 3107 - protein, 23 aa, Artificial sequence
  protein pattern
  Variant (2)..(3): Xaa in position 2 to 3 is any amino acid
  Variant (7)..(8): Xaa in position 7 to 8 is any or no amino acid
  Variant (10)..(11): Xaa in position 10 to 11 is any or no amino acid
  Variant (13)..(13): Xaa in position 13 is any amino acid
  Variant (15)..(16): Xaa in position 15 to 16 is any amino acid
  Variant (17)..(17): Xaa in position 17 is Ala, Gly, Asn, Pro or Ser
  Variant (18)..(18): Xaa in position 18 is Ile or Val
  Variant (19)..(19): Xaa in position 19 is Ala, Gly or Ser
  Variant (20)..(20): Xaa in position 20 is Phe, Ile, Leu or Met
  Variant (21)..(21): Xaa in position 21 is Ala, Cys or Gly
  Variant (22)..(22): Xaa in position 22 is any amino acid
  Variant (23)..(23): Xaa in position 23 is Ile, Leu, Met or Val
GXXTSGXXSXXPXLXXXXXXXXX

SEQ ID NO: 3108 - protein, 19 aa, Artificial sequence
  protein pattern
  Variant (2)..(2): Xaa in position 2 is any amino acid
  Variant (4)..(4): Xaa in position 4 is Ala, Gly, Ser or Thr
  Variant (5)..(5): Xaa in position 5 is any amino acid
  Variant (6)..(6): Xaa in position 6 is Phe, Ile, Leu, Met or Val
  Variant (7)..(10): Xaa in position 7 to 10 is any amino acid
  Variant (11)..(11): Xaa in position 11 is Ala or Gly
  Variant (12)..(12): Xaa in position 12 is Gly or Thr
  Variant (13)..(14): Xaa in position 13 to 14 is any amino acid
  Variant (17)..(18): Xaa in position 17 to 18 is any or no amino acid
AXYXXXXXXXXXXXDDXXI

SEQ ID NO: 3109 - DNA, 273 bp, Escherichia coli
  CDS (1)..(273): transl_table=11
atgaccgtcaagcaaactgttgaaatcacaaacaagctgggcatgcatgcccggcctgcaatgaagctgtttgaattaatgcagggttttgacgctgaagtgctcttacgtaatgacgaaggcaccgaggctgaagccaacagcgttattgcgctgctgatgttggattctgccaaaggacggcagattgaagttgaagcgaccggtccacaggaagaggaagcactggccgccgttatcgccctctttaattctggttttgatgaagattaa

SEQ ID NO: 3110 - protein, 90 aa, Escherichia coli
MTVKQTVEITNKLGMHARPAMKLFELMQGFDAEVLLRNDEGTEAEANSVIALLMLDSAKGRQIEVEATGPQEEEALAAVIALFNSGFDED

SEQ ID NO: 3111 - DNA, 297 bp, Mesorhizobium loti MAFF303099
  CDS (1)..(297): transl_table=11
atgaacgcgctatccccggaaaaagaccacatcgtccgggagtttccgatcgtcaaccagcgcggcctgcatgcacgcgcctcggcgaaattcgtccagctcgccagcggcttcgacgccgcagtccatgtcgagaaggatggcgtcaaggtcggcggcacgtcgatcatgggcctgatgatgcttgccgccagcccaggctactcgatccgcgtcaccgccagcgggccggaggcgctcgaggtcatggacgcgctcgagcagcttgtcgcctcccgcttcggcgaggaatgctga

SEQ ID NO: 3112 - protein, 98 aa, Mesorhizobium loti MAFF303099
MNALSPEKDHIVREFPIVNQRGLHARASAKFVQLASGFDAAVHVEKDGVKVGGTSIMGLMMLAASPGYSIRVTASGPEALEVMDALEQLVASRFGEEC

SEQ ID NO: 3113 - DNA, 303 bp, Mesorhizobium loti MAFF303099
  CDS (1)..(303): transl_table=11
atgtccgcagccgccgaagcgaccgttttgatcacccacgatgtggggctgcatgcgcgtccttcggtgaagttcaccaagctggccaagacgtttgccgccgacgtggaaatcgcgcttgccgccaacgggccgtggttcgacgccaagagcatcgtcaaggtgatggcagccaaggcgccgaagggaacgatgctgtacatcagggctaggggcagcggcgccgatgacgcggtacgcgcgctgatcgacctggtgcagcgagatttcgacgaggacgccggtcatgtccgctcggcgtga

SEQ ID NO: 3114 - protein, 100 aa, Mesorhizobium loti MAFF303099
MSAAAEATVLITHDVGLHARPSVKFTKLAKTFAADVEIALAANGPWFDAKSIVKVMAAKAPKGTMLYIRARGSGADDAVRALIDLVQRDFDEDAGHVRSA

SEQ ID NO: 3115 - DNA, 270 bp, Escherichia coli O157:H7 EDL933
  CDS (1)..(270): transl_table=11
  misc_feature (232)..(232): w is a or t
atgttgaataaaaccgtggaggtcagaaacagtactggcctgcatgcacgtccggcggcctgtctggcgaaagccgccaaaaaatatagctgtaaagtgacgctgcactatgagggtaatgatattaatgccaccagcatgatgaatattatgcgcgccggaataaaaggcggaaaaacggtggaaatacgctgcgacggtgatgatgaaaacgaggccatacagactctcwccgacttatttcgcgaccgcttcggtgaagctgaataa

SEQ ID NO: 3116 - protein, 89 aa, Escherichia coli O157:H7 EDL933
  misc_feature (78)..(78): The Xaa at location 78 stands for Ser, or Thr.
MLNKTVEVRNSTGLHARPAACLAKAAKKYSCKVTLHYEGNDINATSMMNIMRAGIKGGKTVEIRCDGDDENEAIQTLXDLFRDRFGEAE

SEQ ID NO: 3117 - DNA, 288 bp, Xylella fastidiosa 9a5c
  CDS (1)..(288): transl_table=11
atggagcaatcattgacgatgcttgaacacgaactaatagtaactaacaaactaggactccacgcgcgagccacggccaaactggtacaaacaatgtcgaagttccaaagcaacacgacattgtcgacaaaaggccgcgaagtcaacgccaaaagcatcatgggagtcatgctgctcgccgccagccaaggcaccgtgatccgggtacggatcgacggtgaagacgaacatacggcaatgcaagcactgagtgaactgttcgaaaaccgcttcaacgaggacacataa

SEQ ID NO: 3118 - protein, 95 aa, Xylella fastidiosa 9a5c
MEQSLTMLEHELIVTNKLGLHARATAKLVQTMSKFQSNTTLSTKGREVNAKSIMGVMLLAASQGTVIRVRIDGEDEHTAMQALSELFENRFNEDT

SEQ ID NO: 3119 - DNA, 261 bp, Clostridium acetobutylicum ATCC 824
  CDS (1)..(261): transl_table=11
atggtaactaaaagcgttgttgttaaaagttcaactggtttacatgctagaccagcaactttacttgtaaaaaaagcatcaggtttcaaatcagatgtaactatggaattcaatggtaaaaaagctaatgcaaaaagtcttataggtgttttatcattaggagtttcaaaagatagtaatattaagttaatcgtttccggtgatgatgaagctttagcagctgaggaaatagttaaattaatcgaatctttagatgagtaa

SEQ ID NO: 3120 - protein, 86 aa, Clostridium acetobutylicum ATCC 824
MVTKSVVVKSSTGLHARPATLLVKKASGFKSDVTMEFNGKKANAKSLIGVLSLGVSKDSNIKLIVSGDDEALAAEEIVKLIESLDE

SEQ ID NO: 3121 - DNA, 276 bp, Agrobacterium tumefaciens str. C58
  CDS (1)..(276): transl_table=11
atgtcgcctctctcccgggaattgcccatcatcaacaagcgcggtctccacgctcgggcatccgcgaagttcgtgcagatggtcgagggtttcgacgccacgatcacggtttccaaggacggcatgaccgttggcggcacatccatcatgggcctgatgatgctggcggcaagtcccggatgcagcgtctatgtcgaggcgagtggcaatcaggcggtagaggcgctggccgcactggaagcgctggtcgccaaccgctttggcgaagaggcctga

SEQ ID NO: 3122 - protein, 91 aa, Agrobacterium tumefaciens str. C58
MSPLSRELPIINKRGLHARASAKFVQMVEGFDATITVSKDGMTVGGTSIMGLMMLAASPGCSVYVEASGNQAVEALAALEALVANRFGEEA

SEQ ID NO: 3123 - DNA, 291 bp, Sinorhizobium meliloti 1021
  CDS (1)..(291): transl_table=11
atggaccaccgccccgacacggctctgacgcgcgaactgctcatcgtcaacaaacgcggcctgcatgcgcgtgcctctgcgaaattcgtgcagaccgtcgagaccttcgacgcggagatcaccgtctccaaggacggcatgaccgtcggcgggacctcgatcatggggctgatgatgctggcggcgagcaccggctgctcggtcttcgtcaccgccagcggcgctcaggccgaagaagcgctcaacgcgctggataggctggttcgcgacaggttcggcgaagagatgtga

SEQ ID NO: 3124 - protein, 96 aa, Sinorhizobium meliloti 1021
MDHRPDTALTRELLIVNKRGLHARASAKFVQTVETFDAEITVSKDGMTVGGTSIMGLMMLAASTGCSVFVTASGAQAEEALNALDRLVRDRFGEEM

SEQ ID NO: 3125 - DNA, 279 bp, Caulobacter crescentus CB15
  CDS (1)..(279): transl_table=11
gtgacgggcatggcttcaagaacggtcgagatcgtcaacgagcggggattgcacgcccgggcctcggccaagttcgtgaagatggcgtcaggcttcgacgccgaggtgaccgtcagtcgcgaaggcgcgtccgttgatgcgcgatcgatcatgggtctgatgatgctcgcggccggcattggctcgaccatcgacatcagcgccgaggggcccgaagccgaagccgcgatcgaagcgctgtgcgagctggtcggcaaccggttcgacgaggagcggtaa

SEQ ID NO: 3126 - protein, 92 aa, Caulobacter crescentus CB15
MTGMASRTVEIVNERGLHARASAKFVKMASGFDAEVTVSREGASVDARSIMGLMMLAAGIGSTIDISAEGPEAEAAIEALCELVGNRFDEER

SEQ ID NO: 3127 - DNA, 270 bp, Ralstonia solanacearum GMI1000
  CDS (1)..(270): transl_table=11
atgctgcagagggatatcaccatcatcaataagctcgggctgcatgcccgcgcctccgccaaactcacgcagctcgccagcaagttcgacagccagatcaagatgtcgcgcaacggccgccaggtcgatgccaagagcatcatgggcgtgatgatgctggctgcgggcatcggctccaccgtcacgctggagatcgaaggcccggacgagcaggcggccatggatggcctggtcgccctgatcggcgaccgcttcggcgaaggcgagtaa

SEQ ID NO: 3128 - protein, 89 aa, Ralstonia solanacearum GMI1000
MLQRDITIINKLGLHARASAKLTQLASKFDSQIKMSRNGRQVDAKSIMGVMMLAAGIGSTVTLEIEGPDEQAAMDGLVALIGDRFGEGE

SEQ ID NO: 3129 - DNA, 303 bp, Brucella melitensis 16M
  CDS (1)..(303): transl_table=11
gtgaccgtcaccggcgaatatgatcccgacaatgccgtttcgcgctccttcgagatcgtcaacaagcgggggcttcacgctcgcgcttcggctaaattcgtgcagcttgtggataattataacgcccatgtccgcgtcagcaaggatggcatgacggtgggcggcacgtccatcatgggcttgatgatgcttgccgcttcgcccggctgctgcattgaggtgagtgcctccggcgaacaggccgatgcagttctcgacgcgctccagacgcttatcgccgacaggttcggcgaggaagcctga

SEQ ID NO: 3130 - protein, 100 aa, Brucella melitensis 16M
MTVTGEYDPDNAVSRSFEIVNKRGLHARASAKFVQLVDNYNAHVRVSKDGMTVGGTSIMGLMMLAASPGCCIEVSASGEQADAVLDALQTLIADRFGEEA

SEQ ID NO: 3131 - DNA, 270 bp, Fusobacterium nucleatum subsp. nucleatum ATCC 25586
  CDS (1)..(270): transl_table=11
atgaaatcagtaaaagtacatataaaaaataaaaaaggattacatgcaagaccatcatctctatttgtacaattagttacgaagtatgattctgatatcactgttaaatcagaagatgaaactgtaaatggaaaaagtattatgggacttatgcttttagcagcagaagaaggtagagaattagaattaatagcagatggaccagatgaagatgccatgcttgaagacttagttgatttaatagaagtaaagagattcaatgaggagtaa

SEQ ID NO: 3132 - protein, 89 aa, Fusobacterium nucleatum subsp. nucleatum ATCC 25586
MKSVKVHIKNKKGLHARPSSLFVQLVTKYDSDITVKSEDETVNGKSIMGLMLLAAEEGRELELIADGPDEDAMLEDLVDLIEVKRFNEE

SEQ ID NO: 3133 - DNA, 264 bp, Fusobacterium nucleatum subsp. nucleatum ATCC 25586
  CDS (1)..(264): transl_table=11
atgacaagcaaaactgttgaaatagtaaatgaaactggattacacacaagacctggaaatgaatttgtaagtttagcaaagacattttcttcacaaataagtgtagaaaatgaagcaggagtaaaagtaaatgggacttcattattaaaattactttcattaggaattaaaaaaggaagtaaaataactgtatatgctgatggtgaagatgaaaatgaagcagttgataaattatcatctcttcttgaaaacttaaaagattaa

SEQ ID NO: 3134 - protein, 87 aa, Fusobacterium nucleatum subsp. nucleatum ATCC 25586
MTSKTVEIVNETGLHTRPGNEFVSLAKTFSSQISVENEAGVKVNGTSLLKLLSLGIKKGSKITVYADGEDENEAVDKLSSLLENLKD

SEQ ID NO: 3135 - DNA, 267 bp, Thermoanaerobacter tengcongensis MB4
  CDS (1)..(267): transl_table=11
atgaaagaagttactattgaaatcaaaaataagacagggcttcatgcaagacctgcggctttatttgtccaaacagccagtaaattttcttcccagatttgggtagaaaaagataataaaaaggtaaatgctaaaagcattatgggaataatgtctctaggggtctcccagggcaatgtagtgaagttgagtgctgagggagacgatgaggaggaggctataaaagctttagttgacctcatcgaatcaaagttcggtgaagagtaa

SEQ ID NO: 3136 - protein, 88 aa, Thermoanaerobacter tengcongensis MB4
MKEVTIEIKNKTGLHARPAALFVQTASKFSSQIWVEKDNKKVNAKSIMGIMSLGVSQGNVVKLSAEGDDEEEAIKALVDLIESKFGEE

SEQ ID NO: 3137 - DNA, 267 bp, Chlorobium tepidum TLS
  CDS (1)..(267): transl_table=11
gtgattgtccaggaagtgattatcagaaacagcgcgggtctgcacacccggccagcggcggcggtcgtcaagctcgcctccagattcaagtcggactttttcatcgagatggatggcttggaaatcaacgccaagtcgatcatcggcgtcatgagcctggccgcgcccaaagggtcgcgcatggtgctcaaactggagggcgaggacgaagcagaagcggccaagcaccttatcgaatttttcgaacaggggttcggcgaagcgtag

SEQ ID NO: 3138 - protein, 88 aa, Chlorobium tepidum TLS
MIVQEVIIRNSAGLHTRPAAAVVKLASRFKSDFFIEMDGLEINAKSIIGVMSLAAPKGSRMVLKLEGEDEAEAAKHLIEFFEQGFGEA

SEQ ID NO: 3139 - DNA, 264 bp, Oceanobacillus iheyensis HTE831
  CDS (1)..(264): transl_table=11
atgaaatcacaaacatttacgattactgctgaaactggagtacatgctcgtcctgcaactttgttagtaaataaagctggacaattcgattctgaaatcgaagtttcatacaaaggcaagcaagttaacttgaaatcgatcatgggtgttatgtctttaggtattccaaaaggcgcagaaatcgaagtttctgctgatggaaaagatgaagaagacgctcttaacggtgttgctgaagtaattaaagagcatcttggtgaatag

SEQ ID NO: 3140 - protein, 87 aa, Oceanobacillus iheyensis HTE831
MKSQTFTITAETGVHARPATLLVNKAGQFDSEIEVSYKGKQVNLKSIMGVMSLGIPKGAEIEVSADGKDEEDALNGVAEVIKEHLGE

SEQ ID NO: 3141 - DNA, 261 bp, Oceanobacillus iheyensis HTE831
  CDS (1)..(261): transl_table=11
ttggtagaaaaattggtaacggttgaattagatactggattacaggctaggcctgcagcacaatttgttcaagaagcaaatcgtttttcatcccatgtctttttagaaaaagatgataagaaaataaatgctaaaagtataatgggactgatgagtttggcaataaccaaaggagaacaaataaagttaattgcggaaggacctgatgaggatacagcaattgaacatctagaaaaatatgtatacgacggagaagcttaa

SEQ ID NO: 3142 - protein, 86 aa, Oceanobacillus iheyensis HTE831
MVEKLVTVELDTGLQARPAAQFVQEANRFSSHVFLEKDDKKINAKSIMGLMSLAITKGEQIKLIAEGPDEDTAIEHLEKYVYDGEA

SEQ ID NO: 3143 - DNA, 264 bp, Leptospira interrogans serovar Lai str. 56601
  CDS (1)..(264): transl_table=11
ttgaaagaaatcctactcaaaatcaatgaaaatggaactggaatgcacgcaagacccgcgtctgtatttgtgaattgtgcatctaaatttccctgtgaaattactgtcgttaaagacgacgtagtagtaaacggaaagagtattatggggcttatgatgctcgcacttgcacccggaaacgaatttaaaattcaagtagaaggtgaaaaggaagacgaggcactggaggcgctaagtaatatcgtaaataacgatttcgtttaa

SEQ ID NO: 3144 - protein, 87 aa, Leptospira interrogans serovar Lai str. 56601
MKEILLKINENGTGMHARPASVFVNCASKFPCEITVVKDDVVVNGKSIMGLMMLALAPGNEFKIQVEGEKEDEALEALSNIVNNDFV

SEQ ID NO: 3145 - DNA, 258 bp, Shewanella oneidensis MR-1
  CDS (1)..(258): transl_table=11
atgtacgaaaaatctgtcactatcactgcaaaacatggtattcatactcgcccagccgcactgttggtgaaagaagcgaagaccttcgattgtgacgttttggttgaatgtaatggcaaacaagcaagcgccaaaagcttgtttaagctacaaactttaggtttgtaccatggtgtcaccgtgagagttttcgccgagggagagcaggcgcaggaagccgtcgaaaaagtctcgactttgttaatcaccttaagttag

SEQ ID NO: 3146 - protein, 85 aa, Shewanella oneidensis MR-1
MYEKSVTITAKHGIHTRPAALLVKEAKTFDCDVLVECNGKQASAKSLFKLQTLGLYHGVTVRVFAEGEQAQEAVEKVSTLLITLS

SEQ ID NO: 3147 - DNA, 339 bp, Corynebacterium efficiens YS-314
  CDS (1)..(339): transl_table=11
gtgggcccccaaccgcacctttccaccggatgtcctccggttccccgaggtgcagagaaaggatttcccatggcttccaaaaccgttaccgttggttcctccgtcggcctgcatgcacgccccgcctcgctgatcgccgaggccgccgcagaattcgatgatgagatcctgctgaccctcgttggttccgacgatgacgaggaaaccgatgcttcctcctccctcatgatcatggcactgggcgcggaacacggtgatcaggtcaccgtcacctccgacaaccccgaggccgtggagaagatcgcctccatgatcgagcaggatctggacgccgagtag

SEQ ID NO: 3148 - protein, 112 aa, Corynebacterium efficiens YS-314
MGPQPHLSTGCPPVPRGAEKGFPMASKTVTVGSSVGLHARPASLIAEAAAEFDDEILLTLVGSDDDEETDASSSLMIMALGAEHGDQVTVTSDNPEAVEKIASMIEQDLDAE

SEQ ID NO: 3149 - DNA, 273 bp, Pseudomonas putida KT2440
  CDS (1)..(273): transl_table=11
atgcccgcccgcgaaatcaccatcatcaacaagctgggtctgcatgcccgggcggcagccaagttcgtcggtgtggccggccgcttcccctgccaggtacgggtgggtcgcgccccggacaagctggtggatggcaagagcatcatggcggtgatgatgctggccgcaggcaaaggcacccaggtgcacctgcataccgagggcgagcaggacagcgacgccatggacgcgctggtcgagctgatcaacaatttctttgacgaaggcgaatag

SEQ ID NO: 3150 - protein, 90 aa, Pseudomonas putida KT2440
MPAREITIINKLGLHARAAAKFVGVAGRFPCQVRVGRAPDKLVDGKSIMAVMMLAAGKGTQVHLHTEGEQDSDAMDALVELINNFFDEGE

SEQ ID NO: 3151 - DNA, 264 bp, Mycoplasma penetrans HF-2
  CDS (1)..(264): transl_table=4
atgaaatcaattaatgtaactattattgatccaattggaattcatgcaagaccagcttcaatgatttcaagtactgctgctaaattccaatcttctgtaacttttaaaaatggagaaaaatcagcaaatgctaaatctgtaattaacttaatggctctttcagctaaacagggaaacagtattgaaattgccgttgatggtgcagatgaagatgcagctattgaagctattaaaaaagtaatggaagaagaaaaattaatttaa

SEQ ID NO: 3152 - protein, 87 aa, Mycoplasma penetrans HF-2
MKSINVTIIDPIGIHARPASMISSTAAKFQSSVTFKNGEKSANAKSVINLMALSAKQGNSIEIAVDGADEDAAIEAIKKVMEEEKLI

SEQ ID NO: 3153 - DNA, 258 bp, Vibrio vulnificus CMCP6
  CDS (1)..(258): transl_table=11
atgtacgagaagcaagtagaaatcacagcagaaaacggccttcacactcgcccagctgctcaattcgtaaaagaagctaaagcttttgacgcggatatcactgtgacttctaacggcaaaagcgcaagcgctaagagtctgttcaaactacaaactctaggtcttgtaaaaggcactgtagttacaatctctgctgaaggcccacaagcacagcaagcagttgatcacctagttgctctaatggatcaactacactaa

SEQ ID NO: 3154 - protein, 85 aa, Vibrio vulnificus CMCP6
MYEKQVEITAENGLHTRPAAQFVKEAKAFDADITVTSNGKSASAKSLFKLQTLGLVKGTVVTISAEGPQAQQAVDHLVALMDQLH

SEQ ID NO: 3155 - DNA, 276 bp, Vibrio vulnificus CMCP6
  CDS (1)..(276): transl_table=11
gtggaactcagccgcaaagtactcatacagaatcgacttggcttgcacgctcgtgctgccgtcaaattggtagaactggcacaaagctttgccgccgaagtcaccatcgacaacgaagaagacaaaaccgccgcggctgacagcgtgatggggctactcatgcttgagtctgcacaagggcaatatgtgaccattcatgccagcggagaacaggcagaacaagccctggacgccatttgtcatcttatcgaagataagtttgaagaaggcgaatag

SEQ ID NO: 3156 - protein, 91 aa, Vibrio vulnificus CMCP6
MELSRKVLIQNRLGLHARAAVKLVELAQSFAAEVTIDNEEDKTAAADSVMGLLMLESAQGQYVTIHASGEQAEQALDAICHLIEDKFEEGE

SEQ ID NO: 3157 - DNA, 306 bp, Bradyrhizobium japonicum USDA 110
  CDS (1)..(306): transl_table=11
atgagcatgctggacaaagcggacggaaagattttcaccggaaatgtgcggctggtgcacgcggttggcatgcacgcgcgccccgcggtcaagctgaccaagctcgccaagaagttccaggcccagatttccgtgcgggtcgcaggcgcggccgagtggatcaatgccaagagcgtggtcaagatcatggcgatgcgtgcggcccacggcagcacgatcgagatcagggcgtccggcagtgatgcggaagccgccgttgcggcgctggtcgacctgatcgcaaccgattttccggacggggcttag

SEQ ID NO: 3158 - protein, 101 aa, Bradyrhizobium japonicum USDA 110
MSMLDKADGKIFTGNVRLVHAVGMHARPAVKLTKLAKKFQAQISVRVAGAAEWINAKSVVKIMAMRAAHGSTIEIRASGSDAEAAVAALVDLIATDFPDGA

SEQ ID NO: 3159 - DNA, 318 bp, Bradyrhizobium japonicum USDA 110
  CDS (1)..(318): transl_table=11
atgagcgacgacgcgccgcaagccgggtcgggcgtgcccgcgggcgcgatctccaaggagctcctcatcatcaacaagcgcggcctgcacgcacgcgcctcagcgaaattcgtccaggcggtcgagcgcttcaacgcgcaagtgtgggtgacgcgcggcggcgagaccgtcggcggcacctcgatcatgggcctgatgatgctcgctgcgggacccggcacgacgatcacggtcgctgcggccggtgcagatgccgatgccgcgctcgcggcgatcacggagctcgttgaaagcaagttcaacgaggaggggatttag

SEQ ID NO: 3160 - protein, 105 aa, Bradyrhizobium japonicum USDA 110
MSDDAPQAGSGVPAGAISKELLIINKRGLHARASAKFVQAVERFNAQVWVTRGGETVGGTSIMGLMMLAAGPGTTITVAAAGADADAALAAITELVESKFNEEGI

SEQ ID NO: 3161 - DNA, 273 bp, Pseudomonas syringae pv. tomato str. DC3000
  CDS (1)..(273): transl_table=11
atgcccgttcgtcaaatcaccatcatcaacaaactgggcctgcacgcccgcgccgccgccaaattcgtaggcgtcgccggcaagttcccttgcaaaatcagggtcggccgcacgccagacagcatggtcgacggcaaaagcatcatggctgtgatgatgctggccgcaggcaaaggtaccgacatccacctgcacaccgaaggcgaattcgaacaggaagcgctggacgggctggttgagctgattgataacaagtttgatgagggcgagtaa

SEQ ID NO: 3162 - protein, 90 aa, Pseudomonas syringae pv. tomato str. DC3000
MPVRQITIINKLGLHARAAAKFVGVAGKFPCKIRVGRTPDSMVDGKSIMAVMMLAAGKGTDIHLHTEGEFEQEALDGLVELIDNKFDEGE

SEQ ID NO: 3163 - DNA, 276 bp, Vibrio parahaemolyticus RIMD 2210633
  CDS (1)..(276): transl_table=11
gtggagttaagtcgtaaagtattgattcaaaatcgtcttgggttacacgcgcgcgccgcagttaagttggtagaacttgcgcaaagctttgatgctgtagtaaccatcgacaacgaagaagacaaaaccgccaccgcagacagcgtgatggggctgttgatgttggaatcggctcaaggacaatacgtaacgattcatgccacaggcgatcaagcagagttggcactcgacgctgtatgtcacctgattgaagacaagtttgacgaaggcgagtaa

SEQ ID NO: 3164 - protein, 91 aa, Vibrio parahaemolyticus RIMD 2210633
MELSRKVLIQNRLGLHARAAVKLVELAQSFDAVVTIDNEEDKTATADSVMGLLMLESAQGQYVTIHATGDQAELALDAVCHLIEDKFDEGE

SEQ ID NO: 3165 - DNA, 270 bp, Nitrosomonas europaea ATCC 19718
  CDS (1)..(270): transl_table=11
atgcaaactgaatcattgaccatcctcaataagctgggcctgcatgcacgtgcctcggccaagctgacacaactggccggcaagttcgaaagcgaagtctggcttacgcgtaacggccgccgggtgaatgccaaaagtatcatgggtgtcatgacccttgctgcaagtataggcacagtcgtcgaactggaaacgtccggccccgatgaagttcaggccatggaagcattgaaagccctgatcaacgattacttcggggaaggtgaatga

SEQ ID NO: 3166 - protein, 89 aa, Nitrosomonas europaea ATCC 19718
MQTESLTILNKLGLHARASAKLTQLAGKFESEVWLTRNGRRVNAKSIMGVMTLAASIGTVVELETSGPDEVQAMEALKALINDYFGEGE

SEQ ID NO: 3167 - DNA, 348 bp, Rhodopirellula baltica SH 1
  CDS (1)..(348): transl_table=11
atgagtgccccaatacacgagcgttctgttcgtgtcgtcaatcgccaaggtttgcacgcccggccagccgatttgctggttcgctgtgcgtcggaattccaatgccagatcttcctgcaaaagggatctgaaaaggtggattgccgtagcatcctgtctctgttgacgctcggtgccaccgaaggaaccgacctgacggtttccgcgcaaggacaagacgccgaacaagccctcgaagccgtcggtcgtttgtttgacctcggttttcacgaacttgacgagaactctggttcgcctgcctgttcggccggcggcaccagcgattctcccgaccaatcaccctcgtag

SEQ ID NO: 3168 - protein, 115 aa, Rhodopirellula baltica SH 1
MSAPIHERSVRVVNRQGLHARPADLLVRCASEFQCQIFLQKGSEKVDCRSILSLLTLGATEGTDLTVSAQGQDAEQALEAVGRLFDLGFHELDENSGSPACSAGGTSDSPDQSPS

SEQ ID NO: 3169 - DNA, 270 bp, Bordetella parapertussis 12822
  CDS (1)..(270): transl_table=11
atgcctagctcagacatcgtcattagcaacaaactcggactgcatgcccgggccgccgccaagctgacgcagctggccagccgtttcagcagcgagatcttcatttcgcgtggcgcgcagcgcgtcaacgccaagagcatcatgggcgtgatgatgctcgccgccgggttgggggtgacagtcaagctggaagcctcgggcagcgatgccgaccaggcgctgtccgaaattcaaactctgttcgacaataagttcggtgagcaggaatag

SEQ ID NO: 3170 - protein, 89 aa, Bordetella parapertussis 12822
MPSSDIVISNKLGLHARAAAKLTQLASRFSSEIFISRGAQRVNAKSIMGVMMLAAGLGVTVKLEASGSDADQALSEIQTLFDNKFGEQE

SEQ ID NO: 3171 - DNA, 270 bp, Chromobacterium violaceum ATCC 12472
  CDS (1)..(270): transl_table=11
atgctgcgatctgaagtcgaaatcatcaacaagctgggcctgcacgcgcgcgcttcgagcaagttcacccagctggccagccgttacaaaagcgatattttcatttcccgcaacaaccgccgcgtcaacggcaagagcatcatgggcgtgatgatgctggcggcggccaagggcgccaaggtcgaactggagatcagcggcgacgacgaacagcaggcactggaggcgctgaccgcgctgatcaacaaccgcttcgacgaagcggagtaa

SEQ ID NO: 3172 - protein, 89 aa, Chromobacterium violaceum ATCC 12472
MLRSEVEIINKLGLHARASSKFTQLASRYKSDIFISRNNRRVNGKSIMGVMMLAAAKGAKVELEISGDDEQQALEALTALINNRFDEAE

SEQ ID NO: 3173 - DNA, 273 bp, Photorhabdus luminescens subsp. laumondii TTO1
  CDS (1)..(273): transl_table=11
atgactgtcaagcagagacttgaaatcaaaaatcggctgggaatgcacgcccggccagcaatgaagctgtatgatctagtacagctctttgaatctcatgtcattttacgcaatgatagccatgttgaagccgaggccagcagcgtaattgctatgctaatgctggattcagaaaaaggcagctatattgaagttgaagccagtggcccagatgaagagcaagctctcgcagctattattgatctatttaattcgggatttgacgaagaataa

SEQ ID NO: 3174 - protein, 90 aa, Photorhabdus luminescens subsp. laumondii TTO1
MTVKQRLEIKNRLGMHARPAMKLYDLVQLFESHVILRNDSHVEAEASSVIAMLMLDSEKGSYIEVEASGPDEEQALAAIIDLFNSGFDEE

SEQ ID NO: 3175 - DNA, 267 bp, Corynebacterium diphtheriae NCTC 13129
  CDS (1)..(267): transl_table=11
atggcttccaagaccgtttctgtcggatcctccgtcggcctgcatgcacgcccagcgtcgattattgcagaggcagccggtgaatttgatgaggatatcttcctcaccatcgaaggcgaagacgatgatgagactgatgcagcttcgtctcttatgatcatggctttgggtgcagagaagggcgataaggttaccgtcacctccgaaaaccctgaggctgttgagaagatcgcagctttgatcgaaaaggatctcgacgccgtttaa

SEQ ID NO: 3176 - protein, 88 aa, Corynebacterium diphtheriae NCTC 13129
MASKTVSVGSSVGLHARPASIIAEAAGEFDEDIFLTIEGEDDDETDAASSLMIMALGAEKGDKVTVTSENPEAVEKIAALIEKDLDAV

SEQ ID NO: 3177 - DNA, 333 bp, Rhodopseudomonas palustris CGA009
  CDS (1)..(333): transl_table=11
atgaccatcgacgcgcctcagcccggttccggaccggaccaagcctccggcgcttccggcgataagatttcccgtgagattcccgtcaccaataagcgcggcctgcatgcgcgggcttcggccaagtttgtgcagatggccgagcgcttcaatgccgaggtctgggtcacccgcaacggcgagacggtcggcggtacctcgatcatgggcctgatgatgttggccgccggaatcggtaccaccgtgaccgtctcggcgagcggccccgaagcgcgccaggcgctggatgcaatcaccgagctgatgggctcaaagttcggcgaagaagaatag

SEQ ID NO: 3178 - protein, 110 aa, Rhodopseudomonas palustris CGA009
MTIDAPQPGSGPDQASGASGDKISREIPVTNKRGLHARASAKFVQMAERFNAEVWVTRNGETVGGTSIMGLMMLAAGIGTTVTVSASGPEARQALDAITELMGSKFGEEE

SEQ ID NO: 3179 - DNA, 267 bp, Geobacter sulfurreducens PCA
  CDS (1)..(267): transl_table=11
atgcttgagagggaattcaccatagtaaacaagctcggcctgcacgcacgggcatccgccctgcttgtcaaaacggccagccggttccattccgacatcaagatcgagcgggaaggcgtcgaggtgaacggcaagagtatcatgggaataatgatgcttgccgctgccaaggggacgaccatccgtgtccgggtggcgggcgacgatgaggatgaggccatggcctcactcgacgagattatcactaatgggttcggcgaggagtga

SEQ ID NO: 3180 - protein, 88 aa, Geobacter sulfurreducens PCA
MLEREFTIVNKLGLHARASALLVKTASRFHSDIKIEREGVEVNGKSIMGIMMLAAAKGTTIRVRVAGDDEDEAMASLDEIITNGFGEE

SEQ ID NO: 3181 - DNA, 267 bp, Treponema denticola ATCC 35405
  CDS (1)..(267): transl_table=11
atgatttcaaaaactattaaggttcaaaatcgggcaggaatacatgcccggccggcagctcttattgcacaaaaatcgaacaatttttcttcggaaatttttttatgcaaggaagatgcaaaaatcaatgctaaatcggtaatagggattataactatggctgccgcctacggcacagagctcaccctcacctgtgatgggcctgatgaaaaggaagccagcgaagcaatcgaaactatttttaacaataaatttgaagaagaataa

SEQ ID NO: 3182 - protein, 88 aa, Treponema denticola ATCC 35405
MISKTIKVQNRAGIHARPAALIAQKSNNFSSEIFLCKEDAKINAKSVIGIITMAAAYGTELTLTCDGPDEKEASEAIETIFNNKFEEE

SEQ ID NO: 3183 - DNA, 273 bp, Clostridium thermocellum ATCC 27405
  CDS (1)..(273): transl_table=11
atgaaaatggttgagaaaactgttgtgataactaatcccgaaggactgcatgcgcgaccggcagcactttttgtgcaaactgccggaaagtttacttcgaatgtctggattaaggttgggaaaacaaaagtaaatgccaagagcataatgggacttatatctctggctgttgcacagggcaccgaggttgtaataggtgctgagggagaagatgaagaaaaggctgtggaagagcttattgatcttgttacaacaggttttacggaggattaa

SEQ ID NO: 3184 - protein, 90 aa, Clostridium thermocellum ATCC 27405
MKMVEKTVVITNPEGLHARPAALFVQTAGKFTSNVWIKVGKTKVNAKSIMGLISLAVAQGTEVVIGAEGEDEEKAVEELIDLVTTGFTED

SEQ ID NO: 3185 - DNA, 261 bp, Clostridium difficile 630
  CDS (1)..(261): transl_table=11
atggaaaaagtagttagtatcaaaaatgcaagtggattacatgctagaccagcaggaatgtttgttaagaaggcagctgaatttaaatcaacagtagaggttgtagcaaaagacaaaactgtaaatgcaaaatcaataatgggaataatgagtttaggtttagctcaaggagaagaattaaagttagttgtaaatggagaagatgaagaagtagctttagctgcaatggttgaattagttgaaagtggatttggagaatag

SEQ ID NO: 3186 - protein, 86 aa, Clostridium difficile 630
MEKVVSIKNASGLHARPAGMFVKKAAEFKSTVEVVAKDKTVNAKSIMGIMSLGLAQGEELKLVVNGEDEEVALAAMVELVESGFGE

SEQ ID NO: 3187 - DNA, 270 bp, Herminiimonas arsenicoxydans
  CDS (1)..(270): transl_table=11
atgattgaacaagaaatcgaaattatcaacaagctcggcctgcatgcgcgggcttctgccaagctgacacaactcgctgccaagtacaaaagtgaagtctggatgacgcgtaacaagcgtcgcgtgaatgccaaatccatcatgggcgtgatgatgctggcagcaggcaaaggttcgaaagtcacgctggaaaccaatggcccggatgagagagagtgtttcgatgctctcgaattgctgattcaggacaagttcggcgaaggcgagtaa

SEQ ID NO: 3188 - protein, 89 aa, Herminiimonas arsenicoxydans
MIEQEIEIINKLGLHARASAKLTQLAAKYKSEVWMTRNKRRVNAKSIMGVMMLAAGKGSKVTLETNGPDERECFDALELLIQDKFGEGE

SEQ ID NO: 3189 - DNA, 330 bp, Bradyrhizobium sp. ORS278
  CDS (1)..(330): transl_table=11
atgagcgacgaggacgcgccgcaggacaatgtcgccgggccgtcggtgcccgccgatgccatttcgcgggagctcctgatcaccaacaagcgtggcctgcatgcgcgggcctccgcgaagttcgtgcagatggtcgagaagttccaagccgaggtctgggtgacgcgcggcggcgagactgtcggcggccgctcgattatgggcctgatgatgctggcggcggcgccggggacaaagatcctggtgtcggcgaagggccccgaagcggaagccgcgctccaggggatcaccgacctggtgaacgacaagttccacgaagaaggcgtgtga

SEQ ID NO: 3190 - protein, 109 aa, Bradyrhizobium sp. ORS278
MSDEDAPQDNVAGPSVPADAISRELLITNKRGLHARASAKFVQMVEKFQAEVWVTRGGETVGGRSIMGLMMLAAAPGTKILVSAKGPEAEAALQGITDLVNDKFHEEGV

SEQ ID NO: 3191 - DNA, 318 bp, Bradyrhizobium sp. ORS278
  CDS (1)..(318): transl_table=11
atgacggtgacgacaatggctgatggcggagagatcgggatgcaggacgcgatggggcatgcgctgttgaccaatgcggtcgggctgcacgcgcgcccttcggtcaagctgactcagctcgccaagcgcttcgcatcgacggtggagatcgcaatcgcggccgacgggccatggaccgatgccaagagcccggtgaagatcatgcgcgtcaaggcagcgaagggcgagaccctctacgtgcgagccaatggtccggatgcggcggaggccgtgcgcgcgcttgccgatctcgtcaaccggaaattcgacgaggagtag

SEQ ID NO: 3192 - protein, 105 aa, Bradyrhizobium sp. ORS278
MTVTTMADGGEIGMQDAMGHALLTNAVGLHARPSVKLTQLAKRFASTVEIAIAADGPWTDAKSPVKIMRVKAAKGETLYVRANGPDAAEAVRALADLVNRKFDEE

SEQ ID NO: 3193 - DNA, 261 bp, Dichelobacter nodosus VCS1703A
  CDS (1)..(261): transl_table=11
gtgaaagaacttaaaaccactctcaaaaacgcctccggtttgcatgcgcgtccggcaaaagagctcgtacaattggcgaaaacctttgaatcagaaatcacgcttatcaaagataatcacgcacataatgccaaatcattaatgaaactcctccaagcaggattcagtcaaggcgacgacatcacagtgcgcgggcagggcagtgatgaagaacgcgccgttcagcatatcatcgattttataaatggattaaacgaataa

SEQ ID NO: 3194 - protein, 86 aa, Dichelobacter nodosus VCS1703A
MKELKTTLKNASGLHARPAKELVQLAKTFESEITLIKDNHAHNAKSLMKLLQAGFSQGDDITVRGQGSDEERAVQHIIDFINGLNE

SEQ ID NO: 3195 - DNA, 273 bp, Klebsiella pneumoniae subsp. pneumoniae MGH 78578
  CDS (1)..(273): transl_table=11
atgaccgtaaagcagaccgttgaaatcaccaataagctgggcatgcacgcccgcccggcgatgaagctgttcgaactgatgcagaatttcgatgccgaagtactgctgcgcaacgatgaaggcacggaggcggaagccaacagcgtgattgccctgctgatgctggactcggcgaaagggcgacagatagaggtggaggccagcggtccgcaggaagttgaagccctcgccgcggtgattgccctgtttaacgctggctttgacgaagactaa

SEQ ID NO: 3196 - protein, 90 aa, Klebsiella pneumoniae subsp. pneumoniae MGH 78578
MTVKQTVEITNKLGMHARPAMKLFELMQNFDAEVLLRNDEGTEAEANSVIALLMLDSAKGRQIEVEASGPQEVEALAAVIALFNAGFDED

SEQ ID NO: 3197 - DNA, 273 bp, Kineococcus radiotolerans SRS30216
  CDS (1)..(273): transl_table=11
gtgtccaccgccacccgcaccgctgtcgtcgcctcccgcgtcggcctgcacgcccgccccgcgtcgctgttcgtccaggccgccgcggcgaccgggctgccggtcaccatcgccgtcgggtccggcgaccccgtcgacgcccgcagcatcctcatggtcatggggctgggcgcccggcacggcgaccgggtcgtcctgtccgccgagggggagggggccgaggaggccctcgccaccctcgccggcctcgtggagaccgaccacgatgcgtga

SEQ ID NO: 3198 - protein, 90 aa, Kineococcus radiotolerans SRS30216
MSTATRTAVVASRVGLHARPASLFVQAAAATGLPVTIAVGSGDPVDARSILMVMGLGARHGDRVVLSAEGEGAEEALATLAGLVETDHDA

SEQ ID NO: 3199 - DNA, 381 bp, Xanthobacter autotrophicus Py2
  CDS (1)..(381): transl_table=11
gtgtcctctccggtaaatgacgccttcgtcccgcgggcggacgcggacgaggcggacctgcacgacgttgagtcgcccgaggtggcgtgcggtcgccccatcgccccagaggccctggtgcgcgccctgccgatcgtgaacaagcgcggcctgcacgcccgggcctccgccaagttcgtgcagaccgtggagcggttcgacgcttacgtgaccgtatgtcgcaacggcgaggcggtcggcggcaattccatcatgggcctgatgatgctggccgccggccccggcaccagcgtgaccgtgaccgccaccggcaacgaggcggcagcggtgctcgaggctctcgataccctggtggctgaccgcttcggcgaggaagagtaa

SEQ ID NO: 3200 - protein, 126 aa, Xanthobacter autotrophicus Py2
MSSPVNDAFVPRADADEADLHDVESPEVACGRPIAPEALVRALPIVNKRGLHARASAKFVQTVERFDAYVTVCRNGEAVGGNSIMGLMMLAAGPGTSVTVTATGNEAAAVLEALDTLVADRFGEEE

SEQ ID NO: 3201 - DNA, 267 bp, Candidatus Protochlamydia amoebophila UWE25
  CDS (1)..(267): transl_table=11
gtgaaactcgtttgtaaagtacaagtaaaaaatcgcatgggtcttcatacgcgaccagcaaccacgattgttaaattattgcaaaattgtaagagtgatgtttattttacacacaaacaagaaacaattaatgcgaagagtattttgagtattctcatgttagctgctagaaaaaattctaaaattacaatagcagtggaaggggaagatgcaaatgacaccatggataaactgattgaggcgtttgagtctcaattcggagagtaa

SEQ ID NO: 3202 - protein, 88 aa, Candidatus Protochlamydia amoebophila UWE25
MKLVCKVQVKNRMGLHTRPATTIVKLLQNCKSDVYFTHKQETINAKSILSILMLAARKNSKITIAVEGEDANDTMDKLIEAFESQFGE

SEQ ID NO: 3203 - DNA, 294 bp, Candidatus Protochlamydia amoebophila UWE25
  CDS (1)..(294): transl_table=11
atgctgaaaacaactgaaaagtctgttgttaagggaaaatttattgttagtaacgatcgaggacttcatacaagaccttcaacagaacttgtaaagtgcgcaaatagttttagatctcaagttttcttgaaatatcaaaagcttgctgttaatgcaaaatcattacttggcgttttaatgttagctgcttcaaaaggggctaaaattgggattgaagcagaaggagtggatgctcaagaagctgtagaatctattattgaacttgctaacaataatttttatattaaatattaa

SEQ ID NO: 3204 - protein, 97 aa, Candidatus Protochlamydia amoebophila UWE25
MLKTTEKSVVKGKFIVSNDRGLHTRPSTELVKCANSFRSQVFLKYQKLAVNAKSLLGVLMLAASKGAKIGIEAEGVDAQEAVESIIELANNNFYIKY

SEQ ID NO: 3205 - DNA, 261 bp, Desulfovibrio vulgaris subsp. vulgaris str. Hildenborough
  CDS (1)..(261): transl_table=11
gtgcaggtcgccgtcgacgtgctcaacgaacaggggctgcatgcacgccccgcagcacgccttgcgcaggaggcacagcgcttcgccgcccgcatgagccttgtcgtggacgaggccgaggtggacgccaagagcatccttgatatactctcgcttgccgccgccaagggaacacgcatcgtcgtgcgggcatcgggcgacgacgcacatgcggccgtggaacacatcgccgcgctcttcaacaaccgtttcagggaatag

SEQ ID NO: 3206 - protein, 86 aa, Desulfovibrio vulgaris subsp. vulgaris str. Hildenborough
MQVAVDVLNEQGLHARPAARLAQEAQRFAARMSLVVDEAEVDAKSILDILSLAAAKGTRIVVRASGDDAHAAVEHIAALFNNRFRE

SEQ ID NO: 3207 - DNA, 267 bp, Mycoplasma mobile 163K
  CDS (1)..(267): transl_table=4
atgaaaaaattagaagcagttgttattgacaaaattggatttcatgcaaggccagcttcgaaagttgtgaatgtagcttcaaaatttcattcaaaaatcgaaataactaaagcagatggaactgttggaaatttaaaatcagtaataaatattatgtctttagcaattagacatggtgaaaaaattaaaattactgctgaaggcgaagatgaagcagcagcaatcaaacaaattgaaaaagtattaattgatgaaaaattaatctaa

SEQ ID NO: 3208 - protein, 88 aa, Mycoplasma mobile 163K
MKKLEAVVIDKIGFHARPASKVVNVASKFHSKIEITKADGTVGNLKSVINIMSLAIRHGEKIKITAEGEDEAAAIKQIEKVLIDEKLI

SEQ ID NO: 3209 - DNA, 297 bp, Bartonella quintana str. Toulouse
  CDS (1)..(297): transl_table=11
atgctttccaaaaattctcttccatctacattaagtcgccatttcaatatctgtaataaacgtgggttgcacgcgcgtgcttctgcaaaatttgtacaaattgttgacaatttcaacgccattgttgaagttgaaaaggatgggaaaatcgttggtggctcgtcaattatgggtcttatgatgttagcagcttcatccggttgtaacctcactattcgcgtttcaggaccagaagcaagtgacgttctcgacgctcttgaaaaacttatcaacaataaatttggagatgagaactag

SEQ ID NO: 3210 - protein, 98 aa, Bartonella quintana str. Toulouse
MLSKNSLPSTLSRHFNICNKRGLHARASAKFVQIVDNFNAIVEVEKDGKIVGGSSIMGLMMLAASSGCNLTIRVSGPEASDVLDALEKLINNKFGDEN

SEQ ID NO: 3211 - DNA, 276 bp, Acinetobacter sp. ADP1
  CDS (1)..(276): transl_table=11
ctggtcatgattgatacgacggtagatgtaattaacaaacttggtttacacgcacgcgcatcaggaaagctgattgaggtgaccacaaaatttcgctcttccatccaaattggtaagggcgataagctgatcgatgcaaaaaacattatgtccttactcatgcttggtgcaggtaagggaaccactttgcgtttagtgattgaaggtgctgatgaagataaggcacttgatgaaattcaagcattattcgcagcaaaattttatgaggcagattaa

SEQ ID NO: 3212 - protein, 91 aa, Acinetobacter sp. ADP1
MVMIDTTVDVINKLGLHARASGKLIEVTTKFRSSIQIGKGDKLIDAKNIMSLLMLGAGKGTTLRLVIEGADEDKALDEIQALFAAKFYEAD

SEQ ID NO: 3213 - DNA, 273 bp, Erwinia carotovora subsp. atroseptica SCRI1043
  CDS (1)..(273): transl_table=11
atgacagtccggcaaacggttgaaattaaaaacaagctgggtatgcatgctcgcccagcgatgaagctgttcgagctggtgcagagctttgatgcggaagtgatactgcgcaatgacagcggcaccgaagcggaagccagtagcgtgattgccatgctgatgctggactcggccaaaggccgactcatcgaagtagaagccactggccaagacgaagaacaggcgcttgctgccgtcatcgggctgttcgaagcggggttcgacgaagactag

SEQ ID NO: 3214 - protein, 90 aa, Erwinia carotovora subsp. atroseptica SCRI1043
MTVRQTVEIKNKLGMHARPAMKLFELVQSFDAEVILRNDSGTEAEASSVIAMLMLDSAKGRLIEVEATGQDEEQALAAVIGLFEAGFDED

SEQ ID NO: 3215 - DNA, 300 bp, Propionibacterium acnes KPA171202
  CDS (1)..(300): transl_table=11
atgatccgcaccgaggtgacaataggccaccctgccgggatccatgccagggtggccgcacacgccgtactactggcctccggccactcggccagtgttttcctgcgatcctcacgcgggacggccagtcttacccggctagcggacctgctgagattggacgtccgcgaggacgccgtcgtcgagatcctggccgatggccctgacgaggtcgaagcactgcacgaagtcgcgacattcctcacgtcctcgacaaacgaccccgcaccacatactgcatcagacgaagggaacgattga

SEQ ID NO: 3216 - protein, 99 aa, Propionibacterium acnes KPA171202
MIRTEVTIGHPAGIHARVAAHAVLLASGHSASVFLRSSRGTASLTRLADLLRLDVREDAVVEILADGPDEVEALHEVATFLTSSTNDPAPHTASDEGND

SEQ ID NO: 3217 - DNA, 267 bp, Symbiobacterium thermophilum IAM 14863
  CDS (1)..(267): transl_table=11
atggtagaaaggacctttaccctaagcaaccccaccggactgcatgccaggcccgccgcactgttcgtcaaggaagtgcagaagttcgccgacacggagatcttcgtgcgcaagggcgagaaggaggtctcggcccgttccctgctctccctcctgagcctcggcgtcgcccagggggagaccatcgtcatccgctgccaggggccccgggaagaggaggccatggcggcgctggccgcgctgattgagggtggcctcggtgagtga

SEQ ID NO: 3218 - protein, 88 aa, Symbiobacterium thermophilum IAM 14863
MVERTFTLSNPTGLHARPAALFVKEVQKFADTEIFVRKGEKEVSARSLLSLLSLGVAQGETIVIRCQGPREEEAMAALAALIEGGLGE

SEQ ID NO: 3219 - DNA, 267 bp, Bacillus licheniformis ATCC 14580
  CDS (1)..(267): transl_table=11
atggcacaaaaaacgtttaaagtaactgcagattctggaatccacgctcgtccagcgactgttcttgtacaaacagcaagcaaatatgatgcagatattaatttggaatataacggaaaaacagtaaaccttaaatctattatgggcgttatgtcactaggtattgccaaaggtgctgaaatcacgatttctgcttccggcgctgatgaaaatgatgctctttccgcacttgaagaaacaatgaaaagcgaaggtttaggcgaataa

SEQ ID NO: 3220 - protein, 88 aa, Bacillus licheniformis ATCC 14580
MAQKTFKVTADSGIHARPATVLVQTASKYDADINLEYNGKTVNLKSIMGVMSLGIAKGAEITISASGADENDALSALEETMKSEGLGE

SEQ ID NO: 3221 - DNA, 270 bp, Bacillus licheniformis ATCC 14580
  CDS (1)..(270): transl_table=11
atggttcaacaaaaagtggaagttcttttaaaaacagggcttcaagcgcgcccagcggcattgtttgttcaagaagccaaccgttttcaatcagatatttttctggaaaagggagataaaaaagtgaatgccaaaagcatcatggggctgatgagccttgctgtcagctccggatcggaagtcacgctgatcgctgacggatccgatgaacaagatgcccttgatgcactgactgcatatgttcaagagaaagaagctaaacctttatga

SEQ ID NO: 3222 - protein, 89 aa, Bacillus licheniformis ATCC 14580
MVQQKVEVLLKTGLQARPAALFVQEANRFQSDIFLEKGDKKVNAKSIMGLMSLAVSSGSEVTLIADGSDEQDALDALTAYVQEKEAKPL

SEQ ID NO: 3223 - DNA, 270 bp, Azoarcus sp. EbN1
  CDS (1)..(270): transl_table=11
atgccgagagctgaaaccgaaatcatcaacaaactgggcctgcacgcgcgcgcgtcggcgaaactcacacagacggcgagcagctacggtgcggacatctggctcgagcgcaacggccgccgcgtcaatgccaaaagcatcatgggggtgatgatgctggctgccgcgcagggatcgcgaatcaccatcgatacgtcgggacgggatgccgacgccgccctcgaggccatcctggagctgatcgcggaccgattcggcgagggagagtaa

SEQ ID NO: 3224 - protein, 89 aa, Azoarcus sp. EbN1
MPRAETEIINKLGLHARASAKLTQTASSYGADIWLERNGRRVNAKSIMGVMMLAAAQGSRITIDTSGRDADAALEAILELIADRFGEGE

SEQ ID NO: 3225 - DNA, 270 bp, Silicibacter pomeroyi DSS-3
  CDS (1)..(270): transl_table=11
atggcgcaacgtacattgaagatcatcaacgaaaagggcctgcatgcccgggcctcggccaagctggtcgaggttgtcgaagggttcgacgcaaccgccgaggtgtcccgcgacggcttgtccgcctcgggtgacagcatcatggggcttttgatgttggcagccgcgcgcggaaccactattgacgtcgagacctccggcccggatgcggatgccctggcggatgcgctcgaggcactggtgaacgacaagttcggcgagggtttctga

SEQ ID NO: 3226 - protein, 89 aa, Silicibacter pomeroyi DSS-3
MAQRTLKIINEKGLHARASAKLVEVVEGFDATAEVSRDGLSASGDSIMGLLMLAAARGTTIDVETSGPDADALADALEALVNDKFGEGF

SEQ ID NO: 3227 - DNA, 264 bp, Bacillus clausii KSM-K16
  CDS (1)..(264): transl_table=11
atggctgaaaaaacatttaaaattactgcagaaacgggcattcacgcgcgtccagctacacagcttgttaataaagctggccaattctcgtctgatatcactttggaatacaaagggaaatcagtcaatcttaaatcgatcatgggtgtcatgtctcttggtgttggacaaggcgcagaagtaacaatcaaagcggaaggttcagacgcagatgaagcgctttcagctattgaagaagtgattaaagagggacttggcgaataa

SEQ ID NO: 3228 - protein, 87 aa, Bacillus clausii KSM-K16
MAEKTFKITAETGIHARPATQLVNKAGQFSSDITLEYKGKSVNLKSIMGVMSLGVGQGAEVTIKAEGSDADEALSAIEEVIKEGLGE

SEQ ID NO: 3229 - DNA, 273 bp, Pseudomonas syringae pv. syringae B728a
  CDS (1)..(273): transl_table=11
atgcccgctcgtcaaatcaccatcatcaacaaactgggcctgcacgcccgcgctgccgccaaattcgtcggggtcgcaggcaagtttccctgcaagatcagggtcggccgcactccggagagcatggtcgacggtaaaagcatcatggccgtgatgatgctggctgccggcaagggcaccgagatccacctgcacaccgaaggcgaattcgaacaggaagcgcttgatggcctgatcgagctgatcgacaaccggtttgatgagggcgaataa

SEQ ID NO: 3230 - protein, 90 aa, Pseudomonas syringae pv. syringae B728a
MPARQITIINKLGLHARAAAKFVGVAGKFPCKIRVGRTPESMVDGKSIMAVMMLAAGKGTEIHLHTEGEFEQEALDGLIELIDNRFDEGE

SEQ ID NO: 3231 - DNA, 273 bp, Pseudomonas fluorescens Pf-5
  CDS (1)..(273): transl_table=11
atgccagctctggaaatcgagatcatcaataaactgggcctgcatgcccgtgcctcggccaagttcgtcggcgtggccgggcagtttccctgccagatccgcgccggcaggaccccggactccatggtcgacggcaaaagcatcatggccatgatgatgctggccgccggcaagggcaccaggatccacctgaagaccgaaggcgagcaggaacaggaagcgatggatgcgctggtggcactgatcaacaacttcttcgacgaaggcgagtag

SEQ ID NO: 3232 - protein, 90 aa, Pseudomonas fluorescens Pf-5
MPALEIEIINKLGLHARASAKFVGVAGQFPCQIRAGRTPDSMVDGKSIMAMMMLAAGKGTRIHLKTEGEQEQEAMDALVALINNFFDEGE

SEQ ID NO: 3233 - DNA, 276 bp, Colwellia psychrerythraea 34H
  CDS (1)..(276): transl_table=11
gtgaatgttatctctcaacaagtgaccatttgtaataaattgggtttacacgctcgtgccgcaactaaattagcgcaattaagccaaaagtttgccgcgaaaatcaccctagaattagccggtaaagaagccgacgctggtagtattatggcgctaatgttactagcaggcggtcaaggaaaaatggtaaatatcaccgcacaaggcaaagacgcacagttggcactcgctgaaatatgccaacttatttctgataagttcgacgaagctgaataa

SEQ ID NO: 3234 - protein, 91 aa, Colwellia psychrerythraea 34H
MNVISQQVTICNKLGLHARAATKLAQLSQKFAAKITLELAGKEADAGSIMALMLLAGGQGKMVNITAQGKDAQLALAEICQLISDKFDEAE

SEQ ID NO: 3235 - DNA, 273 bp, Pseudomonas syringae pv. phaseolicola 1448A
  CDS (1)..(273): transl_table=11
atgcccgctcgtcaaatcaccatcatcaacaaattgggcctgcatgcccgcgctgccgccaaattcgtcggagtcgcaggcaagttcccttgcacgatcagggttggccgctctgagcagaccatggtcgatggtaaaagcatcatggccgtgatgatgctggcggcaggcaaaggcaccgaaatccatctgaaaaccgaaggcgaattcgagcaggaagcgctcgatggcctggttgaactgatcaacaacaagtttgatgagggcgagtaa

SEQ ID NO: 3236 - protein, 90 aa, Pseudomonas syringae pv. phaseolicola 1448A
MPARQITIINKLGLHARAAAKFVGVAGKFPCTIRVGRSEQTMVDGKSIMAVMMLAAGKGTEIHLKTEGEFEQEALDGLVELINNKFDEGE

SEQ ID NO: 3237 - DNA, 270 bp, Dechloromonas aromatica RCB
  CDS (1)..(270): transl_table=11
atgctgacgaccgaaaccgaaatcatcaacaagctgggcctccatgcccgcgcttccgccaaattgacccagctcgccggcaagtacaagtgcgaagtctggatgagcaagggcacgcgccgcatcaacgccaagagcatcatgggcgtgatgatgctggccgccggcaaaggctcgaaggtcacgctggaaaccgatggcgccgacgaagccgaggcgatggaagccttgctggcgctgatcgccgactatttcggcgagggagaataa

SEQ ID NO: 3238 - protein, 89 aa, Dechloromonas aromatica RCB
MLTTETEIINKLGLHARASAKLTQLAGKYKCEVWMSKGTRRINAKSIMGVMMLAAGKGSKVTLETDGADEAEAMEALLALIADYFGEGE

SEQ ID NO: 3239 - DNA, 264 bp, Thermobifida fusca YX
  CDS (1)..(264): transl_table=11
gtgagccgcgcggaacgccgggtcaccgtggcttcccccgtgggactgcatgcccggcccgcggcgcggttcgttacggcggcctccgagttcgacggggaggtgcgcattgcccgtcccagcggggcgagcgtgccggcgacgagcatgctggcggtgctggcgctgggggtgcgctgcggggaggagatcgtgatcaccgcggagggcgagggggccgaagagctgctggaccgtctcgccgagatcgccgctacgccgtga

SEQ ID NO: 3240 - protein, 87 aa, Thermobifida fusca YX
MSRAERRVTVASPVGLHARPAARFVTAASEFDGEVRIARPSGASVPATSMLAVLALGVRCGEEIVITAEGEGAEELLDRLAEIAATP

SEQ ID NO: 3241 - DNA, 270 bp, Ralstonia eutropha JMP134
  CDS (1)..(270): transl_table=11
atgctgcagagggacaccaccatcatcaataagctcgggctgcacgcccgcgcttcggccaagctaacgcaactggcaggcaacttcgccagccaggtcaggatgtcccgcaacggacgccaggtcgatgccaagagcatcatgggcgtgatgatgcttgcggcggggatcggctccaccgtgaccatcgagaccgacggaccggacgagcgggaggcgatggatgcgctgctggcgctgatcgccaaccgctttggcgagggcgagtga

SEQ ID NO: 3242 - protein, 89 aa, Ralstonia eutropha JMP134
MLQRDTTIINKLGLHARASAKLTQLAGNFASQVRMSRNGRQVDAKSIMGVMMLAAGIGSTVTIETDGPDEREAMDALLALIANRFGEGE

SEQ ID NO: 3243 - DNA, 270 bp, Thiobacillus denitrificans ATCC 25259
  CDS (1)..(270): transl_table=11
atgcagcaacgggacgttgaaatcgtcaacaagctggggctgcacgcgcggccgtcagcacgcctcacccaactggcatcgagcttcaagagcaacgtcttcctgtcgcgcaacggccgccgcgtcaacgccaagagcatcatgggcgtgatgatgctcgccgcggccaagggcagcacgatcaccgtcgaggccgaaggcgacgacgagcaggacgcggtcgacgcgctggcgaaactgatttcggacggattcggggaagagcgatga

SEQ ID NO: 3244 - protein, 89 aa, Thiobacillus denitrificans ATCC 25259
MQQRDVEIVNKLGLHARPSARLTQLASSFKSNVFLSRNGRRVNAKSIMGVMMLAAAKGSTITVEAEGDDEQDAVDALAKLISDGFGEER

SEQ ID NO: 3245 - DNA, 276 bp, Pseudomonas fluorescens PfO-1
  CDS (1)..(276): transl_table=11
atgcctgctcgtgaaatcgaaatcatcaacaagctgggcctgcacgcccgcgcatcggcaaaattcgtcggagtggcgggacagtttcccgattgcacgatccgagtgggccgcaccccggaaaccacggtcgacggtaaaagcatcatggcaatgatgatgctcgctgcgggcaagggcaccaaaatccacctgagtaccgacggccaccaggaacaggaagccatggacgcgctggtgaccctgatcaacaactatttcgacgaaggtggttga

SEQ ID NO: 3246 - protein, 91 aa, Pseudomonas fluorescens PfO-1
MPAREIEIINKLGLHARASAKFVGVAGQFPDCTIRVGRTPETTVDGKSIMAMMMLAAGKGTKIHLSTDGHQEQEAMDALVTLINNYFDEGG

SEQ ID NO: 3247 - DNA, 270 bp, Rhodobacter sphaeroides 2.4.1
  CDS (1)..(270): transl_table=11
atgatcgaacgagaacttctcatcgtgaacgaaaagggcctgcatgcgcgggcttcggccaagttcgtcgaagtcgtggaacggcacgatgcccaggccgaggtctccaaggacgggatggtggtctcgggcgactcgatcatgggtctcctgatgctcgccgcctcgcgcgggacctcgatccggatccggaccatgggctccgaggccagcgcgctggccgaggcgctctcggcgctggtggcggaccggttcggcgaggacatgtga

SEQ ID NO: 3248 - protein, 89 aa, Rhodobacter sphaeroides 2.4.1
MIERELLIVNEKGLHARASAKFVEVVERHDAQAEVSKDGMVVSGDSIMGLLMLAASRGTSIRIRTMGSEASALAEALSALVADRFGEDM

SEQ ID NO: 3249 - DNA, 270 bp, Burkholderia sp. 383
  CDS (1)..(270): transl_table=11
atgcttcaacaagaaaccaccatcgtcaataaattggggctccatgcgcgcgcatcggccaagcttacgcaactggccggcaacttccagtcggaagtctggatgacgcgcaacgggcgcaagatcaatgcaaagagcatcatgggcgtgatgatgctggcggcgggcatcggcagcaccgtgacgatcgagaccgaagggtccgacgagcaggaagcgatggacgcgctgctgaagctgatcgccgacaagttcggcgaaggccagtga

SEQ ID NO: 3250 - protein, 89 aa, Burkholderia sp. 383
MLQQETTIVNKLGLHARASAKLTQLAGNFQSEVWMTRNGRKINAKSIMGVMMLAAGIGSTVTIETEGSDEQEAMDALLKLIADKFGEGQ

SEQ ID NO: 3251 - DNA, 267 bp, Geobacter metallireducens GS-15
  CDS (1)..(267): transl_table=11
atgctcgaccaggaattcaccatcatcaacaaactcggtctccacgcacgggcctcggccctttttgtcaagacggcaagccgttttcgctctgacataaagattgtgcgagaggggatcgaggtgaacggcaagagcatcatggggatcatgatgctggccgcggccaagggaacacttatcagggtgaaaattgagggggaggacgaggcggaagcaatggccgccctcggagagcttataaccaatggattcggcgaggaatga

SEQ ID NO: 3252 - protein, 88 aa, Geobacter metallireducens GS-15
MLDQEFTIINKLGLHARASALFVKTASRFRSDIKIVREGIEVNGKSIMGIMMLAAAKGTLIRVKIEGEDEAEAMAALGELITNGFGEE

SEQ ID NO: 3253 - DNA, 300 bp, Desulfovibrio desulfuricans G20
  CDS (1)..(300): transl_table=11
gtgcaggaagagattcgtgaaatagaagacggactgtgcctcactgtccgcgtcgccaatgatcaggggctgcatgcacgccccgccgccagactggtaaaggaagcttcccgctttacatcgcgcatagtactggcatcaggcgacgcggaggtggacgccaaatccattcttgatatcctgtcgctggctgcggccaaagggactgcgctggagctgcgagccagcggacccgatgcgcgcgaagctctgcggcatcttgccgcaacatttgccaaccgcttccgcgaggacacgtaa

SEQ ID NO: 3254 - protein, 99 aa, Desulfovibrio desulfuricans G20
MQEEIREIEDGLCLTVRVANDQGLHARPAARLVKEASRFTSRIVLASGDAEVDAKSILDILSLAAAKGTALELRASGPDAREALRHLAATFANRFREDT

SEQ ID NO: 3255 - DNA, 339 bp, Rhodospirillum rubrum ATCC 11170
  CDS (1)..(339): transl_table=11
atgcggggcccttctcgaggaaactttgggagcatgactttgcccacgaccgtccaggagtccgtcgacggcgccatcgcccgcgacgccaccatcgtcaatcggcgcggcctgcacgcccgggcggcggcgaaattcgtcaagaccgccgaaaccttcaaggccgaggtcaccgtcaccaatcgcggacaagcggtgtcggggcgctcgatcatggggctgatgatgttggccgccggaccggggaccaccatctcgctctccgcgattggcgaggacgccgataccgcgctggaggcgctgtgcgccctgatcgcggacgggttccatgaagagtga

SEQ ID NO: 3256 - protein, 112 aa, Rhodospirillum rubrum ATCC 11170
MRGPSRGNFGSMTLPTTVQESVDGAIARDATIVNRRGLHARAAAKFVKTAETFKAEVTVTNRGQAVSGRSIMGLMMLAAGPGTTISLSAIGEDADTALEALCALIADGFHEE

SEQ ID NO: 3257 - DNA, 282 bp, Moorella thermoacetica ATCC 39073
  CDS (1)..(282): transl_table=11
atgattacaaaagaactaaccatcaccaatgaaacaggccttcatgcccgtccggctactctttttgtccaaactgcccagtcatttaaaagtaaaataggcataacaaagggagatagacaagccgacgccaaaagtattctggcagtaatgggcctgggaatcaccaaagacacttccattacgatatgggcggaaggggaagacgagaaggaagctatagaggccttagaacgattagttaaaagcaatttccgggaaggtattgaagatgcttcttaa

SEQ ID NO: 3258 - protein, 93 aa, Moorella thermoacetica ATCC 39073
MITKELTITNETGLHARPATLFVQTAQSFKSKIGITKGDRQADAKSILAVMGLGITKDTSITIWAEGEDEKEAIEALERLVKSNFREGIEDAS

SEQ ID NO: 3259 - DNA, 270 bp, Burkholderia thailandensis E264
  CDS (1)..(270): transl_table=11
atgcttcaacaagaaacgaccatcgtgaacaaattggggctccatgcgcgcgcgtctgccaagctcacgcagctcgcgggcaatttccagtcggaagtctggatgacgcgcaacggccgccggatcaacgcgaagagcatcatgggcgtcatgatgctggcggcgggcatcggcagcatggtgacgatcgagaccgaagggccggacgagcaggaagcgatggacgcgctcctcaaattgatcgccgacaaattcggcgaagggcagtga

SEQ ID NO: 3260 - protein, 89 aa, Burkholderia thailandensis E264
MLQQETTIVNKLGLHARASAKLTQLAGNFQSEVWMTRNGRRINAKSIMGVMMLAAGIGSMVTIETEGPDEQEAMDALLKLIADKFGEGQ

SEQ ID NO: 3261 - DNA, 270 bp, Syntrophus aciditrophicus SB
  CDS (1)..(270): transl_table=11
atgatcgtaatcaggacgtttgaactaaaaaataaactgggccttcatgcccgtgttgcggcaaaacttgtcactgttgccagagggttcaaatcaagaatctttctggaaagagatggacaggaagtcaatggtaaaagccttctgggcatccttacactggcctgccctcaggggagccgggtaactgtacgggtggagggtgccgatgctcttcaggctatggataatctggagcagcttttcgagagtaaatttggtgaaacatga

SEQ ID NO: 3262 - protein, 89 aa, Syntrophus aciditrophicus SB
MIVIRTFELKNKLGLHARVAAKLVTVARGFKSRIFLERDGQEVNGKSLLGILTLACPQGSRVTVRVEGADALQAMDNLEQLFESKFGET

SEQ ID NO: 3263 - DNA, 309 bp, Novosphingobium aromaticivorans DSM 12444
  CDS (1)..(309): transl_table=11
atggcggaacagggcgcgcagcagggatacgtcactcgcgaaacggtgacgatcgtcaaccagcgcggccttcatgcccgggccagcgcgaagttcgtgaatgccgtggccaagctgcccgagggcttcgacgtgaccgtcgccaaggatgggactgatgccaatggcgcctcgatcctgggactgatgatgctgggcgccgcccggggcgacactgtcgacgtagctgttgccgggcccgagggcgaggccgacgcgatcctgatgaagctcaccggcctgatcaaggacggcttcggggaagactga

SEQ ID NO: 3264 - protein, 102 aa, Novosphingobium aromaticivorans DSM 12444
MAEQGAQQGYVTRETVTIVNQRGLHARASAKFVNAVAKLPEGFDVTVAKDGTDANGASILGLMMLGAARGDTVDVAVAGPEGEADAILMKLTGLIKDGFGED

SEQ ID NO: 3265 - DNA, 270 bp, Saccharophagus degradans 2-40
  CDS (1)..(270): transl_table=11
atgcagtatcgcgaaacagaaatcattaacaagttaggcctgcacgcacgggccgcatccaagttcgccaatttagccactcgttttcaatgcaaaataacggttaaactaggcgagaaaagtatcgatggcaaaagtattatgtcgctgatgcttctggccgcgggaattggtagccaaatagctatcacaactgaaggctcagacgaagaagaagcaatggatgcccttctagagttaattaacaaccgcttcgacgagccggaataa

SEQ ID NO: 3266 - protein, 89 aa, Saccharophagus degradans 2-40
MQYRETEIINKLGLHARAASKFANLATRFQCKITVKLGEKSIDGKSIMSLMLLAAGIGSQIAITTEGSDEEEAMDALLELINNRFDEPE

SEQ ID NO: 3267 - DNA, 270 bp, Methylobacillus flagellatus KT
  CDS (1)..(270): transl_table=11
atgattaaacaagaaatagaaatcatcaataagctgggcctgcatgcccgcgcatccaccaagctcacgcagactgccagccaatatgcctgcgaaatctggatcgaacgcaatggcaggcgcgtcaacgccaagagcatcatgggcgtgatgatgctcgcggcgagcaagggcagcaaggtgacgctcgaaacgaacggcagcgacgaacaggctgccatggatgccctggtgaagctcatcaacgaccgttttggcgaacctgaataa

SEQ ID NO: 3268 - protein, 89 aa, Methylobacillus flagellatus KT
MIKQEIEIINKLGLHARASTKLTQTASQYACEIWIERNGRRVNAKSIMGVMMLAASKGSKVTLETNGSDEQAAMDALVKLINDRFGEPE

SEQ ID NO: 3269 - DNA, 270 bp, Burkholderia xenovorans LB400
  CDS (1)..(270): transl_table=11
atgctgcaacaggaaacgactatcgtgaacaagctggggctgcacgcgcgcgcgtcggccaagttgacgcaactcgcgggcaactatcaggcggaaatctggatgagccgtaacggccgccgtatcaatgcgaagagcatcatgggtgtgatgatgctggccgcgggtattggcagcacggtgctcatcgaaacggaaggcgcggacgaaaaagaagcaatggacgcattgctgaaactgattgcggataaatttggcgagggtcagtga

SEQ ID NO: 3270 - protein, 89 aa, Burkholderia xenovorans LB400
MLQQETTIVNKLGLHARASAKLTQLAGNYQAEIWMSRNGRRINAKSIMGVMMLAAGIGSTVLIETEGADEKEAMDALLKLIADKFGEGQ

SEQ ID NO: 3271 - DNA, 270 bp, Ralstonia metallidurans CH34
  CDS (1)..(270): transl_table=11
atgctgcagagggacaccaccatcatcaataagctcgggcttcatgcccgcgcatccgccaagctcacgcagttggcaggtagcttcaacagccaggtcaagatgtcccgtaacggccgccaggtcgacgccaagagcatcatgggcgtgatgatgctggcagccggaattggatcgacggtctcgatcgagactgacggccctgacgagcaggaggcgatggatgcgctgctggcgctgatcgccaaccgcttcggcgaaggcgagtga

SEQ ID NO: 3272 - protein, 89 aa, Ralstonia metallidurans CH34
MLQRDTTIINKLGLHARASAKLTQLAGSFNSQVKMSRNGRQVDAKSIMGVMMLAAGIGSTVSIETDGPDEQEAMDALLALIANRFGEGE

SEQ ID NO: 3273 - DNA, 270 bp, Silicibacter sp. TM1040
  CDS (1)..(270): transl_table=11
atggctcgaaaaacgctcaagattgtaaacgaaaagggtctgcatgcacgcgcgtcggccaaactggtcgaagtggtcgaaggctttgatgccactgccgaggtcatcaaagacgggatgtctgcgtcaggcgatagcatcatggggcttttgatgttggcagcgtcgaagggaacgactattgacgtcgaaacttctggacctgatgctgaagcgctggcctccgccgtcgaagccttggtggctgacaagtttggcgaaggctactaa

SEQ ID NO: 3274 - protein, 89 aa, Silicibacter sp. TM1040
MARKTLKIVNEKGLHARASAKLVEVVEGFDATAEVIKDGMSASGDSIMGLLMLAASKGTTIDVETSGPDAEALASAVEALVADKFGEGY

SEQ ID NO: 3275 - DNA, 291 bp, Myxococcus xanthus DK 1622
  CDS (1)..(291): transl_table=11
gtgggagtcgcgatggcaagcgtggtcgaagggacatacgagatcatcaacgcgctggggctgcacgcccgggccgcggcgcagatggtcaaggtggccaaccggttcaagagcgaggtcaccatcgaagcccagggacagcgggccaatgccaaatccatcatgggcgtgctgatgctcgccgccgcccagggcacccaggtgaagctcacctgcaagggcgacgacgcggatgcctgtctccaggagctggcgaagctcattggtgaccgtttcggcgaggcgcagtga

SEQ ID NO: 3276 - protein, 96 aa, Myxococcus xanthus DK 1622
MGVAMASVVEGTYEIINALGLHARAAAQMVKVANRFKSEVTIEAQGQRANAKSIMGVLMLAAAQGTQVKLTCKGDDADACLQELAKLIGDRFGEAQ

SEQ ID NO: 3277 - DNA, 261 bp, Rubrobacter xylanophilus DSM 9941
  CDS (1)..(261): transl_table=11
atggtagaacgcgaagccacggtggtgcccgaggaggggctgcacgccaggcctgcggccaggttcgtggggacggccaagcagttcgtctcggacatcgtggtcataaaggacggcaaggaggccaacgccaagagcccgctgaagctcatgaccctcggggcgaagaagggcgaccgggtggtgatccgggccgagggcgaggacgcggaggaggccgtcgaggcgctggttgagatcgtgacctcggaggagccctag

SEQ ID NO: 3278 - protein, 86 aa, Rubrobacter xylanophilus DSM 9941
MVEREATVVPEEGLHARPAARFVGTAKQFVSDIVVIKDGKEANAKSPLKLMTLGAKKGDRVVIRAEGEDAEEAVEALVEIVTSEEP

SEQ ID NO: 3279 - DNA, 306 bp, Mesorhizobium sp. BNC1
  CDS (1)..(306): transl_table=11
atgagtgatgcgccaaccaatccgccagccgacgaagtaatcacgcgcgatttcgcgatcgtgaaccagcgcggactgcatgcgcgtgcctcggcgaaattcgtccagctcgtcagcagctacaacgccaaggtctcggtggagaaggacggtatttctgtcggcggcacatccatcatggggttgatgatgcttgccgccagcccgggatgccgcattcgggtaagcgccagcgggccggatgcgtcgaagcttctcgatgctctggctgaactgattgccgagcgcttcggcgaggaaatttaa

SEQ ID NO: 3280 - protein, 101 aa, Mesorhizobium sp. BNC1
MSDAPTNPPADEVITRDFAIVNQRGLHARASAKFVQLVSSYNAKVSVEKDGISVGGTSIMGLMMLAASPGCRIRVSASGPDASKLLDALAELIAERFGEEI

SEQ ID NO: 3281 - DNA, 276 bp, Shewanella sp. MR-4
  CDS (1)..(276): transl_table=11
atgccaaagcttgagcgccaaatcaccatctgcaataaactcggtttacatgcccgcgccgcgacaaagctcgtggtgttggcctcagagtttgatgccagcattacgctgatccaaggtgaaaaacaggcctctgccgccagtgttttagggctactcatgctggaaacgggtatgggtaaaaccattaccctgattgccgaaggtccagatgcggagcccgcgctcaatgccatttgcgcgcttatcgacgctaagttcgacgaagcctgctaa

SEQ ID NO: 3282 - protein, 91 aa, Shewanella sp. MR-4
MPKLERQITICNKLGLHARAATKLVVLASEFDASITLIQGEKQASAASVLGLLMLETGMGKTITLIAEGPDAEPALNAICALIDAKFDEAC

SEQ ID NO: 3283 - DNA, 360 bp, Alkalilimnicola ehrlichei MLHE-1
  CDS (1)..(360): transl_table=11
ttgaattgccaatccgaggaacacccgcaacccaaccaaggacccaccgccgtggccagccaggcaatggacatcgtgaacacactcgggctgcatgcccgtgccgccggcaaattttccgccctggccgcagagttcccgtgccaaatccgggtcacccgcggtcaacgcacggtggatggcaaaagcgtgatggggctgatgatgctggccgccggctgcggcagccagatcctggtggaggccgagggggaccaggccgaggaggcgctggccgccctcagccgcctggtggccaatggcttcgacgaaggccccggtgcgccgagcccccacccgggcgataaaggcgacgactag

SEQ ID NO: 3284 - protein, 119 aa, Alkalilimnicola ehrlichei MLHE-1
MNCQSEEHPQPNQGPTAVASQAMDIVNTLGLHARAAGKFSALAAEFPCQIRVTRGQRTVDGKSVMGLMMLAAGCGSQILVEAEGDQAEEALAALSRLVANGFDEGPGAPSPHPGDKGDD

SEQ ID NO: 3285 - DNA, 294 bp, Hyphomonas neptunium ATCC 15444
  CDS (1)..(294): transl_table=11
atgtcgacgtccgttccggcagcctctgcccgtgtcacgattgtcaatcgtaagggcctgcatgcgcgggcgtcggcgaaggtcgccaagcttgcggccgagtatgatgccaaggtcatcgtgcgccatgagggcgagcaggcagatgcccgctcgatcatggatctcctgatgctcgttgcccatacaggctgcgagatcgagctttcgggcaccggcacgcaggccgcagaggcggttgaagccatcgccgcgctggtcgccgatggcttcggggaacgtgacgggggctga

SEQ ID NO: 3286 - protein, 97 aa, Hyphomonas neptunium ATCC 15444
MSTSVPAASARVTIVNRKGLHARASAKVAKLAAEYDAKVIVRHEGEQADARSIMDLLMLVAHTGCEIELSGTGTQAAEAVEAIAALVADGFGERDGG

SEQ ID NO: 3287 - DNA, 276 bp, Rhizobium leguminosarum bv. viciae 3841
  CDS (1)..(276): transl_table=11
atgacatcgctctcccgggaactcctcattatcaacaagcgcggtcttcacgcgcgcgcttccgccaaattcgtgcagatggtcgagaccttcgatgccgccatcaccgtttccaaggatggaatgacggtcggcggaacctccatcatgggcttgatgatgcttgcggcaagccccggctcgagcgtcgtcgtctcggcgagcggcagccaggccgaggaagcgctggaggccctggaccagctgatccagaataggtttggcgaagagatgtga

SEQ ID NO: 3288 - protein, 91 aa, Rhizobium leguminosarum bv. viciae 3841
MTSLSRELLIINKRGLHARASAKFVQMVETFDAAITVSKDGMTVGGTSIMGLMMLAASPGSSVVVSASGSQAEEALEALDQLIQNRFGEEM

SEQ ID NO: 3289 - DNA, 264 bp, Oenococcus oeni PSU-1
  CDS (1)..(264): transl_table=11
atggtttctaaagaatttacgattactgctgactctggcttacacgctcgtcctgcgacgatgcttgttcaaaaagcctcagagttcgattcaaagttgactttgaagtatgatggcaaagaagtcaatctaaagtcgattatgggtgtaatgagtcttggcgcgggtaaaggtgctaagatcgagatcgttgccgacggtggcgacgcacaagcagcccttgacggtgttgaaggtacgcttaagagcgagtctctagtttaa

SEQ ID NO: 3290 - protein, 87 aa, Oenococcus oeni PSU-1
MVSKEFTITADSGLHARPATMLVQKASEFDSKLTLKYDGKEVNLKSIMGVMSLGAGKGAKIEIVADGGDAQAALDGVEGTLKSESLV

SEQ ID NO: 3291 - DNA, 276 bp, Shewanella sp. ANA-3
  CDS (1)..(276): transl_table=11
atgccaaagcttgagcgccaagtcaccatctgcaataaactcggcttacatgcccgcgccgccactaagctcgtggtgcttgcgtctgagtttgatgccagcattacgctgatccaaggtgaaaaacaggcctctgccgccagtgttttagggctactgatgctagaaaccggcatgggtaaaaccattaccctgattgccgaaggcccagatgccgagcccgcgctcaatgccatttgcgcgcttattgacgctaagttcgacgaagcctgttaa

SEQ ID NO: 3292 - protein, 91 aa, Shewanella sp. ANA-3
MPKLERQVTICNKLGLHARAATKLVVLASEFDASITLIQGEKQASAASVLGLLMLETGMGKTITLIAEGPDAEPALNAICALIDAKFDEAC

SEQ ID NO: 3293 - DNA, 258 bp, Nocardioides sp. JS614
  CDS (1)..(258): transl_table=11
atgctcaccaagaccgtcgtcgtcggatcctccgtcggcctgcatgcccggcccgcccagctcatcgcccaggccgccgaggagctcgacagcgaggtgctgatcggcatccccggtggggatcccgtcgacgcgagctcctcgctgatgatcatgacgctcggggccggacccggtgaccaggtcgaggtgtccagcgacgaccaggccgctctcgacacgatcgccgccctcgtcgagcaggacctcgacgcgtag

SEQ ID NO: 3294 - protein, 85 aa, Nocardioides sp. JS614
MLTKTVVVGSSVGLHARPAQLIAQAAEELDSEVLIGIPGGDPVDASSSLMIMTLGAGPGDQVEVSSDDQAALDTIAALVEQDLDA

SEQ ID NO: 3295 - DNA, 270 bp, Azoarcus sp. BH72
  CDS (1)..(270): transl_table=11
atgccaagagcggaagcgcaaatcgtcaacaagctgggcctgcacgcgcgcgcatcggccaagctcacccagctcgccagcagctttccggccgaagtctggctggaacgcaacggccgccgggtcaatgcgaaaagcatcatgggggtgatgatgctggccgcggcgcgcggcgccacggtcaccgtggaaaccgccggctccgacgccgacgcggccttggaggcgctgctggcgctgatcgccgacaagttcggcgaaggggaatga

SEQ ID NO: 3296 - protein, 89 aa, Azoarcus sp. BH72
MPRAEAQIVNKLGLHARASAKLTQLASSFPAEVWLERNGRRVNAKSIMGVMMLAAARGATVTVETAGSDADAALEALLALIADKFGEGE

SEQ ID NO: 3297 - DNA, 270 bp, Acidovorax sp. JS42
  CDS (1)..(270): transl_table=11
atgatcaagaagaacatcaccatcagcaataagctgggcctgcatgcccgcgcctccgccaagctcaccaagatggcgggcagttttccctgcgacgtctggatgcgcaagggagagcgccgcatcaatgccaagagcatcatgggggtgatgatgctggcggcgggcatggggtccgaggtcgagatcgagaccgatggcgcgcaggagcaggaagccatggatgcgcttgtcgcgctcatcgatggcaagttcggcgagggcgaataa

SEQ ID NO: 3298 - protein, 89 aa, Acidovorax sp. JS42
MIKKNITISNKLGLHARASAKLTKMAGSFPCDVWMRKGERRINAKSIMGVMMLAAGMGSEVEIETDGAQEQEAMDALVALIDGKFGEGE

SEQ ID NO: 3299 - DNA, 306 bp, Magnetospirillum magnetotacticum MS-1
  CDS (1)..(306): transl_table=11
atgccggacgtgatcggaacctcgggcgaaaccggcgcggaactggtccgcaccgccctcatttccaaccggcgcggcctgcatgcccgtgccgccgccaaattcgtcaaactggccgccaccttcgacgcccagatcaccgtcagccatcgcggcaccgaagtctcgggcctgtccatcatggggctgatgatgctggctgcggcgccgggctgttccatcgaactgaaggtgacgggagcccaggccaccgaggccatggacgccctcttcgacctcgtcgaccgcaagttcgacgaagactga

SEQ ID NO: 3300 - protein, 101 aa, Magnetospirillum magnetotacticum MS-1
MPDVIGTSGETGAELVRTALISNRRGLHARAAAKFVKLAATFDAQITVSHRGTEVSGLSIMGLMMLAAAPGCSIELKVTGAQATEAMDALFDLVDRKFDED

SEQ ID NO: 3301 - DNA, 273 bp, Fusobacterium nucleatum subsp. vincentii ATCC 49256
  CDS (1)..(273): transl_table=11
ttgatgaaatcagtaaaagtacatataaaaaataaaaaaggtttgcatgcaagaccttcatctctatttgtacaattagttacaaagtatgattctgatatcagtgttaaatcggaagatgaaactgtaaatggaaaaagtattatgggtcttatgcttttagcagcagaagagggtagagaattagaattgattgcagatggaccagatgaagatgctatgcttgaagagctagttgatttaatagaagtaaagaagttcaatgaggagtaa

SEQ ID NO: 3302 - protein, 90 aa, Fusobacterium nucleatum subsp. vincentii ATCC 49256
MMKSVKVHIKNKKGLHARPSSLFVQLVTKYDSDISVKSEDETVNGKSIMGLMLLAAEEGRELELIADGPDEDAMLEELVDLIEVKKFNEE

SEQ ID NO: 3303 - DNA, 267 bp, Mycoplasma genitalium G37
  CDS (1)..(267): transl_table=4
atgaaaaaatttcaagcagttattaaagacccagtgggaattcacgcacgtcctgcttctatccttgcaagtgaggctagtaagtttaaatctgaacttaaactggtagctccaagtggtgttgaaggtaatattaaatcaattattaacttaatgtctttaggaattagacataatgacaacattactatcaaagcagatggagctgatgaagaagaagctttagcagctattaaagcttgtcttagaaaaaataaagttatctaa

SEQ ID NO: 3304 - protein, 88 aa, Mycoplasma genitalium G37
MKKFQAVIKDPVGIHARPASILASEASKFKSELKLVAPSGVEGNIKSIINLMSLGIRHNDNITIKADGADEEEALAAIKACLRKNKVI

SEQ ID NO: 3305 - DNA, 267 bp, Prosthecochloris aestuarii DSM 271
  CDS (1)..(267): transl_table=11
gtgattgtcaaggaagttgttgtaaaaaataaagctggtttacataccaggcctgccgctgcagtggtgaaactggcttcgcgcttcaaagccgatttttttatcgagatgcacggttcggaagtcaacgccaaatcaattatcggagtgatgagtcttgctgctccgaaaggaacgaaactggttttgaaactcgatggagacgacgaagacgaagcggcccgtcagctcgtcgatttttttgatcaggggtttggcgagcagtaa

SEQ ID NO: 3306 - protein, 88 aa, Prosthecochloris aestuarii DSM 271
MIVKEVVVKNKAGLHTRPAAAVVKLASRFKADFFIEMHGSEVNAKSIIGVMSLAAPKGTKLVLKLDGDDEDEAARQLVDFFDQGFGEQ

SEQ ID NO: 3307 - DNA, 270 bp, Xylella fastidiosa Ann-1
  CDS (1)..(270): transl_table=11
atgcttgaacacgaactaacagtaactaacaaactaggactccacgcgcgagccactgccaaactggtacaaacaatgtcgaagttccaaagcaacacgacattgtcgacaaaaggccgcgaagtcaacgccaaaagcatcatgggagtcatgctgctcgccgccagccaaggcaccgtgatccggatacggatcgacggtgaagacgaacatacggcaatgcaagcactgagtgaactgttcgaaaaccgcttcaacgaggacacataa

SEQ ID NO: 3308 - protein, 89 aa, Xylella fastidiosa Ann-1
MLEHELTVTNKLGLHARATAKLVQTMSKFQSNTTLSTKGREVNAKSIMGVMLLAASQGTVIRIRIDGEDEHTAMQALSELFENRFNEDT

SEQ ID NO: 3309 - DNA, 285 bp, Roseovarius nubinhibens ISM
  CDS (1)..(285): transl_table=11
atgacagaccagcagagtgtgacgcgatcgctcgagatcgtgaatgaaaagggattgcatgcgcgggcttcggcgcggctggtcgaggtggtcgaagggtttgacgccacggcagaagtgtccaaggatggccaatccgccagcggcgacagtatcatgggtcttttgatgttggcagcctcgcgcggaaccactattgacgtgcaaacccgtggcgcggatgccgaggcgctcgccgatgccattgaaaagcttgtcgctgagcgctttggcgaagacatgtaa

SEQ ID NO: 3310 - protein, 94 aa, Roseovarius nubinhibens ISM
MTDQQSVTRSLEIVNEKGLHARASARLVEVVEGFDATAEVSKDGQSASGDSIMGLLMLAASRGTTIDVQTRGADAEALADAIEKLVAERFGEDM

SEQ ID NO: 3311 - DNA, 279 bp, Oceanicola batsensis HTCC2597
  CDS (1)..(279): transl_table=11
atgtcccaatccgtgacccgcacgttcaagatcgtgaatgaaaagggcctgcacgcgcgggcctcggccaagctggtcgaggtggtcgaggaacacgacgcccaggccgaggtcagccgcgacggcatgagcgccagcggcgacagtatcatggggcttttgatgttggcagcgtcgaagggaagcactattgaggtccaaacctcgggaccggaagccgaggcgcttgccgatgctctggaagcgctcgtggcaagccggttcggcgaagacatgtaa

SEQ ID NO: 3312 - protein, 92 aa, Oceanicola batsensis HTCC2597
MSQSVTRTFKIVNEKGLHARASAKLVEVVEEHDAQAEVSRDGMSASGDSIMGLLMLAASKGSTIEVQTSGPEAEALADALEALVASRFGEDM

SEQ ID NO: 3313 - DNA, 279 bp, Erythrobacter sp. NAP1
  CDS (1)..(279): transl_table=11
atgagcgaagttcgcaagaccgtcactatcgtcaacaaacgcggcctgcatgcgcgggcgagtgcgaagttcgtgggggccgtctctgccctccccgatccgggccaggtgcgcgttgccaaaggcggcaacgaagccgccggtgggtcgatcctgggcctgatgatgctcggcgctgcaaagggtgacgaggtcgaagtgatcgttgctggcgacggttcggaagatgtcctcgcgcagctcgtcgcgctggtcgaagacggcttcggcgaagactga

SEQ ID NO: 3314 - protein, 92 aa, Erythrobacter sp. NAP1
MSEVRKTVTIVNKRGLHARASAKFVGAVSALPDPGQVRVAKGGNEAAGGSILGLMMLGAAKGDEVEVIVAGDGSEDVLAQLVALVEDGFGED

SEQ ID NO: 3315 - DNA, 291 bp, Synechococcus sp. WH 5701
  CDS (1)..(291): transl_table=11
atgagtgatcaacggatcggccgggcggtgctggtgaacgcggtggggttgcatgcccggccggccgtgcgcctcacccagctggccaagcgcttcgcggcgcgggtggaggtagcgctggcgcccgaagggccctgggccgatgccaaaagcccggtgcaggtgctgcgggtgcgggcgccccagggggccgtgctgcacgtgcgcagcgagggggtcgatgcggaggaggccctggcggcggtgctggcgctggtctcggccggcttcgatgaaggcgcggcgccatga

SEQ ID NO: 3316 - protein, 96 aa, Synechococcus sp. WH 5701
MSDQRIGRAVLVNAVGLHARPAVRLTQLAKRFAARVEVALAPEGPWADAKSPVQVLRVRAPQGAVLHVRSEGVDAEEALAAVLALVSAGFDEGAAP

SEQ ID NO: 3317 - DNA, 273 bp, Pseudoalteromonas tunicata D2
  CDS (1)..(273): transl_table=11
atgcgctgtcaaaatacttttttaattcaaaataaactcggcttacatgcacgcgcagctacagtgttagcgcaactagcagcgagctttgatgccagcattacattagaacaagatcaaaaatcagcagaagccgacagcgtgcttggcttactattattagaaagcagccaaggtaaagaagttaaggtcacctgtgaaggccctgatgctgaacaagcactggtggcaattggcaatctgattgctgataaatttaacgaacaagactaa

SEQ ID NO: 3318 - protein, 90 aa, Pseudoalteromonas tunicata D2
MRCQNTFLIQNKLGLHARAATVLAQLAASFDASITLEQDQKSAEADSVLGLLLLESSQGKEVKVTCEGPDAEQALVAIGNLIADKFNEQD

SEQ ID NO: 3319 - DNA, 288 bp, Photobacterium sp. SKA34
  CDS (1)..(288): transl_table=11
atgtatcagaagcaagttgaaatcacagcaccaaatggtttacacactcgtccagcggctcagttcgttaaagaagctaaatcattcgatgcagatgtgacagtaactgctaatggcaaaagcgctagtgcgaaaagcctattcaagcttcaaactcttggtctaattaaaggcgcacaaatcactattgctggtgaaggtgctcaagctcaagaagctgttgatgctctaattcagctaaaagaagatcacgacggttctccaattgcaatgttccgcgaaatctaa

SEQ ID NO: 3320 - protein, 95 aa, Photobacterium sp. SKA34
MYQKQVEITAPNGLHTRPAAQFVKEAKSFDADVTVTANGKSASAKSLFKLQTLGLIKGAQITIAGEGAQAQEAVDALIQLKEDHDGSPIAMFREI

SEQ ID NO: 3321 - DNA, 273 bp, Photobacterium sp. SKA34
  CDS (1)..(273): transl_table=11
atgacagtccaacgcgaattatttattaaaaaccgactcggcttacacgcacgcgcggcaattaaactggttgagcttgcacaaagctttaccgcagtgatcaccttgagtaatactgatgtatcagctactgcggatagtgtcatggggcttttaatgcttgattccgcacaaggacaaaaaatcatggtaagtgctgaaggttcagacgaagtatcagcacttaacgctatctccgctttaattgaagccggctttgatgaagaaaattaa

SEQ ID NO: 3322 - protein, 90 aa, Photobacterium sp. SKA34
MTVQRELFIKNRLGLHARAAIKLVELAQSFTAVITLSNTDVSATADSVMGLLMLDSAQGQKIMVSAEGSDEVSALNAISALIEAGFDEEN

SEQ ID NO: 3323 - DNA, 270 bp, Oceanospirillum sp. MED92
  CDS (1)..(270): transl_table=11
atgcagcaaaaagagcttttgataattaataaacttggtttgcatgcccgtgccgctgcaaagcttataggcgtaacttcacgcttctcttccgatatcatccttgaaaaggaaggcagagaagttgatggtaaaagcatcatgtcagtcatgatgttagctgcagctaagggaacaaccctaacgatcaaaaccagtggctcagatgaagaagacgcaatagtggccattgaaacgctgatcaataaccgattcgacgaagacgaatag

SEQ ID NO: 3324 - protein, 89 aa, Oceanospirillum sp. MED92
MQQKELLIINKLGLHARAAAKLIGVTSRFSSDIILEKEGREVDGKSIMSVMMLAAAKGTTLTIKTSGSDEEDAIVAIETLINNRFDEDE

SEQ ID NO: 3325 - DNA, 270 bp, Rickettsiella grylli
  CDS (1)..(270): transl_table=11
atgagatataaaattattacgataaataacaagctgggattacatgcacgcgcttcgatgaagtgggttaaaatcgctagatgttttattagtcaaattacgctgagatgtaatggaaaacaagtagacggaaagagtattttagaagttatggggcttacagcccgacaagggagtcctgttgaagttattgttcaaggagaagatgaagcagccgctttaaccgtattagaaaaattggttactgacaggtttggtgaagaaggatga

SEQ ID NO: 3326 - protein, 89 aa, Rickettsiella grylli
MRYKIITINNKLGLHARASMKWVKIARCFISQITLRCNGKQVDGKSILEVMGLTARQGSPVEVIVQGEDEAAALTVLEKLVTDRFGEEG

SEQ ID NO: 3327 - DNA, 282 bp, Oceanobacter sp. RED65
  CDS (1)..(282): transl_table=11
gtgcagcagcccatgctagagcaatccattacgattattaacaagctcggtctccacgcccgagccgcggcgaaacttgtttccaccagtagcacttatacgagcaagattaagatcagctataatggaaaagaggtggatgcaaaaagcatcatgtcagtcatgatgctagccgcgagtaaaggcagtgaagttacgttgcatgtttctggagacgacgaaaaagccgcaatgcaggccataacggatcttatcaacaaccgttttgacgaggatgaatag

SEQ ID NO: 3328 - protein, 93 aa, Oceanobacter sp. RED65
MQQPMLEQSITIINKLGLHARAAAKLVSTSSTYTSKIKISYNGKEVDAKSIMSVMMLAASKGSEVTLHVSGDDEKAAMQAITDLINNRFDEDE

SEQ ID NO: 3329 - DNA, 273 bp, Alteromonadales bacterium TW-7
  CDS (1)..(273): transl_table=11
atgcgtatagaagacacttttttaatacaaaataaattaggactgcatgccagagccgcgactgtattagcccaactcgctgtaaaatttgatgcttcaatcaccttatttcaagatgataaagaagctgctggtgacagtgtattagcactaatgctacttgaaagtagccaaggtaaagaagttaaagtggtatgtgaagggcctgatgcagagcaagctttaaatgcaattggagaacttatttcgcaacgatttaacgaacaagagtaa

SEQ ID NO: 3330 - protein, 90 aa, Alteromonadales bacterium TW-7
MRIEDTFLIQNKLGLHARAATVLAQLAVKFDASITLFQDDKEAAGDSVLALMLLESSQGKEVKVVCEGPDAEQALNAIGELISQRFNEQE

SEQ ID NO: 3331 - DNA, 270 bp, marine gamma proteobacterium HTCC2143
  CDS (1)..(270): transl_table=11
atgattaagaccagaataactatcattaataagcttggcctgcacgcaagagctgcgtcaaaattcgtcaccactgccgcctcctttggttgtagtattaaagccgggaaagacggaaacatggtcgatggcaagagtattatgtcggtgatgatgttagcagccagcagaggtacagacctagacctggaatttgacggcaatgatgaacaacaggcgatggatgcagtcaccagcctaatcaacaatcgatttgatgaaggggaatag

SEQ ID NO: 3332 - protein, 89 aa, marine gamma proteobacterium HTCC2143
MIKTRITIINKLGLHARAASKFVTTAASFGCSIKAGKDGNMVDGKSIMSVMMLAASRGTDLDLEFDGNDEQQAMDAVTSLINNRFDEGE

SEQ ID NO: 3333 - DNA, 270 bp, marine gamma proteobacterium HTCC2080
  CDS (1)..(270): transl_table=11
atgattgaggaaccggttaccattataaatcgtctgggactgcacgcccgagccgcggcaaagcttatcgattgtgcagcaggcttcagcagtcagattacattgagaaaaaacgaccaaacggttgacgctaaaagtataatgtcagtcatgatgttggcagcaggtcagggtacaacattgcaccttacgatcgaggggcacgatgaaatggctgcccgagaggccatcttagctttgatcaataatcgctttggtgaatccgaataa

SEQ ID NO: 3334 - protein, 89 aa, marine gamma proteobacterium HTCC2080
MIEEPVTIINRLGLHARAAAKLIDCAAGFSSQITLRKNDQTVDAKSIMSVMMLAAGQGTTLHLTIEGHDEMAAREAILALINNRFGESE

SEQ ID NO: 3335 - DNA, 282 bp, Candidatus Desulfococcus oleovorans Hxd3
  CDS (1)..(282): transl_table=11
atggacaattctactcacacacttgaaaaaaccgtatccattgtcaatgaactcgggcttcacgccagggctgcggccaaactggcggcagtggcgggccgggcaagcggcggtgcgtggctgataagcaataggcaggcggtggacgccaccagtgtgattgatattctgaccctggcctgttccaggggtatgaccgtgacactgaaagtggattccgcggcggacagtcatatacttgaagagatggcggttctggtgaacaacgggtttggagaatag

SEQ ID NO: 3336 - protein, 93 aa, Candidatus Desulfococcus oleovorans Hxd3
MDNSTHTLEKTVSIVNELGLHARAAAKLAAVAGRASGGAWLISNRQAVDATSVIDILTLACSRGMTVTLKVDSAADSHILEEMAVLVNNGFGE

SEQ ID NO: 3337 - DNA, 270 bp, Marinobacter sp. ELB17
  CDS (1)..(270): transl_table=11
atgatccgccgccagctgtttatcatcaacaaactgggtctgcacgcccgcgcaacggccaaactggtggccacagcgtctgctcaccaaagcaagatcagaatcgccggaaaaggccgtgaagtggatgccaaaaacatcatgcaggtgatgatgctggccgccagccagggcacggaagttgaactgattgccgacggtgacgacgagcaacaggccatcatcgcgttgacagaactgatcaacgattactttggcgagggcgaatag

SEQ ID NO: 3338 - protein, 89 aa, Marinobacter sp. ELB17
MIRRQLFIINKLGLHARATAKLVATASAHQSKIRIAGKGREVDAKNIMQVMMLAASQGTEVELIADGDDEQQAIIALTELINDYFGEGE

SEQ ID NO: 3339 - DNA, 267 bp, Bacillus sp. SG-1
  CDS (1)..(267): transl_table=11
atggcacaaaaacaattcacagtaacagctgatacaggaatccacgcacgtcctgcaacacttcttgttcaaacagcaagcaaatttgattctgaagttcacttgcaatataaagagaagaaagtaaacttaaaatcaatcatgggtgttatgtctttaggtgtaggtaaaggtgcagatatcacaatcatcactgagggaagcgatgaagaagaagcattaaacagccttgaagaaacattgaaaaaagaaggactggcagagtaa

SEQ ID NO: 3340 - protein, 88 aa, Bacillus sp. SG-1
MAQKQFTVTADTGIHARPATLLVQTASKFDSEVHLQYKEKKVNLKSIMGVMSLGVGKGADITIITEGSDEEEALNSLEETLKKEGLAE

SEQ ID NO: 3341 - DNA, 258 bp, Bacillus sp. SG-1
  CDS (1)..(258): transl_table=11
atgattgaacaaaaagtagaggtaaaattaaaaactggcttgcaagcccgcccggcggcattattcgtacaggaagccaaccgattctcatcagaagtatttctggaaagaaacggcaaaaaagtaaacgctaaaagcatcatgggcttaatgagccttgccgtaagttcaggaacagaaatcacactgattgcagacggcactgatgaagaacaagcggtgaaacacctcactgaattcgtgcaaaaagaaagctga

SEQ ID NO: 3342 - protein, 85 aa, Bacillus sp. SG-1
MIEQKVEVKLKTGLQARPAALFVQEANRFSSEVFLERNGKKVNAKSIMGLMSLAVSSGTEITLIADGTDEEQAVKHLTEFVQKES

SEQ ID NO: 3343 - DNA, 279 bp, Erythrobacter sp. SD-21
  CDS (1)..(279): transl_table=11
ttgagcgaggcccgcaaacaggtgctggtggtcaaccagcgtggtctccacgcgcgggcgagcgccaggttcgtcggggcggtggccgaagtgcccgaaggatgcaaggtgcgcgtcgccaaaggtgagaacgaggcggcgggcggctccatcctcggcctgatgatgctgggggcggccaagggcgatacgatcgagatcatcgtcgaaggtgccggagcggaagccgtactcgcagacctctccgccatggtcgaggacggtttcggggagccatag

SEQ ID NO: 3344 - protein, 92 aa, Erythrobacter sp. SD-21
MSEARKQVLVVNQRGLHARASARFVGAVAEVPEGCKVRVAKGENEAAGGSILGLMMLGAAKGDTIEIIVEGAGAEAVLADLSAMVEDGFGEP

SEQ ID NO: 3345 - DNA, 300 bp, Opitutaceae bacterium TAV2
  CDS (1)..(300): transl_table=11
atggataaagcagacaccgccacggctggccagcaactgactcgagagcttgttgttcaaaacaagatgggcatccatgcccgccccgctgcgatgatcgtgcgcatcacgaacaaatttaaggcggacgtgctggtcgaaaaagacgaggagcaggtcaacggcaagtccatcatgggcttgatgatgctggctgcgggcaagggctcgaaagtaaagttcctcgccaccggcggcgacgccacgcaaatgctcgacgaactcgaacagctcttcacgcgcaagttcgacgaagcctga

SEQ ID NO: 3346 - protein, 99 aa, Opitutaceae bacterium TAV2
MDKADTATAGQQLTRELVVQNKMGIHARPAAMIVRITNKFKADVLVEKDEEQVNGKSIMGLMMLAAGKGSKVKFLATGGDATQMLDELEQLFTRKFDEA

SEQ ID NO: 3347 - DNA, 303 bp, Magnetospirillum gryphiswaldense
  CDS (1)..(303): transl_table=11
atgaacgccgattcagcccccgtcctggacaatcccatttcccgtcaggcgaccatctgcaaccggcgcggcctgcacgcccgcgccgccgccaagttcgtcaagctggccgccaccttcgacgcccaggtcaatgtcgcccatcgcggcaccgaggtgtcgggcatgtcgatcatgggcctgatgatgctggccgccgccccgggctgctgtatcgatctcgccgcttccggtcctcaggccgaagcggcgctggatgccctgtgcgccctgatcgcgcaaaaattcgacgaagaagactga

SEQ ID NO: 3348 - protein, 100 aa, Magnetospirillum gryphiswaldense
MNADSAPVLDNPISRQATICNRRGLHARAAAKFVKLAATFDAQVNVAHRGTEVSGMSIMGLMMLAAAPGCCIDLAASGPQAEAALDALCALIAQKFDEED

SEQ ID NO: 3349 - DNA, 288 bp, Desulfococcus multivorans
  CDS (1)..(288): transl_table=11
atgaacattagcaagatgcaggatccactgtcgcgggaggtcatcatcgtcaatgagctgggcctccatgccagatccgccgcgaaaattgcggcgatcgccagccatgccgaatcacaggtgaccatttcgaagggggatgagatcgtagatgccaaaagcatcatcgacatgctgaccctggcgtgcggaaaaggcatgcgaatcaccattaacgtcgattcggatgcggatgtcgagattctgagcaaaattgcggaactcgttgaaaacggtttcggagaatag

SEQ ID NO: 3350 - protein, 95 aa, Desulfococcus multivorans
MNISKMQDPLSREVIIVNELGLHARSAAKIAAIASHAESQVTISKGDEIVDAKSIIDMLTLACGKGMRITINVDSDADVEILSKIAELVENGFGE

SEQ ID NO: 3351 - DNA, 267 bp, Tetragenococcus halophilus
  CDS (1)..(267): transl_table=11
atggaaaagaaagattttaatgtaactgctgagacaggaattcacgcacgtccagcaactttattagtacaaactgcaagcaaattcaactctgatattaatttagagtataaaggtaaatcagtaaacttgaaatctattatgggcgttatgtccttaggcgtaggccaaggttctgatgttacgatttcagtagatggtgctgatgaatcagatgcaatggcagcaattgtagaaacaatgaaaaaggaaggattgtctgaataa

SEQ ID NO: 3352 - protein, 88 aa, Tetragenococcus halophilus
MEKKDFNVTAETGIHARPATLLVQTASKFNSDINLEYKGKSVNLKSIMGVMSLGVGQGSDVTISVDGADESDAMAAIVETMKKEGLSE

SEQ ID NO: 3353 - DNA, 348 bp, Rhizobium sp
  CDS (1)..(348): transl_table=11
gtgatggataacaggtcgcgacgggaagcgccggaagcagtcgatacgcacggttactacaaggcggagatcgaggtgactcacggcttcgggctgcatgctcgtccgtcggtcatcttcacgcggctcgcaaagtcgtttccctgcagcgttgagatcgaggtcaacgacagccacgtctggctgaacggtaagagcatcgtcaagatcatgggggcaaagattcgcaggggctcgatgcttaaaatccgcgcccgaggtttacgggccgccgaagcgatccatgccctcaaggcgcttgtcgagcgcgacttcgatgaagcaaagaagcatggccgaagcgcttga

SEQ ID NO: 3354 - protein, 115 aa, Rhizobium sp
MMDNRSRREAPEAVDTHGYYKAEIEVTHGFGLHARPSVIFTRLAKSFPCSVEIEVNDSHVWLNGKSIVKIMGAKIRRGSMLKIRARGLRAAEAIHALKALVERDFDEAKKHGRSA

SEQ ID NO: 3355 - DNA, 255 bp, Bacillus halodurans
  CDS (1)..(255): transl_table=11
ttggttgaaaaacaagtagaagtgaagctgaaaacaggattacaagctcgccctgctgctctctttgttcaggaagcgaatcgcttcacctcagaaatcttcattgagaaggatggaaagaaagtaaatgccaaaagcatcatgggtctcatgagcttggccattggctccggatcaacgatcacattgatcacagaaggaaatgatgaacaggaagcgatggaggctcttatcgcattcatcgaaaaggaataa

SEQ ID NO: 3356 - protein, 84 aa, Bacillus halodurans
MVEKQVEVKLKTGLQARPAALFVQEANRFTSEIFIEKDGKKVNAKSIMGLMSLAIGSGSTITLITEGNDEQEAMEALIAFIEKE

SEQ ID NO: 3357 - DNA, 258 bp, Bacillus subtilis
  CDS (1)..(258): transl_table=11
atggttcaacagaaagtggaagttcgattaaagacaggactgcaagcacgtcctgctgctttgtttgtacaagaagcaaaccggtttacgtcagatgtgtttcttgagaaggatgggaaaaaagtaaacgccaaaagcatcatggggctgatgagccttgcggtaagcacaggcactgaggttaccttgattgcccagggagaagatgaacaagaggcgctggagaagctggctgcttacgttcaagaagaagtttag

SEQ ID NO: 3358 - protein, 85 aa, Bacillus subtilis
MVQQKVEVRLKTGLQARPAALFVQEANRFTSDVFLEKDGKKVNAKSIMGLMSLAVSTGTEVTLIAQGEDEQEALEKLAAYVQEEV

SEQ ID NO: 3359 - DNA, 264 bp, Bacillus halodurans
  CDS (1)..(264): transl_table=11
atggcagaaaaaacgtttaccattacagcggaaactgggattcacgcacgtcctgcaacacagcttgtgaacaaagcggggcagtattcttcagagatcactcttgaatacaaagggaaagctgttaacttgaaatccatcatgggcgttatgtcacttggtgttggcaaaggtgcacaagtgacgatcaaagcagaaggttctgatgaagctgaagcgcttaaaggcattgaagaagtgattaaggaaggattaggagaataa

SEQ ID NO: 3360 - protein, 87 aa, Bacillus halodurans
MAEKTFTITAETGIHARPATQLVNKAGQYSSEITLEYKGKAVNLKSIMGVMSLGVGKGAQVTIKAEGSDEAEALKGIEEVIKEGLGE

SEQ ID NO: 3361 - DNA, 267 bp, Bacillus megaterium
  CDS (1)..(267): transl_table=11
atggcacaaaaaacatttacagtaacagcagactcaggaattcacgcacgtccagcaacaactttagtacaagcagcaagcaaatttgattctgatatcaacttagaattcaacggtaaaactgtaaacttaaaatcaatcatgggcgttatgtctttaggtattcaaaaaggcgctacaatcactatctctgcagaaggttctgacgaagcagatgcacttgctgctcttgaagatacaatgagcaaagaaggattaggcgaataa

SEQ ID NO: 3362 - protein, 88 aa, Bacillus megaterium
MAQKTFTVTADSGIHARPATTLVQAASKFDSDINLEFNGKTVNLKSIMGVMSLGIQKGATITISAEGSDEADALAALEDTMSKEGLGE

SEQ ID NO: 3363 - DNA, 267 bp, Bacillus stearothermophilus
  CDS (1)..(267): transl_table=11
atggcagaaaaaacgtttaaagtcgtttctgattccggcatccacgctcgtccggcgacgattttggtgcaaacggcgagcaaattcaacagcgaaatccagcttgagtacaacggcaaaacggtgaacttgaaatcgatcatgggcgttatgtcgttaggaattccgaaaggggcgacgatcaaaatcacggcagaaggggccgatgcggcagaagcaatggcggcgttaacggatacgttggcgaaagagggtcttgcagaataa

SEQ ID NO: 3364 - protein, 88 aa, Bacillus stearothermophilus
MAEKTFKVVSDSGIHARPATILVQTASKFNSEIQLEYNGKTVNLKSIMGVMSLGIPKGATIKITAEGADAAEAMAALTDTLAKEGLAE

SEQ ID NO: 3365 - DNA, 267 bp, Bacillus subtilis
  CDS (1)..(267): transl_table=11
atggcacaaaaaacatttaaagtaactgcagattctggaatccatgctcgtcctgcgacagttcttgtacaaactgctagcaaatacgacgctgacgttaatttagaatataacggcaaaacagttaaccttaaatctattatgggtgttatgtctttaggtatcgctaaaggcgctgagatcacaatctctgcttccggagctgacgaaaacgatgctcttaacgctttagaagaaacaatgaaaagcgaaggactcggcgagtaa

SEQ ID NO: 3366 - protein, 88 aa, Bacillus subtilis
MAQKTFKVTADSGIHARPATVLVQTASKYDADVNLEYNGKTVNLKSIMGVMSLGIAKGAEITISASGADENDALNALEETMKSEGLGE

SEQ ID NO: 3367 - DNA, 315 bp, Chlamydia muridarum
  CDS (1)..(315): transl_table=11
atgagcggtggggatgatttagttcttcataatcctgtagaggatggagaactctctgctattttcatgatacgaaacccttcaggaatacatgtacgtccggcaggaactattgttaaattatttgatggcgaagattgtgaagcaactttcacttatttaggaaaaacagtgaatgctaggagtgtcatgagtattcttatgttaggagcttcttataatggagagatcactgtgcgaataaaaggcccttcggcttctcgtgtaatgcaaaaactagcagaggtttttaattctggattcggagagttataa

SEQ ID NO: 3368 - protein, 104 aa, Chlamydia muridarum
MSGGDDLVLHNPVEDGELSAIFMIRNPSGIHVRPAGTIVKLFDGEDCEATFTYLGKTVNARSVMSILMLGASYNGEITVRIKGPSASRVMQKLAEVFNSGFGEL

SEQ ID NO: 3369 - DNA, 330 bp, Chlamydia trachomatis
  CDS (1)..(330): transl_table=11
atgagtggggggaatgattcagttcttcataggcctgtagaagctcctcttatggaagatggggaactctcagcagtttttacgatacggaattcttctgggatacacgtgcgtccggctggtactattgttaaactcttcgaaggcgaagaatgcgaagcgactctgacctatttagggaaaaccgtgaacgctaggagcgtcatgagtattcttatgttaggagcttcttataatggcgaggttgctgttcatataaaaggcccctctgcttctcgagtaatgcagaaactctccgaggtttttaattctggattcggagagttgtaa

SEQ ID NO: 3370 - protein, 109 aa, Chlamydia trachomatis
MSGGNDSVLHRPVEAPLMEDGELSAVFTIRNSSGIHVRPAGTIVKLFEGEECEATLTYLGKTVNARSVMSILMLGASYNGEVAVHIKGPSASRVMQKLSEVFNSGFGEL

SEQ ID NO: 3371 - DNA, 258 bp, Escherichia coli O157
  CDS (1)..(258): transl_table=11
atgttccagcaagaagttaccattaccgctccgaacggtctgcacacccgccctgctgcccagtttgtaaaagaagctaagggcttcacttctgaaattactgtgacttccaacggcaaaagcgccagcgcgaaaagcctgtttaaactgcagactctgggcctgactcaaggtacagttgtgactatctccgcagaaggcgaagacgagcagaaagcggttgaacatctggttaaactgatggcggaactcgagtaa

SEQ ID NO: 3372 - protein, 85 aa, Escherichia coli O157
MFQQEVTITAPNGLHTRPAAQFVKEAKGFTSEITVTSNGKSASAKSLFKLQTLGLTQGTVVTISAEGEDEQKAVEHLVKLMAELE

SEQ ID NO: 3373 - DNA, 258 bp, Klebsiella pneumoniae
  CDS (1)..(258): transl_table=11
atgttccagcaagaagttaccattaccgctccgaacggtctgcacacccgccctgctgctcagtttgttaaagaagctaaaggcttcacttctgagatcactgtaacctccaacggcaaaagcgccagcgccaaaagcctgttcaaactgcagactctgggcctgacccagggcaccgtagtgaccctctccgctgaaggcgaagatgagcagaaagctgttgagcatctggttaaactgatggctgaactcgagtaa

SEQ ID NO: 3374 - protein, 85 aa, Klebsiella pneumoniae
MFQQEVTITAPNGLHTRPAAQFVKEAKGFTSEITVTSNGKSASAKSLFKLQTLGLTQGTVVTLSAEGEDEQKAVEHLVKLMAELE

SEQ ID NO: 3375 - DNA, 267 bp, Mycoplasma pneumoniae
  CDS (1)..(267): transl_table=4
atgaagaagattcaagtagtcgttaaagaccctgtgggcattcacgcccgtcctgctagtattattgctggtgaggctaataaatttaaatcggaattaaagctagtatcaccaagcggcgttgaaggtaacatcaagtcgatcatcaacttaatgtctttaggcattaagcaaaacgaccacattaccatcaaggcagaaggaactgatgaagaagaggcactaaatgctattaaagcagttttagaaaaacaccaagttatttaa

SEQ ID NO: 3376 - protein, 88 aa, Mycoplasma pneumoniae
MKKIQVVVKDPVGIHARPASIIAGEANKFKSELKLVSPSGVEGNIKSIINLMSLGIKQNDHITIKAEGTDEEEALNAIKAVLEKHQVI

SEQ ID NO: 3377 - DNA, 270 bp, Neisseria meningitidis serogroup A
  CDS (1)..(270): transl_table=11
atgctcaaacaatccatcgaaatcatcaacaaactcggactccacgcccgcgcgtccaacaagttcacccaaaccgcgtcccaattcaaaagcgaagtctgggttacgaaaaacgacagccgcgtcaacggcaaaagcattatggggctgatgatgctcgccgccgccaagggtacggtcatcgaactggagacggacggcgcggacgaggcggaagcgatgcgcgccctgaccgacttaatcaacggctacttcggcgagggcgaataa

SEQ ID NO: 3378 - protein, 89 aa, Neisseria meningitidis serogroup A
MLKQSIEIINKLGLHARASNKFTQTASQFKSEVWVTKNDSRVNGKSIMGLMMLAAAKGTVIELETDGADEAEAMRALTDLINGYFGEGE

SEQ ID NO: 3379 - DNA, 273 bp, Pseudomonas aeruginosa
  CDS (1)..(273): transl_table=11
atgcccgccctcgagatcaccatcatcaacaagctcggtctgcacgcccgcgcggcggccaagttcgtcggcgtcgcggggcgctacccttgccaggtccgggtcggccgcaatcctgaaagctgcgtcgacggcaagagcatcatggccgtgatgatgctggctgccggcaagggcaccaacctgcacctgcataccgaaggcgaacaggaagacgaggcgttgaacgcgctggtcgaactgatcaacaaccgtttcgacgaaggcgagtag

SEQ ID NO: 3380 - protein, 90 aa, Pseudomonas aeruginosa
MPALEITIINKLGLHARAAAKFVGVAGRYPCQVRVGRNPESCVDGKSIMAVMMLAAGKGTNLHLHTEGEQEDEALNALVELINNRFDEGE

SEQ ID NO: 3381 - DNA, 267 bp, Staphylococcus carnosus
  CDS (1)..(267): transl_table=11
atggaacaacaatcatacactatcatcgacgaaacaggtattcatgctcgtccagcaacaatgcttgtacaaacagcttcaaaatttgattcagatattcaattagaatataacggcaaaaaggtcaacttaaaatctattatgggtgttatgagtttaggtgttggtaaagatgcagaaattactatctatgctgacggaagcgatgaagcagacgctattcaagcaatcactgatgttttatctaaagaaggattaactgaataa

SEQ ID NO: 3382 - protein, 88 aa, Staphylococcus carnosus
MEQQSYTIIDETGIHARPATMLVQTASKFDSDIQLEYNGKKVNLKSIMGVMSLGVGKDAEITIYADGSDEADAIQAITDVLSKEGLTE

SEQ ID NO: 3383 - DNA, 267 bp, Treponema pallidum
  CDS (1)..(267): transl_table=11
atggtcgtaaaaacggtgcgcgtgcttaatcgtgcgggcgtacatgcgcgtcctgcggcgcttattgtgcaagcggcaagtcgctttgattcgaagataatgcttgtgcgggatacgatcagagtgaatgcaaagtctattatgggtgttatggctatggctgcagggtgtggaagtgagctcgagttggttgtagaaggtccagacgaagttgctgcattgtccgccattgagcggctatttcagaataaattcgaggaagagtaa

SEQ ID NO: 3384 - protein, 88 aa, Treponema pallidum
MVVKTVRVLNRAGVHARPAALIVQAASRFDSKIMLVRDTIRVNAKSIMGVMAMAAGCGSELELVVEGPDEVAALSAIERLFQNKFEEE

SEQ ID NO: 3385 - DNA, 258 bp, Vibrio cholerae
  CDS (1)..(258): transl_table=11
atgtacgagaagcaagtagaaatcactgcagaaaacggccttcacactcgtcctgctgcacagtttgttaaagaagcaaaagccttcgatgcagacatcactgtgacttctaacggtaaaagtgcaagcgcgaaaagtctgttcaagctgcaaacgctaggtctggtaaaaggtactgtcgtgactatctctgccgaaggccctcaagcaaaagaagctgttgagcacctagttgctctgatggaccaacttcactaa

SEQ ID NO: 3386 - protein, 85 aa, Vibrio cholerae
MYEKQVEITAENGLHTRPAAQFVKEAKAFDADITVTSNGKSASAKSLFKLQTLGLVKGTVVTISAEGPQAKEAVEHLVALMDQLH

SEQ ID NO: 3387 - DNA, 288 bp, Xylella fastidiosa; identical to SEQ ID NO: 3117
  CDS (19)..(288): transl_table=11

SEQ ID NO: 3388 - protein, 89 aa, Xylella fastidiosa
MLEHELIVTNKLGLHARATAKLVQTMSKFQSNTTLSTKGREVNAKSIMGVMLLAASQGTVIRVRIDGEDEHTAMQALSELFENRFNEDT

SEQ ID NO: 3389 - DNA, 270 bp, Xylella fastidiosa
  CDS (1)..(270): transl_table=11
atgcttgaacacgaactaacagtaactaacaaactaggactccacgcgcgagccactgccaaactggtacaaacaatgtcgaagttccaaagcaacacgacattgtcgacaaaaggccgcgaagtcaacgccaaaagcatcatgggagtcatgctgctcgccgccagccaaggcaccgtgatccgggtacggatcgacggtgaagacgaacatacggcaatgcaagcactgagtgaactgttcgaaaaccgcttcaacgaggacacataa

SEQ ID NO: 3390 - protein, 89 aa, Xylella fastidiosa
MLEHELTVTNKLGLHARATAKLVQTMSKFQSNTTLSTKGREVNAKSIMGVMLLAASQGTVIRVRIDGEDEHTAMQALSELFENRFNEDT

SEQ ID NO: 3391 - DNA, 273 bp, Klebsiella oxytoca
  CDS (1)..(273): transl_table=11
atgaccgttaagcaaaccgttgaaatctccaataagctggggatgcacgctcgcccggcgatgaagctgtttgaattaatgcagaactacgatgctgaagtgctactgcgcaatgatgaaggaactgtagctgaagcgaatagcgtgattgccctgctgatgcttgactcagctaaagggcggcagattgagattgaagccaacggcccgcaagaagtggaggcgctggcagcggttatcgcgctgttcaacgccgggtttgatgaggattag

SEQ ID NO: 3392 - protein, 90 aa, Klebsiella oxytoca
MTVKQTVEISNKLGMHARPAMKLFELMQNYDAEVLLRNDEGTVAEANSVIALLMLDSAKGRQIEIEANGPQEVEALAAVIALFNAGFDED

SEQ ID NO: 3393 - DNA, 273 bp, Proteus mirabilis
  CDS (1)..(273): transl_table=11
atgacccaatatcgacgcgtagcgataaaaaaccgtttaggcatgcatgcaaggcctgccatgaaattgtttgatttggtccatacatttcaatcaacggtgacgttacgtaaccatgaaggcgttgaagcgcaagcagatagtgtgattgcgatgttgatgttagattccgaacaaggcagtcacatcgatatgaaagccagtggctgtgatgaaaaagaaacgattgatgcgattattgcattatttgaatcaggttttgatgaagattaa

SEQ ID NO: 3394 - protein, 90 aa, Proteus mirabilis
MTQYRRVAIKNRLGMHARPAMKLFDLVHTFQSTVTLRNHEGVEAQADSVIAMLMLDSEQGSHIDMKASGCDEKETIDAIIALFESGFDED

SEQ ID NO: 3395 - DNA, 276 bp, Shewanella violacea
  CDS (1)..(276): transl_table=11
atgactaaattagaacgtcaggtcaccatatgcaataaactcggcctccatgcccgagctgcgactaaactcgccatcttggcttcggaatttgacgccgagataaccatagtgcagggagagaaaaaagcctcagctgccagcgtattaggcctgttgatgctagagactggcatggggaaaaccatcactctactcggtaagggtcaggatgccgatgccgcactcgatgcaatatgtgccctggtcgatgccaaattcgatgaagcgagttaa

SEQ ID NO: 3396 - protein, 91 aa, Shewanella violacea
MTKLERQVTICNKLGLHARAATKLAILASEFDAEITIVQGEKKASAASVLGLLMLETGMGKTITLLGKGQDADAALDAICALVDAKFDEAS

SEQ ID NO: 3397 - DNA, 279 bp, Vibrio cholerae
  CDS (1)..(279): transl_table=11
atgccgcaactaagccaaaccgtgctgatccaaaaccgccttggcctgcatgcgcgcgcagcggttaaactggtgcaactggctcaatcctttgatgcagtattgactgtacagagtcaagatggccgtgaagcaaccgccgacagtgtgatggggttactgatgctggaatcggcacaagggcaaaacgtggtgatctccgccgaaggctcgcaagccgaacaagctctacaagcggtttgtcagcttatcgaacaaaaatttgatgaagatgagtaa

SEQ ID NO: 3398 - protein, 92 aa, Vibrio cholerae
MPQLSQTVLIQNRLGLHARAAVKLVQLAQSFDAVLTVQSQDGREATADSVMGLLMLESAQGQNVVISAEGSQAEQALQAVCQLIEQKFDEDE

SEQ ID NO: 3399 - DNA, 21 bp, Artificial sequence
  primer
atgaccgtcaagcaaactgtt

SEQ ID NO: 3400 - DNA, 28 bp, Artificial sequence
  primer
ttaatcttcatcaaaaccagaattaaag

SEQ ID NO: 3401 - protein, 85 aa, Artificial sequence
  consensus sequence
  Variant (6)..(33): Xaa in position 6 to 33 is any amino acid
  Variant (34)..(37): Xaa in position 34 to 37 is any or no amino acid
  Variant (39)..(44): Xaa in position 39 to 44 is any amino acid
  Variant (46)..(49): Xaa in position 46 to 49 is any amino acid
  Variant (51)..(58): Xaa in position 51 to 58 is any amino acid
  Variant (60)..(61): Xaa in position 60 to 61 is any amino acid
  Variant (62)..(66): Xaa in position 62 to 66 is any or no amino acid
  Variant (68)..(79): Xaa in position 68 to 79 is any amino acid
  Variant (80)..(84): Xaa in position 80 to 84 is any or no amino acid
GLHARXXXXXXXXXXXXXXXXXXXXXXXXXXXXXXXXSXXXXXXLXXXXGXXXXXXXXGXXXXXXXAXXXXXXXXXXXXXXXXXE

SEQ ID NO: 3402 - protein, 32 aa, Artificial sequence
  protein pattern
  Variant (2)..(2): Xaa in position 2 is Ile, Leu or Val
  Variant (3)..(3): Xaa in position 3 is Phe, Ile, Leu or Met
  Variant (4)..(4): Xaa in position 4 is any amino acid
  Variant (5)..(5): Xaa in position 5 is Ile, Leu, Met or Val
  Variant (6)..(7): Xaa in position 6 to 7 is any amino acid
  Variant (9)..(11): Xaa in position 9 to 11 is any amino acid
  Variant (12)..(12): Xaa in position 12 is any or no amino acid
  Variant (14)..(15): Xaa in position 14 to 15 is any amino acid
  Variant (16)..(16): Xaa in position 16 is Ile, Leu or Val
  Variant (17)..(17): Xaa in position 17 is any amino acid
  Variant (18)..(18): Xaa in position 18 is Ile, Leu or Val
  Variant (19)..(21): Xaa in position 19 to 21 is any amino acid
  Variant (22)..(22): Xaa in position 22 is Gly or Ser
  Variant (23)..(24): Xaa in position 23 to 24 is any amino acid
  Variant (25)..(25): Xaa in position 25 is Ala, Asp, Glu, Gly or Ser
  Variant (26)..(31): Xaa in position 26 to 31 is any amino acid
  Variant (32)..(32): Xaa in position 32 is Ile, Leu, Met or Val
SXXXXXXLXXXXGXXXXXXXXXXXXXXXXXXX

SEQ ID NO: 3403 - DNA, 1185 bp, Escherichia coli
  CDS (1)..(1185): transl_table=11
atgcaaaaaacggctaccactccatcaaaaatacttgatctcactgccgcggcatttttacttgtcgcctttctgacgggtattgcgggcgctcttcagactcctaccctaagtatattcctcgcagatgaactgaaagcccgtcctataatggtaggttttttcttcaccggtagcgctattatgggaattctggtcagtcaatttctggcaaggcactccgataaacaaggcgaccgtaaattactgattctgctatgttgcttatttggagtgctggcctgcacgctttttgcgtggaatcgcaactacttcattctcctctcaacgggcgtacttctgagtagttttgcttccaccgcaaacccgcaaatgttcgccctcgcccgtgaacacgccgacagaacaggccgtgagacggtcatgttcagtacatttttacgtgctcagatctcgcttgcctgggttatcgggccaccgctcgcttatgaactggcaatgggatttagttttaaagtgatgtatctcaccgctgccatcgcatttgttgtttgcggactgatagtctggttgtttttgccatcaatacaaagaaatattcctgtcgttacccaacccgtagaaattttaccctccacccacaggaagcgggatacgcggctactttttgtggtctgttcaatgatgtgggcggcgaataatctctacatgataaatatgccgctatttattattgatgaactgcatctaaccgataaactgactggagaaatgattggtatcgctgccggtctggaaattccgatgatgttaatcgcaggctattacatgaaacgtattggcaagcgactattaatgctcattgctatcgtgagtggaatgtgtttttacgccagcgtactcatggcgacgactccggcggttgagctggaattgcaaattcttaatgccatcttccttggtattctctgtggtatcggcatgctttattttcaggacttgatgcctgaaaaaataggctctgcgacaacgttatatgcaaatacttcacgcgtcggctggattatcgccggctctgttgacggaattatggttgaaatctggagctaccatgcgttgttctggctggcgatagggatgttgggtattgcgatgatttgcctgctgtttattaaagatatttaa

SEQ ID NO: 3404 - protein, 394 aa, Escherichia coli
MQKTATTPSKILDLTAAAFLLVAFLTGIAGALQTPTLSIFLADELKARPIMVGFFFTGSAIMGILVSQFLARHSDKQGDRKLLILLCCLFGVLACTLFAWNRNYFILLSTGVLLSSFASTANPQMFALAREHADRTGRETVMFSTFLRAQISLAWVIGPPLAYELAMGFSFKVMYLTAAIAFVVCGLIVWLFLPSIQRNIPVVTQPVEILPSTHRKRDTRLLFVVCSMMWAANNLYMINMPLFIIDELHLTDKLTGEMIGIAAGLEIPMMLIAGYYMKRIGKRLLMLIAIVSGMCFYASVLMATTPAVELELQILNAIFLGILCGIGMLYFQDLMPEKIGSATTLYANTSRVGWIIAGSVDGIMVEIWSYHALFWLAIGMLGIAMICLLFIKDI

SEQ ID NO: 3405 - DNA, 1182 bp, Escherichia coli
  CDS (1)..(1182): transl_table=11
atgatcaactcccccgcagtctccagcgcgaaatcgtttgacctgacctcgacggcgtttttaatcgttgcctttctcaccggtattgcgggcgctctgcaaaccccgacactcagtatttttcttaccgatgaagtacatgcccgtccggcgatggtgggattcttctttaccggcagcgctgtcattggggttctggtgagtcagtttctcgccgggcgctctgataagcgcggcgatcgcaaatcgctgattgtcttttgctgcctgttaggcgtgctggcctgcaccctttttgcctggaatcgcaactactttgttttgctattcgttggcgtctttcttagcagctttggctcgaccgctaacccgcaaatgtttgcccttgcccgtgaacatgccgacaaaaccggacgtgaggcggtgatgttcagctcttttttacgcgctcaggtttcactggcatgggtcattggcccaccgctggcttatgccttagcgatgggtttcagctttacggtaatgtatctgagcgcagcggtagcatttattgtttgcggcgtgatggtgtggctgtttttaccgtcgatgcaaaaagagcttccgctggcgaccggcacggttgaagcgccgcgccgtaaccgtcgcgatacgctgctgctgtttgtcatttgtacattgatgtggggctcgaacagcctgtacatcatcaacatgccgctatttattatcaacgaactccatcttcccgagaaactggccggtgtgatgatggggaccgccgccgggctggaaatcccgaccatgttgattgccggatatttcgccaaacgtctgggtaagcgtttcttaatgcgcgttgctgccgtgggtggcgtctgtttttacgcaggaatgctgatggcgcattctcctgtcattctgttgggcttgcagctgctaaatgctatttttattggcattctgggcggtatcgggatgctctattttcaggatctgatgcccggtcaggcaggttcagccaccacgctctataccaacacgtcgcgcgtgggctggatcatcgcgggatcagtggcgggcatcgtcgccgagatctggaattatcacgctgtgttctggtttgcgatggtgatgattatcgccactctgttttgcttactgcggattaaagatgtttaa

SEQ ID NO: 3406 - protein, 393 aa, Escherichia coli
MINSPAVSSAKSFDLTSTAFLIVAFLTGIAGALQTPTLSIFLTDEVHARPAMVGFFFTGSAVIGVLVSQFLAGRSDKRGDRKSLIVFCCLLGVLACTLFAWNRNYFVLLFVGVFLSSFGSTANPQMFALAREHADKTGREAVMFSSFLRAQVSLAWVIGPPLAYALAMGFSFTVMYLSAAVAFIVCGVMVWLFLPSMQKELPLATGTVEAPRRNRRDTLLLFVICTLMWGSNSLYIINMPLFIINELHLPEKLAGVMMGTAAGLEIPTMLIAGYFAKRLGKRFLMRVAAVGGVCFYAGMLMAHSPVILLGLQLLNAIFIGILGGIGMLYFQDLMPGQAGSATTLYTNTSRVGWIIAGSVAGIVAEIWNYHAVFWFAMVMIIATLFCLLRIKDV

SEQ ID NO: 3407 - DNA, 1182 bp, Escherichia coli O6
  CDS (1)..(1182): transl_table=11
atgcataactcccccgcagtcaccagcgcgaaatcgtttgacctgacctcgacggcgtttttaatcgttgcctttctcaccggtattgcgggcgctctgcaaaccccgacactcagtatttttcttactgatgaagtacatgcccgtccggcgatggtgggattcttctttaccggcagcgctgtcattgggattctggtgagtcagtttctcgccgggcgctctgataagcgcggcgatcgcaaatcgctgattgtcttttgctgcctgttaggcgtgctggcctgcaccctttttgcctggaatcgcaactactttgttttgctattcgttggcgtctttcttagcagctttggctcaaccgctaacccgcaaatgtttgcccttgcccgtgaacatgctgacaaaaccggacgtgaggcggtgatgttcagctcttttttacgcgctcaggtttcactggcatgggtcattggcccaccgctggcttatgccttagcgatgggtttcagctttacggtaatgtatctgagcgcagcggtagcgtttattgtttgcggcgtgatggtgtggctgtttttgccgtcgatgcaaaaagagcttccgctggcgaccggcacggttgaagcgccgcgccgtaaccgtcgcgatacgttgctgctgtttgtcatttgtacattgatgtggggctcgaacagcctgtacatcatcaacatgccgctatttattatcaacgaactgcatcttcccgagaaactggccggtgtgatgatggggaccgccgcagggctggaaatcccgaccatgttgatcgccggatattttgccaaacgtctgggtaagcgcttcttaatgcgcgttgctgccgtgggtggcgtctgtttttacgcaggaatgctgatggcgcattcacctgtcattctgttgggcttgcagctgctaaatgctatttttattggcattctgggcggcatcgggatgctctattttcaggatttgatgcccggtcaggcaggttcagccaccacgctctataccaacacgtcgcgcgtgggctggatcatcgcaggatcagtggcgggcatcgtcgccgagatctggaattatcacgctgtgttctggtttgcgatggtgatgattatcgctactctgttttgcttactgcgaattaaagatgtttaa

SEQ ID NO: 3408 - protein, 393 aa, Escherichia coli O6
MHNSPAVTSAKSFDLTSTAFLIVAFLTGIAGALQTPTLSIFLTDEVHARPAMVGFFFTGSAVIGILVSQFLAGRSDKRGDRKSLIVFCCLLGVLACTLFAWNRNYFVLLFVGVFLSSFGSTANPQMFALAREHADKTGREAVMFSSFLRAQVSLAWVIGPPLAYALAMGFSFTVMYLSAAVAFIVCGVMVWLFLPSMQKELPLATGTVEAPRRNRRDTLLLFVICTLMWGSNSLYIINMPLFIINELHLPEKLAGVMMGTAAGLEIPTMLIAGYFAKRLGKRFLMRVAAVGGVCFYAGMLMAHSPVILLGLQLLNAIFIGILGGIGMLYFQDLMPGQAGSATTLYTNTSRVGWIIAGSVAGIVAEIWNYHAVFWFAMVMIIATLFCLLRIKDV

SEQ ID NO: 3409 - DNA, 1182 bp, Salmomella typhi
  CDS (1)..(1182)
atgcacaacagtcccgccgccgctgcgcccaaatcgtttgacctgacgtctaccgcctttttgatcgtcgcttttctcaccggtattgctggtgcgttacagacgccgacactcagtatttttctgacggatgaggttcacgcccgtcccggcatggtgggtttcttttttaccggcagcgcggttatcggcattatcgtgagccagtttctggcgggtcgctcagataaaaaaggcgatcgcaaaaaactgatcgttttctgttgcgtgctgggcatgttggcctgcgtgttgtttgcctggaaccgcaactactttattttgctgttcatcggcgtctttctcagtagcttcggctctaccgccaacccgcagatgtttgcgctggcccgagaacatgccgatcgtacaggtcgtgaagcggtgatgttcagctcaatcctccgcgcccaggtctcgttggcctgggtcattgggccgccgctggcctatgcgctggcgatgggttttagctttacggtgatgtatttgagcgcggcggtagcttttatcgtctgcggcgtcatggtgtggttctttttaccgtcaatgcgcaaagatgcgccgctggcaaccggcacgctggaagcaccgcgtcgtaatcgccgcgatacgctgttgctgtttgtcatctgtacgttaatgtgggggactaacagcctgtatatcattaatatgccgctgtttatcatcaatgagctgcatcttccggaaaaacttgcaggcgtgatgatgggcaccgccgccgggctggagattcccacaatgctgattgcaggttacttcgccaaacggttgggaaaacgcctgttaatgtgcatcgccgttgtcgccggactgtgcttttatgcggggatgttgctggcgcacgcaccggcaacgttgctcggcttgcagttgctgaacgcgatttacatcggcattcttggcgggattggcatgctctattttcaggatctcatgccaggccaggcgggttcagccaccacgctgtataccaataccattcgcgtcggctggatcattgccggttcgttggcgggaatcgccgcagaaatctggaattatcatgcggtcttctggtttgcgttagttatgattgtcgccaccatgttctgcctggcgcgtattaaagatgtttaa

SEQ ID NO: 3410 - protein, 393 aa, Salmomella typhi
MHNSPAAAAPKSFDLTSTAFLIVAFLTGIAGALQTPTLSIFLTDEVHARPGMVGFFFTGSAVIGIIVSQFLAGRSDKKGDRKKLIVFCCVLGMLACVLFAWNRNYFILLFIGVFLSSFGSTANPQMFALAREHADRTGREAVMFSSILRAQVSLAWVIGPPLAYALAMGFSFTVMYLSAAVAFIVCGVMVWFFLPSMRKDAPLATGTLEAPRRNRRDTLLLFVICTLMWGTNSLYIINMPLFIINELHLPEKLAGVMMGTAAGLEIPTMLIAGYFAKRLGKRLLMCIAVVAGLCFYAGMLLAHAPATLLGLQLLNAIYIGILGGIGMLYFQDLMPGQAGSATTLYTNTIRVGWIIAGSLAGIAAEIWNYHAVFWFALVMIVATMFCLARIKDV

SEQ ID NO: 3411 - DNA, 1179 bp, Shigella flexneri 2a str. 301
  CDS (1)..(1179): transl_table=11
atgatctggataatgacgatggctcgccgtatgaacggtgtttacgcggcatttatgctggtcgcttttatgatgggggtggccggggcgctacaggctcctacattgagcttatttctgagtcgtgaggttggcgcgcaacctttctggatcggactcttttatacggtgaatgctattgctgggatcggcgtaagcctctggttggcaaaacgttctgacagtcagggcgatcggcgaaaactgattatattttgctgtttgatggctattggcaatgcgctactgtttgcatttaatcgtcattatctgacgcttatcacctgtggtgtgcttctggcatctctggccaatacggcaatgccacagttatttgctctggcgcgggaatacgcggataactcggcgcgagaagtggtgatgtttagctcggtgatgcgtgcgcagctttctctggcatgggtaatcggtccaccgctggcctttatgctggcgttgaattacggctttacagtgatgttttcgattgccgccgggatattcacactcagtctggtattgattgcatttatgcttctgtctgtggcgcgggtagaactgccgtcggaaaatgctttatcaatgcaaggtgactggcaggatagtaacgtacggatgttatttgtcgcctcgacgttaatgtggacctgcaacactatgtacattattgatatgccattgtggatcagtagcgatttaggattgccagacaaactggcgggtttcctgatggggacggcagctggactggaaataccagcaatgattctggctggctactatgtcaaacgttatggtaagcggcgaatgatggtcattgcagtggtggcaggagtgctgttttacactggattgattttctttcatagccgtatggcgttgatgacgctgcaactttttaacgctgtatttatcggcattgttgcgggtattgggatgctatggtttcaggatttaatgcctggaagagcgggggcagctaccaccttatttaccaacactatctctaccggggtaattctggctggtgttattcagggagcaattgcacaaagttgggggcactttgctgtctactgggtaattgcgattatttctgttgtcgcattatttttaaccgcaaaggttaaagacgtttga

SEQ ID NO: 3412 - protein, 392 aa, Shigella flexneri 2a str. 301
MIWIMTMARRMNGVYAAFMLVAFMMGVAGALQAPTLSLFLSREVGAQPFWIGLFYTVNAIAGIGVSLWLAKRSDSQGDRRKLIIFCCLMAIGNALLFAFNRHYLTLITCGVLLASLANTAMPQLFALAREYADNSAREVVMFSSVMRAQLSLAWVIGPPLAFMLALNYGFTVMFSIAAGIFTLSLVLIAFMLLSVARVELPSENALSMQGDWQDSNVRMLFVASTLMWTCNTMYIIDMPLWISSDLGLPDKLAGFLMGTAAGLEIPAMILAGYYVKRYGKRRMMVIAVVAGVLFYTGLIFFHSRMALMTLQLFNAVFIGIVAGIGMLWFQDLMPGRAGAATTLFTNTISTGVILAGVIQGAIAQSWGHFAVYWVIAIISVVALFLTAKVKDV

SEQ ID NO: 3413 - DNA, 1179 bp, Shigella flexneri 2a str. 301
  CDS (1)..(1179): transl_table=11
atgcataactcccccgcagtctccagcgcgaaatcgtttgacctgacctcgacggcgtttttaatcgttgcctttctcaccggtattgcgggtgctctgcaaaccccgacactcagtattttccttaccgatgaagtacatgcccgtccggcgatggtgggattcttctttaccggcagcgctgtcattgggattctggtaagtcagtttctcgctgggcgctctgataagcgcggcgatcgcaaatcgctgattgtcttttgctgcctgttaggcgtgctggcctgcaccctttttgcttggaatcgcaactactttgttttgctattcgttggcgtctttcttagcagctttggctcgaccgctaacccgcaaatgtttgcccttgcccgtgaacatgccgacaaaaccggacgtgaggcggtgatgttcagctcttttttacgcgctcaggtttcactggcatgggtcattggcccaccgctggcttatgcgttagcgatgggtttcagctttacggtaatgtatctgagcgcagcggtagcgtttattgtttgcggcgtgatggtgtggctgtttttaccgtcgatgcaaaaagagcttccgctggcgaccggcacggttgaagcgccgcgccgtaaccgtcgcgatacgctactgctgtttgtcatttgtacattgatgtggggctcgaacagcctgtacatcatcaacatgccgctatttattatcaacgaactgcatcttcccgagaaactggccggtgtgatgatggggaccgccgccgggctggaaatcccgacgatgttgattgccggatatttcgccaaacgtctgggtaagcgtttcttaatgcgcgttgctgccgtgggtggcgtctgtttttacgcaggaatgctgatggcgcattcacctgccattctgttgggcttgcagctgctaaatgctatttttattggcattctgggcggcatcgggatgctctattttcaggatttgatgcccggtcaggcaggttcagccaccacgctctataccaacacgtcgcgcgtgggctggatcatcgcaggatcagtggcgggcatcgtcgccgagatctggaattatcacgctgtgttctggtttgcgatggtgatgattatcgccactctgttttgggtaatgactccaacttactga

SEQ ID NO: 3414 - protein, 392 aa, Shigella flexneri 2a str. 301
MHNSPAVSSAKSFDLTSTAFLIVAFLTGIAGALQTPTLSIFLTDEVHARPAMVGFFFTGSAVIGILVSQFLAGRSDKRGDRKSLIVFCCLLGVLACTLFAWNRNYFVLLFVGVFLSSFGSTANPQMFALAREHADKTGREAVMFSSFLRAQVSLAWVIGPPLAYALAMGFSFTVMYLSAAVAFIVCGVMVWLFLPSMQKELPLATGTVEAPRRNRRDTLLLFVICTLMWGSNSLYIINMPLFIINELHLPEKLAGVMMGTAAGLEIPTMLIAGYFAKRLGKRFLMRVAAVGGVCFYAGMLMAHSPAILLGLQLLNAIFIGILGGIGMLYFQDLMPGQAGSATTLYTNTSRVGWIIAGSVAGIVAEIWNYHAVFWFAMVMIIATLFWVMTPTY

SEQ ID NO: 3415 - DNA, 1179 bp, Erwinia carotovora subsp. atroseptica SCRI1043
  CDS (1)..(1179): transl_table=11
atgttcactcctgcaaacacaacacgacgcccgcttgacctgacatcgtcagcatttttaatcattgcctttctgactggaacggccggtgccctgcaacttcccacactcagcctctttctttccagcgaagtacaggttcgtccttttatggtgggcatgttttataccggcagcgcggttattggcatcgtcgtcagccaaatgctggccacgcgttcagaccgtcaaggcgatcgtaaatcgttgatcttcgtctgctgcctgctgggtgcattggcctgcatgctgtttgcgtggaaccgtaactattttattctgctctttatcggcgttttactgagcagttttggctcgaccgcgaacccgcaactttttgcgctggcgcgcgagcacgcggataaaaccggtcgtgaagcggcaatgttcagctccatcctccgcgcccagatttctctcgcctgggttgtcggcccgcctatcgcgtttgcgctggcactaggattcggctttaccacgatgtatctgaccgccgcagtcgtctttatcttgtgcggcattttggtcaaattctttctgccctccatgcctaaagcggtggaaaaaaccacctccacgctggaatcacctcgtcgcaaccgtcgtgacacgctcttgctattcattgcgtgtaccttgatgtggacctgcaacgggatttacctcattaatatgccgctgtatctggtgcatgagcttcatctgccagaaaagctggcgggtatcatgatgggcgttgccgctgggctggaaattccggtgatgttgattgcaggttacgttgccaaacgcttcggtaaacgtttcctgatgcggcttgccgttgcatctggcctgctgtttttcggtgggctgttgttcttcaacggagaaaccgcactgctagcgttacaggtgctgaacgccattttcatcgggattctggctggaatcggtatgctctactttcaggatttaatgcctggacaggcaggggctgcgacgacgctgtttaccaataccacgcgcgttggctggatcatctccggctcactggccggtatcgtcgctgaaatctggagctatcacgccgttttctttttcgcactgctgatgatcgtcggttccatctattgtatgtcgcgcatcaaagatgcctga

SEQ ID NO: 3416 - protein, 392 aa, Erwinia carotovora subsp. atroseptica SCRI1043
MFTPANTTRRPLDLTSSAFLIIAFLTGTAGALQLPTLSLFLSSEVQVRPFMVGMFYTGSAVIGIVVSQMLATRSDRQGDRKSLIFVCCLLGALACMLFAWNRNYFILLFIGVLLSSFGSTANPQLFALAREHADKTGREAAMFSSILRAQISLAWVVGPPIAFALALGFGFTTMYLTAAVVFILCGILVKFFLPSMPKAVEKTTSTLESPRRNRRDTLLLFIACTLMWTCNGIYLINMPLYLVHELHLPEKLAGIMMGVAAGLEIPVMLIAGYVAKRFGKRFLMRLAVASGLLFFGGLLFFNGETALLALQVLNAIFIGILAGIGMLYFQDLMPGQAGAATTLFTNTTRVGWIISGSLAGIVAEIWSYHAVFFFALLMIVGSIYCMSRIKDA

SEQ ID NO: 3417 - DNA, 1182 bp, Yersinia pseudotuberculosis IP 32953
  CDS (1)..(1182): transl_table=11
atgagatctgcacgagccttttcccgtcgtatcaacccggttttcctcgctttctttgtggtggcttttctttccggcatcgcgggtgcgttgcaagccccgacattaagcctgtttttaagcacagagttaaaagtgcgtccgctgtgggtcggattgttttataccgtgaatgccattgccggtatcaccgttagcttcctactggccaaacgctcagatctgggtggggatcggcgtaaattaattctgatctgctatctgatggcggtcggaaattgcctgctattcgcctttaatcgtgattatctgacgttgatcactttaggtgttttgatggcctcggtggcgaataccgcgatgccgcaaattttcgccttggcacgggaatatgcggataactctgcgcgtgaagtggtgatgttcagttcgattatgcgtgcgcaattatcattggcttgggttatcgggccaccgctgtcatttatgttagcgctgaattatggctttacgctgatgtttagcattgccgccggtatttttgttattagtgcgctggtggtctggtttatcctgccgtcggttaaacagcctgagcccgtagccgatgccccagtggtggcacaaggcagtttgtttgccgataaaaatgtcttactgctgttcattgcctcaatgctgatgtggacgtgtaataccatgtacatcattgatatgccgctctatatcaccgctaatttagggttgcctgagcggttggcgggtttgctgatggggaccgccgccgggctggaaattcctatcatgttgttggcaggttattcggttaggcgctttggtaaacgtaaaatcatgctgtttgcggtgatggcgggggtgctgttttataccgggctggtgctgtttaaattcaaaaccgcactgatgatattgcagatttttaatgccatctttatcggcatcgtcgccggtattggtatgctctattttcaggatctcatgccggggcgggcaggtgccgcaaccacgttatttaccaacagtatttctagtggggtgattttggccggtgtgctgcaaggtgtattgactgaaacctgggggcataatgcagtttatgtcgctgcgatggtgttggttattctggcgttgatcatctgcgccaaagtgagagaggcttag

SEQ ID NO: 3418 - protein, 393 aa, Yersinia pseudotuberculosis IP 32953
MRSARAFSRRINPVFLAFFVVAFLSGIAGALQAPTLSLFLSTELKVRPLWVGLFYTVNAIAGITVSFLLAKRSDLGGDRRKLILICYLMAVGNCLLFAFNRDYLTLITLGVLMASVANTAMPQIFALAREYADNSAREVVMFSSIMRAQLSLAWVIGPPLSFMLALNYGFTLMFSIAAGIFVISALVVWFILPSVKQPEPVADAPVVAQGSLFADKNVLLLFIASMLMWTCNTMYIIDMPLYITANLGLPERLAGLLMGTAAGLEIPIMLLAGYSVRRFGKRKIMLFAVMAGVLFYTGLVLFKFKTALMILQIFNAIFIGIVAGIGMLYFQDLMPGRAGAATTLFTNSISSGVILAGVLQGVLTETWGHNAVYVAAMVLVILALIICAKVREA

SEQ ID NO: 3419 - DNA, 1275 bp, Mannheimia succiniciproducens MBEL55E
  CDS (1)..(1275): transl_table=11
ttgccgaataaagcggaaacctctcccgccaaattgcgcttaaaagcatttttaaaacggataaaaattatgaataccacggaaaatagcaaacaaaaaccggtgaatgtcgtagcatttgcctttttactgacggcttttttaaccggcatcgcctcttcttttcaaacaccgactctgagtttgtttcttgcccaggaaattcaggtatcaccttttatggtgggaatgttttatacctcgaatgccgttttaggcattgtgttgagccagattctggctaaatattcggacagccaggatgatcggcgcaagatcattattttttgcagtttgcttgctatcggcggctgcattactttcgcctacaaccgaaattattatgtactcatgttttttgccacatttttattgtcattaggctcgtctgcaaatccgcaggcttttgcgctcgcccgggaatatgcggattatacgaaacgtgaagcgataatgttcaccaccattatgcggacacaaatttccctcgcctggattgtagggccgccgctttccttctccattgcattaggttggggattcgaatatatgtatatggttgccgcttccgcatttttattatgtgcgattattgccaaagcgctacttccttatgtgccgcgtaaagccgttgtacctttaacaaaaccggatgaggttgccggtttgccggcaaaaaataaaaagcaaagtgataaacaaagcattaggttgctttttatcacttgttttctgatgtggagctgtaatgggatgtatttaatcagtatgccgttacatgtgatcaacgagctgcatttatccgaacggttagccggtattttaatgggaacggcggcagggttggaaattccggtgatgctgattgccggttatctaacgaaatacttaacaaaaaaatccttaattctgaccgcacttttcatgggattatttttttatatcggtatgctgtttgcagaacaaacctggcaacttgtagcgttacaggcattcaatgctatatttatcggtattattgccactcttggcatggtttattttcaggatcttatgcccggtaaaatgggttctgccactactctattcagcaatgcggcaaaaagcagctggattgttgccggtccttttgtaggaataatcgctcaaatttggaattatagttcggtattttatatttcgattgtgcttgtggcggtgtccttatttagcatgagtaaagtaaaatccgtttag

SEQ ID NO: 3420 - protein, 424 aa, Mannheimia succiniciproducens MBEL55E
MPNKAETSPAKLRLKAFLKRIKIMNTTENSKQKPVNVVAFAFLLTAFLTGIASSFQTPTLSLFLAQEIQVSPFMVGMFYTSNAVLGIVLSQILAKYSDSQDDRRKIIIFCSLLAIGGCITFAYNRNYYVLMFFATFLLSLGSSANPQAFALAREYADYTKREAIMFTTIMRTQISLAWIVGPPLSFSIALGWGFEYMYMVAASAFLLCAIIAKALLPYVPRKAVVPLTKPDEVAGLPAKNKKQSDKQSIRLLFITCFLMWSCNGMYLISMPLHVINELHLSERLAGILMGTAAGLEIPVMLIAGYLTKYLTKKSLILTALFMGLFFYIGMLFAEQTWQLVALQAFNAIFIGIIATLGMVYFQDLMPGKMGSATTLFSNAAKSSWIVAGPFVGIIAQIWNYSSVFYISIVLVAVSLFSMSKVKSV

SEQ ID NO: 3421 - DNA, 1116 bp, Saccharophagus degradans 2-40
  CDS (1)..(1116): transl_table=11
atgtcgtttgttgtaggcctattattcgcgctagtgatgcccaccttgagtgtattagtggccaaggggctgggcgtacgtccgtttttggtgggagtattttttgtagctatggctgcgagcagtattgtgttctctcacatgctggccacttggtccgataaagttaacgaccgccgccctctaataatggccggtatgctatttggcgcggcgtcgtgtttggtgtttgcattttctagtaattattgggtgctgctagggttgggctccaccctgtttagcctctcgtttgcgtttacctcgcaaatgtttgcccacgcccgcgaatttgccgaccagcgtttaacccttggccaaaacacgctgtttaactctattgtgcgcgcaggtatcgctgttgcctgggtatctgggccgcccatcgggtttgcgctgtacaactatttgggtattcaaaggcattacacctacgtggccattgcctatattgccgccgggcttcttgcttggctggcgctgcccaaggcagaaaaatttgataccagcgccttggcgcccatcccagccagtcacaagcaacaagtagtaatagcgataattgccttcgcgtttttatatgcctgcaaccaaacctacttgattgcgctccccctgtatttaccagagcacctaggtttagacagtagctacgctggctggattatgggtaccgctgccgcgctagaaatacctattatgatttttggcggctggctaggcacgcgctacccacttattgcgcttatacgcataggcggcctgtgcgcagcggcactttacctaggcatttggaatgccacagccctatggcagttattcgtactacagctactaaacgcggtgtttattgggtttgtggccgggctaggtatgacgtggtttcaagatatgatgcccggcaaagcgggcgcggcatcggcactgtacttgaacgccaataatataggtaacttactgggcagtttggttattgcagtatttgccgaagccttaggctaccggcatatctttttgattatgattgccattgcggcttgcgcggtggtgacgctatcgttattggataagagatag

SEQ ID NO: 3422 - protein, 371 aa, Saccharophagus degradans 2-40
MSFVVGLLFALVMPTLSVLVAKGLGVRPFLVGVFFVAMAASSIVFSHMLATWSDKVNDRRPLIMAGMLFGAASCLVFAFSSNYWVLLGLGSTLFSLSFAFTSQMFAHAREFADQRLTLGQNTLFNSIVRAGIAVAWVSGPPIGFALYNYLGIQRHYTYVAIAYIAAGLLAWLALPKAEKFDTSALAPIPASHKQQVVIAIIAFAFLYACNQTYLIALPLYLPEHLGLDSSYAGWIMGTAAALEIPIMIFGGWLGTRYPLIALIRIGGLCAAALYLGIWNATALWQLFVLQLLNAVFIGFVAGLGMTWFQDMMPGKAGAASALYLNANNIGNLLGSLVIAVFAEALGYRHIFLIMIAIAACAVVTLSLLDKR

SEQ ID NO: 3423 - DNA, 1179 bp, Escherichia coli
  CDS (1)..(1179): transl_table=11
atgatctggataatgacgatggctcgccgtatgaacggtgtttacgcggcatttatgctggtcgcttttatgatgggggtggccggggcgctacaggctcctacattgagcttatttctgagtcgtgaggttggcgcgcaacctttctggatcggcctcttttatacggtgaatgctattgctgggatcggcgtaagcctctggttggcaaaacgttctgacagtcagggcgatcggcgaaaactgattatattttgctgtttgatggctatcggcaatgcgctattgtttgcatttaatcgtcattatctgacgcttatcacctgtggtgtgcttctggcatctctggccaatacggcaatgccacagttatttgctctggcgcgggaatatgcggataactcggcgcgagaagtggtgatgtttagctcggtgatgcgtgcgcagctttctctggcatgggttatcggtccaccgttggcctttatgctggcgttgaattacggctttacggtgatgttttcgattgccgccgggatattcacactcagtctggtattgattgcatttatgcttccgtctgtggcgcgggtagaactgccgtcggaaaatgctttatcaatgcaaggtggctggcaggatagtaacgtacggatgttatttgtcgcctcgacgttaatgtggacctgcaacaccatgtacattattgatatgccgttgtggatcagtagcgagttaggattgccagacaaactggcgggtttcctgatggggacggcagctggactggaaataccagcaatgattctggctggctactatgtcaaacgttatggtaagcggcgaatgatggtcatagcagtggcggcaggagtactgttttacaccggattgattttctttaatagccgtatggcgttgatgacgctgcaactttttaacgctgtatttatcggcattgttgcgggtattgggatgctatggtttcaggatttaatgcctggaagagcgggggcagctaccaccttatttactaacagtatttctaccggggtaattctggctggcgttattcagggagcaattgcacaaagttgggggcactttgctgtctactgggtaattgcggttatttctgttgtcgcattatttttaaccgcaaaggttaaagacgtttga

SEQ ID NO: 3424 - protein, 392 aa, Escherichia coli
MIWIMTMARRMNGVYAAFMLVAFMMGVAGALQAPTLSLFLSREVGAQPFWIGLFYTVNAIAGIGVSLWLAKRSDSQGDRRKLIIFCCLMAIGNALLFAFNRHYLTLITCGVLLASLANTAMPQLFALAREYADNSAREVVMFSSVMRAQLSLAWVIGPPLAFMLALNYGFTVMFSIAAGIFTLSLVLIAFMLPSVARVELPSENALSMQGGWQDSNVRMLFVASTLMWTCNTMYIIDMPLWISSELGLPDKLAGFLMGTAAGLEIPAMILAGYYVKRYGKRRMMVIAVAAGVLFYTGLIFFNSRMALMTLQLFNAVFIGIVAGIGMLWFQDLMPGRAGAATTLFTNSISTGVILAGVIQGAIAQSWGHFAVYWVIAVISVVALFLTAKVKDV

SEQ ID NO: 3425 - DNA, 1182 bp, Escherichia coli
  CDS (1)..(1182): transl_table=11
atgcataactcccccgcagtctccagcgcgaaatcgtttgacctgacctcgacggcgtttttaatcgttgcctttctcaccggtattgcgggcgctctgcaaaccccgacactcagtatttttcttaccgatgaagtacatgcccgtccggcgatggtgggattcttctttaccggcagcgctgtcattgggattctggtaagtcagtttctcgccgggcgctctgataagcgcggcgatcgcaaatcgctgattgtcttttgctgcctgttaggcgtgctggcctgcaccctttttgcctggaatcgcaactactttgttttgctattcgttggcgtctttcttagcagctttggctcgaccgctaacccgcaaatgtttgcccttgcccgtgaacatgccgacaaaaccggacgtgaggcggtgatgttcagctcttttttacgcgctcaggtttcactggcatgggtcattggcccaccgctggcttatgccttagcgatgggtttcagctttacggtaatgtatctgagcgcagcggtagcgtttattgtttgcggtgtgatggtgtggctgtttttaccgtcgatgcgaaaagagcttccgctggcgaccggcacgatcgaagcgccgcgccgtaaccgtcgcgatacgctgctgctgtttgtcatttgtacattgatgtggggctcgaacagcctgtacatcatcaacatgccgctatttattatcaacgaactgcatcttcccgagaaactggccggtgtgatgatggggaccgccgccgggctggaaatcccgacgatgttgattgccggatatttcgccaaacgtctgggtaagcgtttcttaatgcgcgttgctgccgtgggtggcgtctgtttttacgcaggaatgctgatggcgcattcacctgtcattctgttgggcttgcagctgctaaatgctatttttattggcattctgggcggcatcgggatgctctattttcaggatctgatgcccggtcaggcgggttcagccaccacgctctataccaacacttcgcgcgtgggctggatcatcgcaggatcagtggcgggcatcgtcgccgagatctggaattatcacgctgtgttctggtttgcgatggtgatgattatcgccactctgttttgcttactgcggattaaagatgtttaa

SEQ ID NO: 3426 - protein, 393 aa, Escherichia coli
MHNSPAVSSAKSFDLTSTAFLIVAFLTGIAGALQTPTLSIFLTDEVHARPAMVGFFFTGSAVIGILVSQFLAGRSDKRGDRKSLIVFCCLLGVLACTLFAWNRNYFVLLFVGVFLSSFGSTANPQMFALAREHADKTGREAVMFSSFLRAQVSLAWVIGPPLAYALAMGFSFTVMYLSAAVAFIVCGVMVWLFLPSMRKELPLATGTIEAPRRNRRDTLLLFVICTLMWGSNSLYIINMPLFIINELHLPEKLAGVMMGTAAGLEIPTMLIAGYFAKRLGKRFLMRVAAVGGVCFYAGMLMAHSPVILLGLQLLNAIFIGILGGIGMLYFQDLMPGQAGSATTLYTNTSRVGWIIAGSVAGIVAEIWNYHAVFWFAMVMIIATLFCLLRIKDV

SEQ ID NO: 3427 - DNA, 1182 bp, Salmonella typhimurium
  CDS (1)..(1182): transl_table=11
atgcacaacagtcccgccgccgctgcgcctaaatcgtttgacctgacgtctaccgcctttttgatcgtcgcttttctcaccggtattgccggtgcgttacagacgccgacgctcagtatttttctgacggatgaggttcacgcccgtcccggcatggtgggtttcttttttaccggcagcgcggttatcggcattatcgtgagccagtttctggcgggtcgctcagataaaaaaggcgatcgcaaaaaactgatcgttttctgttgcgtgctgggcatgttggcctgcgtgttgtttgcctggaaccgcaactactttattttgctgttcatcggcgtctttctcagtagcttcggctctaccgccaacccgcagatgtttgcgctcgcccgtgaacatgccgatcgtacaggtcgtgaagcggtgatgttcagctcaatcctccgcgcccaggtctcattggcctgggtcattgggccgccgctggcctatgcgctggcgatgggttttagctttacggtgatgtatttgagcgcggcggtagcttttatcgtctgcggcgtcatggtgtggttctttttaccgtcaatgcgcaaagatgcgccgctggcaaccggcacgctggaagcaccgcgtcgtaatcgccgcgatacgctgttgctgtttgtcatctgtacgttaatgtggggaactaacagcctgtatatcattaatatgccgctgtttatcatcaatgagctgcatcttccggaaaaacttgcaggcgtgatgatgggcaccgccgccgggctggagattcccacaatgctgattgcaggttacttcgccaaacggttgggaaaacgcctgttaatgtgcatcgccgttgtcgccggactgtgcttttatgtgggtatgttgctggcgcacgcaccggcgacgttgctcggcttgcagttgctgaacgcgatttacatcggcattcttggcgggattggcatgctctattttcaggatctcatgccaggccaggcgggttcagccaccacgctgtataccaataccattcgcgtcggctggatcattgccggttcgctggcgggaatcgccgcagaaatctggaattaccatgcggtcttctggtttgcgttagtcatgattgtcgccaccatgttctgcctggcgcgtattaaagatgtttaa

SEQ ID NO: 3428 - protein, 393 aa, Salmonella typhimurium
MHNSPAAAAPKSFDLTSTAFLIVAFLTGIAGALQTPTLSIFLTDEVHARPGMVGFFFTGSAVIGIIVSQFLAGRSDKKGDRKKLIVFCCVLGMLACVLFAWNRNYFILLFIGVFLSSFGSTANPQMFALAREHADRTGREAVMFSSILRAQVSLAWVIGPPLAYALAMGFSFTVMYLSAAVAFIVCGVMVWFFLPSMRKDAPLATGTLEAPRRNRRDTLLLFVICTLMWGTNSLYIINMPLFIINELHLPEKLAGVMMGTAAGLEIPTMLIAGYFAKRLGKRLLMCIAVVAGLCFYVGMLLAHAPATLLGLQLLNAIYIGILGGIGMLYFQDLMPGQAGSATTLYTNTIRVGWIIAGSLAGIAAEIWNYHAVFWFALVMIVATMFCLARIKDV

SEQ ID NO: 3429 - DNA, 1182 bp, Erwinia chrysanthemi
  CDS (1)..(1182): transl_table=11
atgacaatttcttctgcccgcacggcccgacgcctgcccgatctgacgtcttcggcgtttctggtgattgcttttctgaccgggattgccggtgcgctgcagctccccacgctcagtctgtttttatcaacggaagtacaggtacgcccgttcatggtcgggctgttttataccggcagcgcggtgatcggcatcgtcgtcagccagattctggcgacctattccgatcgtcagggcgaccgcaagacgctgatattgcaatgctgcctgttgggcgcgctggcctgcctgctgtatgcctggaaccgtaactatttcgtactgctgtttatcggtgtgctgctgtcgagtttcggctccaccgccaacccgcaactgtttgcgctggcgcgggaacacgccgaccgcaccggccgcggcgccgccatgttcagttcggtaatgcgggcgcagatttcgctatcctgggtgatcgggccgccggtcgccttcgcgctggcgctgggtttcggtttcccggcgatgtacctgacggcggcggtggtattcgtactgtgcggactgctggtgtggctgctgttgccgtcaatgcccaaaacccgggttaaatccgccgcgacgctggagtcgccccggcagaaccggcgcgacacgctattgctgtttaccgcctgtacgctgatgtggacctgcaacggcatctatctgatcaatatgccgttgtatctggttaatgaattgcggttaccggaaaagctggccggggtcatgatgggcaccgccgccgggttggaaatcccggtgatgctgctggccggctacctcaccagccggttaggcaagcgcctgctgatgcggctggcggtgatcgccggactgattttttataccgggctgacgctgctgaacggttcgtgggcgctgctggcgctgcaattgctgaacgcgattttcatcggcattctggccgggatgggaatgttgtactttcaggacctgatgccaggccaggcgggcgccgccacgacgctgttcaccaacaccacccgcgtaggctggattatctccggttcgctggcgggcatcgtggccgaagtctggagttatcatgcgggttttgttatcgccatcgccatgctggccggcgccgccgtctgcatgtggcgcatccgcgacgtttaa

SEQ ID NO: 3430 - protein, 393 aa, Erwinia chrysanthemi
MTISSARTARRLPDLTSSAFLVIAFLTGIAGALQLPTLSLFLSTEVQVRPFMVGLFYTGSAVIGIVVSQILATYSDRQGDRKTLILQCCLLGALACLLYAWNRNYFVLLFIGVLLSSFGSTANPQLFALAREHADRTGRGAAMFSSVMRAQISLSWVIGPPVAFALALGFGFPAMYLTAAVVFVLCGLLVWLLLPSMPKTRVKSAATLESPRQNRRDTLLLFTACTLMWTCNGIYLINMPLYLVNELRLPEKLAGVMMGTAAGLEIPVMLLAGYLTSRLGKRLLMRLAVIAGLIFYTGLTLLNGSWALLALQLLNAIFIGILAGMGMLYFQDLMPGQAGAATTLFTNTTRVGWIISGSLAGIVAEVWSYHAGFVIAIAMLAGAAVCMWRIRDV

SEQ ID NO: 3431 - DNA, 23 bp, Artificial sequence
  primer
atgcaaaaaacggctaccactcc

SEQ ID NO: 3432 - DNA, 28 bp, Artificial sequence
  primer
ttaaatatctttaataaacagcaggcaa

SEQ ID NO: 3433 - protein, 364 aa, Artificial sequence
  consensus sequence
  Variant (3)..(3): Xaa in position 3 is any amino acid
  Variant (4)..(5): Xaa in position 4 to 5 is any or no amino acid
  Variant (8)..(9): Xaa in position 8 to 9 is any amino acid
  Variant (11)..(11): Xaa in position 11 is any amino acid
  Variant (17)..(17): Xaa in position 17 is any amino acid
  Variant (22)..(22): Xaa in position 22 is any amino acid
  Variant (25)..(26): Xaa in position 25 to 26 is any amino acid
  Variant (28)..(31): Xaa in position 28 to 31 is any amino acid
  Variant (33)..(34): Xaa in position 33 to 34 is any amino acid
  Variant (37)..(37): Xaa in position 37 is any amino acid
  Variant (39)..(39): Xaa in position 39 is any amino acid
  Variant (41)..(42): Xaa in position 41 to 42 is any amino acid
  Variant (44)..(45): Xaa in position 44 to 45 is any amino acid
  Variant (48)..(48): Xaa in position 48 is any amino acid
  Variant (51)..(52): Xaa in position 51 to 52 is any amino acid
  Variant (55)..(56): Xaa in position 55 to 56 is any amino acid
  Variant (59)..(60): Xaa in position 59 to 60 is any amino acid
  Variant (64)..(65): Xaa in position 64 to 65 is any amino acid
  Variant (68)..(69): Xaa in position 68 to 69 is any amino acid
  Variant (71)..(71): Xaa in position 71 is any amino acid
  Variant (73)..(77): Xaa in position 73 to 77 is any amino acid
  Variant (79)..(79): Xaa in position 79 is any amino acid
  Variant (83)..(83): Xaa in position 83 is any amino acid
  Variant (86)..(86): Xaa in position 86 is any amino acid
  Variant (88)..(89): Xaa in position 88 to 89 is any amino acid
  Variant (91)..(93): Xaa in position 91 to 93 is any amino acid
  Variant (96)..(96): Xaa in position 96 is any amino acid
  Variant (98)..(98): Xaa in position 98 is any amino acid
  Variant (100)..(102): Xaa in position 100 to 102 is any amino acid
  Variant (105)..(105): Xaa in position 105 is any amino acid
  Variant (108)..(108): Xaa in position 108 is any amino acid
  Variant (115)..(115): Xaa in position 115 is any amino acid
  Variant (118)..(120): Xaa in position 118 to 120 is any amino acid
  Variant (121)..(122): Xaa in position 121 to 122 is any or no amino acid
  Variant (125)..(126): Xaa in position 125 to 126 is any amino acid
  Variant (131)..(132): Xaa in position 131 to 132 is any amino acid
  Variant (136)..(136): Xaa in position 136 is any amino acid
  Variant (142)..(142): Xaa in position 142 is any amino acid
  Variant (146)..(149): Xaa in position 146 to 149 is any amino acid
  Variant (152)..(155): Xaa in position 152 to 155 is any amino acid
  Variant (157)..(158): Xaa in position 157 to 158 is any amino acid
  Variant (160)..(162): Xaa in position 160 to 162 is any amino acid
  Variant (165)..(166): Xaa in position 165 to 166 is any amino acid
  Variant (168)..(177): Xaa in position 168 to 177 is any amino acid
  Variant (181)..(202): Xaa in position 181 to 202 is any amino acid
  Variant (203)..(213): Xaa in position 203 to 213 is any or no amino acid
  Variant (216)..(219): Xaa in position 216 to 219 is any amino acid
  Variant (223)..(224): Xaa in position 223 to 224 is any amino acid
  Variant (226)..(227): Xaa in position 226 to 227 is any amino acid
  Variant (229)..(229): Xaa in position 229 is any amino acid
  Variant (231)..(231): Xaa in position 231 is any amino acid
  Variant (235)..(239): Xaa in position 235 to 239 is any amino acid
  Variant (241)..(241): Xaa in position 241 is any amino acid
  Variant (243)..(245): Xaa in position 243 to 245 is any amino acid
  Variant (249)..(250): Xaa in position 249 to 250 is any amino acid
  Variant (261)..(261): Xaa in position 261 is any amino acid
  Variant (263)..(264): Xaa in position 263 to 264 is any amino acid
  Variant (268)..(270): Xaa in position 268 to 270 is any amino acid
  Variant (272)..(272): Xaa in position 272 is any amino acid
  Variant (276)..(277): Xaa in position 276 to 277 is any amino acid
  Variant (279)..(280): Xaa in position 279 to 280 is any amino acid
  Variant (282)..(284): Xaa in position 282 to 284 is any amino acid
  Variant (286)..(287): Xaa in position 286 to 287 is any amino acid
  Variant (290)..(290): Xaa in position 290 is any amino acid
  Variant (292)..(300): Xaa in position 292 to 300 is any amino acid
  Variant (302)..(303): Xaa in position 302 to 303 is any amino acid
  Variant (306)..(307): Xaa in position 306 to 307 is any amino acid
  Variant (310)..(310): Xaa in position 310 is any amino acid
  Variant (315)..(316): Xaa in position 315 to 316 is any amino acid
  Variant (318)..(318): Xaa in position 318 is any amino acid
  Variant (322)..(322): Xaa in position 322 is any amino acid
  Variant (330)..(330): Xaa in position 330 is any amino acid
  Variant (333)..(333): Xaa in position 333 is any amino acid
  Variant (338)..(339): Xaa in position 338 to 339 is any amino acid
  Variant (341)..(344): Xaa in position 341 to 344 is any amino acid
  Variant (346)..(346): Xaa in position 346 is any amino acid
  Variant (348)..(349): Xaa in position 348 to 349 is any amino acid
  Variant (351)..(353): Xaa in position 351 to 353 is any amino acid
  Variant (355)..(356): Xaa in position 355 to 356 is any amino acid
  Variant (358)..(359): Xaa in position 358 to 359 is any amino acid
  Variant (361)..(363): Xaa in position 361 to 363 is any amino acid
AFXXXAFXXGXAGALQXPTLSXFLXXEXXXXPXXVGXFXTXXAXXGIXVSXXLAXXSDXXGDRXXLIXXCXLXXXXXCXLFAXNRXYXXLXXXGVXLXSXXXTAXPQXFALAREXADXXXXXREXXMFSSXXRAQXSLAWVXGPPXXXXLAXXXXFXXMXXXAAXXFXXXXXXXXXXLPSXXXXXXXXXXXXXXXXXXXXXXXXXXXXXXXXXLFXXXXLMWXXNXXYXIXMPLXXXXXLXLXXXLAGXXMGTAAGLEIPXMXXAGYXXXRXGKRXXMXXAXXXGXXFYXGXXXXXXXXXLXXLQXXNAXFIGIXXGXGMLXFQDLMPGXAGXATTLXXNXXXXGXIXXGXXXGXXAXXWXXXA

SEQ ID NO: 3434 - protein, 29 aa, Artificial sequence
  protein pattern
  Variant (4)..(4): Xaa in position 4 is Trp or Tyr
  Variant (11)..(11): Xaa in position 11 is Glu or Gly
  Variant (12)..(12): Xaa in position 12 is any amino acid
  Variant (13)..(13): Xaa in position 13 is Ala or Ile
  Variant (15)..(15): Xaa in position 15 is Ala or Ser
  Variant (20)..(20): Xaa in position 20 is Phe or Tyr
  Variant (21)..(21): Xaa in position 21 is Ala or Thr
  Variant (23)..(23): Xaa in position 23 is Ser or Thr
  Variant (24)..(24): Xaa in position 24 is any amino acid
  Variant (25)..(25): Xaa in position 25 is Arg or Ser
  Variant (26)..(26): Xaa in position 26 is Ser, Thr or Val
  Variant (28)..(28): Xaa in position 28 is any amino acid
GMLXFQDLMPXXXGXATTLXXNXXXXGXI

SEQ ID NO: 3435 - protein, 35 aa, Artificial sequence
  protein pattern
  Variant (3)..(4): Xaa in position 3 to 4 is Ser or Thr
  Variant (5)..(5): Xaa in position 5 is Phe, Ile or Val
  Variant (6)..(6): Xaa in position 6 is Leu or Met
  Variant (8)..(8): Xaa in position 8 is Ala or Thr
  Variant (10)..(10): Xaa in position 10 is Ile, Leu or Val
  Variant (15)..(15): Xaa in position 15 is any or no amino acid
  Variant (17)..(17): Xaa in position 17 is any or no amino acid
  Variant (21)..(21): Xaa in position 21 is Ile or Leu
  Variant (22)..(22): Xaa in position 22 is Ala or Ser
  Variant (23)..(23): Xaa in position 23 is Phe or Tyr
  Variant (24)..(24): Xaa in position 24 is any amino acid
  Variant (25)..(25): Xaa in position 25 is Ile or Leu
  Variant (27)..(27): Xaa in position 27 is Leu or Met
  Variant (28)..(28): Xaa in position 28 is Gly or Asn
  Variant (29)..(29): Xaa in position 29 is Phe, Trp or Tyr
  Variant (30)..(30): Xaa in position 30 is Gly or Ser
  Variant (32)..(33): Xaa in position 32 to 33 is any amino acid
  Variant (35)..(35): Xaa in position 35 is Phe or Tyr
MFXXXXRXQXSLAWXVXGPPXXXXXAXXXXFXXMX

SEQ ID NO: 3436 - protein, 61 aa, Artificial sequence
  protein pattern
  Variant (2)..(3): Xaa in position 2 to 3 is any amino acid
  Variant (7)..(7): Xaa in position 7 is any or no amino acid
  Variant (9)..(9): Xaa in position 9 is any or no amino acid
  Variant (12)..(12): Xaa in position 12 is Phe, Ile, Leu or Val
  Variant (13)..(13): Xaa in position 13 is any amino acid
  Variant (15)..(15): Xaa in position 15 is any amino acid
  Variant (16)..(16): Xaa in position 16 is Leu or Val
  Variant (17)..(17): Xaa in position 17 is Phe, Leu or Met
  Variant (18)..(18): Xaa in position 18 is Ala or Gly
  Variant (19)..(19): Xaa in position 19 is any amino acid
  Variant (20)..(20): Xaa in position 20 is Gly or Leu
  Variant (21)..(21): Xaa in position 21 is Ala or Asn
  Variant (22)..(22): Xaa in position 22 is Ala or Cys
  Variant (23)..(23): Xaa in position 23 is any amino acid
  Variant (25)..(25): Xaa in position 25 is Phe or Tyr
  Variant (27)..(27): Xaa in position 27 is Phe or Trp
  Variant (30)..(30): Xaa in position 30 is any amino acid
  Variant (32)..(32): Xaa in position 32 is Phe or Leu
  Variant (33)..(33): Xaa in position 33 is any amino acid
  Variant (35)..(35): Xaa in position 35 is Ile or Leu
  Variant (36)..(37): Xaa in position 36 to 37 is any amino acid
  Variant (40)..(40): Xaa in position 40 is Phe or Leu
  Variant (41)..(41): Xaa in position 41 is Leu or Met
  Variant (42)..(42): Xaa in position 42 is Ala or Ser
  Variant (44)..(44): Xaa in position 44 is Phe, Leu or Val
  Variant (45)..(45): Xaa in position 45 is Ala or Gly
  Variant (46)..(46): Xaa in position 46 is Asn or Ser
  Variant (49)..(49): Xaa in position 49 is any amino acid
  Variant (52)..(52): Xaa in position 52 is Ile, Leu or Met
  Variant (59)..(59): Xaa in position 59 is His or Tyr
DXXGDRXKXLIXXCXXXXXXXXXLXAXNRXYXXLXXXGVXXXSXXXTAXPQXFALAREXAD

SEQ ID NO: 3437 - protein, 43 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is any or no amino acid
  Variant (8)..(8): Xaa in position 8 is any amino acid
  Variant (9)..(9): Xaa in position 9 is any or no amino acid
  Variant (11)..(11): Xaa in position 11 is Leu, Met or Val
  Variant (12)..(12): Xaa in position 12 is any amino acid
  Variant (14)..(14): Xaa in position 14 is Phe or Tyr
  Variant (15)..(15): Xaa in position 15 is Ala, Gly, Thr or Val
  Variant (16)..(16): Xaa in position 16 is Gly or Ser
  Variant (17)..(17): Xaa in position 17 is Leu, Met or Val
  Variant (18)..(18): Xaa in position 18 is any amino acid
  Variant (19)..(19): Xaa in position 19 is Phe, Leu or Met
  Variant (20)..(26): Xaa in position 20 to 26 is any amino acid
  Variant (27)..(27): Xaa in position 27 is Leu or Met
  Variant (28)..(28): Xaa in position 28 is any amino acid
  Variant (31)..(31): Xaa in position 31 is Ile, Leu or Val
  Variant (32)..(32): Xaa in position 32 is Phe or Leu
  Variant (35)..(35): Xaa in position 35 is Ile or Val
  Variant (36)..(36): Xaa in position 36 is Phe or Tyr
  Variant (37)..(37): Xaa in position 37 is Ile or Leu
  Variant (40)..(40): Xaa in position 40 is Leu or Val
  Variant (41)..(41): Xaa in position 41 is Ala, Cys or Gly
  Variant (43)..(43): Xaa in position 43 is Ile or Met
MXXXAXVXXGXXFXXXXXXXXXXXXXXXLQXXNAXXXGIXXGX

SEQ ID NO: 3438 - protein, 20 aa, Artificial sequence
  protein pattern
  Variant (2)..(2): Xaa in position 2 is any amino acid
  Variant (3)..(3): Xaa in position 3 is Phe, Ile, Leu or Val
  Variant (4)..(4): Xaa in position 4 is any amino acid
  Variant (6)..(6): Xaa in position 6 is any or no amino acid
  Variant (8)..(10): Xaa in position 8 to 10 is any amino acid
  Variant (11)..(11): Xaa in position 11 is any or no amino acid
  Variant (13)..(13): Xaa in position 13 is Gly, Asn or Ser
  Variant (14)..(14): Xaa in position 14 is His or Tyr
  Variant (15)..(15): Xaa in position 15 is any amino acid
  Variant (16)..(16): Xaa in position 16 is Ala or Ser
  Variant (17)..(17): Xaa in position 17 is Gly, Leu or Val
  Variant (18)..(18): Xaa in position 18 is Phe or Tyr
  Variant (19)..(19): Xaa in position 19 is any amino acid
  Variant (20)..(20): Xaa in position 20 is Phe, Ile, Leu or Val
GXXXGXIXXXXWXXXXXXXX

SEQ ID NO: 3439 - protein, 31 aa, Artificial sequence
  protein pattern
  Variant (2)..(2): Xaa in position 2 is any or no amino acid
  Variant (4)..(5): Xaa in position 4 to 5 is any or no amino acid
  Variant (7)..(7): Xaa in position 7 is any amino acid
  Variant (8)..(8): Xaa in position 8 is Ile, Leu or Val
  Variant (9)..(9): Xaa in position 9 is Cys or Ser
  Variant (10)..(10): Xaa in position 10 is Ala, Gly or Leu
  Variant (11)..(11): Xaa in position 11 is Ile, Leu or Val
  Variant (12)..(12): Xaa in position 12 is Ile, Leu, Met or Val
  Variant (13)..(13): Xaa in position 13 is Ala, Ile or Val
  Variant (14)..(15): Xaa in position 14 to 15 is any amino acid
  Variant (16)..(16): Xaa in position 16 is Phe, Ile, Leu or Met
  Variant (19)..(19): Xaa in position 19 is any amino acid
  Variant (20)..(20): Xaa in position 20 is Ile, Met or Val
  Variant (21)..(28): Xaa in position 21 to 28 is any amino acid
  Variant (29)..(29): Xaa in position 29 is Ala, Gly, Asn, Gln, Ser or Thr
  Variant (30)..(30): Xaa in position 30 is any amino acid
  Variant (31)..(31): Xaa in position 31 is Ile, Leu, Pro or Val
AXAXXFXXXXXXXXXXLPXXXXXXXXXXXXX

SEQ ID NO: 3440 - protein, 14 aa, Artificial sequence
  protein pattern
  Variant (2)..(2): Xaa in position 2 is Phe, Leu or Met
  Variant (3)..(3): Xaa in position 3 is Ile, Leu or Val
  Variant (4)..(4): Xaa in position 4 is Ile or Val
  Variant (7)..(7): Xaa in position 7 is Leu or Met
  Variant (8)..(8): Xaa in position 8 is any amino acid
  Variant (10)..(10): Xaa in position 10 is any amino acid
FXXXAFXXGXAGAL

SEQ ID NO: 3441 - DNA, 1776 bp, Escherichia coli
  CDS (1)..(1776): transl_table=11
atgatcgaaaaattgcgtaatatcgccatcatcgcgcacgtagaccatggtaaaaccaccctggtagacaagctgctccaacaatccggtacgttcgactctcgtgccgaaacccaagagcgcgtgatggactccaacgatttggagaaagagcgtgggattaccatcctcgcgaaaaacaccgctatcaaatggaatgattaccgtatcaacatcgttgataccccggggcacgccgacttcggtggtgaagttgaacgtgtaatgtccatggtagactcagtgctgctggtggttgacgcatttgacggcccgatgccgcaaacgcgcttcgtaaccaaaaaagcgtttgcttacggcctgaagccgattgttgttatcaacaaagttgaccgccctggcgcgcgtcctgattgggttgtggatcaggtattcgatctgttcgttaacctcgacgcgaccgacgagcagctggacttcccgatcgtttacgcttctgcgctgaacggtatcgcgggtctggaccacgaagatatggcggaagacatgaccccgctgtaccaggcgattgttgaccacgttcctgcgccggacgttgaccttgacggtccgttccagatgcagatttctcagctcgattacaacagctatgttggcgttatcggcattggccgcatcaagcgcggtaaagtgaagccgaaccagcaggtcactatcatcgatagcgaaggcaaaacccgcaacgcgaaagtcggtaaagtgctgggccacctcggtctggaacgtatcgaaaccgatctggcggaagctggcgatatcgttgcgatcacgggccttggcgaactgaacatttctgacaccgtttgcgacacgcaaaacgttgaagcgctgccggcactctccgttgatgagccgaccgtttctatgttcttctgcgttaacacctcgccgttctgcggtaaagaaggtaagttcgtaacgtctcgtcagatcctggatcgtctgaacaaagaactggtacacaacgttgcgctgcgcgtagaagaaaccgaagacgccgatgcgttccgcgtttctggtcgtggcgaactgcacctgtctgttctgatcgaaaacatgcgtcgtgaaggtttcgaactggcggtatcccgtccgaaagttatcttccgtgaaatcgacggtcgtaaacaagagccgtatgaaaacgtgactctggacgttgaagaacagcatcagggttctgtaatgcaggcgctgggcgaacgtaaaggcgacctgaaaaacatgaatccagacggtaaaggccgcgtacgtctcgactacgtgatcccaagccgtggtctgattggcttccgttctgagttcatgaccatgacttccggtactggtctgctgtactccaccttcagccactacgacgacgtacgtccgggtgaagtgggtcagcgtcagaacggcgtactgatctctaacggtcagggtaaagcggtcgcgttcgcgctgttcggtctgcaggatcgcggtaagctgttcctcggtcacggtgcagaagtttacgaaggtcagattatcggtattcatagccgctctaacgacctgactgtaaactgcctgaccggtaagaaactgaccaacatgcgtgcttccggtactgacgaagccgttgttctggttccgcctatccgcatgactctggaacaagctctggagttcatcgatgatgacgaactggtagaagtgactccgacctctatccgtattcgtaaacgtcactaa

SEQ ID NO: 3442 - protein, 591 aa, Escherichia coli
MIEKLRNIAIIAHVDHGKTTLVDKLLQQSGTFDSRAETQERVMDSNDLEKERGITILAKNTAIKWNDYRINIVDTPGHADFGGEVERVMSMVDSVLLVVDAFDGPMPQTRFVTKKAFAYGLKPIVVINKVDRPGARPDWVVDQVFDLFVNLDATDEQLDFPIVYASALNGIAGLDHEDMAEDMTPLYQAIVDHVPAPDVDLDGPFQMQISQLDYNSYVGVIGIGRIKRGKVKPNQQVTIIDSEGKTRNAKVGKVLGHLGLERIETDLAEAGDIVAITGLGELNISDTVCDTQNVEALPALSVDEPTVSMFFCVNTSPFCGKEGKFVTSRQILDRLNKELVHNVALRVEETEDADAFRVSGRGELHLSVLIENMRREGFELAVSRPKVIFREIDGRKQEPYENVTLDVEEQHQGSVMQALGERKGDLKNMNPDGKGRVRLDYVIPSRGLIGFRSEFMTMTSGTGLLYSTFSHYDDVRPGEVGQRQNGVLISNGQGKAVAFALFGLQDRGKLFLGHGAEVYEGQIIGIHSRSNDLTVNCLTGKKLTNMRASGTDEAVVLVPPIRMTLEQALEFIDDDELVEVTPTSIRIRKRH

SEQ ID NO: 3443 - DNA, 2004 bp, Arabidopsis thaliana
  CDS (1)..(2004)
atggcggggcctttgcttcgatctctttggtcaaacaccactcgaagatccttctcttctcattcatcaccttccaaattcggatactcgctctcctccttacgctccttttcagcagccaccgcttccacagctgcagccggagctcctaatagctcgcttgaccctaatcgactaagaaacgtggctgtgatagctcatgtcgatcacgggaagacaacacttatggacaggcttcttcgtcagtgtggtgctgatatccctcacgagcgtgctatggattctattaatcttgagcgtgaacgagggatcactatttcttcaaaggtgacatcaatattttggaaggacaacgaacttaacatggtagacacacctggtcacgcagattttggtggtgaggttgaacgagtcgttggtatggttgaaggagctatattagttgttgatgctggagaaggccctcttgcacagactaagtttgttcttgccaaagccttgaagtatggactacgcccaatccttctcttaaacaaggtagatcgaccttcagtcacggaagagaggtgtgatgaagtggagagtttggtgtttgatctttttgcaaattgtggtgctacagaggaacaactagattttccggtgctttatgcctctgcaaaagaagggtgggcatcttctacctataccaaagaccctcctgtagatgcgaagaatatggcagatttgcttgatgccgtagtaagacatgttcagcctccaaaagcaaaccttgatgagccatttctgatgctggtttcaatgatggagaaggacttctatctcggacgaatattaactggaagagtaacttctggagttgtccgtgttggtgacagagtcaatggactacgcaaaactgattctggctctgagaaaatagaagaagcaaaggttgtgaagctaatgaaaaagaaaggtacaaccatagtttcaattgacgctgctggggctggtgatattatctgtatggctggtttgacagctccatcaataggtcacacggtggctagtgcagaggtcacaactgcactccctactgttgagttagatccaccaacaatttctatgacgtttggtgtcaatgactctccgttggctggtcaggatggcacccacttaactggaggaagaatcggggaccggttaatggcagaagctgaaacaaatcttgccataaacgttattccaggcttgtcagagtcatatgaagtccaagggagaggagaacttcaacttggtatcttgattgagaatatgaggcgggaaggttttgagctctcagtctcaccacctaaagtcatgtataaaactgaaaagggacaaaagcttgaaccaattgaagaggtgactattgagattaatgatgaacacgtaggattagtgatggaagctctctcccacaggcgggcggaagttattgacatgggccctgtccctggaaatgagggtaggacgagactgtcactaacttgtccttcaagaggtctggttgggtacagatgtgtgtttagcagcgacacacgaggaactggattcatgcatcgtgctttcctaacttatgaaaagtaccgaggtccgcttggaaatgttaggaaaggagtattggtttccatggcacgtggtactatcacagctcattctctgatgagtttggaagctcgtggaattctctttgtgtctccggggctggattcatatgatggtatgattatcggtgagcattcacgagaaacagatcttgatcttaacccagttaaggccaaagaacttacaaacattcgctctgctgggaaagacgaaaatgtgaagctatctccacctcgtcttatgacacttgaggaagctataggatacgttgcctcagatgagcttatagaggtgacaccaaagacgattcggttgaggaaaagatgtctagacgttaacaagcgtaaatcccagagcaaacgagccaaagactaa

SEQ ID NO: 3444 - protein, 667 aa, Arabidopsis thaliana
MAGPLLRSLWSNTTRRSFSSHSSPSKFGYSLSSLRSFSAATASTAAAGAPNSSLDPNRLRNVAVIAHVDHGKTTLMDRLLRQCGADIPHERAMDSINLERERGITISSKVTSIFWKDNELNMVDTPGHADFGGEVERVVGMVEGAILVVDAGEGPLAQTKFVLAKALKYGLRPILLLNKVDRPSVTEERCDEVESLVFDLFANCGATEEQLDFPVLYASAKEGWASSTYTKDPPVDAKNMADLLDAVVRHVQPPKANLDEPFLMLVSMMEKDFYLGRILTGRVTSGVVRVGDRVNGLRKTDSGSEKIEEAKVVKLMKKKGTTIVSIDAAGAGDIICMAGLTAPSIGHTVASAEVTTALPTVELDPPTISMTFGVNDSPLAGQDGTHLTGGRIGDRLMAEAETNLAINVIPGLSESYEVQGRGELQLGILIENMRREGFELSVSPPKVMYKTEKGQKLEPIEEVTIEINDEHVGLVMEALSHRRAEVIDMGPVPGNEGRTRLSLTCPSRGLVGYRCVFSSDTRGTGFMHRAFLTYEKYRGPLGNVRKGVLVSMARGTITAHSLMSLEARGILFVSPGLDSYDGMIIGEHSRETDLDLNPVKAKELTNIRSAGKDENVKLSPPRLMTLEEAIGYVASDELIEVTPKTIRLRKRCLDVNKRKSQSKRAKD

SEQ ID NO: 3445 - DNA, 1830 bp, Mesorhizobium loti MAFF303099
  CDS (1)..(1830): transl_table=11
atgaaactccgtaatatcgcgatcatcgcgcacgtcgaccatggaaagaccacccttgtcgaccagcttttgaagcagtccggctccttccgtgacaatcagcgcgtcgccgagcgcgccatggattccaacgacctggaaaaggagcgcggcatcaccatcctggccaaggcgacctcggtcgactggaaggacacccgcatcaacatcgtcgacacacccggccacgccgatttcggcggcgaggtcgagcgcatcctgtcgatggtggattcggccatcgtgctcgtcgacgccgccgagggcccgatgccgcagaccaaattcgtcgtcggcaaggcgctcaaggtcggcctgaagccgatcgtcgtcatcaacaagatcgaccggccggacgctaggcatgtcgaggtggtcaacgaggtgttcgacctgttcgccgcgctcgacgccaccgacgaacagctcgacttcccgatcctctacggttctggccgcgacggctgggtttcggaaaatccggaaggcccgaaggaccagcagcttgcgccgctgttcgatctcatcatcaagcatgtgccggcaccgaccgtccatcccggtccgttccgcatgatcggcaccatcctggaagccaatcccttcctcggccgcatcatcaccggccgtatcgaatccggcacgctgaaggccaaccaggcggtcaaggtgctgcaccatgacggcacccagatcgaaaccggccgcatctcgaaaatcctggctttccgcggcctcgagcgccagccgatcgaggaagcccaggcgggcgatatcgtcgccatcgccggcctgtccaagggtaccgtcgccgacacgttctgcgacctggcggtgaccgaggcgctgcatgcgcagccgatcgatccgccgaccgtgaccatgtccttcctcgtcaatgacagcccgctcgccggcaccgaaggcgacaaggtgaccagccgcgtcatccgcgaccgcctgctgcgcgaggccgaaggcaatgtcgcgctgaagatcgaggagtcgcccgacaaggattcgttcttcgtctccggccgaggcgaattgcagctcgccgtgctgatcgagacgatgcgccgcgaaggctttgaaatcgccgtgtcgcgtccgcgcgttgtcatgcagaagggcgagaacggcgaattgctggagccggtcgaggaagtcgtcatcgacgtcgacgaggaacatgccggcgtggtcgtgcagaagatgtctgagcgcaaggccgagatggtcgaactgcgtccttccggcggcaaccgccagcgcatcgtcttccacgcaccgacgcgcggcctcatcggctaccagtcggaacttctgaccgacacgcgcggcaccgccgtgatgaaccggctgttccatgcctacgagccctacaagggcgaactgcccggccgcaccaacggcgtgctgatctccaacgagcagggcgaatcggtcgcctacgccatgtggaacctggaagatcgcggcccgatggtcatcgatccgggcgtcaaggtctaccagggcatgatcatcggcatccactcccgcgacaacgacctcgaagtgaacgtgctgaagggcaagaagctgaccaacatccgcgccgccggcaaggacgaagcggtcaagctcaccccgccgatccgcatgacgctggaacgcgcgctggcctggatccaggacgacgaactggtcgaggtgacgccgaagaccatccggctgcgcaaactctatctcgacccgaacgagcgcaagcgtttcgagaagtcgtccaaggtggtcggcgcggcatag

SEQ ID NO: 3446 - protein, 609 aa, Mesorhizobium loti MAFF303099
MKLRNIAIIAHVDHGKTTLVDQLLKQSGSFRDNQRVAERAMDSNDLEKERGITILAKATSVDWKDTRINIVDTPGHADFGGEVERILSMVDSAIVLVDAAEGPMPQTKFVVGKALKVGLKPIVVINKIDRPDARHVEVVNEVFDLFAALDATDEQLDFPILYGSGRDGWVSENPEGPKDQQLAPLFDLIIKHVPAPTVHPGPFRMIGTILEANPFLGRIITGRIESGTLKANQAVKVLHHDGTQIETGRISKILAFRGLERQPIEEAQAGDIVAIAGLSKGTVADTFCDLAVTEALHAQPIDPPTVTMSFLVNDSPLAGTEGDKVTSRVIRDRLLREAEGNVALKIEESPDKDSFFVSGRGELQLAVLIETMRREGFEIAVSRPRVVMQKGENGELLEPVEEVVIDVDEEHAGVVVQKMSERKAEMVELRPSGGNRQRIVFHAPTRGLIGYQSELLTDTRGTAVMNRLFHAYEPYKGELPGRTNGVLISNEQGESVAYAMWNLEDRGPMVIDPGVKVYQGMIIGIHSRDNDLEVNVLKGKKLTNIRAAGKDEAVKLTPPIRMTLERALAWIQDDELVEVTPKTIRLRKLYLDPNERKRFEKSSKVVGAA

SEQ ID NO: 3447 - DNA, 1818 bp, Rickettsia prowazekii str. Madrid E
  CDS (1)..(1818): transl_table=11
atgacatctattcgtaatatagcaattattgcccacgttgatcacgggaaaactacgcttatagataatatgcttaaacaaagcgggacattcagagctaatcaggcagttgctgagcgtgccatggattttaacgagcttgagcgcgaacgtggaattacaatacttgctaaatgtacagctcttatgtggaatgagatccgtatcaatatagtagatacaccaggacacgctgattttggtggtgaagtagaacgcatccttagcatggttgatggtgttgtgttacttgtcgacgcatcagaaggaccaatgccacaaacaaaattcgtattatctaaagctttaaatcttggtttaaaacctattgtagttattaataaaattgatagagatgaccaaagaattaaggaagttatagatgaagtgtttgagctatttgtagcacttgaagcagataatgatcagctggactttcctatagtttatgcatcaggtagagcaggcacagcatctttaaacttcgataataaaataaatcctttagataatttagctccactttttaacctaatagtaacacacgtacctacacctgcagcagatcataaagcaccgttttctatgcttgtgaccacacgagaatataatcctttcttcggtagggttttaacggggcgtgtacaaagcggaactcttaaaatcaaccaaaacgtacaagtattaaatcatgagaataaagtacttgaaactggtcgtattactaaaatattagcctttagaggtttagagcgaatcgctatagacaatgctaaagcaggagatattattgccgtagcaggcgttgaaaatgctaatgtttctgatactatctgtgcgcctgaagtaaccaaagctataccgtctctacctatagatccaccaactttatctatgacttttagtattaatgactcaccacttgcaggaagcgaaggtacgaaaattacatcaagcttaatcggagctagattaatgcgtgagcttgagagtaacgttgctcttaaagtaacagaaacaactgacaaaaatacttttcaagtcgcaggacgaggtgagttacagcttagtatattaatcgaaactatgcgtcgtgaagggtttgagttatctatcagtagaccagaagtattatgccatactgataagaaaggtaataagcaagaacctattgaagaaattcaaattgatgttgatgacgattatgttggagtagttgtaaaatctttagcacttagaaaagctgaaatgactaatataagaccatcaggtggcggcaaaagtcgtattacattcattggcccatctagaggattaattggctattacagtcagtttttaacagaaacacgaggcacagggattataaatcgtattttctacggatatactgattataaaggtcctatcgaaggaagacgtaaaggcgtactgatctctaactgtgatggagaagcagttacatacgctctatggaatctagaagaaaggggtaaaatgtttataaatcctggagataaagtatatagaggtatgattattggggaacataatcgtgataatgatttagatgtaaacccactaaaagcaaaacaactgagcaatgttagagcagcaggtaaagacgaagcaataagactaactccaccaatgcttttaacacttgagcaggcaatcagctatatacaggatgacgaactagttgaagtcacaccgaaatctattcgtttacgtaaagctctccttaacccaaacgatcgtaaaagagctgcaaaatga

SEQ ID NO: 3448 - protein, 605 aa, Rickettsia prowazekii str. Madrid E
MTSIRNIAIIAHVDHGKTTLIDNMLKQSGTFRANQAVAERAMDFNELERERGITILAKCTALMWNEIRINIVDTPGHADFGGEVERILSMVDGVVLLVDASEGPMPQTKFVLSKALNLGLKPIVVINKIDRDDQRIKEVIDEVFELFVALEADNDQLDFPIVYASGRAGTASLNFDNKINPLDNLAPLFNLIVTHVPTPAADHKAPFSMLVTTREYNPFFGRVLTGRVQSGTLKINQNVQVLNHENKVLETGRITKILAFRGLERIAIDNAKAGDIIAVAGVENANVSDTICAPEVTKAIPSLPIDPPTLSMTFSINDSPLAGSEGTKITSSLIGARLMRELESNVALKVTETTDKNTFQVAGRGELQLSILIETMRREGFELSISRPEVLCHTDKKGNKQEPIEEIQIDVDDDYVGVVVKSLALRKAEMTNIRPSGGGKSRITFIGPSRGLIGYYSQFLTETRGTGIINRIFYGYTDYKGPIEGRRKGVLISNCDGEAVTYALWNLEERGKMFINPGDKVYRGMIIGEHNRDNDLDVNPLKAKQLSNVRAAGKDEAIRLTPPMLLTLEQAISYIQDDELVEVTPKSIRLRKALLNPNDRKRAAK

SEQ ID NO: 3449 - DNA, 1845 bp, Bacillus halodurans C-125
  CDS (1)..(1845): transl_table=11
atgaccgtacgtaacgatttacgcaacattgcgatcatcgcccacgttgaccatggaaaaacgacattggttgaccaattgctaaaacaatcaggaacgttccgagaaaacgaacaagtggatgaacgagcgatggactcgaacgcacttgaaaaggaacgtggtattacgatactagcgaaaaatacggcgattaattacaatgatgtgcgtattaatatattggatactcctggacatgcggattttggcggtgaagtagaacgaatcatgaaaatggttgatggcgttcttctagttgttgatgcttatgaaggctgtatgccacaaacgcgctttgtcttaaagaaagcattggagcaaaagcttacccctttagtcgtcgtcaataaaattgatcgagatttcgcgcgacctgcagaggttgttgacgaagtacttgatttatttatcgaccttggtgcggatgaagatcagcttgatttcccagtcatttatgcctcagctattaatgggactgcaagcacaactgccgagaagcaggatgaggatatgacgagtttatttaaagcgatcattgacaacatcccagcaccagtagataacagtgaggaaccattgcaattccaagtgacgatgctagattacaacgattacttaggtcgtattggaattgggcgcgtattccgtggtgcgatcaaagttggcgagcaggtcgctttaatgaagctggacggctcagtgaaacaattccgggtaacaaaaatgtttggatttatcggcttaaaacgtattgaaattgaagaagcgaaggcaggggatcttatcgctgtttcggggatggaagagatcaacgtaggtgaaactgtctgccctgtcgatcatcaagacccgctcccaattttacgtattgatgagccgacgttgcaaatgacattccttgtgaacaacagtccgtttgctgggagggaaggaaaacatgtgacgagccgtaagcttgaagaacgtctccgagctgagctggaaacggatgtaagtctccgagtagaaaacacagattctccagatatgtgggttgtttcaggtcgcggtgagcttcacctttcgatacttatcgaaaatatgcgccgtgaaggctatgagcttcaagtatcaaagccggaagtcattatccgtgaaatcgatggtgtccaatgtgagccagttgaacgggtgcagattgatgtgcctgaggaatacactggagcggtcatggaatctcttggggagcgaaaaggggaaatgctgaacatgacaaacacgggctctggtcaagttcggcttgaattcatggttcccgcacgtgggttaatcgggtatacgactgaatttttatcgcaaacgcgtgggtatggaattattaaccactcatttgacagttatcagcctgtgaccccaggtcaagtaggtggacgaagacaaggggttctcgtgtcaatggagacaggaaaagcgacccagtatggcatcattcaagtggaggaccgggggacgatttttgttgagcctgggactgacatttatgaaggaatgattgttggtgaacatacgcgtgagaacgaccttaccgttaatattacgaaaatgaaacagcaaactaacgttcgttcggctacaaaagaacatacagtgacgatgaaaaagccacgtattatgacgcttgaggaagctttggaatatttgaatgacgatgagtattgtgaaatcactcctgaagcgatccgccttcgcaagaagattttagtaaaaacggagcgggagcgagctgaaaagagacggaagttggcagctcaaaatcaatcgtag

SEQ ID NO: 3450 - protein, 614 aa, Bacillus halodurans C-125
MTVRNDLRNIAIIAHVDHGKTTLVDQLLKQSGTFRENEQVDERAMDSNALEKERGITILAKNTAINYNDVRINILDTPGHADFGGEVERIMKMVDGVLLVVDAYEGCMPQTRFVLKKALEQKLTPLVVVNKIDRDFARPAEVVDEVLDLFIDLGADEDQLDFPVIYASAINGTASTTAEKQDEDMTSLFKAIIDNIPAPVDNSEEPLQFQVTMLDYNDYLGRIGIGRVFRGAIKVGEQVALMKLDGSVKQFRVTKMFGFIGLKRIEIEEAKAGDLIAVSGMEEINVGETVCPVDHQDPLPILRIDEPTLQMTFLVNNSPFAGREGKHVTSRKLEERLRAELETDVSLRVENTDSPDMWVVSGRGELHLSILIENMRREGYELQVSKPEVIIREIDGVQCEPVERVQIDVPEEYTGAVMESLGERKGEMLNMTNTGSGQVRLEFMVPARGLIGYTTEFLSQTRGYGIINHSFDSYQPVTPGQVGGRRQGVLVSMETGKATQYGIIQVEDRGTIFVEPGTDIYEGMIVGEHTRENDLTVNITKMKQQTNVRSATKEHTVTMKKPRIMTLEEALEYLNDDEYCEITPEAIRLRKKILVKTERERAEKRRKLAAQNQS

SEQ ID NO: 3451 - DNA, 1851 bp, Pasteurella multocida subsp. multocida str. Pm70
  CDS (1)..(1851): transl_table=11
atgacagataaaatagatatcaataaattgcgtaatatcgcaattatcgcccacgttgaccacggtaaaactaccctcgttgataaacttttacaacaatccggcacattagaggcatcacgtaatgaaagtgatgagcgtgtcatggactctaatgacatcgaaaaagaacgtggtattaccattttagctaagaataccgccattaattggaatgactatcgcattaatatcgtagacaccccaggacacgcagacttcggtggtgaagtggaacgtgtgatgtcaatggtagattgtgtacttttaattgtagatgcttttgatggtccaatgccacaaacgcgttttgtgactcaaaaagcgtttgcccacggtttaaaaccaattgtggtgatcaacaaagttgaccgtccgggcgcgcgccctgactgggtagtggatcaagtttttgatctttttgtcaacttaggtgcaactgatgagcagttagattttccaattatttatgcttctgcattaaatggtgttgcgggtcttgaacacgatgatttagcagaagatatgaccccattatttgaagcgattgtgaaacatgttgagccaccaaaagtggaacttgagcaacctttccaaatgcaaatctcccaattagattacaacagctatgttggggtaatcgggatcggacgtattaaacgtggttcagttaaacctaaccaaaccgtgagcattattgatagcgaaggtaaaacccgtaccggtaaaatcggtcaagtactcggtcatttaggtttgcaacgttatgaaacagagcgtgcttatgccggggatattattgcgatcacgggattaggtgagttaaatatttctgataccatttgcgatattaaccatgttgaagccttacccgcattaagcgttgatgaacctacggtgactatgttcttctgtgttaatacttcacctttctgtggtaaagaagggaaatatgtgacgtctcgccaaattcttgagcgcttaaataaagaattggtacacaacgtggcattacgagtagaagaaacagaagatccagatgctttccgtgtttcgggtcgtggtgaattacacctttctgttttaatcgagaatatgcgtcgtgaaggctatgaattggctgtgtcacgcccacgtgttatctataaagaagtagatggacgtaagcaagagccatttgagcaagtgacgattgatattgaagaacagcatcaaggttcagtcatggaagcactcggtattcgtaaaggtgaagtacgtgatatggtgccagatggtaaaggacgtacccgtttggaatataacattccaagccgtggcttaattggtttccgcggcgaatttatgacgatgacctccggtaccggtttactttattcaagttttagtcactatgatgatattaaacccggtgaaattggacaacgtaaaaatggtgtcttaatttctaatgcgactgggaaggcattggcttacgccttatttagtttacaggagcgtggtaaattaatgattgaacatggtaccgaagtgtatgaagggcaaatcatcggtattcatagccgttcaaatgacttaactgtgaactgtttacaaggtaaaaaattaactaacatgcgtgcctcaggtaaagatgaagccgttgtgttagtgccacctgtacgctttagtttagaacaagcgattgagtttattgatgatgatgagttggtggaagtgacaccaagctcgattcgtatccgtaaaaaattgttaacggaaaccgatcgtaagcgtgcaagtcgtacgacaaccagtactagcactcactag

SEQ ID NO: 3452 - protein, 616 aa, Pasteurella multocida subsp. multocida str. Pm70
MTDKIDINKLRNIAIIAHVDHGKTTLVDKLLQQSGTLEASRNESDERVMDSNDIEKERGITILAKNTAINWNDYRINIVDTPGHADFGGEVERVMSMVDCVLLIVDAFDGPMPQTRFVTQKAFAHGLKPIVVINKVDRPGARPDWVVDQVFDLFVNLGATDEQLDFPIIYASALNGVAGLEHDDLAEDMTPLFEAIVKHVEPPKVELEQPFQMQISQLDYNSYVGVIGIGRIKRGSVKPNQTVSIIDSEGKTRTGKIGQVLGHLGLQRYETERAYAGDIIAITGLGELNISDTICDINHVEALPALSVDEPTVTMFFCVNTSPFCGKEGKYVTSRQILERLNKELVHNVALRVEETEDPDAFRVSGRGELHLSVLIENMRREGYELAVSRPRVIYKEVDGRKQEPFEQVTIDIEEQHQGSVMEALGIRKGEVRDMVPDGKGRTRLEYNIPSRGLIGFRGEFMTMTSGTGLLYSSFSHYDDIKPGEIGQRKNGVLISNATGKALAYALFSLQERGKLMIEHGTEVYEGQIIGIHSRSNDLTVNCLQGKKLTNMRASGKDEAVVLVPPVRFSLEQAIEFIDDDELVEVTPSSIRIRKKLLTETDRKRASRTTTSTSTH

SEQ ID NO: 3453 - DNA, 1818 bp, Pseudomonas aeruginosa PAO1
  CDS (1)..(1818): transl_table=11
gtgatcgaaaatctgcgcaacatcgccatcatcgcccacgtcgaccatggcaagaccaccctggtggacaagctgctgaagctgtccggcaccctcgaccgcaaagaagcggaaagcgagcgggtgatggactccaacgaccaggaaaaagagcgtggcatcaccatcctggcgaagaacaccgcgatcaagtggaacggctacaacatcaacatcgtcgacacccccggtcacgccgacttcggcggcgaggtggagcgcgtgatgtcgatggtcgactccgtgctgctggtggtcgacgcccaggacggccccatgccgcagacccgcttcgtgacccagaaggccttcaaggccggcctgcgtccgatcgtggtggtgaacaagatcgaccgcccgggcgcgcgtccggactgggtcatcgaccagatcttcgacctgttcgacaacctcggcgccaccgacgagcaactcgacttcccgatcgtctacgccagcgccctgaacggcatcgccggcctcgaccacgagaagatggacgacaacatggacgcgctgttccaggcgatcatcgaccacgtcccggccccggtggtggacaccgagggtccgttccagatgcagatctcgcagctggactacaacagcttcctcggcgtgatcggtatcggccgcatcacccgcggcaaggtcaagtccaacaccccggtggtggccatcagcgacgacggcagcaagcgcaacggccgcatcctgaagatcatgggccaccacggcctgcagcgcgtcgaggtggccgaggcggaagccggcgacatcgtctgcgtcagcggcatggaggagctgttcatctccgataccctgtgcgacccgcagaacgtcgaggcgctgccgccgctgaccgtcgaccagccgaccgtgagcatgaccttccaggtcaacgattcgccgttcgccggccgcgaaggcaagttcgtcaccagccgcaacatcaaggagcgcctggagaaggaactgctgcataacgtggcgctgcgcgtcgagccgggcgacagcccggagaagttcaaggtttccggccgtggcgaactgcacctgtcggtactgatcgagaccatgcgccgcgaaggcttcgagctggccgtgggccgcccggaagtggtgatcatcgagaaggacggcgagaagcaggagccctacgagaacgtcaccatcgacatcgaggagcagcaccagggctcggtgatggagcagatgggcctgcgcaagggcgacctgagcaacatgattcccgacggcaagggccgcgtgcgcctggagtacaccattccggcgcgcggcctgatcggcttccgcaacaacttcctgaccctgacctcgggcaccggcatcctgacctcgaccttcagccactacggtccgatcaaggccggcgaagtcagcaaccgccagaacggcgtactggtctccatggccaccggcaccgcgctgacctactcgctggagaccctgcagagccgcggcaagctgttcctcggcccgggcgacgaaatctacgaaggccagttggccggcatcaacagccgtgacaacgacctggtgatcaacccgaccaagggcaagaagctcgacaacatgcgcgcttccggcaaggacgaagtcatcgccctggttccgccgatccgcttcaccctcgagcaggcgctggagttcatcgccgacgacgagctggtggaagtgacgccgaagtcgatccgcctgcgcaagaagatgctcaacgagaacgaccgcaagcgctacgagcgcagcaaggtctaa

SEQ ID NO: 3454 - protein, 605 aa, Pseudomonas aeruginosa PAO1
MIENLRNIAIIAHVDHGKTTLVDKLLKLSGTLDRKEAESERVMDSNDQEKERGITILAKNTAIKWNGYNINIVDTPGHADFGGEVERVMSMVDSVLLVVDAQDGPMPQTRFVTQKAFKAGLRPIVVVNKIDRPGARPDWVIDQIFDLFDNLGATDEQLDFPIVYASALNGIAGLDHEKMDDNMDALFQAIIDHVPAPVVDTEGPFQMQISQLDYNSFLGVIGIGRITRGKVKSNTPVVAISDDGSKRNGRILKIMGHHGLQRVEVAEAEAGDIVCVSGMEELFISDTLCDPQNVEALPPLTVDQPTVSMTFQVNDSPFAGREGKFVTSRNIKERLEKELLHNVALRVEPGDSPEKFKVSGRGELHLSVLIETMRREGFELAVGRPEVVIIEKDGEKQEPYENVTIDIEEQHQGSVMEQMGLRKGDLSNMIPDGKGRVRLEYTIPARGLIGFRNNFLTLTSGTGILTSTFSHYGPIKAGEVSNRQNGVLVSMATGTALTYSLETLQSRGKLFLGPGDEIYEGQLAGINSRDNDLVINPTKGKKLDNMRASGKDEVIALVPPIRFTLEQALEFIADDELVEVTPKSIRLRKKMLNENDRKRYERSKV

SEQ ID NO: 3455 - DNA, 1842 bp, Lactococcus lactis subsp. lactis Il1403
  CDS (1)..(1842): transl_table=11
atgataaaattgactaaattacgcgaagatattagaaacgtcgctgttattgcccacgttgaccatggtaaaactacattggttgacgaactcttaaaacaatctcaaacgttggatgctcgtaaagaattagctgaacgtgcgatggactcaaatgcacttgagcaagaacgtgggattactatccttgccaaaaatacagcagttgaatataacggaactcgtatcaacatcttggacacaccaggtcacgcggacttcggtggagaagttgaacgtattatgaaaatggttgatggggttgtcctcgttgtcgatgcttatgaaggaacaatgcctcaaacacgttttgttttgaaaaaagctttggaacaaaacttgactccaatcgttgttgttaataagattgacaaaccatctgctcgtccagctgaagttgttgatgaagttcttgaacttttcatcgaacttggtgctgatgacgaacaattggatttcccagttgtttatgcttcagcaatcaatggttcttcatcaatgtctgataatccagctgatcaagaacacacaatggcaaatatttttgatacaatcatcgaccatatccctggcccagttgataactctgatgaacctttacaattccaagtttcacttttggactacaatgactatgttggacgtattggtattggacgtgttttccgtggaacaatcaaagttggggacagcgttactttgtctaaacttgatggttcaactaaaaacttccgcgttactaaactttttggtttcttcggtcttgaccgtcaagaaatccaagaagcaaaagctggtgatttgattgctttgtctggtatggaagatatcttcgttggggaaactgttacaccttcagaccacgttgaaccattgccaatcttgcacattgacgaacctactttgcaaatgactttccttgctaacaattcacctttcgctggtcgcgaaggaaaatgggtaacatcacgtaaagttgaagaacgtttggtttctgaattgcaaactgacgtttcacttcgtgttgaaaacactgaatctcctgataaatgggttgtttctggtcgtggtgaattgcacttgtcaattcttattgaaacaatgcgccgtgaaggatatgaacttcaagtttcacgtcctgaagttatcatcaaagaaattgatggtgttgcttgcgaaccatttgaacgtgttcaaatcgacactcctgaagaataccaaggttcaatcatccaagcgctctctgaacgtaaaggtgatatgcttgatatgcaaatcactggtaacggtcaagcgcgtttgattttccttgttcctgcacgtggtttgattggattcacaacagaattcatgtcaatgactcgtggatacggaattatgaaccatactttcgatcaatatcttccagctgttaagggagaaatcggtggacgtcaccgtggttctttgatttctatggattcaggtcaagttacttcttacgcaatgggttacgttcaagaacgtggacaactttttgttgatgcaggtactgaagtttatggtgggatgattgttggtgaacacagtcgtgataatgatttgactgtaaatatcactaaaatgaaacaacaaacaaacgttcgttcttcaaataaagactctacatctgttttgaacacaccaaaaattctttcacttgaagaatctttggaattccttggagatgatgattacttggaagtaactccagaatcaatccgcttgcgtaaacaaattttggataaagcaatgcgtgaaaaatcaactaagaagaaaaaataa

SEQ ID NO: 3456 - protein, 613 aa, Lactococcus lactis subsp. lactis Il1403
MIKLTKLREDIRNVAVIAHVDHGKTTLVDELLKQSQTLDARKELAERAMDSNALEQERGITILAKNTAVEYNGTRINILDTPGHADFGGEVERIMKMVDGVVLVVDAYEGTMPQTRFVLKKALEQNLTPIVVVNKIDKPSARPAEVVDEVLELFIELGADDEQLDFPVVYASAINGSSSMSDNPADQEHTMANIFDTIIDHIPGPVDNSDEPLQFQVSLLDYNDYVGRIGIGRVFRGTIKVGDSVTLSKLDGSTKNFRVTKLFGFFGLDRQEIQEAKAGDLIALSGMEDIFVGETVTPSDHVEPLPILHIDEPTLQMTFLANNSPFAGREGKWVTSRKVEERLVSELQTDVSLRVENTESPDKWVVSGRGELHLSILIETMRREGYELQVSRPEVIIKEIDGVACEPFERVQIDTPEEYQGSIIQALSERKGDMLDMQITGNGQARLIFLVPARGLIGFTTEFMSMTRGYGIMNHTFDQYLPAVKGEIGGRHRGSLISMDSGQVTSYAMGYVQERGQLFVDAGTEVYGGMIVGEHSRDNDLTVNITKMKQQTNVRSSNKDSTSVLNTPKILSLEESLEFLGDDDYLEVTPESIRLRKQILDKAMREKSTKKKK

SEQ ID NO: 3457 - DNA, 1812 bp, Neisseria meningitidis MC58
  CDS (1)..(1812): transl_table=11
atgaaacaaatccgcaacatcgccatcatcgcccacgtcgaccacggcaaaaccacattggtcgaccaactgctgcgccaatccggcacattccgcgccaaccagcaggttgacgagcgcgtgatggacagcaacgaccttgaaaaagaacgcggcatcaccatcctcgccaaaaacaccgccatcgattacgaaggctaccacatcaatatcgtcgacacgccgggacacgccgacttcggcggcgaagtagagcgcgttttggggatggtggactgcgtcgtcttgttggtggacgcgcaggaaggcccgatgccgcaaacccgtttcgtgaccaaaaaagccttggctttggggctgaaaccgattgtcgtcatcaacaaaatcgacaagccgtccgctcgtccgagctgggttatcgaccaaactttcgagctgttcgacaacttgggcgcgaccgacgagcagttggatttcccgattgtttacgcttcagggttgagcggtttcgccaaattggaagaaaccgacgagagcaacgacatgcgtccgctgttcgatactatcttaaaatatacgcctgcaccgagcggcagcgcggacgaaacgctgcaactgcaaatttcccaactcgactacgacaactacaccggccgcctcggtatcggtcgtatcttgaacggacgcatcaaacccggccaaaccgttgccgtcatgaaccacgatcagcaaatcgcccaaggccgcatcaaccagcttttgggtttcaaaggtttggaacgcgtgccgcttgaagaagccgaagccggcgacatcgtgattatttccggtatcgaagacatcggtatcggcgtaaccatcaccgacaaagacaatcccaaaggcctaccgatgttgagcgtggacgaaccgacgctgacgatggactttatggtcaacaccagcccgctggcgggtacggaaggcaaattcgtaaccagccgccaaatccgcgaccgcctgcaaaaagaattgctgaccaacgtcgccctgcgcgtggaagataccgccgatgccgacgtgttccgcgtatccgggcgcggcgagctgcacctgaccattttgctggaaaacatgcgccgcgaaggctacgaactcgccgtcggcaaaccgcgcgtcgtgtaccgcgacatcgacggtcaaaaatgcgaaccgtatgaaaacctgaccgtggatgtacccgacgacaaccaaggcgcggtaatggaagaactcggccgccgccgtggcgaactgactaatatggaaagcgacggcaacggacgcacccgcctcgaataccatattccagcgcgcggcttgatcggtttccaaggcgaatttatgaccctgacgcgcggggtcgggctgatgagccacgtgttcgacgattacgcgcccgtcaaacccgatatgcccggccgccacaacggcgtgctggtgtcccaagagcagggcgaggcagtcgcttacgccttgtggaatctggaagaccgcggccgtatgttcgtatcgcccaacgacaaaatctacgaaggcatgattatcggcatccacagtcgcgacaacgatttggtggtcaacccgctcaaaggcaaaaaacttaccaacatccgtgccagcggtaccgacgaagccgttcgcctgaccacgccaatcaagctgacgctggaaggtgcggttgagtttatcgacgatgacgaactcgttgaaatcacgccgcaatccatccgtctgcgcaagcgttacttgagcgaattggaacgccgccgccactttaaaaagctggattga

SEQ ID NO: 3458 - protein, 603 aa, Neisseria meningitidis MC58
MKQIRNIAIIAHVDHGKTTLVDQLLRQSGTFRANQQVDERVMDSNDLEKERGITILAKNTAIDYEGYHINIVDTPGHADFGGEVERVLGMVDCVVLLVDAQEGPMPQTRFVTKKALALGLKPIVVINKIDKPSARPSWVIDQTFELFDNLGATDEQLDFPIVYASGLSGFAKLEETDESNDMRPLFDTILKYTPAPSGSADETLQLQISQLDYDNYTGRLGIGRILNGRIKPGQTVAVMNHDQQIAQGRINQLLGFKGLERVPLEEAEAGDIVIISGIEDIGIGVTITDKDNPKGLPMLSVDEPTLTMDFMVNTSPLAGTEGKFVTSRQIRDRLQKELLTNVALRVEDTADADVFRVSGRGELHLTILLENMRREGYELAVGKPRVVYRDIDGQKCEPYENLTVDVPDDNQGAVMEELGRRRGELTNMESDGNGRTRLEYHIPARGLIGFQGEFMTLTRGVGLMSHVFDDYAPVKPDMPGRHNGVLVSQEQGEAVAYALWNLEDRGRMFVSPNDKIYEGMIIGIHSRDNDLVVNPLKGKKLTNIRASGTDEAVRLTTPIKLTLEGAVEFIDDDELVEITPQSIRLRKRYLSELERRRHFKKLD

SEQ ID NO: 3459 - DNA, 1809 bp, Campylobacter jejuni subsp. jejuni NCTC 11168
  CDS (1)..(1809): transl_table=11
ttggaaaacattagaaatatagcagttatagctcacgttgaccatggtaaaaccactatggtagatgaattgttaaaacaatcaggcacctttagcgaaagagaacaaatttcagaacgcgttatggatagcaacgatatagaaaaagaacgcggtattaccatactttcaaaaaacacagcgatcaattacaaaggtacaaaaatcaacatcatagatactccagggcatgctgattttggcggagaagtagaacgtgttttaaaaatgattgatggagttttgcttttagtagatgctcaagaaggcgttatgccacaaactaaattcgtggttaaaaaagctttatctttagggcttaaacctatagttgtaatcaacaaaatagacaaaccagctgccgatcctgaaagagtgatcaatgaaatttttgatctttttgtagccctagatgcaaacgatgagcaacttgactttgctatagtttatgctgcagcaaaaaatggttatgctaagcttgatctaaacgatgaaagtgataatatggagccactttttaaaaccatacttgaacgcgttccagctccaagtggtagtgatgaaaatcctttgcaacttcaagttttcactttggggtatgataatttcgtaggtaaaataggcattgctagaattttcaatggggttgtgaagaaaaaccaaagcgtaatgcttgcaaaagctgatggtaccaaggtaaatggtagaatttcaaaactcattggctttatgggcttagaaaaaatggacatcgaagaagcaggaagtggagatattgtagctatagcaggttttgaagctttagatgttggcgatagcgttgtagatccaaacaatcccatgccacttgatcctttacacattgaagagccgactttaagcatagtattttctgtaaatgatggaccattagcaggaactgaaggaaaacatgtaacttcaaataaaatcgctgaacgtttagaagctgaaatgaaaactaatattgctatgaaatacgaaagcacaggcgaaggtaaatttaaagtaagcggtaggggcgaacttcaaatcactattttagctgaaaatatgcgtcgtgaaggttttgagttttgcatgggaagacctgaagttatcgtaaaagttgaagatggagttaaaacagaaccttttgaacatttagttatcgatgtgcctgaagaatttagcggtgcagtaatagaaaaacttggcaaaagaaaagctgaaatgaaaaccatggcaccaacgggcgatggacaaacaagacttgagtttgaaattccagcacgcggacttataggttttagaagtcagtttttaaccgatactaaaggcgaaggtgtgatgaatcatagctttttagaattccgtccttttagcggtgcggttgaaaagcgtaataatggagcgttaatttctatggaaaatggcgtggctttagggtattctttgtttaaccttcaagagcgtggagtacttttcatagagcctcaaactaaagtttataccggtatgattataggtgagcactctcgtccaaatgatttagatgttaatcctatcaaaggaaagaatcttaccaatgtaagagcaagtggaagcgatgatgcaatcaaacttgtgccacctagaaaattaagtcttgaaagagctttagagtggatagaagaagatgaacttgtagaagttacacctgtaaatgtgcgtgttcgcaaacgctatcttgacccaactcaaagaaaaagaatggaaaaagcaaaatcttaa

SEQ ID NO: 3460 - protein, 602 aa, Campylobacter jejuni subsp. jejuni NCTC 11168
MENIRNIAVIAHVDHGKTTMVDELLKQSGTFSEREQISERVMDSNDIEKERGITILSKNTAINYKGTKINIIDTPGHADFGGEVERVLKMIDGVLLLVDAQEGVMPQTKFVVKKALSLGLKPIVVINKIDKPAADPERVINEIFDLFVALDANDEQLDFAIVYAAAKNGYAKLDLNDESDNMEPLFKTILERVPAPSGSDENPLQLQVFTLGYDNFVGKIGIARIFNGVVKKNQSVMLAKADGTKVNGRISKLIGFMGLEKMDIEEAGSGDIVAIAGFEALDVGDSVVDPNNPMPLDPLHIEEPTLSIVFSVNDGPLAGTEGKHVTSNKIAERLEAEMKTNIAMKYESTGEGKFKVSGRGELQITILAENMRREGFEFCMGRPEVIVKVEDGVKTEPFEHLVIDVPEEFSGAVIEKLGKRKAEMKTMAPTGDGQTRLEFEIPARGLIGFRSQFLTDTKGEGVMNHSFLEFRPFSGAVEKRNNGALISMENGVALGYSLFNLQERGVLFIEPQTKVYTGMIIGEHSRPNDLDVNPIKGKNLTNVRASGSDDAIKLVPPRKLSLERALEWIEEDELVEVTPVNVRVRKRYLDPTQRKRMEKAKS

SEQ ID NO: 3461 - DNA, 1812 bp, Neisseria meningitidis Z2491
  CDS (1)..(1812): transl_table=11
atgaaacaaatccgcaacatcgccatcatcgcccacgtcgaccacggcaaaaccacattggtcgaccaactgctgcgccaatccggcacattccgcgccaaccagcaggttgacgagcgcgtgatggacagcaacgaccttgaaaaagaacgcggcatcaccatcctcgccaaaaacaccgccatcgattacgaaggctaccacatcaatatcgtcgacacgccgggacacgccgacttcggcggcgaagtagagcgagttttggggatggtggactgcgtcgtcttgttggtggacgcgcaggaaggcccgatgccgcaaacccgtttcgtgaccaaaaaagccttggctttggggctgaaaccgattgtcgtcatcaataaaatcgacaaaccgtccgcccgtccgagctgggtcatcgaccaaactttcgagctgttcgacaacttgggcgcgaccgacgagcagttggatttcccgattgtttatgcttccggtctgtccggtttcgccaaattggaagaaaccgacgagagcaacgacatgcgtccgctgttcgatactatcttaaaatatacgcctgcaccgagcggcagcgcggacgaaacgctgcaactgcaaatttcccaactcgactacgacaactacaccggccgcctcggtatcggtcgtatcttgaacggacgtatcaagcccggtcaagttgttgccgtcatgaaccacgatcaacaaatcgcccaaggccgcatcaaccagcttttgggtttcaaaggtttagaacgcgtgccgcttgaagaagccgaagccggcgacatcgtgattatttccggtattgaagacatcggcatcggcgtaaccatcaccgacaaagacaaccccaaaggcctgccgatgttgagcgtggacgaaccgacgctgacgatggactttatggtcaacaccagcccgttggcaggtacggaaggcaaattcgtaaccagccgccaaatccgcgaccgcctgcaaaaagaattgctgaccaacgtcgccctgcgcgtggaagataccgccgatgccgacgtgttccgcgtatccgggcgcggcgagctgcacctgaccattttgctggaaaacatgcgccgcgaaggctacgaactcgccgtcggcaaaccgcgcgtcgtgtaccgcgacatcgacggtcaaaaatgcgaaccgtatgaaaacctgaccgtggacgtacccgacgacaaccaaggcgcggtaatggaagaactcggccgccgccgtggcgaactgactaatatggaaagcgacggcaacggacgcacccgcctcgaataccatattccagcgcgcggcttgatcggcttccaaggcgaatttatgaccctgacgcgcggggtcgggctgatgagccacgtgttcgacgattacgcgcccgtcaaacccgatatgcctggccgccacaacggcgtgctggtgtcccaagagcagggcgaggcagtcgcttacgccttgtggaatctggaagaccgcggccgtatgttcgtatcgcccaacgacaaaatctacgaaggtatgattatcggcatccacagtcgcgacaacgatttggtggtcaacccgctcaaaggcaaaaaacttaccaacatccgtgccagcggtaccgacgaagccgttcgcctgaccacgccgattaagctgacgctggaaggtgcggtcgagtttatcgacgatgatgagctggtagaaatcacgccgcaatccatccgtctgcgcaagcgttacttgagcgaattggaacgccgccgccatttcaaaaagctagattga

SEQ ID NO: 3462 - protein, 603 aa, Neisseria meningitidis Z2491
MKQIRNIAIIAHVDHGKTTLVDQLLRQSGTFRANQQVDERVMDSNDLEKERGITILAKNTAIDYEGYHINIVDTPGHADFGGEVERVLGMVDCVVLLVDAQEGPMPQTRFVTKKALALGLKPIVVINKIDKPSARPSWVIDQTFELFDNLGATDEQLDFPIVYASGLSGFAKLEETDESNDMRPLFDTILKYTPAPSGSADETLQLQISQLDYDNYTGRLGIGRILNGRIKPGQVVAVMNHDQQIAQGRINQLLGFKGLERVPLEEAEAGDIVIISGIEDIGIGVTITDKDNPKGLPMLSVDEPTLTMDFMVNTSPLAGTEGKFVTSRQIRDRLQKELLTNVALRVEDTADADVFRVSGRGELHLTILLENMRREGYELAVGKPRVVYRDIDGQKCEPYENLTVDVPDDNQGAVMEELGRRRGELTNMESDGNGRTRLEYHIPARGLIGFQGEFMTLTRGVGLMSHVFDDYAPVKPDMPGRHNGVLVSQEQGEAVAYALWNLEDRGRMFVSPNDKIYEGMIIGIHSRDNDLVVNPLKGKKLTNIRASGTDEAVRLTTPIKLTLEGAVEFIDDDELVEITPQSIRLRKRYLSELERRRHFKKLD

SEQ ID NO: 3463 - DNA, 1782 bp, Deinococcus radiodurans R1
  CDS (1)..(1782): transl_table=11
atggaatacagaaacatcgccatcatcgcgcacgtcgaccacggcaagaccacgctggtcgacggcctgctcaagcagacgctggaactcaagcacggggaagaaatcgccgaacgcgcgatggactccaacgacctcgagcgcgagcgcggcatcaccattctggcgaagaacacggccgtggaatacaacggggtcaagatcaacatcgtggacacccccggccacgccgacttcgggggcgaagtggagcgcgtgctgggcatggtcgacggcgccctggtgctcgtcgacgctgctgaaggcccgatgccgcagacccgcttcgtgctgaaaaaggccatcgagctcgggctcaagcccatcgtggtcgtcaacaagatcgaccgcaacgacgcccgccccgaagaggtcgtcaacctgaccttcgacctgatggccgaactcggcgccaacgacgaccagctcgacttcccggtgctgtacgccatcgcccgtgaaggcaaggcgttcaaggacctcgaacagccccgcgacgacttcaaggaactgttcgacatggtgctcgagcacattcccgcgccgaaggtggacctcgactcgcccttccagatgctggtcaccaacctcgactactccgagtacctcggccgcatcgtgctggggcgcgtggcgcgcggcaccgtcaagaagggcgagtttgtgcagctgatgcacaaagacggcaccatgaccaagtcccgtgtggtgcagccctttacgcacctcggcctcaagcgcattgaggtggacgaagtgggcgccggggacatcgtggcgctcgccgggatcgaagacgcgcagatcggggaaaccatcgccgacctcgccgaacccgaagcgctgccgatcatcacggtggacgagccgaccgtcagcatgaccttccagcccaacaccagccccttcgccggcaaggaaggcaagtacgtcacctcgcgtcacctcaacgaccgcctgaagcgcgaagtgatgaccaacgtgtcgctcaaggtcgaagaagtgcgccccgacgagttcgtggtgtcgggccgtggcgagctgcacctgagtatcctgctcgaaaccatgcgccgtgaaggctacgaagtgcaggtcggcagcccccgcgtgatcatccgcgagatcgacggcgagaagcacgagccgatcgagcacctcgtgatcgacgtgcccgagcagcacgccagcaccgtgatcggtgtgctcggcgcccgcaaaggccagatggtgaacatggaaccgcagggcagccgcgtgcgcgtggagttcaagattcccgcccgcgccctgttcggcttccgcacccagtttctgagcatgacccagggcgagggcatcatgagccacatcttcgacggctacgcgccctgggccggcgaactcaagacccgccagaacggctcgctcgtcagcatggaagacggcacctcgttcgcgtactcgatctggaagctgcaagaccgtggcaacttcttcatcgacgccgggcaggaagtgtacgtgggcatgatcgtgggtgaaaacgcccgcgagcaggacatgaacgtcaacgtctgcaagaacaagaagctgacgaacgtgcgctcctcgggcgccgatgaagccctcaccctgattccgcccaagcgcctgtcgctggaagacgcgctggaatacatcgccgacgacgaactggtcgagctgaccccccagagcatccgcctgcgcaagaaagtgctcaaccccagcttccgcaagtaa

SEQ ID NO: 3464 - protein, 593 aa, Deinococcus radiodurans R1
MEYRNIAIIAHVDHGKTTLVDGLLKQTLELKHGEEIAERAMDSNDLERERGITILAKNTAVEYNGVKINIVDTPGHADFGGEVERVLGMVDGALVLVDAAEGPMPQTRFVLKKAIELGLKPIVVVNKIDRNDARPEEVVNLTFDLMAELGANDDQLDFPVLYAIAREGKAFKDLEQPRDDFKELFDMVLEHIPAPKVDLDSPFQMLVTNLDYSEYLGRIVLGRVARGTVKKGEFVQLMHKDGTMTKSRVVQPFTHLGLKRIEVDEVGAGDIVALAGIEDAQIGETIADLAEPEALPIITVDEPTVSMTFQPNTSPFAGKEGKYVTSRHLNDRLKREVMTNVSLKVEEVRPDEFVVSGRGELHLSILLETMRREGYEVQVGSPRVIIREIDGEKHEPIEHLVIDVPEQHASTVIGVLGARKGQMVNMEPQGSRVRVEFKIPARALFGFRTQFLSMTQGEGIMSHIFDGYAPWAGELKTRQNGSLVSMEDGTSFAYSIWKLQDRGNFFIDAGQEVYVGMIVGENAREQDMNVNVCKNKKLTNVRSSGADEALTLIPPKRLSLEDALEYIADDELVELTPQSIRLRKKVLNPSFRK

SEQ ID NO: 3465 - DNA, 1830 bp, Xylella fastidiosa 9a5c
  CDS (1)..(1830): transl_table=11
atgtccatagaaaatctacgtaatatcgccatcgttgctcacgttgaccatggtaagaccactcttgttgatcagttacttaagcaatctgggactttcagcgaacgtacccaggtgggtgagcgcgtgatggacagtaatgaccaggaaaaggaacgtggcatcacgattcttgctaaaaatacggcaatcaattggaacggtaaccgcatcaacattgttgatactcctgggcatgctgattttggaggggaggttgaacgcgtattgtcgatggttgattcagttctactgttggtggatgcaatggatgggccaatgccgcagacgcgcttcgtgacccagaaggcttttgcaatggggttcaagccgatcgtggtggttaacaagattgaccgtcctggtgctcgtccggattgggttgttgagcaggtttgggacttattcgaccgtctcggtgctacgccggagcagatggactttccgattgtctatgcctcggcactgaatggctatgccagcttggagtcaagtgcgcgggcgggggatatgaatccgctgtacgaagcgatcatgcagcacgttcaaccgccgcaagtggacctgcatggcccatttcagatgcgtatcagtcaattggactacaacagttatgttggtctcattgggattggtcgcattcaacgtggcaaggtgtctactaacatgccggtgacggtcattgatcgcatgggtaataaacataacggtaaagtccttcaggtactcggtttccttggtctggagcgtcatgaggttgaggaggcccaggcaggcgatatcgttgctatttcgggtattgagtcactcagtatttccgatacccttactgacccaacgtccccagatgcgctgccagcattgagtgtggatgaaccgacaatcagtatgacctttcaagttaataattcgccatttgctgggcagaaggaatattcgggggggaagttcctgacaagccgtcagatccgtgaacgcttggcacgcgaaactttacataatgttgccttgcgtgttgaggatactgaggatcctgacagatttaaggtttccggccgaggcgagctgcacttgtctgtcttgattgagactatgcggcgtgagggctatgaattgggtgtatcgcgcccggaagtcatcatcaaggaaatcgatggaatactccaagagccttacgagcagttagtcgtggacgtggaggaggagcatcaaggtggtgtgatagagcgcttgggcacgcgtaaagctcagttgtcgaatatggagttggatggtaaggggcgcgtacgtttggattacattatcccggcgcgtggtttgattggttttcagactgagtttaagaccatcacttctgggagcggccttctgttccacatctttgatcactacggcccgaaagctgatggtccgattgccaagcgtatcaacggtgtcatgatctctaatggtcatggcaaagcacctgggtatgctttgatgggcttgcaagaacgtgggcgtttgctgattgatgctggtgaggatatttacgaaggtatgttggttggcatccattccaaggataatgacctgaccgtcaatgcacttcgcgagaagcaattgacaaatattcgtgctgctgggaaggacgatgcgatctcattgaccccgcccattaagatgtccctggagcaggcgttagagtttatcgaagatgacgagttggttgaggtcaccccgaaggcaatccggttacggaaaaaatatcttagtgaaaatgatcgcaagcgtgccagtcgtactggctga

SEQ ID NO: 3466 - protein, 609 aa, Xylella fastidiosa 9a5c
MSIENLRNIAIVAHVDHGKTTLVDQLLKQSGTFSERTQVGERVMDSNDQEKERGITILAKNTAINWNGNRINIVDTPGHADFGGEVERVLSMVDSVLLLVDAMDGPMPQTRFVTQKAFAMGFKPIVVVNKIDRPGARPDWVVEQVWDLFDRLGATPEQMDFPIVYASALNGYASLESSARAGDMNPLYEAIMQHVQPPQVDLHGPFQMRISQLDYNSYVGLIGIGRIQRGKVSTNMPVTVIDRMGNKHNGKVLQVLGFLGLERHEVEEAQAGDIVAISGIESLSISDTLTDPTSPDALPALSVDEPTISMTFQVNNSPFAGQKEYSGGKFLTSRQIRERLARETLHNVALRVEDTEDPDRFKVSGRGELHLSVLIETMRREGYELGVSRPEVIIKEIDGILQEPYEQLVVDVEEEHQGGVIERLGTRKAQLSNMELDGKGRVRLDYIIPARGLIGFQTEFKTITSGSGLLFHIFDHYGPKADGPIAKRINGVMISNGHGKAPGYALMGLQERGRLLIDAGEDIYEGMLVGIHSKDNDLTVNALREKQLTNIRAAGKDDAISLTPPIKMSLEQALEFIEDDELVEVTPKAIRLRKKYLSENDRKRASRTG

SEQ ID NO: 3467 - DNA, 1887 bp, Mycobacterium leprae TN
  CDS (1)..(1887): transl_table=11
gtgccattccgcaatgtcgccattgtcgcgcacgtcgaccacggcaaaaccacgctggttgacgcgatgctacgccagtccggcgcgctacacgaacgcggtcaagtccaggaacgcgtgatggataccggtgacttggaacgggaaaaaggcatcacaatcctggccaaaaacacggccgtacattgtcacaattcggacggtacggtgacggtgatcaatgttatcgacacgcctggccatgccgacttcggcggtgaagtggaacgcgggctgtctatggtggatggggtgttgttgctggtcgatgcctccgaagggccgctgccgcagacgcggttcgtgctgcgcaagacgctggctgcgcatttgccggtgattctggtagttaacaagacagatcgtcccgacgcacgcatcgccgaggtggtggaagccagccacgacctgttgcttgacgtcgcatccgatcttgacgaggaagcggctgcggccgccgagcgtgcgctgggtctgccgacgttgtatgcgtccgggcgtgccggcatcgccagcaccgagcagcctgctgacggtgctgtgcccacgggcgacaacctcgaccccttgttcgacgtgctgatggagcacatcccgtcgccgaagggtgaccccgaagcgccgttgcaggcgttggtgactaacttggacgcctcggccttcctcggtcggcttgctttggtccgcatctataacggcaagctgcgcaaggggcagcaggtggcttggatgcgtgaagtggacgggctgcctgtcaccaccgacgccaagatcactgagttgctggtcaccaaaggtgtcgagcgcagcactacagaggaagcgacggcaggggatatcgtagccgtagcgggactgcccgagatcatgatcggtgacacgttggccgatcccgagcatgctcatgcactaccgcgtatcaccgtagacgagccggctatctcggtgacgatcggcaccaatacctcgcccctggcgggcaaggtgtcgggccacaagttgactgcgcggatggttcgtggccgcctggacgctgagttggtcggcaacatctcgatccgtgtggtggacataggacggcccgatgcgtgggaggtgcagggccgaggtgagcttgcgttggcagtgcttgttgagacgatgcgtcgggaagggttcgagcttacggtcggcaagccgcaggtggtcacccgtacgatcgatggcaaactgcacgaaccattcgaggtgatgacgatcgactgtcccgaggagttcgtcggcgcgatcacccagttgatggccggccgtaagggccgcatggaggagatggccaaccatgctgtgggctgggtgcgaatggacttcatcgtgcccagccgtggcttgattggcttccgtaccgacttcctcaccctcacacgcggcaccggtattgctaacgctgtgttcgacagctatcggccgtgggccggtgagatccgagccagggatacggggtcgctggtttccgaccggccgggtactattacgccgtttgctctgctccaacttgccgatcggggtcagttcttcgtgtcgcctggccaggacacttaccaaggtatggtcgtcggaatcaaccctcgtccggaagatctcgatatcaatgttactcgtgagaaaaagctgaccaacatgcggtcatcgaccgccaatgtcatcgagacgttgaccaaaccgctcgagctggacctggagcgggcgatggaattctgctcgttcgacgaatgtgttgaggtgacccctgagattgtgcgggtgcgcaagatcgaactggaatccaacgcccgggcccgaggccgggcccgagccaaggttcgaggctag

SEQ ID NO: 3468 - protein, 628 aa, Mycobacterium leprae TN
MPFRNVAIVAHVDHGKTTLVDAMLRQSGALHERGQVQERVMDTGDLEREKGITILAKNTAVHCHNSDGTVTVINVIDTPGHADFGGEVERGLSMVDGVLLLVDASEGPLPQTRFVLRKTLAAHLPVILVVNKTDRPDARIAEVVEASHDLLLDVASDLDEEAAAAAERALGLPTLYASGRAGIASTEQPADGAVPTGDNLDPLFDVLMEHIPSPKGDPEAPLQALVTNLDASAFLGRLALVRIYNGKLRKGQQVAWMREVDGLPVTTDAKITELLVTKGVERSTTEEATAGDIVAVAGLPEIMIGDTLADPEHAHALPRITVDEPAISVTIGTNTSPLAGKVSGHKLTARMVRGRLDAELVGNISIRVVDIGRPDAWEVQGRGELALAVLVETMRREGFELTVGKPQVVTRTIDGKLHEPFEVMTIDCPEEFVGAITQLMAGRKGRMEEMANHAVGWVRMDFIVPSRGLIGFRTDFLTLTRGTGIANAVFDSYRPWAGEIRARDTGSLVSDRPGTITPFALLQLADRGQFFVSPGQDTYQGMVVGINPRPEDLDINVTREKKLTNMRSSTANVIETLTKPLELDLERAMEFCSFDECVEVTPEIVRVRKIELESNARARGRARAKVRG

SEQ ID NO: 3469 - DNA, 1842 bp, Streptococcus pneumoniae TIGR4
  CDS (1)..(1842): transl_table=11
atgacaaaattaagagaagatatccgtaacattgcgattatcgcccacgttgaccacggtaaaacaaccctggttgacgaattattgaaacaatcagaaacgcttgatgcacggactgaattggcagagcgtgctatggactcaaacgatatcgaaaaagagcgtggaattaccatccttgctaaaaatactgccgttgcttacaacggaactcgtatcaacattatggacacaccaggacacgcggactttggtggagaagttgagcgtatcatgaaaatggttgacggtgttgtcttggtcgtagatgcctatgaaggaaccatgccacaaactcgtttcgtattgaaaaaagccttggaacaagaccttgtcccaatcgtggttgttaacaaaatcgataagccatcagctcgtccagcagaagtagtggatgaagtcttggaacttttcatcgagcttggtgcagatgacgaccagcttgatttcccagtggtttatgcttcagcgatcaacggaacttcttcattgtcagatgatccagctgaccaagaagcgactatggcaccaatctttgacacgattatcgaccatatcccagctccagtagataactcagatgagcctttgcagttccaagtgtcacttttggactacaatgacttcgttggacgtatcggtatcggtcgtgtcttccgtggtacagttaaggttggggaccaagttaccctttctaaacttgacggtacaactaaaaacttccgtgttacaaaactcttcggtttctttggtttggaacgtcgtgaaatccaagaagccaaagcgggtgacttgattgccgtttcaggtatggaagacatctttgtcggtgaaaccatcactccgacagatgcagtagaagctcttccaatcctacacatcgatgagccaactcttcaaatgactttcttggtcaacaactcaccatttgctggtaaagaaggtaaatgggtaacttctcgtaaggtggaagaacgcttgcaggcagaattgcaaacagacgtttcccttcgtgttgacccaactgattcaccagataaatggactgtttcaggacgtggagaattgcacttgtcaatccttatcgaaacaatgcgtcgtgagggctatgaacttcaagtatctcgtccagaagttatcgtaaaagaaatcgacggtattaaatgtgaaccatttgaacgtgtacaaatcgacactccagaagaataccaagggtctgttatccaaagcctttctgaacgtaaaggtgaaatgttggatatgatttcaactggtaatggtcaaactcgtttggtcttccttgttccagcgcgtggtttgattggatactcaactgagttcttatcaatgactcgtggttacggtatcatgaaccataccttcgaccaatacttgccattgattccaggggaaattggtggacgtcaccgtggtgcccttgtttctatcgatgctggtaaggctacaacttactcaatcatgtctatcgaagaacgtggtacgatctttgtcaacccaggtactgaggtttatgaaggaatgatcatcggtgaaaactctcgtgaaaatgacttgacagttaacatcacgaaggcaaaacaaatgaccaacgttcgttcagctactaaggaccaaacagctgttatcaagacgcctcgtatcttgacacttgaagagtctcttgagttcttgaacgacgatgagtacatggaagtaacgcctgagtctatccgtttgcgtaaacaaatccttaacaaagcagagcgtgagaaagctaacaagaagaaaaaatcagctgaataa

SEQ ID NO: 3470 - protein, 613 aa, Streptococcus pneumoniae TIGR4
MTKLREDIRNIAIIAHVDHGKTTLVDELLKQSETLDARTELAERAMDSNDIEKERGITILAKNTAVAYNGTRINIMDTPGHADFGGEVERIMKMVDGVVLVVDAYEGTMPQTRFVLKKALEQDLVPIVVVNKIDKPSARPAEVVDEVLELFIELGADDDQLDFPVVYASAINGTSSLSDDPADQEATMAPIFDTIIDHIPAPVDNSDEPLQFQVSLLDYNDFVGRIGIGRVFRGTVKVGDQVTLSKLDGTTKNFRVTKLFGFFGLERREIQEAKAGDLIAVSGMEDIFVGETITPTDAVEALPILHIDEPTLQMTFLVNNSPFAGKEGKWVTSRKVEERLQAELQTDVSLRVDPTDSPDKWTVSGRGELHLSILIETMRREGYELQVSRPEVIVKEIDGIKCEPFERVQIDTPEEYQGSVIQSLSERKGEMLDMISTGNGQTRLVFLVPARGLIGYSTEFLSMTRGYGIMNHTFDQYLPLIPGEIGGRHRGALVSIDAGKATTYSIMSIEERGTIFVNPGTEVYEGMIIGENSRENDLTVNITKAKQMTNVRSATKDQTAVIKTPRILTLEESLEFLNDDEYMEVTPESIRLRKQILNKAEREKANKKKKSAE

SEQ ID NO: 3471 - DNA, 1818 bp, Clostridium acetobutylicum ATCC 824
  CDS (1)..(1818): transl_table=11
atggaaaaaattactagaaatgatataagaaatattgctataatagcccacgttgaccatggtaagactactctcgtggatgctttacttagacaaagtcatgtttttagagcaaatgagaaagttgaagagagagtaatggattctaatgatctagaaaaagaaagaggaataacaatactttctaaaaatacatctttaatgcatgatggaattaaaattaacatagtagatactccaggacatgctgattttggtggagaggttgagcgtgtacttaaaatggtagacagtgttcttcttttagtagatgcttttgagggacctatgcctcagactaaatttgttttgaaaaaagctttagagcttaaattaaaaccaatagttgtaataaataaaatagataagccaaatgctagacctatggaagttgtagatgaagttttggacttgtttatagacttaggtgcagatgaagatcaacttgacttcccaatagtttatgcttctgcaaaagctggtattgctaagcttgatgtagatgatgaaagcgaaacaatggaacctttgttcgagactattgttaaatacgttaaaggtcctgaaggatatcttgatgaaccacttcaaatgcttgtttctacaatagattctaatgaatatgttggtagaattgcaataggaagagttgaaagaggatctataaagaagaatcagcaggctgttttaataagacgtgatggagcaaaggaaaatgtaaaaatttcaagcttatttacttatgaaggtcttaagagagttgaagctgatgaagttaagtttggagatattgctgtagtttcaggaatacctgatgttaatatcggagaaacaattgcagatgcatctagaccagaagcattaccttttgtagatattgatgagcctacattaagcatgttcttcatggtaaatgattctccttttgcaggtagagaaggcgatttcgttacatcaaggcatttaagagacagacttgaaaaggaattagagacaaacgtaagtttaaaagttgaagaaactgattcagctgataaattcaaggtaagtggaagaggagaacttcatctttcaatattgatagaaacaatgagaagagaaggattcgaattccaagtatctaaaccaactgtaatatacaaagaggaaaatggtaagaagttagagccaattgaagagctcacaatagacgtaccagaagaatttatgggcgttgtaatggagaagcttggacctagaaaggctgaacttgttaacatgacttcagctgtaaatggttatacaagattagagttcaaaataccttctagaggtttaattggattcagaaatgagttcatgacagatacaaagggaaatggaataatgaactctacacttatagattatgaaccatttagaggagatattcctgaaagatcaagaggatctatagttgtttttgaaacaggagtttcagttgtctatggattgtacagtgctcaagaaagaggaagattatttgttggtgctggagtagatgtttacgaaggaatggtagttggagaatgttcaagagccgaagatatcgaagttaatgtttgtaagaaaaagcatctttcaaacactagatcttctggagctgatgatgctttaaaattagttccaattcctgacatgtctttagagaaatgtcttgagtttatagcatctgatgaattggtagaaatcactccaaagagcattagaatgagaaagaaagtcttagatacaaatttacgtaagaagaaaagaaaatag

SEQ ID NO: 3472 - protein, 605 aa, Clostridium acetobutylicum ATCC 824
MEKITRNDIRNIAIIAHVDHGKTTLVDALLRQSHVFRANEKVEERVMDSNDLEKERGITILSKNTSLMHDGIKINIVDTPGHADFGGEVERVLKMVDSVLLLVDAFEGPMPQTKFVLKKALELKLKPIVVINKIDKPNARPMEVVDEVLDLFIDLGADEDQLDFPIVYASAKAGIAKLDVDDESETMEPLFETIVKYVKGPEGYLDEPLQMLVSTIDSNEYVGRIAIGRVERGSIKKNQQAVLIRRDGAKENVKISSLFTYEGLKRVEADEVKFGDIAVVSGIPDVNIGETIADASRPEALPFVDIDEPTLSMFFMVNDSPFAGREGDFVTSRHLRDRLEKELETNVSLKVEETDSADKFKVSGRGELHLSILIETMRREGFEFQVSKPTVIYKEENGKKLEPIEELTIDVPEEFMGVVMEKLGPRKAELVNMTSAVNGYTRLEFKIPSRGLIGFRNEFMTDTKGNGIMNSTLIDYEPFRGDIPERSRGSIVVFETGVSVVYGLYSAQERGRLFVGAGVDVYEGMVVGECSRAEDIEVNVCKKKHLSNTRSSGADDALKLVPIPDMSLEKCLEFIASDELVEITPKSIRMRKKVLDTNLRKKKRK

SEQ ID NO: 3473 - DNA, 1821 bp, Agrobacterium tumefaciens str. C58
  CDS (1)..(1821): transl_table=11
atggcacttcgcaacatcgcgatcatcgcgcacgttgaccatggaaaaacgacgctcgtggacgagcttctgaagcagtccggctcgttccgcgataaccagcgcgttgcagagcgcgtgatggacagcaacgacctcgaaaaggaacgcggcatcaccattctcgccaaggcgacctcggtggagtggaagggtgttcgcatcaacatcgtcgacacccccggccacgccgacttcggcggcgaagtcgagcgtatcttgtcgatggtggatggcgcgatcgttctggtcgatagttccgaaggcccgatgccgcagaccaagttcgtggtttccaaggcgctgaaggtcggtcttcgcccgatcgttgcgatcaacaagatcgaccgtccggatggccgtcatgaagaagtcatcaacgaagttttcgacctctttgcaaaccttgacgccaccgacgagcagctcgacttcccgatcctctacggttctggtcgtgacggctggatgaacgtcaacccggaaggtccgaaggatcagggtctcgcaccgctgcttgatctggttctcgaacatgttccggagcccaaggtcgaagaaggtccgttccgtctgatcggcacgatcctcgaagccaaccccttcctcggtcgtatcattaccggccgtatcgcttctggttccatcaagccgaaccaggccgtgaaggttctgggtcaggacggcaagctgatcgaaactggccgtatttccaagatccttgccttccgcggtatcgagcgcacggccatcgaagaagcccatgccggtgacatcgttgccattgccggtctttccaagggtaccgttgccgataccttctgcgatccgtccgtcaccgaggcgatgaccgcgcagccgatcgatccgccgaccgtcaccatgtcgttcatcgttaacgatagcccgctcgccggcaccgaaggcgacaaggttaccagccgcgtcatccgcgaccgtctgttcaaggaagccgaaggcaacgttgcgctgaagatcgaagaggccgaaggcaaggattcgttcttcgtttccggccgtggcgaattgcagctggcggttctgatcgaaaccatgcgtcgcgaaggcttcgagcttgccgtttcgcgtccgcgggtcgtgatgcacaaggatgagaacggcaccctgctggagccgatcgaagaagtcgtgatcgacgttgacgaagagcattccggcgtcgtcgttcagaagatgtcggagcgcaaggctgaaatggccgagcttcgtccttccggcggcaatcgcgttcgtttgaagttctacgctccgacccgtggcctgatcggctaccagtcggaactgctgaccgacacgcgcggtacggccatcatgaaccgtctgttccacgactatcagcccttcaagggccagattgccggtcgcgtcaacggcgttctcctgtccaatggttcgggcgaggctgttgcctatgccatgttcaacctggaagatcgcggcccgatgatcatcgagccgggtgagaaggtttatgccggcatgatcatcggtattcacacgcgcgacaacgatctcgaagtgaacgtgttgaagggcaagcagctgaccaacatccgcgccgccggcaaggatgaagccgtcaagctgacgccgccgatccgcatgacactcgaccgcgctctttcctggatccaggaagacgagttgatggaagtgacgccgaagtcgatccgtctgcgcaagatgttcctcgacgccaacgaccgcaagcgttttgaaaaggccaagctcgcaatctga

SEQ ID NO: 3474 - protein, 606 aa, Agrobacterium tumefaciens str. C58
MALRNIAIIAHVDHGKTTLVDELLKQSGSFRDNQRVAERVMDSNDLEKERGITILAKATSVEWKGVRINIVDTPGHADFGGEVERILSMVDGAIVLVDSSEGPMPQTKFVVSKALKVGLRPIVAINKIDRPDGRHEEVINEVFDLFANLDATDEQLDFPILYGSGRDGWMNVNPEGPKDQGLAPLLDLVLEHVPEPKVEEGPFRLIGTILEANPFLGRIITGRIASGSIKPNQAVKVLGQDGKLIETGRISKILAFRGIERTAIEEAHAGDIVAIAGLSKGTVADTFCDPSVTEAMTAQPIDPPTVTMSFIVNDSPLAGTEGDKVTSRVIRDRLFKEAEGNVALKIEEAEGKDSFFVSGRGELQLAVLIETMRREGFELAVSRPRVVMHKDENGTLLEPIEEVVIDVDEEHSGVVVQKMSERKAEMAELRPSGGNRVRLKFYAPTRGLIGYQSELLTDTRGTAIMNRLFHDYQPFKGQIAGRVNGVLLSNGSGEAVAYAMFNLEDRGPMIIEPGEKVYAGMIIGIHTRDNDLEVNVLKGKQLTNIRAAGKDEAVKLTPPIRMTLDRALSWIQEDELMEVTPKSIRLRKMFLDANDRKRFEKAKLAI

SEQ ID NO: 3475 - DNA, 1863 bp, Streptococcus pneumoniae R6
  CDS (1)..(1863): transl_table=11
ttgaatattatagaggaaatcatgacaaaattaagagaagatatccgtaacattgcgattatcgcccacgttgaccacggtaaaacaaccctggttgacgaattattgaaacaatcagaaacgcttgatgcacgtactgaattggcagagcgtgctatggactcaaacgatatcgaaaaagagcgtggaatcaccatccttgctaaaaatactgccgttgcttacaacggaactcgtatcaacattatggacacaccaggacacgcggacttcggtggagaagttgagcgtatcatgaaaatggttgacggtgttgtcttggtcgtagatgcctatgaaggaaccatgccacaaactcgtttcgtattgaaaaaagccttggaacaagaccttgtcccaatcgtggttgttaacaaaatcgataagccatcagctcgtccagcagaagtagtggatgaagtcttggaacttttcatcgagcttggtgcagatgacgaccagcttgatttcccagtggtttatgcttcagcgatcaacggaacttcttcattgtcagatgatccagctgaccaagaagcgactatggcaccaatctttgacacgattatcgaccatatcccagctccagtagataactcagatgagcctttgcagttccaagtgtcacttttggactacaatgacttcgttggacgtatcggtatcggtcgtgtcttccgtggtacagttaaggttggggaccaagttaccctttctaaacttgacggtacaactaaaaacttccgtgttacaaaactcttcggtttctttggtttggaacgtcgtgaaatccaagaagccaaagcgggtgacttgattgccgtttcaggtatggaagacatctttgtcggtgaaaccatcactccgacagatgcagtagaagctcttccaatcctacacatcgatgagccaactcttcaaatgactttcttggtcaacaactcaccatttgctggtaaagaaggtaaatgggtaacttctcgtaaggtggaagaacgcttgcaggcagaattgcaaacagacgtttcccttcgtgttgacccaactgattcaccagataaatggactgtttcaggacgtggagaattgcacttgtcaatccttatcgaaacaatgcgtcgtgagggctatgaacttcaagtatctcgtccagaagttatcgtaaaagaaatcgacggtgttaaatgtgaaccatttgaacgtgtacaaatcgacactccagaagaataccaagggtctgttatccaaagcctttctgaacgtaaaggtgaaatgttggatatgatttcaactggtaatggtcaaactcgtttggtcttccttgttccagcgcgtggtttgattggatactcaactgagttcttgtcaatgactcgtggttacggtatcatgaaccataccttcgaccaatacttgccattgattccaggggaaattggtggacgtcaccgtggtgcccttgtttctatcgatgctggtaaggctacaacttactcaatcatgtctatcgaagaacgtggtacgatctttgtcaacccaggtactgaggtttatgaaggaatgatcatcggtgaaaactctcgtgaaaatgacttgacagttaacatcacgaaggcaaaacaaatgaccaacgttcgttcagctactaaggaccaaacagctgttatcaagacgcctcgtatcttgacacttgaagagtctcttgagttcttgaacgacgatgagtacatggaagtaacgcctgagtctatccgtttgcgtaaacaaatccttaacaaagcagagcgtgagaaagctaacaagaagaaaaaatcagctgaataa

SEQ ID NO: 3476 - protein, 620 aa, Streptococcus pneumoniae R6
MNIIEEIMTKLREDIRNIAIIAHVDHGKTTLVDELLKQSETLDARTELAERAMDSNDIEKERGITILAKNTAVAYNGTRINIMDTPGHADFGGEVERIMKMVDGVVLVVDAYEGTMPQTRFVLKKALEQDLVPIVVVNKIDKPSARPAEVVDEVLELFIELGADDDQLDFPVVYASAINGTSSLSDDPADQEATMAPIFDTIIDHIPAPVDNSDEPLQFQVSLLDYNDFVGRIGIGRVFRGTVKVGDQVTLSKLDGTTKNFRVTKLFGFFGLERREIQEAKAGDLIAVSGMEDIFVGETITPTDAVEALPILHIDEPTLQMTFLVNNSPFAGKEGKWVTSRKVEERLQAELQTDVSLRVDPTDSPDKWTVSGRGELHLSILIETMRREGYELQVSRPEVIVKEIDGVKCEPFERVQIDTPEEYQGSVIQSLSERKGEMLDMISTGNGQTRLVFLVPARGLIGYSTEFLSMTRGYGIMNHTFDQYLPLIPGEIGGRHRGALVSIDAGKATTYSIMSIEERGTIFVNPGTEVYEGMIIGENSRENDLTVNITKAKQMTNVRSATKDQTAVIKTPRILTLEESLEFLNDDEYMEVTPESIRLRKQILNKAEREKANKKKKSAE

SEQ ID NO: 3477 - DNA, 1830 bp, Rickettsia conorii str. Malish 7
  CDS (1)..(1830): transl_table=11
atgacatctattcgtaatatagcaattattgcccacgttgatcatggaaaaactacgcttgttgataacatgcttaaacaaagcggaacatttagagctaaccaagcagttgctgagcgtgctatggactctaacgatcttgagcgtgagcgtggaatcacgatacttgccaaatgcactgctcttatgtggaacgatatccgtatcaatatagttgatacgccaggacacgccgattttggcggtgaagtagaacgcatccttagcatggttgacggtgtagtgctacttgtcgatgcatcggaaggaccaatgccgcaaacaaaattcgtgctttctaaagcgttaaatctcggcttaaaacctattgtcgttattaataaaatcgatagagatgaccaaagaattaaagaagttatcgatgaagtatttgagctatttgtggcacttgaagcaaacaacgatcagcttgacttccctatagtttatgcatcaggtagagcaggtagagcatctttaacctttgatgataaaattaatcctttagacaatttagcagatgatttagcaccgcttttcgaccttatagtacagcatgtaccaaaacccttagccgatgacaaagcaccgttttctatgcttgttactactagagaatataactctttcttcggtagggttttaacaggtcgtgtacaaagcggcactgtcaaaattaaccaaaacgtaaaagtattaaatcgtgagaataaagtacttgaaaccggacgtatcactaaaatattagcctttagaggcttagagcgaatcgctataaatgatgctacagccggcgatattattgccgtagcaggcgttgaaaacgccaacgttgccgatactatctgctcccctgaggtaaccgaggccgtaccgtctctacctatcgatccgccgactttatccatgacttttagcgttaatgactcaccgcttgcaggaagcgaagggacaaaagttacgtcgagcttaattggagctaggttaatgcgtgagcttgaaagtaacgttgccttaaaagttactgaagctgccgagaaaaatgctttccaagttgcagggcgtggtgagttacaacttggtatcttaattgaaactatgcgtcgtgaaggatttgagctatctattagcagacccgaagtattattccaaactgatgagaaaggtaataagcaagaaccgatggaagaaatccaagttgacgttgatgatgattatgttggagtagtcgtaaaatctttagcactgagaaaagccgaaatgactgatatgaggccgtcaggcggcggtaaaagccgtgttacgtttatcggaccgtctagagggttaatcggctatcacagccagtttttaaccgaaacacgaggcacaggaattatgaatcgtattttccatggatatgctgattataaaggaaatatcgagggaagacgtaacggtgtgcttatctctaacggtgacggggcagcagtcgcatatgctctatggaatctagaagaaaggggaaaaatgtttataaaccctagtgacaaagtatatagaggcatgattatcggcgaacataatcgtgataatgatttagaggtaaacccactaaaagcgaaacaactgagcaacgttagagcaacaggtaaagacgaagccataaggctaactccgccaatgcttttaacgttagagcaggcaatcagctatatacaagatgacgagcgagttgaagtcacaccgaaatctattcgtttacgtaaagctctacttgaccctaacgaccgtaaaagagctgcaaagtag

SEQ ID NO: 3478 - protein, 609 aa, Rickettsia conorii str. Malish 7
MTSIRNIAIIAHVDHGKTTLVDNMLKQSGTFRANQAVAERAMDSNDLERERGITILAKCTALMWNDIRINIVDTPGHADFGGEVERILSMVDGVVLLVDASEGPMPQTKFVLSKALNLGLKPIVVINKIDRDDQRIKEVIDEVFELFVALEANNDQLDFPIVYASGRAGRASLTFDDKINPLDNLADDLAPLFDLIVQHVPKPLADDKAPFSMLVTTREYNSFFGRVLTGRVQSGTVKINQNVKVLNRENKVLETGRITKILAFRGLERIAINDATAGDIIAVAGVENANVADTICSPEVTEAVPSLPIDPPTLSMTFSVNDSPLAGSEGTKVTSSLIGARLMRELESNVALKVTEAAEKNAFQVAGRGELQLGILIETMRREGFELSISRPEVLFQTDEKGNKQEPMEEIQVDVDDDYVGVVVKSLALRKAEMTDMRPSGGGKSRVTFIGPSRGLIGYHSQFLTETRGTGIMNRIFHGYADYKGNIEGRRNGVLISNGDGAAVAYALWNLEERGKMFINPSDKVYRGMIIGEHNRDNDLEVNPLKAKQLSNVRATGKDEAIRLTPPMLLTLEQAISYIQDDERVEVTPKSIRLRKALLDPNDRKRAAK

SEQ ID NO: 3479 - DNA, 1827 bp, Sinorhizobium meliloti 1021
  CDS (1)..(1827): transl_table=11
atgagcattcgtaacatcgcgatcatcgcgcacgtcgaccatgggaaaaccacgctcgtcgacgaacttctgaagcagtcgggctccttccgcgaaaaccagcgcgtcgccgagcgcatgatggattccaacgaactggaaaaggaacgcggcatcaccatcctcgccaaggcgacttcggtcgagtggaagggtacccgcatcaatatcgtcgacacccccggccacgccgatttcggcggtgaagtcgagcgcattctgtcgatggtggacggcgccatcgtgctggtcgacgccgccgaaggcccgatgccgcagacgaaattcgtcgtcggcaaggcgctcaaggtcggtcttcggccgatcgtggcgatcaataagatcgaccggcccgatgcccgtcacgaggaagtcatcaacgaggtattcgatctcttcgcggcgctcgatgcgaccgatgagcagctcgacttcccgattctctacggttccggccgtaacggctggatgaacgtcgcgccggaaggtccgcaggatcagggcctggcaccgctcctcgatctcgttctcgatcacgttccggagccgagcgtcggcgaaggcccgttccggatgatcggcaccattctcgaagccaatcccttcctcggccgcatcatcaccgggcgcattcattccggttcgatcaagccgaaccaggcggtcaaggtcctcgggcaggacggcaaggtgctcgagtccgggcgcatctccaagattcttgcattccgcggcatcgagcgtcagccgatcgaggaagcccatgcgggcgacatcgtggcgatcgccggcctctccaagggcaccgtcgccgacacgttctgtgatccggccatcaacgagccgctgaaggcgcagccgatcgatccgccgaccgtcaccatgtccttcctcgtcaacgattctccgctcgccggcaccgaaggcgacaaggtcacttcgcgcgtcatccgcgaccgtctgttcaaggaagccgagggcaacgtcgcattgaagatcgaggaatcctccgagaaggactcgttctacgtgtcgggccgcggcgaactgcagctcgcggttctgatcgaaacgatgcgccgcgaaggcttcgagctcgccgtctcgcgtccgcgcgtggtcatgcacaaggatgagaacggacagctcctggagccgatcgaagaggtcgtcatcgacgtcgacgaggagcattcgggcgtcgtcgtccagaaaatgtccgaacgcaaggccgaaatggccgagcttcgtccctccggcggcaaccgcgtccggctggtgttcttcgcgcccacccgcggtctcatcggctatcagtcggagcttctgaccgatacgcgcggcacggcgatcatgaaccgcctgttccacgactaccagccctataagggtgagatcggcggccgcgtgaacggtgttctgctctcgaacgacgccggcgaatccgtggcctatgcgatgttcaacctcgaagatcgcggcccgatgatcatcgacgccggcgaaaaggtctatgcgggcatgatcatcggtatccacacgcgcgacaacgatctggaagtcaacgtcctcaagggtaagaagctcaccaacatgcgcgcgtccggcaaggacgaggcggtaaagctgacgccgccgatccgcatgacgctcgaccgggcgctgtcatggatccaggacgacgaactggtcgaggtcacgccgaagtcgatccggcttcgcaagatgtatctcgatccgaacgagcgcaagcgcttcgagaagtcgcggacggccggcgctgcttaa

SEQ ID NO: 3480 - protein, 608 aa, Sinorhizobium meliloti 1021
MSIRNIAIIAHVDHGKTTLVDELLKQSGSFRENQRVAERMMDSNELEKERGITILAKATSVEWKGTRINIVDTPGHADFGGEVERILSMVDGAIVLVDAAEGPMPQTKFVVGKALKVGLRPIVAINKIDRPDARHEEVINEVFDLFAALDATDEQLDFPILYGSGRNGWMNVAPEGPQDQGLAPLLDLVLDHVPEPSVGEGPFRMIGTILEANPFLGRIITGRIHSGSIKPNQAVKVLGQDGKVLESGRISKILAFRGIERQPIEEAHAGDIVAIAGLSKGTVADTFCDPAINEPLKAQPIDPPTVTMSFLVNDSPLAGTEGDKVTSRVIRDRLFKEAEGNVALKIEESSEKDSFYVSGRGELQLAVLIETMRREGFELAVSRPRVVMHKDENGQLLEPIEEVVIDVDEEHSGVVVQKMSERKAEMAELRPSGGNRVRLVFFAPTRGLIGYQSELLTDTRGTAIMNRLFHDYQPYKGEIGGRVNGVLLSNDAGESVAYAMFNLEDRGPMIIDAGEKVYAGMIIGIHTRDNDLEVNVLKGKKLTNMRASGKDEAVKLTPPIRMTLDRALSWIQDDELVEVTPKSIRLRKMYLDPNERKRFEKSRTAGAA

SEQ ID NO: 3481 - DNA, 1833 bp, Caulobacter crescentus CB15
  CDS (1)..(1833): transl_table=11
atgtccatgcgaaatatcgccatcatcgcgcacgtcgatcatggcaagaccaccctcgtcgaccagctgctggctcagtccggcgtgttccgcgccaacgaagccacgaccgaacgggcgatggactccaacgaccaggagcgcgagcgcggcatcacgattctggccaagtgcacctcggtgctctggaacggtgaagcgggcgaaacccgcatcaacatcatcgacacccccggccacgccgacttcggcggtgaggtcgagcggatcctgggcatggtggacggctgcgtcttgctggtcgacgccgaggaaggcgtcatgccgcagaccaagttcgtgctgaccaaggcgctgaagatgggcctgcgcccgatcctctgcatcaacaaggtcgaccgcgcccacgccgatccggaccgcgtccacaacgccgccttcgacctgttcgccgccatcggcgccacggacgagcagctggacttcccgcacatctacgcctcgggccgcgccggctgggccacgctggacctgaaccagcccagcgacaacctggccccgctgttcgacctgatcgtgcgccacgtgcccgagcccaagcagatcgccaaaaaggacgagcccttccagatcctgtcggtgctgatcgaaagcgacccgttcctgggccgcctgctgaccggccgcatcgaaagcggcaaggccgtccccggcatggccatcaaggccctggaccgcgacggcaaggaaatcgagcgcggccgcatcaccaaggtgctggccttccgcggcctgaagcgtcagccgatcgatgacggcgccgaagccggcgacatcgtcgccatcgccggcctgagcaaggccaccgtggccgatacgctctgcgccctggacgtcaacgaagccctgccggcccagccgatcgacccgccgaccatctcgatgaccgtctcggtcaatgacagcccgctggccggccgcgaaggcgacaaggtccagtcgcgcgtcatccgcgaccgcctcttgaaggaagccgagagcaacgtggccatccgcgtcaccgagacctcggaacgcgacgcctacgaagtggccggccgcggcgaactgcagctgggcgtgctgatcgagaacatgcgccgcgaaggcttcgaagtgtcgatcagccgtccgcgcgtggtctatcagaccggcgagaacggcgagcgcctggagccgatggaagacgtgatgatcgacgtggacgacgagttcaccggcatcgtcatcgaaaagctgtcggcccgtaaggccgagctgaaggacatgggtccgtcgggcgcgggcaagacccgcatcaccctgctctcgccgtcgcgctcgctgatcggctatcagggcgagttcctgaccgacacgcgcggttcgggcgtgctgaaccgcgtgttcagccactacgagccgcacaagggcccgatcgaccagcagcgcaagggcgtgctggtgtcgaactcggacggtgaaacggcggcctacgcgctgtggaacctggaagagcgcggcgtgatgttcgtcggcgccggcgagaagacctaccagggcatgatcatcggcgagaacagccgctcggacgacctggacgtcaacccgatgaaggccaagcagctgaccaacgtccgcgcctcgggcaaggacgagtcgatccgcctgaccccgccgcgccgcatgaccctggaacaggccatcgcctatatcgaggacgatgagctggtcgaggtgaccccgaagaacatccgcctgcgcaagcaggtcctgaacccctcgttccgcaagaagcgcacgaaggaagactag

SEQ ID NO: 3482 - protein, 610 aa, Caulobacter crescentus CB15
MSMRNIAIIAHVDHGKTTLVDQLLAQSGVFRANEATTERAMDSNDQERERGITILAKCTSVLWNGEAGETRINIIDTPGHADFGGEVERILGMVDGCVLLVDAEEGVMPQTKFVLTKALKMGLRPILCINKVDRAHADPDRVHNAAFDLFAAIGATDEQLDFPHIYASGRAGWATLDLNQPSDNLAPLFDLIVRHVPEPKQIAKKDEPFQILSVLIESDPFLGRLLTGRIESGKAVPGMAIKALDRDGKEIERGRITKVLAFRGLKRQPIDDGAEAGDIVAIAGLSKATVADTLCALDVNEALPAQPIDPPTISMTVSVNDSPLAGREGDKVQSRVIRDRLLKEAESNVAIRVTETSERDAYEVAGRGELQLGVLIENMRREGFEVSISRPRVVYQTGENGERLEPMEDVMIDVDDEFTGIVIEKLSARKAELKDMGPSGAGKTRITLLSPSRSLIGYQGEFLTDTRGSGVLNRVFSHYEPHKGPIDQQRKGVLVSNSDGETAAYALWNLEERGVMFVGAGEKTYQGMIIGENSRSDDLDVNPMKAKQLTNVRASGKDESIRLTPPRRMTLEQAIAYIEDDELVEVTPKNIRLRKQVLNPSFRKKRTKED

SEQ ID NO: 3483 - DNA, 1824 bp, Salmonella typhimurium LT2
  CDS (1)..(1824): transl_table=11
gtgatcgaaaatttgcgtaacatcgccatcatcgcgcacgttgaccatggtaaaactaccctggttgataagctgctccagcaatccggtacgttcgacgcgcgtgccgaaactcaagagcgagtgatggactccaacgatttggagaaagagcgtggtattactatcctcgctaaaaacaccgctattaaatggaatgattaccgtatcaacatcgttgatactcccgggcacgctgacttcggtggtgaagtagagcgcgtcatgtccatggttgactctgtgctgctggtggttgacgcatttgacggcccgatgccgcaaacgcgcttcgtgaccaaaaaagcctttgctcatggcctgaaacccattgtggttatcaacaaagttgaccgtcctggcgcgcgccctgactgggttgttgaccaggtattcgacctgtttgttaacctcgacgcgaccgacgaacagctggacttcccgatcatctacgcttcggcgctgaacggtatcgcgggtctggaccacgaagatatggcggaagacatgaccccgctatatcaggcgattgttgatcatgttccggcgccggacgttgacctcgatggtccgttgcagatgcagatctcccagctggactacaacaactatgttggcgttatcggcattggccgtatcaaacgcggcaaagtgaagccgaaccagcaggtcactatcatcgatagtgaagggaaaacccgtaacgcgaaagtaggtaaagtgctgacgcatctgggtctggagcgtatcgacagcaatatcgccgaagcgggcgatatcattgcgatcaccggtctgggcgagctgaacatttccgacaccatctgcgacccgcagaacgttgaagcgctgccggcgctgtccgttgatgagccgaccgtgtctatgttcttctgcgttaacacctcgccgttctgcggtaaagaaggtaagtttgtgacttctcgtcagattcttgaccgtctgaacaaagagctggtgcataacgtggcgctgcgcgttgaagaaaccgaagatgcggatgcgttccgtgtatccggtcgtggcgaactgcacctgtccgtgctgattgaaaatatgcgtcgtgaaggtttcgaactggcggtttcccgtccgaaagttatcttccgtgaaatcgacggtcgtaaacaagagccgtacgaaaacgtgacgctggacgtcgaagagcagcaccaggggtctgtcatgcaggcgctgggcgagcgtaaaggcgacctgaaaaacatgaatccggacggtaaaggccgcgtacgtctcgactacgtgatcccaagccgtgggctgattggtttccgttcagaattcatgaccatgacttccggtacgggtctgctgtactccaccttcagccattacgacgatattcgtccgggtgaagtgggccagcgtcagaacggcgtactgatctccaacggtcagggtaaagcggtggcgtttgcgctgttcggtttgcaggatcgcggtaagctgttcctgggtcacggcgcggaagtttatgaaggccagattattggtattcacagtcgctccaacgacctgacggtaaactgcctgaccggtaagaaactgaccaacatgcgtgcgtccggtacggatgaagcggtgattctggttccgccaattaaaatgagccttgagcaagcgctggagttcattgatgacgacgaactggtagaagtcaccccaacctctatccgtatccgtaaacgtcacctgacggaaaacgatcgccgccgtgcgaaccgtggtcagaaagaagagtaa

SEQ ID NO: 3484 - protein, 607 aa, Salmonella typhimurium LT2
MIENLRNIAIIAHVDHGKTTLVDKLLQQSGTFDARAETQERVMDSNDLEKERGITILAKNTAIKWNDYRINIVDTPGHADFGGEVERVMSMVDSVLLVVDAFDGPMPQTRFVTKKAFAHGLKPIVVINKVDRPGARPDWVVDQVFDLFVNLDATDEQLDFPIIYASALNGIAGLDHEDMAEDMTPLYQAIVDHVPAPDVDLDGPLQMQISQLDYNNYVGVIGIGRIKRGKVKPNQQVTIIDSEGKTRNAKVGKVLTHLGLERIDSNIAEAGDIIAITGLGELNISDTICDPQNVEALPALSVDEPTVSMFFCVNTSPFCGKEGKFVTSRQILDRLNKELVHNVALRVEETEDADAFRVSGRGELHLSVLIENMRREGFELAVSRPKVIFREIDGRKQEPYENVTLDVEEQHQGSVMQALGERKGDLKNMNPDGKGRVRLDYVIPSRGLIGFRSEFMTMTSGTGLLYSTFSHYDDIRPGEVGQRQNGVLISNGQGKAVAFALFGLQDRGKLFLGHGAEVYEGQIIGIHSRSNDLTVNCLTGKKLTNMRASGTDEAVILVPPIKMSLEQALEFIDDDELVEVTPTSIRIRKRHLTENDRRRANRGQKEE

SEQ ID NO: 3485 - DNA, 1839 bp, Listeria innocua Clip11262
  CDS (1)..(1839): transl_table=11
ttgaatttaagaaacgatattcgtaatgtagcaattattgcccacgttgaccatggtaaaactacactagtagaccaattactacgccaatcaggtactttccgcgacaatgaaacagttgcagaacgtgcaatggacaacaatgatttagaaagagaacgcggtattacaattttagcgaaaaatacagcaattaagtatgaagatacacgcgtaaacatcatggatacacctggacacgccgattttggtggagaagtagaacgtatcatgaaaatggttgatggtgttcttttagtagtggacgcgtatgaaggtactatgcctcaaacacgttttgtactaaaaaaagcactagaacaaaacctaactccaatcgtagtagtaaacaaaattgaccgtgactttgctcgcccagaagaagttgttgatgaagtactagaattattcatcgaactaggtgcgaacgacgatcaattagaattcccagttgtttatgcttctgcaattaacggaacttcaagctttgaatccgacccagcagaacaaaaagaaacaatgaaaccacttttagacactattattgaacatattccagctccagttgataacagcgacgagccattacaattccaagtttctttacttgattataatgactatgttggtcgtattggtattggccgcgttttccgtggaacaatgcacgtaggacaaacagttgccttaattaaactagacggcacagtaaaacaattccgtgtaacgaaaatgttcggtttcttcggactaaaacgtgacgaaattaaagaagcaaaagcgggtgacttagtagcacttgcaggaatggaagacatcttcgtcggtgaaacagtaacaccatttgaccaccaagaagcacttccacttttacgtattgatgagccaaccttgcaaatgacttttgtaacaaataacagtcctttcgcaggccgtgaaggtaaacacgtaacaagccgtaaaattgaagaacgcttacttgcagaacttcaaacggatgtatctttacgcgttgaaccaacagcttctccagacgcatgggtagtatctggtcgtggtgagcttcacttgtctatcttaattgaaacgatgcgtcgtgaaggttatgagttacaagtttctaaaccagaagtaatcatccgtgaaatcgatggcgtgaaatgtgaaccagtagaagacgttcaaattgatactccagaagaattcatgggttcagttattgaatctatcagccaacgtaaaggcgaaatgaaaaacatgattaacgacggcaatggccaagttcgtttacaattcatggttccagctcgtggattaatcggttatacaactgatttcctttcaatgacacgtggttatggtattatcaaccatacattcgatagctaccaaccaatccaaaaaggtcgcgttggtggacgtagccgtggtgttcttgtatccatggaaacaggtaaatctactacttacggaacaatgcaagtagaagatcgtggtactatttttgtagaaccaggaactgatatttacgaaggtatgatcgttggagaaaacaaccgtgaaggcgatatcgctgtaaacattgtaaaagcaaaacaaatgactaacattcgttctgctaacaaagaccaaaccaacgttatcaaaaaacctcgtcacttatcattagaagaatcattagaattcctaaacgaagatgaatactgtgaagttacaccagaatccatccgtttacgtaaaaaaattctaaacaaaaacgaacgtgaaaaagcagcaaaacgttcaaaaactgctgaataa

SEQ ID NO: 3486 - protein, 612 aa, Listeria innocua Clip11262
MNLRNDIRNVAIIAHVDHGKTTLVDQLLRQSGTFRDNETVAERAMDNNDLERERGITILAKNTAIKYEDTRVNIMDTPGHADFGGEVERIMKMVDGVLLVVDAYEGTMPQTRFVLKKALEQNLTPIVVVNKIDRDFARPEEVVDEVLELFIELGANDDQLEFPVVYASAINGTSSFESDPAEQKETMKPLLDTIIEHIPAPVDNSDEPLQFQVSLLDYNDYVGRIGIGRVFRGTMHVGQTVALIKLDGTVKQFRVTKMFGFFGLKRDEIKEAKAGDLVALAGMEDIFVGETVTPFDHQEALPLLRIDEPTLQMTFVTNNSPFAGREGKHVTSRKIEERLLAELQTDVSLRVEPTASPDAWVVSGRGELHLSILIETMRREGYELQVSKPEVIIREIDGVKCEPVEDVQIDTPEEFMGSVIESISQRKGEMKNMINDGNGQVRLQFMVPARGLIGYTTDFLSMTRGYGIINHTFDSYQPIQKGRVGGRSRGVLVSMETGKSTTYGTMQVEDRGTIFVEPGTDIYEGMIVGENNREGDIAVNIVKAKQMTNIRSANKDQTNVIKKPRHLSLEESLEFLNEDEYCEVTPESIRLRKKILNKNEREKAAKRSKTAE

SEQ ID NO: 3487 - DNA, 1791 bp, Nostoc sp. PCC 7120
  CDS (1)..(1791): transl_table=11
atgacgctcccaattcgtaacgtcgccatcatcgcccacgttgaccacggcaaaaccaccctggttgatgcactcctcaaacaatccggcattttccgcgaaggcgaagacgttccggattgcgttatggactccaacgctttagagcgagaacggggtattactattctgtcgaaaaatacagctgttcgttacaaagaaacactaatcaatattgttgatacccctggacacgccgattttggtggtgaagtggaacgggtactcggcatggttgacggatgtctgctgattgttgatgccaatgaaggccccatgcctcaaacacggtttgtgttgaaaaaagctttagaaaaaggcttgcgccccatcgttgtcatcaataagattgaccgcgctaaagccgacccccacgttgctgtggataaggtgttggatctgttcttagaattaggtgcagacgaagaccagtgtgattttacctacctgtttgcttccggtatgggcggttatgccaaggaaagcatggaagcagaggcggtagatatgcagcccctgtttaatgcgattctgcaacacgttccaccaccagtaggcgacatcaacaagcccctacaattgcaagtcacaaccctagattattctgaatatttgggacggattgtcattggcagaatccacaatggtactatccgcgctggtcagcaagcggctctggttacagaaagtggctctattgtcaagggaaaaatcaccaagttgatgggatttgaagggctgaagcgggtagagatggaagaagcaaccgcaggttatattgttgcggtggctggttttgctgatgcttacatcggtgaaacaattactgatccaaccgaaccccaagctttaccactaattaaagtggatgagcctaccttacagatgaccttctgggtaaacgattcaccctttgctggtcaagaaggtaaattggtgacatccagacaagtacgcgatcgcctattccgcgaactagaaaccaacgttgctttacgcgttgaagaaaccgactcccccgacaaattcctagtttccggtcgtggagaactgcacctgggtatcttaatcgaaaccatgcgccgcgaaggttttgagttccaagtatctcagccacaagtaatttaccgcgaaatcaacggtcaaccttgcgaaccttatgaattgttggtgttagacgttcctgctgattctgtcggtagctgtatcgaacgtctaggacaacgcaaaggcgaaatgcaagatatgcagcctggaagtggcgatcgcacccagctagagtttgtcattcccgcccgtggtttgattggtttccgtggtgaattcatgcggatgacccgtggtgaaggcatcatgaatcacagcttcttagattaccgtcaactcagtggtgatattgaagcccgtaacaaaggcgttctcatctcctttgaagaaggcgtttctactttctacgccatgaagaacgctgaagatagaggctcattcttcattactcccggtactaaagtttaccgaggcatgattgtcggtgaacacaatcgccctcaagacttagaattgaatgtctgcaaaaccaagcagttaactaaccaccgtgctgctggtggtgatgaattggttcagttgcaagcaccaatcgacatgagtttagagcgtgcattagagtacatcggccccgatgagttagtggaagttacaccccaatcaatccgtctacggaagatgtcgaagaaattggcaaaacgataa

SEQ ID NO: 3488 - protein, 596 aa, Nostoc sp. PCC 7120
MTLPIRNVAIIAHVDHGKTTLVDALLKQSGIFREGEDVPDCVMDSNALERERGITILSKNTAVRYKETLINIVDTPGHADFGGEVERVLGMVDGCLLIVDANEGPMPQTRFVLKKALEKGLRPIVVINKIDRAKADPHVAVDKVLDLFLELGADEDQCDFTYLFASGMGGYAKESMEAEAVDMQPLFNAILQHVPPPVGDINKPLQLQVTTLDYSEYLGRIVIGRIHNGTIRAGQQAALVTESGSIVKGKITKLMGFEGLKRVEMEEATAGYIVAVAGFADAYIGETITDPTEPQALPLIKVDEPTLQMTFWVNDSPFAGQEGKLVTSRQVRDRLFRELETNVALRVEETDSPDKFLVSGRGELHLGILIETMRREGFEFQVSQPQVIYREINGQPCEPYELLVLDVPADSVGSCIERLGQRKGEMQDMQPGSGDRTQLEFVIPARGLIGFRGEFMRMTRGEGIMNHSFLDYRQLSGDIEARNKGVLISFEEGVSTFYAMKNAEDRGSFFITPGTKVYRGMIVGEHNRPQDLELNVCKTKQLTNHRAAGGDELVQLQAPIDMSLERALEYIGPDELVEVTPQSIRLRKMSKKLAKR

SEQ ID NO: 3489 - DNA, 1821 bp, Ralstonia solanacearum GMI1000
  CDS (1)..(1821): transl_table=11
atgcgcgcgcttcgcaacatcgccatcattgcccacgttgaccacggcaagaccacgctggtcgaccagctcctccgccaagccggcacgttccgcgagaacgagcagatcgccgagcgcgtgatggactcgaacgacatcgaaaaagagcgcggcatcacgatcctggccaagaactgcgcggtcgagtacaacggcacgcacatcaacatcgtcgacaccccgggccacgccgacttcggcggcgaagtggagcgcgtgctgtcgatggtcgacggcgtgctgctgctggtggacgcggtggaaggtccgatgccgcagacgcgcttcgtgacgcgcaaggcactggcgctgggcctgaagcccatcgtcgtgatcaacaaggtggaccgtccgggcgcccgtccggagtgggtgatcaaccagaccttcgacctgttcgacaagctgggcgccaatgatgatcagctcgatttcccggtggtgtacgcctcgggcctgaacggctatgccggcctgaccgacgacgtgcgcagcggcgacatgaagccgctgttcgagaccatcctcgacaaggtgccgcagcgtaacgacgacccgaacggctcgttccagctgcagatcatctcgctcgattactcgagctacgtcggcaagatcggcgtgggccgcatcacgcgcggccgtgtgcgtccgctgcaagacgtggtggtcaagttcggcccggaaggtgccccgatcaagggccgcgtcaaccaggtgctgaagttccgtggcctggagcgcgagctggtgcaggaagcggaagccggcgacatcgtgctgatcaacggcattgatgagctgggcatcggctgcaccgtgtgcgcgccggacgcgcaagacgccctgccgatgctgaaggtggacgagccgacgctgaccatgaacttctgcgtcaacacctcgccgctggcgggccgcgaaggcaagttcgtcaccagccgccagttgcgcgaccgcctggaccgcgagctgaagtccaacgtggcgctgcgcgtgaaggacaccggcgacgacacgatcttcgaagtgtcgggccgtggcgaactgcacctgaccatcctggtggaaaacatgcgccgcgagggctacgagctggccgtgtcgcgtccgcgcgtggtgttcaaggaaatcgacggcgtgaagcacgagccgttcgagcgcctgaccgtggacgtggaagacggccaccagggcggcgtgatggaagagctcggccgccgcaagggcgagctgctcgacatggcgtcggacggcaagggccggacccgcctggaataccgcattccggcgcgcggcctgatcggcttccagggtgagttcctgacgctgacgcgcggcaccggcctgatcagccacatcttcgacgactactcgccggtcaaggaaggcgacctgggtgagcgccacaacggtgtgctgatctcgcaggacgacggcgctgccgtggcctacgcgctgtggaagctgcaggatcgcggccgcatgttcgtgtcgcccggcgatgcgctgtacgaaggcatgatcatcggcatccacagccgtgacaacgacctcgtcgtcaacccgatcaagggcaagcagctgaccaacgtgcgtgcttcgggcaccgatgaggccgtgcgcctggtgccgccgatccagatgtcgctggaatacgcggtggaattcatcgccgacgacgaactggtcgaggtcacgcccaagagcatccgtctgcgcaagcgtcacctgaaggaacacgagcgcaagcgcgcctcgcgtgaagaagcggtctga

SEQ ID NO: 3490 - protein, 606 aa, Ralstonia solanacearum GMI1000
MRALRNIAIIAHVDHGKTTLVDQLLRQAGTFRENEQIAERVMDSNDIEKERGITILAKNCAVEYNGTHINIVDTPGHADFGGEVERVLSMVDGVLLLVDAVEGPMPQTRFVTRKALALGLKPIVVINKVDRPGARPEWVINQTFDLFDKLGANDDQLDFPVVYASGLNGYAGLTDDVRSGDMKPLFETILDKVPQRNDDPNGSFQLQIISLDYSSYVGKIGVGRITRGRVRPLQDVVVKFGPEGAPIKGRVNQVLKFRGLERELVQEAEAGDIVLINGIDELGIGCTVCAPDAQDALPMLKVDEPTLTMNFCVNTSPLAGREGKFVTSRQLRDRLDRELKSNVALRVKDTGDDTIFEVSGRGELHLTILVENMRREGYELAVSRPRVVFKEIDGVKHEPFERLTVDVEDGHQGGVMEELGRRKGELLDMASDGKGRTRLEYRIPARGLIGFQGEFLTLTRGTGLISHIFDDYSPVKEGDLGERHNGVLISQDDGAAVAYALWKLQDRGRMFVSPGDALYEGMIIGIHSRDNDLVVNPIKGKQLTNVRASGTDEAVRLVPPIQMSLEYAVEFIADDELVEVTPKSIRLRKRHLKEHERKRASREEAV

SEQ ID NO: 3491 - DNA, 1833 bp, Clostridium perfringens str. 13
  CDS (1)..(1833): transl_table=11
atgagtaacgaatttacaagaaatgatattagaaatatagctataatcgctcacgttgaccatggtaaaacaactttagttgacgcattattaagacaaagtaacgtttttagaacaaacgaaaaagtagaagagagagtaatggactcaaatgacttagaaaaagaaagaggtattacaatactttcaaaaaatacagcagttcattataacggagttaaaataaatataatagatacaccaggacacgctgacttcggaggagaggttgaacgtgtacttaaaatggtagaaagtgttttacttgtagtagactcatatgaaggggctatgcctcaaacaaaattcgttttaagaaaagctcttgagttaggattaaaaccaatagttgttataaacaaaatagataaaccagatgctagaccagaagaagttattgatgaaatatttgaattattcttagagcttggtgcagatgatgagcaattagatttcccaatagtttatgcttcagctagagatggagtagctacaattaacatagatgagccaaaagataacatgaaagatttattcgatactataatcgaaaaagttgaatcaccaaagggatctatagaagaaagtttacaaatgttagttacaactttagattcaagtgaatatgttggtaaaatagctataggtaaaataactagaggaatagctaagaaaaaccaacaagctgctgttgtaagacaagatggaacagtaactaaattcaaaatatcaagtctttatactcatgatggattaaagagaatagaggttgatgaagctcaattaggagatatagttgcaataagcggtatatctgacgtaaatattggagaaactataacagatgcacaaaatccagaaggattaccatttgttaaaatagacgagcctacattaaacatgaactttatggttaatgactcaccatttgctggtagagaaggggatttcgtaacttcaagacatttaagagatagattattaaaagaattagaaactaacgtaagtttaaaagttaaagaaataactccagattgtttcgaagtaagtggtagaggagagttacatctttcaatacttatagaaacaatgagaagagaaggatatgaattccaagtttctaagccaaacgttataacaaaaatagatgaaaatggtgttaaggttgaaccaatagagcacttaactatagacgttccagaagaatttatgggacctgttatggaaaaattaggacctagaaaagctgaaatggtaaatatgacttcagcggttaatggatactcaagattagagttcaaaatacctgcaagaggacttataggatttagaaatgaattcatgacagatacaaaaggtaacggaataatgaaccatgtatttgatggatttgaaaaatacaaaggagagatcccaggaagaagtagaggatcaatcgtagtatttgaatcaggagaagcagttacatatggattatttaatgctcaagaaagaggaactttattcatagagccaggtacagaagtttatgctggaatggtttgtggagaatgttcaagagcagatgacatagacgttaatatttgtaagaaaaaacaattaactaatacaagatcatctggagctgatgatgctttaaaattaactccagtaagacaaatgtcattagagcaatgtttagaattcataaacaatgacgaattagttgaagttactccagtaaatgtaagaatgagaaagagaatcttagacagtgctgagagaaagagagctataaatagaagtaaaaaataa

SEQ ID NO: 3492 - protein, 610 aa, Clostridium perfringens str. 13
MSNEFTRNDIRNIAIIAHVDHGKTTLVDALLRQSNVFRTNEKVEERVMDSNDLEKERGITILSKNTAVHYNGVKINIIDTPGHADFGGEVERVLKMVESVLLVVDSYEGAMPQTKFVLRKALELGLKPIVVINKIDKPDARPEEVIDEIFELFLELGADDEQLDFPIVYASARDGVATINIDEPKDNMKDLFDTIIEKVESPKGSIEESLQMLVTTLDSSEYVGKIAIGKITRGIAKKNQQAAVVRQDGTVTKFKISSLYTHDGLKRIEVDEAQLGDIVAISGISDVNIGETITDAQNPEGLPFVKIDEPTLNMNFMVNDSPFAGREGDFVTSRHLRDRLLKELETNVSLKVKEITPDCFEVSGRGELHLSILIETMRREGYEFQVSKPNVITKIDENGVKVEPIEHLTIDVPEEFMGPVMEKLGPRKAEMVNMTSAVNGYSRLEFKIPARGLIGFRNEFMTDTKGNGIMNHVFDGFEKYKGEIPGRSRGSIVVFESGEAVTYGLFNAQERGTLFIEPGTEVYAGMVCGECSRADDIDVNICKKKQLTNTRSSGADDALKLTPVRQMSLEQCLEFINNDELVEVTPVNVRMRKRILDSAERKRAINRSKK

SEQ ID NO: 3493 - DNA, 2031 bp, Arabidopsis thaliana
  CDS (1)..(2031)
atggagctcagcttgagcacttcctccgcttctcctgcggttttgaggagacaagcttctcctctgcttcacaagcagcaagtgctcggcgtcagctttgcttccgcgctcaaacctggaggaggagctcttcgatttccttcccgccgtccgcttcctcgtcccatcacttgctccgcctctccatcaactgccgaaccagcctccgtagaggtgaagaagaagcagttggataggagggataacgtgaggaatatcgcaatcgttgcacatgttgatcatggcaaaactactttggttgattctatgcttaggcaagctaaggttttccgagataaccaagtcatgcaagagaggatcatggactcaaatgaccttgagcgtgaaagaggaatcactattcttagcaaaaatacctccatcacttacaaaaacactaaagtaaatattatagatactcctggccattctgactttgggggtgaagtggagcgtgtcttgaacatggttgatggagtgcttcttgtggtggactctgttgagggaccaatgccccagacaaggtttgttttaaagaaggctcttgagtttggacatgcagtggtcgtggtcgtaaacaagattgacaggccttctgctcgtcctgaatttgttgtcaattccacttttgaactatttattgaactaaatgcaacagatgaacagtgtgatttccaagcgatatatgctagtgggattaaaggaaaggcggggctttctccggatgaccttgcagaagacctgggacccctgttcgaagctataatcagatgcgtacctgggccaaatattgaaaaagatggtgcacttcagatgcttgccacaaatattgagtatgatgagcataaaggacgcattgctattggacgactacacgcaggggtactgcgcaaaggaatggatgtcagggtgtgcacttctgaagattcctgtagatttgcaagagttagtgagctttttgtatatgagaaattctacagagtacctactgattcagtggaagctggagatatttgcgctgtatgtggcatagacaacattcagattggggagactattgctgataaagtacatgggaagcctctacctacaatcaaagtagaagagccaactgtgaaaatgtccttctctgtaaacacctctccattttctggtcgtgaggggaagtatgtaacaagcaggaacttacgagatcgtttaaaccgtgaacttgaaagaaatctagctatgaaagtggaagatggtgagacagcagacacattcattgttagtgggcgtggtacattacacattaccatcctgatagaaaacatgcgaagagaaggatatgaatttatggttggccccccgaaagttatcaacaaaagggttaacgataaattgctggagccatatgagatagcaactgttgaagtaccagaggctcacatggggcctgttgttgaacttcttggcaaaaggcgtggacagatgtttgatatgcagggtgttgggtcggaaggaacaacctttctgcggtacaaaatcccaacacgtggacttcttggattgaggaacgcaattttaacagcttctcgcgggacagctatccttaacactgtatttgacagttatggaccttgggccggtgatattagcacccgcgatctaggttcgctggttgcctttgaagatggaacatcaacatcatatgccctggcgagtgcgcaggagagagggcaaatgtttgtaggttctggagtggatgtatacaaaggtcagatagttgggatccaccagagacccggcgacttgggtcttaatatctgcaagaagaaggcagcgacaaacataagatccaacaaagatgtaacagtgattcttgacactcccttaacatatagtctggacgactgcatcgaatacattgaagaggatgagttggtggaggttacaccttctagtattaggatgtgcaagaatcagaaaatggcaaagaaaggcaggcagtaa

SEQ ID NO: 3494 - protein, 676 aa, Arabidopsis thaliana
MELSLSTSSASPAVLRRQASPLLHKQQVLGVSFASALKPGGGALRFPSRRPLPRPITCSASPSTAEPASVEVKKKQLDRRDNVRNIAIVAHVDHGKTTLVDSMLRQAKVFRDNQVMQERIMDSNDLERERGITILSKNTSITYKNTKVNIIDTPGHSDFGGEVERVLNMVDGVLLVVDSVEGPMPQTRFVLKKALEFGHAVVVVVNKIDRPSARPEFVVNSTFELFIELNATDEQCDFQAIYASGIKGKAGLSPDDLAEDLGPLFEAIIRCVPGPNIEKDGALQMLATNIEYDEHKGRIAIGRLHAGVLRKGMDVRVCTSEDSCRFARVSELFVYEKFYRVPTDSVEAGDICAVCGIDNIQIGETIADKVHGKPLPTIKVEEPTVKMSFSVNTSPFSGREGKYVTSRNLRDRLNRELERNLAMKVEDGETADTFIVSGRGTLHITILIENMRREGYEFMVGPPKVINKRVNDKLLEPYEIATVEVPEAHMGPVVELLGKRRGQMFDMQGVGSEGTTFLRYKIPTRGLLGLRNAILTASRGTAILNTVFDSYGPWAGDISTRDLGSLVAFEDGTSTSYALASAQERGQMFVGSGVDVYKGQIVGIHQRPGDLGLNICKKKAATNIRSNKDVTVILDTPLTYSLDDCIEYIEEDELVEVTPSSIRMCKNQKMAKKGRQ

SEQ ID NO: 3495 - DNA, 1914 bp, Corynebacterium glutamicum ATCC 13032
  CDS (1)..(1914): transl_table=11
gtgacccacccagagtttcgtaacgtagcgattgtcgcgcacgttgaccacggaaagaccacactcgttaatgccatgcttgaacagtctggcgtattcagtgaccacggtgaagtagccgaccgtgtgatggactccggtgacctggaaaaggaaaagggcatcaccatccttgccaagaacaccgcgattcgtcgtaaaggcgctggcaaggacggcaatgacctgattatcaacgtcattgacaccccaggccacgctgacttcggtggcgaagttgagcgcgcactgtccatggttgacggcgttgtccttctggttgacgcatctgaaggcccactgcctcagacccgattcgtgcttggcaaggctcttgctgcgaagatgccagtcatcattgctgtgaacaagactgaccgccctgacgctcgtattgacgaggttgttgaagaggcacaggatctgcttcttgagctcgcatctgcacttgatgatgaagaagcagcacaggcagctgagcagcttcttgatctgccagttctgtacacctccggtcgtgagggcaaggcttccactgagaacccaggcaacggcaacgttcctaattccccagatctgatgcctttgtttgagaccctctacgaggttctcccagagccaaccgctgacattgatggccctctgcaggctcacgtcaccaaccttgactcttcctccttccttggtcgtatcggcctggttcgcgttcacgcaggtaccttgcgtaagggccagcaggttgcatggattcactacgatgaagaaggtaaccagcacaccaagaccgctaagatcgcagagcttctggctaccgttggcgttgcccgcgttcctgctaccgaagttgttgcaggtgacatcgctgctatctccggcatcgaagacatcatgattggcgataccctcgcggatcctgagaacccagttgcactgcctcgcatcaccgttgatgagccagcactgtccatgaccatcggtgtgaacacctcaccaatggctggtcgtggcggcggagacaagctgaccgcacgtgtggtcaaggctcgtcttgagaacgaactgatcggtaacgtgtccctgaaggtcaacccaactgagcgcccagatacctgggaagttcagggtcgtggcgaaatggctctgtccatcctcgttgagaccatgcgtcgcgaaggcttcgagctcaccgttggtaagccacaggttgttacccagaccatcgacggcaagctgcacgagccttacgagatcatcgtcatcgacgttccttccgagtaccagggcaacgtgacccagctgctggctacccgcaagggcctcatgcagtccatgtccaccaccccaggttccgactggatccgcatggaattccgtattcctgctcgtggcctgattggtttccgtacccagttcatgactgaaacccgtggtaccggtatcgctaactcctactctgacggcatggatgtttgggctggcgaaatcaagggccgcgcacacggttccttggttgctgaccgttccggccagatcaccgcttacgctctgacccagctggcagaccgtggtagcttcttcgttgagccaggcactgagacctacgaaggtgtcgttgttggtctgaacaaccgtgaagaagacatggacatcaacccaaccaaggaaaagaagctcaccaacatgcgtgcagcttccgcagacaccactgtcaccttggctaaggctcggtctctctccttggatgaggcactggagttctgtggcgtcgacgagtgcgtcgaggttacccctgatgttctgcgcatccgcaaggtcatcctgaacgctactgagcgtggccgtgcacgttcccgtgcgaagagcctgaacaagtaa

SEQ ID NO: 3496 - protein, 637 aa, Corynebacterium glutamicum ATCC 13032
MTHPEFRNVAIVAHVDHGKTTLVNAMLEQSGVFSDHGEVADRVMDSGDLEKEKGITILAKNTAIRRKGAGKDGNDLIINVIDTPGHADFGGEVERALSMVDGVVLLVDASEGPLPQTRFVLGKALAAKMPVIIAVNKTDRPDARIDEVVEEAQDLLLELASALDDEEAAQAAEQLLDLPVLYTSGREGKASTENPGNGNVPNSPDLMPLFETLYEVLPEPTADIDGPLQAHVTNLDSSSFLGRIGLVRVHAGTLRKGQQVAWIHYDEEGNQHTKTAKIAELLATVGVARVPATEVVAGDIAAISGIEDIMIGDTLADPENPVALPRITVDEPALSMTIGVNTSPMAGRGGGDKLTARVVKARLENELIGNVSLKVNPTERPDTWEVQGRGEMALSILVETMRREGFELTVGKPQVVTQTIDGKLHEPYEIIVIDVPSEYQGNVTQLLATRKGLMQSMSTTPGSDWIRMEFRIPARGLIGFRTQFMTETRGTGIANSYSDGMDVWAGEIKGRAHGSLVADRSGQITAYALTQLADRGSFFVEPGTETYEGVVVGLNNREEDMDINPTKEKKLTNMRAASADTTVTLAKARSLSLDEALEFCGVDECVEVTPDVLRIRKVILNATERGRARSRAKSLNK

SEQ ID NO: 3497 - DNA, 1818 bp, Fusobacterium nucleatum subsp. nucleatum ATCC 25586
  CDS (1)..(1818): transl_table=11
atgaaaattaaaaacatagcaattattgcccatgttgaccatggtaaaacaacacttgtagattgtctgttaagacaagggggagtttttaaaactcatgaacttgaaaaagttgaagaaagagttatggactcagatgatattgaaagagaaagaggaattacaattttctctaaaaatgcttctgttaaatataaagactataagattaacatagttgatacaccaggacatgctgattttggtggagaagtacagagaattatgaagatggttgattctgtacttttacttgtagatgcttttgaaggacctatgcctcaaacaaaatatgttttgaaaaaagctttggaacaaggacatagaccaatagttgtagtaaacaaagttgataaacctaatgctagaccagaagatgtactatatatggtttatgatttatttatagaattaaatgctaatgaatatcaacttgaatttccagttatttatgcatcaggaaaatcaggttttgctagaaaagaattgactgatgaaaatatggatatgcaaccattatttgaaacaatattagaacatgtccaagaccctgatggagatgtaacaaaacctactcaatttttaataacaaatatcgcttatgataattatgttggaaagttagcagttggaagaatacataatggaactttaaaaagaaatcaagatgtaatgttaataaaaagagatggaaaacaagttagaggtaaagtttctgtcctatatggctatgaaggattaaaaagagttgaaatagaagaagcagaagctggagatatagtttgtgttgctggtattgatgatatagatataggagaaacattagctgatataaatgaacctgttgctttacctttgattgatattgatgagcctactcttgctatgacatttatggtaaatgattctccatttgttggaaaggaagggaaatttgtaacttcaagacatatttgggatagattacaaaaagaaattcaaacaaatgttagtatgagagtagaagcaactgattcacctgactcatttatagtaaaaggtagaggagagcttcaactttcaatattacttgaaaatatgagaagagaaggttttgaagtacaagtttctaaaccaagagttttatttaaagaaaaagatggaaaaaaattagaacctattgaacttgctttaattgatgtagatgatagttatactggtgttgtaattgaaaagatgggagttagaaaagcagaaatggtttctatggttccaggtcaagatggttatacaagacttgaatttaaagttccagcaagaggacttattggttttagaaatgaatttttaactgatactaagggaactggaattttaaatcattcattctttgattatgaagaatataagggagatatccctacaagaaataaaggagttttaattgcaactgaaccaggagttacagttccttatgctttgaataatttacaagatagaggaactttattcttagatccaggtgttcctgtgtatgaaggaatgatagttggagaacataacagagaaaatgatttagttgtaaatgtttgtaaaactaaaaaattaacaaatatgagagcagctggttctgatgatgcagttaaacttgcaactccaaggaaatttacattggaacaagcacttgattatattgcagaagatgaacttgtagaagttactcctacaaatatcagacttagaaagaaaatcttaaaagaaggagacagaagaaaaaactggtctgctactaataaatag

SEQ ID NO: 3498 - protein, 605 aa, Fusobacterium nucleatum subsp. nucleatum ATCC 25586
MKIKNIAIIAHVDHGKTTLVDCLLRQGGVFKTHELEKVEERVMDSDDIERERGITIFSKNASVKYKDYKINIVDTPGHADFGGEVQRIMKMVDSVLLLVDAFEGPMPQTKYVLKKALEQGHRPIVVVNKVDKPNARPEDVLYMVYDLFIELNANEYQLEFPVIYASGKSGFARKELTDENMDMQPLFETILEHVQDPDGDVTKPTQFLITNIAYDNYVGKLAVGRIHNGTLKRNQDVMLIKRDGKQVRGKVSVLYGYEGLKRVEIEEAEAGDIVCVAGIDDIDIGETLADINEPVALPLIDIDEPTLAMTFMVNDSPFVGKEGKFVTSRHIWDRLQKEIQTNVSMRVEATDSPDSFIVKGRGELQLSILLENMRREGFEVQVSKPRVLFKEKDGKKLEPIELALIDVDDSYTGVVIEKMGVRKAEMVSMVPGQDGYTRLEFKVPARGLIGFRNEFLTDTKGTGILNHSFFDYEEYKGDIPTRNKGVLIATEPGVTVPYALNNLQDRGTLFLDPGVPVYEGMIVGEHNRENDLVVNVCKTKKLTNMRAAGSDDAVKLATPRKFTLEQALDYIAEDELVEVTPTNIRLRKKILKEGDRRKNWSATNK

SEQ ID NO: 3499 - DNA, 1842 bp, Streptococcus pyogenes MGAS8232
  CDS (1)..(1842): transl_table=11
atgactaacttaagaaacgatatccgtaacgtagcgattattgcccacgttgaccacggaaaaacaacacttgtagatgaattattaaaacaatcccatactcttgatgagcgtaaagagcttcaagagcgtgccatggattccaatgaccttgaaaaagaacgtgggattacgatccttgcgaaaaatacggcagtagcctataacgatgttcgtattaacatcatggataccccaggacacgcggacttcggtggtgaagttgaacgtatcatgaaaatggttgacggggttgttcttgttgtggatgcctacgaaggaacaatgccccagacgcgtttcgtattgaaaaaagcacttgagcaaaaccttatcccgatcgttgtggtgaacaagattgataaaccttcagctcgtccagcagaagttgtagatgaagtgcttgaattattcatcgaacttggtgccgatgatgagcaattggaattcccagttgtttacgcatcagctattaatggcacatcatcattatcagatgatcctgctgaccaagagcatactatggcacctatctttgatacgattattgatcatattccagcgccagttgataattcagatgagcctttgcaattccaagtgtcacttttggactacaacgatttcgtaggtcgtatcggtatcggtcgtgttttccgtggtactgttaaagtgggtgaccaagtaactctttcaaaacttgatggtaccactaaaaacttccgtgttacaaaactgtttggtttcttcggtttggaacgtcgtgaaattcaagaagctaaagcaggtgacttgattgctgtttcaggtatggaagatatctttgttggagaaaccattacaccaactgactgtgtggaagctctgccaattcttcgtattgatgagccaacgcttcagatgactttcttggtcaataactctccttttgcaggtcgtgagggtaaatggatcacgtcacgtaaggttgaagaacgtcttttagcagaattgcaaacagacgtgtcacttcgtgttgacccaacagattcgccagataaatggacgatttcagggcgtggagaattgcacttgtcaattcttatcgaaaccatgcgccgtgaaggctatgaacttcaagtatcacgtccagaagttatcatcaaagaaattgatggtgtcaaatgtgaaccgtttgagcgtgttcaaattgatacaccagaagaatatcagggtgcaatcatccagtctctttcagaacgtaaaggggatatgcttgatatgcagatggttggtaatggtcaaacgcgtttgattttcttgattcctgcacgtggtttgattggttattcaacagagtttctttcaatgacacgtggatatggtatcatgaatcatacttttgatcagtatctaccggttgttcaaggagaaattggtggccgtcatcgtggtgccttggtttctattgaaaatgggaaagcaacgacatattcaatcatgcgtattgaagaacgtggaactatctttgtcaatccaggtacagaagtttacgaagggatgattgttggtgaaaactcacgtgataacgaccttggtgttaacattacaacagctaagcaaatgacaaatgtccgttcagcgactaaagatcaaactgcagttatcaagacgcctcgtatcctaacgcttgaagaatcattagagttcttgaatgacgacgaatacatggaagtaacgccagaatctatccgcttgcgtaaacaaatcttgaataaagctgcgcgtgataaagctaataaaaagaaaaaatcagccgaatag

SEQ ID NO: 3500 - protein, 613 aa, Streptococcus pyogenes MGAS8232
MTNLRNDIRNVAIIAHVDHGKTTLVDELLKQSHTLDERKELQERAMDSNDLEKERGITILAKNTAVAYNDVRINIMDTPGHADFGGEVERIMKMVDGVVLVVDAYEGTMPQTRFVLKKALEQNLIPIVVVNKIDKPSARPAEVVDEVLELFIELGADDEQLEFPVVYASAINGTSSLSDDPADQEHTMAPIFDTIIDHIPAPVDNSDEPLQFQVSLLDYNDFVGRIGIGRVFRGTVKVGDQVTLSKLDGTTKNFRVTKLFGFFGLERREIQEAKAGDLIAVSGMEDIFVGETITPTDCVEALPILRIDEPTLQMTFLVNNSPFAGREGKWITSRKVEERLLAELQTDVSLRVDPTDSPDKWTISGRGELHLSILIETMRREGYELQVSRPEVIIKEIDGVKCEPFERVQIDTPEEYQGAIIQSLSERKGDMLDMQMVGNGQTRLIFLIPARGLIGYSTEFLSMTRGYGIMNHTFDQYLPVVQGEIGGRHRGALVSIENGKATTYSIMRIEERGTIFVNPGTEVYEGMIVGENSRDNDLGVNITTAKQMTNVRSATKDQTAVIKTPRILTLEESLEFLNDDEYMEVTPESIRLRKQILNKAARDKANKKKKSAE

SEQ ID NO: 3501 - DNA, 1821 bp, Thermoanaerobacter tengcongensis MB4
  CDS (1)..(1821): transl_table=11
atgagggcagtaagggaagatgtaagaaatgtagcgattatagctcatgtagaccacggcaagactactttggtggatgccatgttaaaacagagcggtatattcaggtggaatgagaaagtggaagagagaatacttgactttaatgaccttgaaagagaaagaggaataacaatattagctaagaatacggcggtaaggtataaaaatgtgaaaataaatatagttgatacgccaggacatgctgattttagcggtgaagttgaaagagtcttgaagatggtagatggagtgcttcttctggtagactcttttgaaggacctatgccccagacgagatttgttttgagcaaggctttggagcttgatttaaagccaatagttgtaataagtaaaattgataggcctgatgcaaggccaaatgaggtcattgacgaggtttttgacctctttatagagcttggcgccaatgatgaccagattgattttcctgttgtgtatacttctggaaaaggtggcatagcaaaattagatttaaaggaggaatctcgtgatttaaggcctctatttgaaactataataaaatacattcctgctccttcaggagacatagagggaccttttcagcttatagtcactactttggactatgacgactacatcggcaggattgctattggaaaggtagtgagaggcagaattaaagctggagaagaagtggcgatatgcaaaaagggtggaagtattcagaagttcaacataaacaacatataccaatttgagggattaagaagggtgcctgtggaagaggcaaaacttggggatatagtagccgtttcgggaattagagatattgagataggagagacaatagcggataaggacaaccctgaacctgtagactttgtagaaattgaggagcctactgtgtccatgacttttagtgtgaataccagtccctttgcaggaacagaagggaaatacgtgacttctagacatctaagagaaagactttttaaggaactggagacaaatgtggctttaagagtggaggagacagattcccctgattcttttaaggtttctggcagaggagaattgcacctttctattttgattgagactatgagaagggaaggatatgagctacaggtttcaaaacctacagttatattcaaggaagtaaatggagtaaagatggaacctattgagcttttgaccgtagatattccagaagagtacatgggagttgtaatggaaaaattggggcccaggaaagccgaattgatggacatgcacactttaaaaccggggactataaggcttaagtttaagattcctacaaggggtttgataggatacaggtcagagtttttgactgatacaaagggaaatggaataatgacctctgtgttttacggctatgaaccttacaaaggtgaaattccctctcgatcaaggggagctcttgttgcttttgagacgggtattgccacgacttacggcctttatcacgctcaggaaaggggaactctttttattgagccaggcaccaaggtgtacgaaggaatggttgtcggcatgaattcccgaagtggggatattgaagtcaatgtatgtaagaaaaaacacgtcaccaatttgcggtctgcaacggctgaagaagccctaaggctttctcctgtgaaaaagatgactttagaggaagctctagaatttatagataatgacgagttggtagaagttacgcctcagagcataagaataagaaagaaaattttggattcccagcagaggtacaaaagtgcaaaacaaaaatag

SEQ ID NO: 3502 - protein, 606 aa, Thermoanaerobacter tengcongensis MB4
MRAVREDVRNVAIIAHVDHGKTTLVDAMLKQSGIFRWNEKVEERILDFNDLERERGITILAKNTAVRYKNVKINIVDTPGHADFSGEVERVLKMVDGVLLLVDSFEGPMPQTRFVLSKALELDLKPIVVISKIDRPDARPNEVIDEVFDLFIELGANDDQIDFPVVYTSGKGGIAKLDLKEESRDLRPLFETIIKYIPAPSGDIEGPFQLIVTTLDYDDYIGRIAIGKVVRGRIKAGEEVAICKKGGSIQKFNINNIYQFEGLRRVPVEEAKLGDIVAVSGIRDIEIGETIADKDNPEPVDFVEIEEPTVSMTFSVNTSPFAGTEGKYVTSRHLRERLFKELETNVALRVEETDSPDSFKVSGRGELHLSILIETMRREGYELQVSKPTVIFKEVNGVKMEPIELLTVDIPEEYMGVVMEKLGPRKAELMDMHTLKPGTIRLKFKIPTRGLIGYRSEFLTDTKGNGIMTSVFYGYEPYKGEIPSRSRGALVAFETGIATTYGLYHAQERGTLFIEPGTKVYEGMVVGMNSRSGDIEVNVCKKKHVTNLRSATAEEALRLSPVKKMTLEEALEFIDNDELVEVTPQSIRIRKKILDSQQRYKSAKQK

SEQ ID NO: 3503 - DNA, 1908 bp, Streptomyces coelicolor A3(2)
  CDS (1)..(1908): transl_table=11
atggccacgcgccacgacatccgcaacgtcgccatcgtcgcccacgtcgaccacggcaagaccaccatcgtcgacggaatgctgaagcaggccggcgccttcgccgcgcaccagctcgaaggcgtcgacgaccgcatgatggactcgaacgacctggagcgtgagaagggcatcacgatcctcgccaagaacacggcggtgaagtaccacccgaaggatggcggcgacgtcatcaccatcaacatcatcgacacccccggccacgccgacttcggcggcgaggtcgagcgcggtctgtcgatggtcgacggtgtcgtgctgctcgtggacgcctccgagggtccgctgccgcagacccggttcgtgctgcgcaaggcgctcagccagcggctgccgatcatcctgtgcatcaacaagacggaccggccggacgcccgcatcgacgaggtcgtcaacgagacctacgacctcttcctcgacctggacgccgacgaggagcagatcgagttcccgatcgtctacgcctgcggccgggacggcgtcgcctccctcaccaagcccgaggacggcacggtcccctccgactccaccagcctggagccgttcttctcgacgatcctggaccacatcccggcgccgacctacgacgaggacgccccgctccaggcccacgtcaccaacctggacgccgacaacttcctcggccgcatcgcgctgctgcgcgtccaccagggcgagctgaagaagggccagaccgtcgcctggatgaagcgcgacgggtccgtgcagaacgtgcggatctccgagctgatgatgacggaggcgctcacccgcaagcccgccgagaaggccggccccggtgacatctgcgcggtcgccggcatcccggacatcatgatcggcgagaccctggccgacgtggagaacccggtcccgctgccgctgatcacggtggacgagcccgcgatctccatgaccatcggcaccaacacctccccgctggtcggccgcggcgccaccggcaagggcgccgacaacaaggcggtcgtcaaggaccgcaaggtcaccgcccgtcaggtcaaggaccgcctggaccgcgagctgatcggcaacgtctcgctccgcgtcctggacaccgagcgccccgacgcctgggaggtgcagggccgcggtgagctggcgctggccatcctggtcgagcagatgcgccgggagggcttcgagctgaccatcggcaagccgcaggtcgtcaccaaggaggtcgagggcaagacgtacgagcccgtcgagcggatgacgatcgacgtgcccgaggagcacatgggcgcggtcacgcagctcatgggcgtgcgcaagggccggatggacaacatgtccaaccacggctcgggctgggtccgcatggagttcgtggtcccctcccgcggcctgatcggattccggacggagttcctcacccagacccgcggcaccggcatcgcgcactccatccacgagggccacgagccctggttcggcaccctcacgacacgtaacaacggctcgctggtcgccgaccgctcgggtgccgtcaccgcgttcgcgatgaccaacctccaggagcgcggtgtgctcttcacggaccccggcaccgaggtgtacgagggcatgatcgtcggcgagaactcccgcgccgacgacatggacgtgaacatcaccaaggagaagaagctcaccaacatgcggtcgtcctcggccgactcgttcgaggcgatcgtcccgccgcgcaagctctccctggagcagtccctggagttctgccgcgacgacgagtgcgtcgaggtgacccccgaggccgtccggatccgcaaggtgaacctggacgcccgcgagcgcgcccgcgccgccagccgcgccaagcacggctga

SEQ ID NO: 3504 - protein, 635 aa, Streptomyces coelicolor A3(2)
MATRHDIRNVAIVAHVDHGKTTIVDGMLKQAGAFAAHQLEGVDDRMMDSNDLEREKGITILAKNTAVKYHPKDGGDVITINIIDTPGHADFGGEVERGLSMVDGVVLLVDASEGPLPQTRFVLRKALSQRLPIILCINKTDRPDARIDEVVNETYDLFLDLDADEEQIEFPIVYACGRDGVASLTKPEDGTVPSDSTSLEPFFSTILDHIPAPTYDEDAPLQAHVTNLDADNFLGRIALLRVHQGELKKGQTVAWMKRDGSVQNVRISELMMTEALTRKPAEKAGPGDICAVAGIPDIMIGETLADVENPVPLPLITVDEPAISMTIGTNTSPLVGRGATGKGADNKAVVKDRKVTARQVKDRLDRELIGNVSLRVLDTERPDAWEVQGRGELALAILVEQMRREGFELTIGKPQVVTKEVEGKTYEPVERMTIDVPEEHMGAVTQLMGVRKGRMDNMSNHGSGWVRMEFVVPSRGLIGFRTEFLTQTRGTGIAHSIHEGHEPWFGTLTTRNNGSLVADRSGAVTAFAMTNLQERGVLFTDPGTEVYEGMIVGENSRADDMDVNITKEKKLTNMRSSSADSFEAIVPPRKLSLEQSLEFCRDDECVEVTPEAVRIRKVNLDARERARAASRAKHG

SEQ ID NO: 3505 - DNA, 1830 bp, Xanthomonas axonopodis pv. citri str. 306
  CDS (1)..(1830): transl_table=11
atgtctatcgaaaaactccgcaatatcgccatcgtcgcgcacgtcgaccatggcaagaccaccctcgtcgactgcctgctgaagcagtccggcaccctgtccgaacgcaccgtgttggctgagcgcgtgatggacagcaacgaccaggaaaaggaacgtggcatcacgatcctggccaagaacaccgccatcacctggcagggcaaccgcatcaatatcgtcgacacccccggacacgccgacttcggtggcgaagtcgagcgcgtgctgtcgatggtggactcggtgctgatcctggtcgacgcgatggatggcccgatgccgcagacccgcttcgtgacccagaaggcctttgcgatgggcttcaagccgatcgtggtggtcaacaagatcgaccgtcccggcgcacgccctgactgggtgatcgaccaggtgttcgacctgttcgacaagctcggcgccaccgacgagcagctggatttcccgatcgtctacacctccgcactgaacggctacgcaagcctggattcggacgtgcgcgaaggcgacatgaccccgctgtacgaagcgatcatgcagcacgtgtcggccccggacgtggacccggacggcccgttccagatgcgcatcagccagctggactacaacaacttcgtgggcgtgatcggcatcggccgcatccagcgcggcaccctgaagaagaacatgccggtcagcgtgatcgaccgcgagggcaagaagcgccagggcaaggtgctgcaggtgctgggcttcctgggcctggagcgtatcgagcaggacaccgccgaggccggcgacatcgtggccatctccggcatccaggaactgaccatctccgacaccgtgtgcgcgctcgatcatcccgaagcgctgccggcgctgaccgtggacgagcccaccatctcgatgaccttccaggtcaacaactcgccgttcgccggtaacaaggacctgtccggcggcaagttcctgaccaaccgccagctgcgcgaccgtctggaccgcgagaaggtgcacaacgtggcgctgaaggtcgaggaaggctcggacgccgacaagttcctggtctccggccgtggcgagctgcacctgtcggtgctgatcgaaaacatgcgtcgtgaaggctacgagctggccgtgtcgcgtccggaagtgatcatcaaggaaatcgacggcaagctgatggagccgatcgaacagctggtggtggacatcgaagaacagcaccagggcggcgtgatggaaaagctgggcacccgcaagggccagctgaagaacatggaacccgacggcaagggccgcgtgcgtctggattacatgatcccggcgcgtggcctgatcggcttccagaacgaattccgcaccctgacccagggctcgggtctgctgttccacgtgttcgaccactacggtccgaaggaacagggcgcgatcgccaagcgccagaacggcgtgatgatcgccaatgcaccgggcgcgacgccggcttatgcgctgggaccgctggaagagcgtgggcgcctgttcgccgccgaaggcgacaacgtgtacgaaggccagctggtcggtatccattccaaggacaacgacctgaccgtcaacgcgatcaagaccaagccgctgaccaacatgcgcgcctcgggcaaggacgatgcgatcaagctgaccccggcgatcaagtacacgctggaacaggcgctggacttcatcgaggacgacgagctggtggaagtcacgccgaaggaaatccgcctgcgcaagaagttcctgaccgaaagcgaccgcaagcgtgctggccgttcgggctga

SEQ ID NO: 3506 - protein, 609 aa, Xanthomonas axonopodis pv. citri str. 306
MSIEKLRNIAIVAHVDHGKTTLVDCLLKQSGTLSERTVLAERVMDSNDQEKERGITILAKNTAITWQGNRINIVDTPGHADFGGEVERVLSMVDSVLILVDAMDGPMPQTRFVTQKAFAMGFKPIVVVNKIDRPGARPDWVIDQVFDLFDKLGATDEQLDFPIVYTSALNGYASLDSDVREGDMTPLYEAIMQHVSAPDVDPDGPFQMRISQLDYNNFVGVIGIGRIQRGTLKKNMPVSVIDREGKKRQGKVLQVLGFLGLERIEQDTAEAGDIVAISGIQELTISDTVCALDHPEALPALTVDEPTISMTFQVNNSPFAGNKDLSGGKFLTNRQLRDRLDREKVHNVALKVEEGSDADKFLVSGRGELHLSVLIENMRREGYELAVSRPEVIIKEIDGKLMEPIEQLVVDIEEQHQGGVMEKLGTRKGQLKNMEPDGKGRVRLDYMIPARGLIGFQNEFRTLTQGSGLLFHVFDHYGPKEQGAIAKRQNGVMIANAPGATPAYALGPLEERGRLFAAEGDNVYEGQLVGIHSKDNDLTVNAIKTKPLTNMRASGKDDAIKLTPAIKYTLEQALDFIEDDELVEVTPKEIRLRKKFLTESDRKRAGRSG

SEQ ID NO: 3507 - DNA, 1830 bp, Chlorobium tepidum TLS
  CDS (1)..(1830): transl_table=11
atgagcaggaaacagaatattcgcaatatcgccattatcgcgcacgtcgatcatggcaagaccaccctcgtggactccattttcaagcagacgggcgcgttcagggagaaccagcatgttgacgtcagggtgatggactccaatccgcaggagcgtgagcggggcatcaccattttttcgaaaaatgcagccgtgcagcacaaggggtgcaaaatcaatatcgtcgacacccccggtcacgccgatttcggcggcgaggtcgagcgcatcctgaagatggtcgatggcgtgctcctgcttgtcgatgctttcgaggggccgatgccgcagaccaagttcgtgcttcgcaaggcgctcgaactgcatctgaagccgatcgtggtcatcaacaagatcgaccgtccgcaggccgatccggagaaggtgcatgatcaggtgctcgaccttttcattgcgctcggcgctgacgaagatcagctcgatttcccctacatcttcgcttcggccaagaacggcattgccaaatgtaatatgtcggatccggacggcgacatgagccttctgctcgacatgatcgtcaaggagattcccgcccctgaagcggacgacgatgctggattccagatgctcgtcaccagcctcgactacagtgactatatcggcaagatcgccatcggccgcattcagcgcggcaaggttgcgcccggcaaccagctcacgctggtgacgcaggatggtgtggttggcaaaggtacggtcaccaagcttttccttttcgaccgcacgcagcgcgtcgaggcgatggaggcgacggcgggcgacatcgtcgcgcttgccggtatcgcggcggccaacgtcggtgaaacacttaccacccccgaccagcccgaaccgatcgaatcgttcgagatcagcaagccgacgctttccatgctcttttcagtgaacgactcgccgttcgccggtcaggagggcaaggaggtgaccagccgcaaaatccgcgagcggctcatgaaagagatcatgaccaacgtcgcgctcaacgtcgaggagaccgacagcgccgacaccttccgcgtgtcgggacgcggcgagcttcacctctccgtactgatcgagaccatgcgccgcgagggctacgaactggccatctcccgtcccgaggtgattcttcgcgaggagaacggcgtgacgatggagccggtcgagcatgttaccatcgacgttccggaagagtacaccggcgtggttatcgaaaagatgggccgcaggaaggccgagatgaccaacatgagcaccctgcgcggcggcatgaaccgcctggagttcgaaattccgacgcgcggcctgatcggttacaacctcgaattcaccaccgacaccaagggtgagggcatgatgtcgcacgtgttccacaactaccagccctacaaaggcaagctgccgtcgcgcgaaaccggcgctctggtctctgccgaaaccggcgtggccgtggcctatgcgatttcgagtctcgaagatcgaggcaccttcttcattgggccgaacgcgaaggtttatgaaggcatggtggttggcgaatcgactcgtgacctcgacatcacggtgaacatctgcaagaccaagaagctcaccaacatgcgtgcctccggctcggacgactcgatccgcctgacgccgccgaagaggctttcgcttgaacaggcgctggagtttatcaatgacgacgagctgctcgaagtgacgcccgagaacatcaggatccgcaagaagattctcaacgccgacctcagagccaaggcgacgaagaaagccaaggcgatggcgtga

SEQ ID NO: 3508 - protein, 609 aa, Chlorobium tepidum TLS
MSRKQNIRNIAIIAHVDHGKTTLVDSIFKQTGAFRENQHVDVRVMDSNPQERERGITIFSKNAAVQHKGCKINIVDTPGHADFGGEVERILKMVDGVLLLVDAFEGPMPQTKFVLRKALELHLKPIVVINKIDRPQADPEKVHDQVLDLFIALGADEDQLDFPYIFASAKNGIAKCNMSDPDGDMSLLLDMIVKEIPAPEADDDAGFQMLVTSLDYSDYIGKIAIGRIQRGKVAPGNQLTLVTQDGVVGKGTVTKLFLFDRTQRVEAMEATAGDIVALAGIAAANVGETLTTPDQPEPIESFEISKPTLSMLFSVNDSPFAGQEGKEVTSRKIRERLMKEIMTNVALNVEETDSADTFRVSGRGELHLSVLIETMRREGYELAISRPEVILREENGVTMEPVEHVTIDVPEEYTGVVIEKMGRRKAEMTNMSTLRGGMNRLEFEIPTRGLIGYNLEFTTDTKGEGMMSHVFHNYQPYKGKLPSRETGALVSAETGVAVAYAISSLEDRGTFFIGPNAKVYEGMVVGESTRDLDITVNICKTKKLTNMRASGSDDSIRLTPPKRLSLEQALEFINDDELLEVTPENIRIRKKILNADLRAKATKKAKAMA

SEQ ID NO: 3509 - DNA, 1791 bp, Thermosynechococcus elongatus BP-1
  CDS (1)..(1791): transl_table=11
atgagtctgccgattcgtaatgttgccattatcgcccacgttgaccacggcaaaaccacgctggtggatgccctgctgcgccagtcgggtgcctttcgcgaaggggaagacattcctgagtgcgtcatggactccaatgatctggagcgcgagcggggcattacgattctggccaaaaatactgcggttcgctacaaagacttgacgattaacattgtcgatacccccggccacgccgattttggtggtgaagtagagcgtgttctcggcatggtggaaggttgcttgctgattgtggatgccaacgaagggccgatgccccaaacgcggtttgttctaaaaaaagcccttgagaaaggtctgcgacccattgtggttgtcaataaaattgaccggccccaggcggaaccctacaaagccatcgataaggtgttggacctcttcattgagctgggggcagatgacgatcagtgtgagtttccttatctttttgcttcgggcttggcgggctatgcaaaaaccaatctagatgaagaaggcaaggatatgcagcccctctttgaagccattgtccgccatattccaccgccagtgggcaatcccaatgcgccgctgcaacttcaggtgacaaccttggattattcggagtacctagggcggattgtgattggcaagattcacaatggcacgatccaagtggggcagcaggcagccttagtcaaggataatggccaaattgtcaaggcaaagattaccaaactcttgggctttgagggcctcaagcgaattgaattagacacggccagtgcgggcaatattgtggcgatcgccggctttagtgatgccaacattggcgaaaccgttaccgaccccaacaacccccaagccctacccctaatcaaggtggatgaaccgaccctgcaaatgacctttgcagtcaacgactccccctttgccggtcaggagggaacctttgtgacctcgcggcagttgcgcgatcgcctctttcgggagttggaaaccaatgtggccctgcgggttgaagaaacggactcccccgatcgctttgccgtttcgggtcggggtgaattgcaccttggcattctcattgaaacgatgcgccgcgaaggctacgaattccaggtctcccagccacaggtgatctaccgtgaggtcaatggccagccctgtgaaccctacgaatgcttggtcctcgacgttcccgatgaagccgttggcggctgtattgagcgcctaggccagcgccgcggtgaaatgcaggatatgcaggtaggaggcaatggccgcactcaactggagtttgtgattccggctcgcggtctcattggtttccggggggagtttatgcgcctaacgcgcggcgaagggattatgaaccacagcttcctggactatcgtcccctcgccggtgagatcagtacccggcgcaatggtgtcttgattgcctttgaggagggcacggccaccttctatgccctgaaaaatgccgaagatcgcggtgtctttttcattacccccggtaccaaagtctataagggcatgattgttggtgagcacaaccgcccccaggatttggaaatcaatgtctgcaaagccaaacaactcaccaactttcgctcctcaaccggggatgaactggtacaactgcaagcccccgtggaaatgagcctagagcgggcactggagtacattggccccgatgagttggtggaggtaacgccccaatccattcgcctgcggaaaatgagcaagaagctggcacgccgctaa

SEQ ID NO: 3510 - protein, 596 aa, Thermosynechococcus elongatus BP-1
MSLPIRNVAIIAHVDHGKTTLVDALLRQSGAFREGEDIPECVMDSNDLERERGITILAKNTAVRYKDLTINIVDTPGHADFGGEVERVLGMVEGCLLIVDANEGPMPQTRFVLKKALEKGLRPIVVVNKIDRPQAEPYKAIDKVLDLFIELGADDDQCEFPYLFASGLAGYAKTNLDEEGKDMQPLFEAIVRHIPPPVGNPNAPLQLQVTTLDYSEYLGRIVIGKIHNGTIQVGQQAALVKDNGQIVKAKITKLLGFEGLKRIELDTASAGNIVAIAGFSDANIGETVTDPNNPQALPLIKVDEPTLQMTFAVNDSPFAGQEGTFVTSRQLRDRLFRELETNVALRVEETDSPDRFAVSGRGELHLGILIETMRREGYEFQVSQPQVIYREVNGQPCEPYECLVLDVPDEAVGGCIERLGQRRGEMQDMQVGGNGRTQLEFVIPARGLIGFRGEFMRLTRGEGIMNHSFLDYRPLAGEISTRRNGVLIAFEEGTATFYALKNAEDRGVFFITPGTKVYKGMIVGEHNRPQDLEINVCKAKQLTNFRSSTGDELVQLQAPVEMSLERALEYIGPDELVEVTPQSIRLRKMSKKLARR

SEQ ID NO: 3511 - DNA, 1824 bp, Oceanobacillus iheyensis HTE831
  CDS (1)..(1824): transl_table=11
atgcaattaagaaatgatattcgcaatatcgcaattattgcgcacgttgaccacggaaaaacaacgcttgtggatcagctattaaaatattctggtactttccgagacaatgagcatgttgatgaacgtgcaatggactctggagatatagaacgtgaacgtggaattacaatattagctaaaaatacagctgtaaaatataaagatacaacgataaatatattagatacacctgggcacgctgacttcggtggagaagtagaacgtatcatgaaaatggtagatggtgttgccttagtagtagatgcatatgaaggtacaatgccacagacacgatttgtgttaaagaaagcattggagcaaaagttaacaccgatggttgtgcttaataaaattgatcgcccgaatgcacgcccagaagaggttgttgatgaagtacttgatttatttattgaattaggagccgatgatgaacaattagaatttccggtagtatatgcatcagctattaatggaacttctggtttagaagcggaagagcaagaagaaacaatggatcctgtattccaaacgattttagagcatattccagcgccaattgatacaaaagaagaacctttacaattccaagtaacactacttgattataacgactatgttggacgtattggagtgggacgagttgttcgaggaagcataaaagttggccagcaagtggtagtattaaaacaagatggatcgcaaaaatccttccgcgtttccaagctatttggttttaccgggttaaaacgtattgaaatccaagaagctatagccggtgatatcgttgcgttatctggaatggaagatttaaatgtgggagagactgtatgcccagtagagcaaccagaagcactaccttggttgcgaattgatgaaccaacattgcaaatgacattcttagtaaataatagtccttttgcaggtaaagaaggaaagttcattacctctcgtaaaattgaagaacgtttgatgaagcaattagagacagatgtaagcttgcgtgtagacccaacggattcgccagatgtatggacagtatctggacgtggagaattacatctatcaatcctaatcgaaaacatgcgtcgtgaaggttatgaattacaattatccaaaccggaagttattattcgtgaaattgatggcgtgaaatgtgaaccagtagaacgtgtacaagtggatgtaccagaagaatacacgggtgcaattatggagtcactaggtgaacgtaaaggtgaaatgattgatatggtcaatcaagggaacggtcaagttcgtatcgaatttaaagtgccttctcgtggattattaggttatacgactgaattcatgtcacaaactcgtggatacggtattttaaatcacacgttcgatgcttacgaaccacttattaaaggtcaagtcggcggacgtcgtgaaggggtactagttgcacttgaaaacgggaaagcatcaacttacggtataatgaatctagaagatcgtggtgtgatttttgtatcaccaggaacagaagtatatgcaggtatgatcgtaggagaacataatcgtgataatgacttaacggttaatattacacgtgaaaaacatttaaccaatgtacgttcagctacgaaagatcaaacaacaacaatccgtaagtccagaactttatctttagaagaagcacttcaatatttaagtgatgatgaattttgtgaagttacaccggaatccattcgattaagaaagaaaatcttaaataaaaatgagagagaaaaagctgcaaagcgtaaagtataa

SEQ ID NO: 3512 - protein, 607 aa, Oceanobacillus iheyensis HTE831
MQLRNDIRNIAIIAHVDHGKTTLVDQLLKYSGTFRDNEHVDERAMDSGDIERERGITILAKNTAVKYKDTTINILDTPGHADFGGEVERIMKMVDGVALVVDAYEGTMPQTRFVLKKALEQKLTPMVVLNKIDRPNARPEEVVDEVLDLFIELGADDEQLEFPVVYASAINGTSGLEAEEQEETMDPVFQTILEHIPAPIDTKEEPLQFQVTLLDYNDYVGRIGVGRVVRGSIKVGQQVVVLKQDGSQKSFRVSKLFGFTGLKRIEIQEAIAGDIVALSGMEDLNVGETVCPVEQPEALPWLRIDEPTLQMTFLVNNSPFAGKEGKFITSRKIEERLMKQLETDVSLRVDPTDSPDVWTVSGRGELHLSILIENMRREGYELQLSKPEVIIREIDGVKCEPVERVQVDVPEEYTGAIMESLGERKGEMIDMVNQGNGQVRIEFKVPSRGLLGYTTEFMSQTRGYGILNHTFDAYEPLIKGQVGGRREGVLVALENGKASTYGIMNLEDRGVIFVSPGTEVYAGMIVGEHNRDNDLTVNITREKHLTNVRSATKDQTTTIRKSRTLSLEEALQYLSDDEFCEVTPESIRLRKKILNKNEREKAAKRKV

SEQ ID NO: 3513 - DNA, 1932 bp, Bifidobacterium longum NCC2705
  CDS (1)..(1932): transl_table=11
atggcggttcgtggagatatccgtaatgtggcgattgtggctcacgtcgatcacggcaagaccaccctggtcaatgccatgcttcagcagtcgcacgtgttttccgagcgtgaggaagtgccggatcgtgtaatggattccaacgatctggaacgcgagaagggcatcaccatcctcgccaagaacacggccgtggaatacaccggtccgctggccgccaagtacggccacccggagggcatcaccctcaacatcatcgacacccccggccacgccgatttcggcggcgaggtcgagcgcggcatctccatggttgacggcgtcgtgctgctcgtggacgcctccgaaggcccgctgccgcagacccgcttcgtgctgcgcaaggccctcgaagccaagctgccggtcatcctgtgcgtgaacaaggtcgaccgccccgacgcccgtatcgaagaggtcgtcggcgaaacctccgacctgctgctcggcctggccgacgacgtgcagcacgagggcatcgacctggaccttgaccagctgcttgaaatgccggtcatctactgcgccgccaaggccggctacgcctccgtgaaccagcccgccgacggtggcctgccggacaacgacaacctcgagccgctgttcgaaaccatcatctccaccatcccggcccccgaatacgaggagggcgccccgctgcaggctcacgtggccaacatcgactcctccgacttcctcggccgactcggtctggtccgtatctacaacggcacccttgagaagggcaagacctacggcctgtcccgtgtggacggctccctcgagaacttccgcgtctccgaactgctgcgcacccagggcctcgagcgtatcccggtcgaatccgcaggccccggcgacatcgtggccgttgccggcgttaacgacatcatgatcggcgagaccatcgtcgaccccaacgacccgaagccgctgccgctcatccatgtggacgatccggccatctccatgaccttcggcaccaacgactccccgctggccggcaccgagggcaaggaccacaagctcaccgcccgcatgatcaaggaccgtctggaccgcgagctcatcggtaacgtgtccatcaaggtgctgcccaccgaccgtcccgacgcttgggaagtccagggccgtggcgagctggcgctggccgtgcttgccgagcagatgcgccgcgaaggctacgagctgaccgtcggccgtccgcaggtggtcaccaagaagatcgacggcgtgatcaacgagccgatggaaaacaccaccatcgacgtgccggaagagtacatgggtaccgtcacccagctcatggccgaccgtaagggccgtatggatggcatgaccaaccacggctccggctgggtccgtctgcagttcaccgtgccgtcccgtggtctgatcggcttccgcaccgcgctgctttccgccactcgtggcaccggcatctcctcctccatctctgccggctacgcgccgtgggctggcgccatcaccattcgccagaacggttccatggtttccgatcgcaagggtatcgccaccccgtacgccatgcagcgtctgcaggcccgtggcaacttcttcgtcgaaccgcagtccccggtgtatgaaggccaggtcgtgggtgtgaacaacaagcccgacgagctggacgtgaacatcacgctggccaagcacatgaccaacatgcgttcctccaccgctgacgtgctcgaaaccctgaccccgccgatcaagatgagccttgaggagtccctggacttcgccaacgaggacgagtgcgtggaagtcaccccggagtccatccgcgtgcgcaagatcatcctcggccgtgaggactggtacaagtggcgcgccaagcagcgccgccagaacgccgcccagcagggtaagtga

SEQ ID NO: 3514 - protein, 643 aa, Bifidobacterium longum NCC2705
MAVRGDIRNVAIVAHVDHGKTTLVNAMLQQSHVFSEREEVPDRVMDSNDLEREKGITILAKNTAVEYTGPLAAKYGHPEGITLNIIDTPGHADFGGEVERGISMVDGVVLLVDASEGPLPQTRFVLRKALEAKLPVILCVNKVDRPDARIEEVVGETSDLLLGLADDVQHEGIDLDLDQLLEMPVIYCAAKAGYASVNQPADGGLPDNDNLEPLFETIISTIPAPEYEEGAPLQAHVANIDSSDFLGRLGLVRIYNGTLEKGKTYGLSRVDGSLENFRVSELLRTQGLERIPVESAGPGDIVAVAGVNDIMIGETIVDPNDPKPLPLIHVDDPAISMTFGTNDSPLAGTEGKDHKLTARMIKDRLDRELIGNVSIKVLPTDRPDAWEVQGRGELALAVLAEQMRREGYELTVGRPQVVTKKIDGVINEPMENTTIDVPEEYMGTVTQLMADRKGRMDGMTNHGSGWVRLQFTVPSRGLIGFRTALLSATRGTGISSSISAGYAPWAGAITIRQNGSMVSDRKGIATPYAMQRLQARGNFFVEPQSPVYEGQVVGVNNKPDELDVNITLAKHMTNMRSSTADVLETLTPPIKMSLEESLDFANEDECVEVTPESIRVRKIILGREDWYKWRAKQRRQNAAQQGK

SEQ ID NO: 3515 - DNA, 1827 bp, Brucella suis 1330
  CDS (1)..(1827): transl_table=11
atggaattgcgtaatatcgctattatcgcacacgtcgatcatggcaaaaccacactggtcgatgaactcctgaagcagtccggctcgttccgcgagaaccagcgcgttgcagaacgcatgatggactcgaacgatatcgaaaaggaacgcgggatcaccattctcgccaaggcgacctcggttgtctggaaaaatacccgtatcaatatcgtcgatacgccgggccacgccgatttcggcggtgaagtcgagcgtatcctttcgatggtcgatggcgccatcgttctcgtcgatgctgccgaaggcccgatgccgcagacgaaattcgtcgtcggcaaggcgctgaaggtcggcctcaagcctatcgttgcgatcaacaagatcgaccgtcccgatggccgccatgaagaagtggtcaacgaagtgttcgacctctttgccaatctggacgctaccgacgaacagctcgatttcccgattctctatggttccggccgcaatggctggatggcgctgagcccggaaggcccgaaggatcaaggtctggctccgctgttcgacctcgtgctgaagcatgttcccgcgccgaaggttgccgaaggcccgttccgcatgatcggcacgatccttggagccgatccgttcctcggccgcatcatcaccggccgtatccattcgggctcgatcaagccgaaccaggccgtcaaggttctgggtcaggacggttcggtgctcgaaaacggccgtatctcgaaaatccttgccttccgtggcattgagcgtcaggccattgacgaagcacatgcaggcgatatcgttgccattgccggtctttccaagggcactgttgccgacactttctgcgatccttcggtcagcgagccgctcgccgcacagccgatcgatccgccgactgtaaccatgtccttcatcgtcaacgacagcccctatgcgggcaccgaaggcgacaaggtgacgagccgtgtcatccgtgaccgcctgcttaaggaagccgaaggcaatgtcgcgctgaagatcgaggaatcgaccgagaaggattcgttcttcgtttccggtcgtggtgaattgcagcttgcggttctgatcgaaaatatgcgccgcgaaggcttcgagcttggcgtttcgcgcccgcgcgtcgtcatgaaagacggagagaacggcgaaaagctggagccggtggaagaagtcgtcatcgacgtcgatgaggaatattccggcacggtcgtgcagaagatgtcggagcgcaaggccgaaatggtcgagctgcgtccttcgggcggcaaccgcgtgcgcctggtgttctacgctccgactcgcggcctcatcggctatcagtcggaacttttgaccgatacgcgcggcacggcgatcatgaaccgcctgttccacgattatcagccctataagggcgagattgtaggccgcaacaacggcgttctgatctccaacgatcagggtgaagctgtggcttacgcgctgttcaaccttgaagatcgcggcccgatgattatcgaggctggcgtcaaggtctatcagggcatgttgatcggcatccatagccgtgacaacgatctggaagtgaatgtgctcaagggcaagaagctcaccaatatccgcgccgccggcaaggatgaagccgtgaagcttaccccgccgatcaagatgacgctggaacgcgccctgtcgtggattcaggatgacgaactggtggaagtgacgccgaagtcgatccgtcttcgcaagctttatctcgatcccaatgagcacaagcgttttcagaagagcaagtcgtcgagtgctgcataa

SEQ ID NO: 3516 - protein, 608 aa, Brucella suis 1330
MELRNIAIIAHVDHGKTTLVDELLKQSGSFRENQRVAERMMDSNDIEKERGITILAKATSVVWKNTRINIVDTPGHADFGGEVERILSMVDGAIVLVDAAEGPMPQTKFVVGKALKVGLKPIVAINKIDRPDGRHEEVVNEVFDLFANLDATDEQLDFPILYGSGRNGWMALSPEGPKDQGLAPLFDLVLKHVPAPKVAEGPFRMIGTILGADPFLGRIITGRIHSGSIKPNQAVKVLGQDGSVLENGRISKILAFRGIERQAIDEAHAGDIVAIAGLSKGTVADTFCDPSVSEPLAAQPIDPPTVTMSFIVNDSPYAGTEGDKVTSRVIRDRLLKEAEGNVALKIEESTEKDSFFVSGRGELQLAVLIENMRREGFELGVSRPRVVMKDGENGEKLEPVEEVVIDVDEEYSGTVVQKMSERKAEMVELRPSGGNRVRLVFYAPTRGLIGYQSELLTDTRGTAIMNRLFHDYQPYKGEIVGRNNGVLISNDQGEAVAYALFNLEDRGPMIIEAGVKVYQGMLIGIHSRDNDLEVNVLKGKKLTNIRAAGKDEAVKLTPPIKMTLERALSWIQDDELVEVTPKSIRLRKLYLDPNEHKRFQKSKSSSAA

SEQ ID NO: 3517 - DNA, 1821 bp, Leptospira interrogans serovar Lai str. 56601
  CDS (1)..(1821): transl_table=11
atggaaatccgcaatatagcaatcattgcccacgtagaccacgggaaaaccacacttctggacggaattctccgtcaaaccggcgccgtcacagccaaagaggacggagaaagaatcatggattccaatgacttggaaaaggaaaaaggaatcacgatcaaagcaaaaaatacagcggtggtttataaagggactataatcaacgtagtagatactcccggtcacgcggatttcggcggagaagtggaacgcgttcttgcaactgcggattcttgtcttcttcttgtggacgcttttgacggaccgatgcctcagactcgtttcgtattaggaaaatctcttcaactcggacacagacctattttagtaattaataaaatagaccgtccaggcgcgagaccagaagcggttgtagatatggcgtttgatctattttccgatttaggagccacagacgaacagttagattttccaatcgtatatgcatctgcaaaacaaggttgggcggttcataatctgagcgaatctccaggtacaaacctggatcctcttttggacaccgttcttaaacacgttccgcctgttcaagcggacacggaagccccgcttcaatttcaagtgacttccttggattataacgattatgtaggaagaattgcagtcggaaaaatttatgcgggaaaaatggcgctcggaatgaacgttatacaacttgcggcaaaaaaaaccgaaacggctccatcagcggatactgcattatttaggattacaaaattatacaattttgaaggactcaaaagaaacgaagtcaatgcggcggaagcaggagacatcgtggcgattgcgggtcttccggatgtatttatcggagatacaatttgtgaacctggaaaaccggcccccagaccagcgatcgaggtagaagaaccgaccgtatctatgttttttatggtaaacaattctccgtttgccggaaaagaaggaaagttcgtaacgacccgaaatattcgagaacgtctggatcgagaactagaaactaacgtagcgatgagactcgaagaaaccgaagataaggatcgttttaaggtgttagggcgtggagaacttcatttgtcggttcttatcgaaacaatgagaagagaaggatttgaaatccaagtctctcgtcctgaagtcattttaaaaactaacgagcaagggcaaaaactcgaaccttacgaatatttggtaatggatgttcctgatcaatttacaggagcgatcattgccgagttaaaccgtagaaagggagaactacaattgatggacgcacatccgtccggaatgacccgagtagaatttgtaatacctacaaggggaattataggttttagaggattttttatttcagaaaccagaggagaaggagtgatgtcttctcgttttcttaggttcgatgtatataaaggggatattcctggtcgtaagaacggcgcattgatttcaatggactcaggagaatccactgcatatgctctttggaagattcaagaaagaggggaattggtgatcgggccgaatacctctgtttatcccggaatgatcatcggaattcattctcgtgataatgatctagaagtgaatcctgtaaaggaaaagaaactgagtaacgttcgttcttctggagcggatgaggcgatccgtctggttcctcctagaaaattttctttagaacaaaacatagaatttttagatgatgacgaacttttggaagtaactcccacgagtttacgtcttcgtaaaaagtttttagacgcaaatatgcgtaaacgtaacaaataa

SEQ ID NO: 3518 - protein, 606 aa, Leptospira interrogans serovar Lai str. 56601
MEIRNIAIIAHVDHGKTTLLDGILRQTGAVTAKEDGERIMDSNDLEKEKGITIKAKNTAVVYKGTIINVVDTPGHADFGGEVERVLATADSCLLLVDAFDGPMPQTRFVLGKSLQLGHRPILVINKIDRPGARPEAVVDMAFDLFSDLGATDEQLDFPIVYASAKQGWAVHNLSESPGTNLDPLLDTVLKHVPPVQADTEAPLQFQVTSLDYNDYVGRIAVGKIYAGKMALGMNVIQLAAKKTETAPSADTALFRITKLYNFEGLKRNEVNAAEAGDIVAIAGLPDVFIGDTICEPGKPAPRPAIEVEEPTVSMFFMVNNSPFAGKEGKFVTTRNIRERLDRELETNVAMRLEETEDKDRFKVLGRGELHLSVLIETMRREGFEIQVSRPEVILKTNEQGQKLEPYEYLVMDVPDQFTGAIIAELNRRKGELQLMDAHPSGMTRVEFVIPTRGIIGFRGFFISETRGEGVMSSRFLRFDVYKGDIPGRKNGALISMDSGESTAYALWKIQERGELVIGPNTSVYPGMIIGIHSRDNDLEVNPVKEKKLSNVRSSGADEAIRLVPPRKFSLEQNIEFLDDDELLEVTPTSLRLRKKFLDANMRKRNK

SEQ ID NO: 3519 - DNA, 1812 bp, Shewanella oneidensis MR-1
  CDS (1)..(1812): transl_table=11
gtgctagagaatttacgtaacatcgccattattgcgcacgttgaccatggcaaaacgaccctggttgacaagctgctgtcgcaatcaggaacccttgcaacccggggagaagctactgagcgggtgatggactccaacgatcttgaaaaggagcgtggaatcacgattctggcaaagaacactgccatcaagtggaacgactaccgcattaacatcgtagacacccctggccacgccgacttcggtggtgaggttgagcgtgttctgtctatggttgactcagtattgttgctggttgatgccgttgatggtccaatgccacaaactcgcttcgtaaccaaaaaagcgtttgcccaaggcttaaagccaatcgttgttatcaacaagattgaccgtccaggtgctcgccctgattgggttatcgaccaagtattcgacctattcgataacttaggtgcgaccgacgaacaattagattttccaatcgtttatgcttctgcattaaacggttttgcaaccttagatccagatgttgtcagcgaagatatgacgccactgtttcagactatcgttgaaaaagtgtcatcacctgatgctgatgcggatggtccattccagatgcaaatttctcagctcgattacaactcttacgtgggtgttatcggtgtgggtcgcattaaccgtggtagcatcaagactaaccaacaggtgagcgtgatcggtgccgacggtaaagtacgcaacggtaaaatgggccaagtattaggttacatgggcttagagcgtaccgaagttgatgtagcaaacgcgggcgatatcgttgcgattactggtttgggtgagcttaaaatttcggacacagtgtgcgccgctggcaatgtagaggcgatgccgcctttatctgttgacgagccaacgctgaccatgaccttccaagtcaacacttcaccttttgcgggtaaagaaggtaagtatgtgacttcacgtaacattcttgagcgtctgcaacaggaattagtgcacaacgtggcactgcgtgttgaagaaaccgacagcccagaccgtttcgcggtatctggtcgtggtgaattacacttatctatcctgatcgaaaacatgcgtcgtgaaggttacgaattagcagtttctcgcccagaagttatcttaaaaaccatcgatggtgaactgtgtgagccatttgaaactctgaccgttgacgttgaagaagaacatcaagggacagtgattgagaagctgggtatccgtaaagctgaaatgaaagatatgcagcttgacggtaaaggtcgcgtgcgcgttgactttgttatcccaagccgtggcttaatcggtttccaaacagagttcttaacagcaacgtcaggtaccggtttgatttaccactcattcgatcactacggtccacataaaggtggcgacattggtcaacgcgctaacggcgtactgatctctaacgcaacgggtaaggcgctgacattcgcactgttcggtctacaggaccgcggtcgtctgtttattggccacgctgctgaagtttacgaaggtcaagttgtgggtattcatgctcgttcaaacgatctgacagttaactgtctgaaaggtaagcagctgactaacatgcgtgcttctggtactgacgaagctcaggttctgactacgccaatcactttaacgcttgagcaagcgcttgagtttattgatgatgacgaattagttgaagtgacacctaagagcatccgtgttcgtaagaaacacttaactgaaaacgaccgtaagcgcgctagccgcggctaa

SEQ ID NO: 3520 - protein, 603 aa, Shewanella oneidensis MR-1
MLENLRNIAIIAHVDHGKTTLVDKLLSQSGTLATRGEATERVMDSNDLEKERGITILAKNTAIKWNDYRINIVDTPGHADFGGEVERVLSMVDSVLLLVDAVDGPMPQTRFVTKKAFAQGLKPIVVINKIDRPGARPDWVIDQVFDLFDNLGATDEQLDFPIVYASALNGFATLDPDVVSEDMTPLFQTIVEKVSSPDADADGPFQMQISQLDYNSYVGVIGVGRINRGSIKTNQQVSVIGADGKVRNGKMGQVLGYMGLERTEVDVANAGDIVAITGLGELKISDTVCAAGNVEAMPPLSVDEPTLTMTFQVNTSPFAGKEGKYVTSRNILERLQQELVHNVALRVEETDSPDRFAVSGRGELHLSILIENMRREGYELAVSRPEVILKTIDGELCEPFETLTVDVEEEHQGTVIEKLGIRKAEMKDMQLDGKGRVRVDFVIPSRGLIGFQTEFLTATSGTGLIYHSFDHYGPHKGGDIGQRANGVLISNATGKALTFALFGLQDRGRLFIGHAAEVYEGQVVGIHARSNDLTVNCLKGKQLTNMRASGTDEAQVLTTPITLTLEQALEFIDDDELVEVTPKSIRVRKKHLTENDRKRASRG

SEQ ID NO: 3521 - DNA, 1845 bp, Streptococcus mutans UA159
  CDS (1)..(1845): transl_table=11
atgacaaattttagagaagatattagaaatgttgctatcattgcccacgttgaccatgggaaaacaacccttgttgatgagctcttaaaacaatcgcatacacttgatgagcataaaaaattagaagaacgtgcgatggactctaatgatcttgaaaaagagcgtgggattactattcttgcaaaaaatactgctgttgcctacaatggtgtacgtattaacattatggacacaccaggacatgcggattttggtggagaagtagagcgtatcatgaaaatggttgatggggttgttcttgttgttgatgcttatgaaggtaccatgccgcaaacacgttttgttttgaaaaaagctttggaacaaaacctggttccaatcgtggtggtgaataagattgacaagccatcagctcgtccggcagaagttgttgatgaagttcttgaacttttcattgaacttggagcagatgatgaccagttagagtttccagtcgtttacgcttcggcgattaatggaacttcttcattatcagatgaaccagcggatcaagaacatacaatggcacccgtttttgatactattattgagcatattccagcaccgatcgataattcagatcagccacttcaatttcaagtgtctctccttgattataacgactttgttggacgtatcggtattgggcgagtcttccgtggttctgttaaagtcggggatcaagtgacactttctaaacttgatggtacaacaaagaattttcgtgttacaaaacttttcggtttcttcggtttggaacgtcgtgagattaaggaagctaaggctggcgatttgattgctgtttcaggtatggaagatatctttgttggtgaaacgattacaccaactgatgctgtagaaccacttcctattcttcacattgatgagccaactctgcaaatgacctttttagctaacaattccccttttgcaggccgtgaaggtaaatttgtaacctcgcgtaaggtagaagagcgtttgttggcagaattgcaaacagatgtttcccttcgtgtagaagccactgactcaccagataaatggacggtttcaggtcgtggggagttacatctgtcaatccttattgaaaccatgcgccgtgaaggatatgagctgcaagtatcgcgtccagaagttattatcaaagaaattgatggcatcaaatgtgagccatttgaacgcgtgcaaattgacacaccggaagaataccaaggtgctgttatccagtccctttcagaacgtaaaggtgaaatgcttgatatgcaagcaactggtaatggtcaaacgcgccttatatttttagcaccagctcgaggacttatcggctacccaacagaattcttatccatgacacgaggttatggtatcatgaaccacacttttgacaaatatatgccagttatcaatgctgaaatcggtggtcgtcatcgtggtgccctcgtttcaattgatacaggtaaggcaacgacttattctattatgtctattgaagaacgtggaacaatcttcgttaacccaggtacagaagtgtatgaaggaatgattattggagaaaatgcacgcgagaatgatttgacagtcaacattacaaaggctaagcagatgactaatgtgcgctctgcaaccaaggatcagacagcagttattaagacgccgcgtattttaacacttgaagaatcacttgagtttctgaatgatgatgaatacatggaagtaacacctgagtccattcgtttacgtaaacaaattcttgataagaatgcgcgtgctaaagcggctaagaagaaaaaatcagctgaagattga

SEQ ID NO: 3522 - protein, 614 aa, Streptococcus mutans UA159
MTNFREDIRNVAIIAHVDHGKTTLVDELLKQSHTLDEHKKLEERAMDSNDLEKERGITILAKNTAVAYNGVRINIMDTPGHADFGGEVERIMKMVDGVVLVVDAYEGTMPQTRFVLKKALEQNLVPIVVVNKIDKPSARPAEVVDEVLELFIELGADDDQLEFPVVYASAINGTSSLSDEPADQEHTMAPVFDTIIEHIPAPIDNSDQPLQFQVSLLDYNDFVGRIGIGRVFRGSVKVGDQVTLSKLDGTTKNFRVTKLFGFFGLERREIKEAKAGDLIAVSGMEDIFVGETITPTDAVEPLPILHIDEPTLQMTFLANNSPFAGREGKFVTSRKVEERLLAELQTDVSLRVEATDSPDKWTVSGRGELHLSILIETMRREGYELQVSRPEVIIKEIDGIKCEPFERVQIDTPEEYQGAVIQSLSERKGEMLDMQATGNGQTRLIFLAPARGLIGYPTEFLSMTRGYGIMNHTFDKYMPVINAEIGGRHRGALVSIDTGKATTYSIMSIEERGTIFVNPGTEVYEGMIIGENARENDLTVNITKAKQMTNVRSATKDQTAVIKTPRILTLEESLEFLNDDEYMEVTPESIRLRKQILDKNARAKAAKKKKSAED

SEQ ID NO: 3523 - DNA, 1842 bp, Streptococcus agalactiae NEM316
  CDS (1)..(1842): transl_table=11
atgacaaatttaagaacagatatccgtaacgttgcgatcattgcccacgttgaccacggtaaaacaactctcgttgatgaattattaaaacaatcacatactcttgatgagcgtaaagagcttgaagaacgtgcaatggattcaaatgatatcgagaaagaacgtggtatcaccattcttgcaaaaaatacagccgtagcatacaacgatgttcgtatcaatattatggacacacctggtcacgcggactttggtggtgaagttgagcgtattatgaaaatggttgatggtgttgttttagtcgttgatgcttacgaaggaacaatgccacaaacacgttttgttttgaagaaagctcttgaacaaaacttaattccaatcgttgttgtaaataaaattgataagccatcagctcgtccatcagaggttgttgatgaagttcttgaactcttcattgagctcggtgctgatgatgaccaactagatttccctgttgtttatgcttcagccatcaatggaacatcttcaatgtcagatgatcctttagatcaagaaaaaacaatggcaccgatttttgatactatcattgatcacattccagccccagttgacaactcggaagaaccacttcaattccaagtttctcttcttgattacaatgattttgtaggacgtattggtattggacgtgttttccgcgggactgtcaaagttggagatcaagttactctttcaaaacttgatggtacaactaaaaacttccgcgtaacaaaactttttggtttctttggacttgaacgtaaagaaatccaagaggctaaagcgggtgatttaatcgctgtttctggtatggaagatatcttcgttggtgagacagtaactccgacagatgatattgaaccactaccagttttacgtattgacgagccaacacttcaaatgactttcttggtgaataattcaccatttgcaggtcgcgaaggtaaatggattacgtcacgtaaggttgaagaacgtcttttagcagaattacaaacagacgtttctttgcgtgttgacccaacagattcgccagataaatggacggtttcagggcgtggagaattacatttatctatcctcattgaaacaatgcgtcgtgagggatatgaacttcaagtatcacgtccagaagttatcatcaaagaaattgatggtgttcaatgcgagccgtttgagcgtgttcaaattgatactccagaagaatatcagggtgctattatccaaagtttgtcagagcgtaaaggtgatatgcttgatatgcagatggttggtaatggtcaaacgcgtttgattttcttgattcctgcacgtggtttgattggttattcaacagagtttctttcaatgacacgtggatatggtatcatgaatcatacttttgaccagtatctaccggttgttcaaggagaaattggtggtcgtcatcgtggtgtcttggtttctattgaaaatggtaaagcaactacatattcaattatgcgtattgaagaacgtgggactatctttgtaaatccaggtacagaagtttatgaaggaatgattgttggtgagaattctcgtgataatgatctcggagtcaatattacaactgctaaacaaatgacaaatgtccgttcagcaactaaagatcaaactgcagtcatcaagacgcctcgtatccttactttagaagagtcacttgaatttttagcagatgatgagtacatggaagtaactcctgagtctattcgtcttcgtaaacaaattttaaataaagcagcacgtgacaaagctaataaaaagaaaaaatcagctgaataa

SEQ ID NO: 3524 - protein, 613 aa, Streptococcus agalactiae NEM316
MTNLRTDIRNVAIIAHVDHGKTTLVDELLKQSHTLDERKELEERAMDSNDIEKERGITILAKNTAVAYNDVRINIMDTPGHADFGGEVERIMKMVDGVVLVVDAYEGTMPQTRFVLKKALEQNLIPIVVVNKIDKPSARPSEVVDEVLELFIELGADDDQLDFPVVYASAINGTSSMSDDPLDQEKTMAPIFDTIIDHIPAPVDNSEEPLQFQVSLLDYNDFVGRIGIGRVFRGTVKVGDQVTLSKLDGTTKNFRVTKLFGFFGLERKEIQEAKAGDLIAVSGMEDIFVGETVTPTDDIEPLPVLRIDEPTLQMTFLVNNSPFAGREGKWITSRKVEERLLAELQTDVSLRVDPTDSPDKWTVSGRGELHLSILIETMRREGYELQVSRPEVIIKEIDGVQCEPFERVQIDTPEEYQGAIIQSLSERKGDMLDMQMVGNGQTRLIFLIPARGLIGYSTEFLSMTRGYGIMNHTFDQYLPVVQGEIGGRHRGVLVSIENGKATTYSIMRIEERGTIFVNPGTEVYEGMIVGENSRDNDLGVNITTAKQMTNVRSATKDQTAVIKTPRILTLEESLEFLADDEYMEVTPESIRLRKQILNKAARDKANKKKKSAE

SEQ ID NO: 3525 - DNA, 1923 bp, Corynebacterium efficiens YS-314
  CDS (1)..(1923): transl_table=11
atgcccccagtgacccatccagagtttcgtaacgtcgcgatcgtcgcgcacgttgaccacggaaagaccacactcgttaatgccatgctcgaacagtccggcgtgttcggcgatcacggcgaagttgctgaccgtgtgatggattccggtgatctggaacgcgagaagggcatcaccatcctggccaagaacaccgccatccgacgcaagggcgccggcaaggacggcaatgacctggtcatcaacgtcatcgacacccccggccacgccgatttcggtggcgaggtcgagcgcgcactgtccatggtcgacggtgtcgtcctgctggtggatgcctccgaaggtccgctgccccagacccgcttcgtgctgtccaaggcactggccgccaagatgccggtgatcatcgccgtcaacaagaccgaccgccccgatgcccgcatcgacgaggtcgtcgaggaagcccaggatctcctcctcgagctggcctccgccatcgaggacgaggaggccgcagccgccgccgagcagctgctcgacctcccggtcctgtacacctccggccgtgagggcaaggcctccaccgagaaccccggcaacggcaacgtcccggcctccccggatctgcagcccctgttcgacaccctgctcaaggtcatccccgcccccgaggccaacatcgatgcacccctgcaggcacatgtgaccaacctggactcctcgtccttcctcggccgcatcggcctggtgcgcatccacgccggttccctgaagaagggccagcaggttgcctggatccactatgacgaggagggcaaccagcacaccaagaccgccaagatcgccgagctgctgtccaccgtcggcttctcccgtgtccccgcacaggaggtcatcgccggtgacatcgcggccatctccggcatcgaggacatcatgatcggtgacaccctcgccgacgtgaacaaccccgtcgccctgccccggatcaccgttgatgagcctgccctgtccatgaccatcggtgtcaacacctcgcccatggccggtcgtggtggcggcgacaagctgaccgcccgcgtgatcaaggcccgcctggatcaggaactgatcggtaacgtctccctcaaggtcaagccgacggatcgccccgacacctgggaggtccagggtcgtggtgagatggcactgtccatcctggttgagaccatgcgccgcgagggcttcgaactgaccgtgggcaagccacaggtggtcacccagaccatcgacggcaagctgcacgagccctatgagatcatcgtcatcgatgtcccctccgagtaccagggcaacgtcacccagctgctggccacccgcaagggcctgatgcagtcgatgaccaccaccccgggatccgactggatccgcatggagttccgtgttccctcccgtggcctcatcggtttccgcacccagttcatgaccgagacccgcggtaccggtatcgccaactcctactccgatggcctggatgtctgggccggtgagatcaagggccgtgcccacggctccctggtcgccgaccgttccggtcagatcaccgcctacgccctgcagcagctggctgaccgcggcaacttcttcgtcgagccgggtaccgagacctacgagggtgtcgtggttggttccaacaaccgcgaagaggacatggacatcaacccgaccaaggagaagaagctgaccaacatgcgtgcagcttccgccgacaccaccgtcaccctggccaaggcccacaacctctccctggatgaggcactggagttctgtggtgtcgacgagtgcgtcgaggtcaccccggatgtcctgcgcgtgcgcaaggtcatcctcaacgccaccgagcgtaaccgtgcacgttcccgcgccaagagcctgaacaagtag

SEQ ID NO: 3526 - protein, 640 aa, Corynebacterium efficiens YS-314
MPPVTHPEFRNVAIVAHVDHGKTTLVNAMLEQSGVFGDHGEVADRVMDSGDLEREKGITILAKNTAIRRKGAGKDGNDLVINVIDTPGHADFGGEVERALSMVDGVVLLVDASEGPLPQTRFVLSKALAAKMPVIIAVNKTDRPDARIDEVVEEAQDLLLELASAIEDEEAAAAAEQLLDLPVLYTSGREGKASTENPGNGNVPASPDLQPLFDTLLKVIPAPEANIDAPLQAHVTNLDSSSFLGRIGLVRIHAGSLKKGQQVAWIHYDEEGNQHTKTAKIAELLSTVGFSRVPAQEVIAGDIAAISGIEDIMIGDTLADVNNPVALPRITVDEPALSMTIGVNTSPMAGRGGGDKLTARVIKARLDQELIGNVSLKVKPTDRPDTWEVQGRGEMALSILVETMRREGFELTVGKPQVVTQTIDGKLHEPYEIIVIDVPSEYQGNVTQLLATRKGLMQSMTTTPGSDWIRMEFRVPSRGLIGFRTQFMTETRGTGIANSYSDGLDVWAGEIKGRAHGSLVADRSGQITAYALQQLADRGNFFVEPGTETYEGVVVGSNNREEDMDINPTKEKKLTNMRAASADTTVTLAKAHNLSLDEALEFCGVDECVEVTPDVLRVRKVILNATERNRARSRAKSLNK

SEQ ID NO: 3527 - DNA, 1821 bp, Pseudomonas putida KT2440
  CDS (1)..(1821): transl_table=11
gtgatcgaaaatctgcgtaacatcgccatcatcgcccacgttgaccatggtaaaaccactctggtcgacaaactcctgcgtcagtccggcactctggagcgtaacgagctcaacgacgagcgcgtcatggactccaacgaccaggaaaaagagcgcggtattaccattctggcgaaaaacaccgccatcaactggaacggctaccacatcaacatcgtcgacacccccggccacgccgacttcggtggcgaggttgagcgtgtaatgtcgatggtcgactccgtgctgctgctggtcgacgcccaggacggcccgatgccgcaaacccgcttcgtgaccaagaaggctttcgaagccggcctgaagccaatcgtcgtgatcaacaaggttgaccgtccgggcgcacgtcctgactgggttctggaccagatcttcgacctgttcgacaacctcggtgccaccgacgaacagctggacttcaaagtggtctacgcctcggccctgaacggcattgccggcctggaccacactgccatggccgaagacatgaccccgctgtaccagtcgatcgtcgacaacgtaccagcaccgtctgttgaccgcgacggcccgttccagatgcagatctcggcactggactacaacagcttcctcggcgttatcggtgttggccgcatcgcccgtggccgcgtcaagccgaacaccccggttgtcgccatcgacaccaacggcaagaagcgtaacggccgtatcctgaagctgatgggtcaccacggtctgcaccgcgttgacgtcgaagaagcccaggctggcgatatcgtctgcatcagcggtttcgatgagctgttcatctccgacaccctgtgcgccccggatgcggtagaagcgatgaagccgctgaccgttgacgagccgaccgtttcgatgaccttccaggtcaacgactcgccgttctgcggtaaagaaggcaagttcgtcaccagccgtaacatcaaggaccgtctggacaaggagctgctgtacaacgttgccctgcgcgttcaggagaccgactccccagacaagttcaaggtttcgggccgtggtgagctgcacctgtcggtgctgatcgaaaccatgcgtcgtgaaggcttcgaaatggccgtgggccgtcctgaagtgatcatccgcgaagtcgacggcgtgaagcaggagccgttcgagaacgtcaccatcgacatccctgaagaatcccagggcaaggtcatggaagagatgggtctgcgtaaaggcgacctgaccaacatggttccggatggcaagggccgtgttcgtctggagtacaacattccagcccgtggtctgatcggtttccgtaaccagttcctgaccctgaccaacggtgcaggcatcctgacctcgatcttcgatcgctacgacaccatgaagtcgggccagatgtccggccgcctcaacggcgtactggtttcggtcgagaccggcaaggcactgacctactcgctggaaaccctgcaggctcgcggcaagctgttcgttgaacacggccaggagatctacaacggtcagatcatcggcctgaacagccgtgacaacgacctgggcgtgaacccgaccaaaggcaagaagctcgacaacatgcgtgcttcgggcaaagacgaagtcatcgccctggtaccgccagttcgccacaccctcgagcaggccctggaattcatccaggacgacgagctgtgcgaagtgactcctaagtcgatccgtctgcgcaagaagatcctggacgaaggcgagcgtacccgcgcagccaagaaagccaagaactga

SEQ ID NO: 3528 - protein, 606 aa, Pseudomonas putida KT2440
MIENLRNIAIIAHVDHGKTTLVDKLLRQSGTLERNELNDERVMDSNDQEKERGITILAKNTAINWNGYHINIVDTPGHADFGGEVERVMSMVDSVLLLVDAQDGPMPQTRFVTKKAFEAGLKPIVVINKVDRPGARPDWVLDQIFDLFDNLGATDEQLDFKVVYASALNGIAGLDHTAMAEDMTPLYQSIVDNVPAPSVDRDGPFQMQISALDYNSFLGVIGVGRIARGRVKPNTPVVAIDTNGKKRNGRILKLMGHHGLHRVDVEEAQAGDIVCISGFDELFISDTLCAPDAVEAMKPLTVDEPTVSMTFQVNDSPFCGKEGKFVTSRNIKDRLDKELLYNVALRVQETDSPDKFKVSGRGELHLSVLIETMRREGFEMAVGRPEVIIREVDGVKQEPFENVTIDIPEESQGKVMEEMGLRKGDLTNMVPDGKGRVRLEYNIPARGLIGFRNQFLTLTNGAGILTSIFDRYDTMKSGQMSGRLNGVLVSVETGKALTYSLETLQARGKLFVEHGQEIYNGQIIGLNSRDNDLGVNPTKGKKLDNMRASGKDEVIALVPPVRHTLEQALEFIQDDELCEVTPKSIRLRKKILDEGERTRAAKKAKN

SEQ ID NO: 3529 - DNA, 1830 bp, Vibrio vulnificus CMCP6
  CDS (1)..(1830): transl_table=11
atgacgactccacagattgataaattaagaaatatcgcgatcatcgcgcacgttgaccacggtaaaacaacactggttgataaattgctgcagcaatcgggcactttacaatctcgcggcgatgtagaagagcgagtcatggactcgaacgacatcgaaaaagagcgtggcattaccattttggcgaaaaacaccgctatccgttggaatgactaccgcatcaatatcgtagataccccgggacacgcggacttcggtggcgaagttgagcgtattatgtcgatggtagactgcgtactgcttatcgttgacgcagtagatggcccaatgccacaaacgcgttttgtaacgcaaaaagcattcgcacacggccttaagccaatcgttgtaatcaacaagatcgaccgtccaggtgcgcgtcctgattgggttatggaccaagtgttcgacctattcgacaacctaggtgcaactgacgaacagctcgatttcaaagtggtttacgcttcagcacttaacggttgggcttctctagaagaaggcgaaactggcgaagacatggaaccactattccaaacgatcgttgatgtagttgatgcgccaaatgttgaccttgatggtccactacagatgcaaatctctcagctcgattacagctcatacgtgggtgttatcggtgttggtcgtgtgactcgtggtaaagtgaaagcaaaccaacaagtaaccatcgttggtgctgatggcaaaacacgtaacggtaaagtgggcacggtactgggttacatgggccttgagcgtcacgaagttgaacaagcaactgcgggcgacatcatcgcaatcactggtcttggcgagctaaaaatctcagacaccatctgtgatgtaaacaagccagaagcgttgccagcattgtctgttgatgaaccaaccgtcaccatgacgttccaagtaaacacctctccgtttgcgggtcttgaaggtaaatacgtgacttcacgtaacatccttgagcgtcttgagaaggaactggttcacaacgtagcactgcgcgttgagcaaacagaagatccagacaaattccgtgtttcaggccgtggtgagcttcacctatctatcctgatcgagaacatgcgtcgtgaaggctttgagcttgcagtatcgcgtccagaagtaatcctgaaagaagaaaacggccagctaatggaaccgttcgaaaccgtaaccatcgacgttcaagaagaacaccaaggtggcattatggagaagatcggtatgcgtaaaggcgaactgaaagacatgtctccagatggtaaaggccgtgttcgtttggactttatgatgccatctcgtggtctgatcggtttccaaacagagttcatgacactgacttcgggttcaggtcttctttaccatacgtttgatcactacggcccacacaaaggcggtaacatcggtcaacgtatcaacggtgtattgattgcgaacgcagcgggtaaagcgctaactaacgcgctatttaacctgcaagagcgtggtcgtctcttcatcggtcacggtgtggaagtgtatgaaggtatggttattggtattcacagccgtgataacgacctaactgtaaacgcactgaaaggcaagcagctaaccaacgttcgtgcttctggtacggatgacgcacaggtgctaacgccgccaatcacgatgaccctagaacaagcactagagttcatcgatgacgacgagctagtagaagtaacgccggaaaacatccgtattcgtaagaagttcctaacggaaagcgatcgtaaacgtgcttctcgcgaagcgaagtaa

SEQ ID NO: 3530 - protein, 609 aa, Vibrio vulnificus CMCP6
MTTPQIDKLRNIAIIAHVDHGKTTLVDKLLQQSGTLQSRGDVEERVMDSNDIEKERGITILAKNTAIRWNDYRINIVDTPGHADFGGEVERIMSMVDCVLLIVDAVDGPMPQTRFVTQKAFAHGLKPIVVINKIDRPGARPDWVMDQVFDLFDNLGATDEQLDFKVVYASALNGWASLEEGETGEDMEPLFQTIVDVVDAPNVDLDGPLQMQISQLDYSSYVGVIGVGRVTRGKVKANQQVTIVGADGKTRNGKVGTVLGYMGLERHEVEQATAGDIIAITGLGELKISDTICDVNKPEALPALSVDEPTVTMTFQVNTSPFAGLEGKYVTSRNILERLEKELVHNVALRVEQTEDPDKFRVSGRGELHLSILIENMRREGFELAVSRPEVILKEENGQLMEPFETVTIDVQEEHQGGIMEKIGMRKGELKDMSPDGKGRVRLDFMMPSRGLIGFQTEFMTLTSGSGLLYHTFDHYGPHKGGNIGQRINGVLIANAAGKALTNALFNLQERGRLFIGHGVEVYEGMVIGIHSRDNDLTVNALKGKQLTNVRASGTDDAQVLTPPITMTLEQALEFIDDDELVEVTPENIRIRKKFLTESDRKRASREAK

SEQ ID NO: 3531 - DNA, 1827 bp, Bradyrhizobium japonicum USDA 110
  CDS (1)..(1827): transl_table=11
atgaacctccgcaacgtcgccatcatcgctcacgtcgaccacggcaagacgaccctcgtcgacaaactcctccagcagtccggcacgttccgcgagaaccagaaggtgaccgatcgcgccatggactccaacgatctggagcgtgagcgcggcattaccattctggccaaggcggcctcggtgcagtggaaggacacccgggtcaacatcgtcgacacccccggccacgccgatttcggcggcgaggtcgagcgcatcctcaacatggtggacggcgcgctggtgctggtggacgccgctgaaggcccgttgccgcagaccaagttcgtggtctccaaggcgctgaaggtcggcctcaagccgatcgtcgtcatcaacaaggtcgaccgccccgacgcgcgcccgaccgaagtcatcaacgaggtgttcgacctgttcgcggcgctcgacgccagcgaggagcagctcgacttcccgatcctctacgggtcggccaagcagggctggatggcagagactcccgagggtccgaaggacaagggcatggagccgctgttcgacctgatcctgcgccatgtcgcgccgcccacggttgaagagggcccgttccgcatgatcggcacgatcctcgaagccaatccctatctcggccgcatcatcaccggccgcatctcctcgggcacgttgaaacccaaccagcaggtcaaggtgctgaacgccgagggcaagctggtggaaaccggccgcattaccaagatcctggcgttccgcggcctcgagcgcacgccgctggatgaggccgaagccggcgacatcgtcgccattgccggtctcaccaagggcaccgtcgccgacaccttctgcgatccgagcgtggaggtgccgctgccggcgcagccgatcgatccgccgaccgtgtcgatgtcgttcatcgtcaacaattccccgctcgccggcaccgaaggcgacaaggtgacgagccgcatgatccgcgaccgtctgctgcgcgaggctgaaggcaacgtcgcgctgcgcgtcgtcgaagcctcggacaaggacgcgatggaggtgtccggccgcggcgaattgcagctcgcgatcctgatcgagaccatgcgccgcgagggctttgagctctcggtgtcgcgtccgcgcgtcgtgttccagaaggatgaggccaccggcgccaccatggagccgatcgaggaagtcgtgatcgacgtcgacgaggagcactccggcgtcgtcgtgcagaagatgagcgagcgcaaggccgagctgatcgagatgaagccgtccggcggcaaccgcctgcgccttgtgttctacgcgccgacccgcggcctgatcggctaccagggcgagctgctcaccgacacccgcggcaccgcgatcatgaaccgcctgttccacggctacgccccgtacaagggcgagatccagggccgccgcaacggcgtgctgatctccaacgaccagggcgaggccgtggcctacgccatgttcaagctggaagaccgcggcccgatgatgatcgagccgggctggaaggtctacaagggcatgatcgtcggcgagcacacccgcgacaacgatctcgagatcaacgtgctcaagggcaagcagctcaccaacatccgcacgacgtcgaaggacgaagccgtgcgcctgaccccgccgatccgcatgaccctggaaaaggcgctcgcctatatcgaggacgacgagctcgtcgaggtcaccccgaagtcgatccgcctgcgcaagaagcacctcgacccgaacgagcgcaagcgcgcggagaagtccaaggaagcggtggcgtaa

SEQ ID NO: 3532 - protein, 608 aa, Bradyrhizobium japonicum USDA 110
MNLRNVAIIAHVDHGKTTLVDKLLQQSGTFRENQKVTDRAMDSNDLERERGITILAKAASVQWKDTRVNIVDTPGHADFGGEVERILNMVDGALVLVDAAEGPLPQTKFVVSKALKVGLKPIVVINKVDRPDARPTEVINEVFDLFAALDASEEQLDFPILYGSAKQGWMAETPEGPKDKGMEPLFDLILRHVAPPTVEEGPFRMIGTILEANPYLGRIITGRISSGTLKPNQQVKVLNAEGKLVETGRITKILAFRGLERTPLDEAEAGDIVAIAGLTKGTVADTFCDPSVEVPLPAQPIDPPTVSMSFIVNNSPLAGTEGDKVTSRMIRDRLLREAEGNVALRVVEASDKDAMEVSGRGELQLAILIETMRREGFELSVSRPRVVFQKDEATGATMEPIEEVVIDVDEEHSGVVVQKMSERKAELIEMKPSGGNRLRLVFYAPTRGLIGYQGELLTDTRGTAIMNRLFHGYAPYKGEIQGRRNGVLISNDQGEAVAYAMFKLEDRGPMMIEPGWKVYKGMIVGEHTRDNDLEINVLKGKQLTNIRTTSKDEAVRLTPPIRMTLEKALAYIEDDELVEVTPKSIRLRKKHLDPNERKRAEKSKEAVA

SEQ ID NO: 3533 - DNA, 1851 bp, Buchnera aphidicola str. Bp (Baizongia pistaciae)
  CDS (1)..(1851): transl_table=11
atgtctctaaatattatgcaaaaaaaaacaaacaaaaacctcagaaatatagcaattattgcgcatgtagatcacggaaaaactaccttagttgataaattactacaacagtcaggaacttttaaaaaacatgaagaattttccgaacgaattatggattcaaatgatctagaaaaagaaagaggaattactattttagcaaaaaacactgccattcaatggaaaaaataccgaataaatatcattgatactccaggacatgctgattttggtggagaagtagagagaattttatctatggtagattctgtattattagtagttgatgctcttgaaggacccatgccgcaaactagatttgtcactcaaaaagcattcagttatggtattaaaccaattgtagtcataaataaaatagacagaaaacatgctcgaccaaactgggttatagatcaaatatttgatttatttgttaatcttaatgctacagatgaacaactagattttcctactatatatacttcagcattactaggaacatcaggagtatcatataatcatatgaatcccgatatgattccactatataatgctattgtaaaatatactccaccaccaactgtttatccaaattgtccatttcaaatgcaaatttcacaattagattatgacaactacttgggaattattggtatcgggcgtatcaacaagggatcagttacatcaaatcaatctatatctataattaataatactgaagttaaaagaaccgggaaaattgggaaaatattacaatatttaggtcttaataaaattgaaatcaatgaagcacaatcaggagacataatagcaattaccggaattgacaaattaaacatttcagatactatttgtgatcctcaatatattagtgctttaccaatgcttaaaatagatgaaccaacagtagaaatgctattttctgtaaataaatcaccattttcaggaacagaaggaaaatatataacgtctagacaaatatttaatcgtttaaaaaaagaagaaaattacaacgtagctttaaaaattaaagaaactaacgatactaacacattttccgtttctggacgaggagaattacacttatctattttaattgaaaatatgagacgagaggggtttgaactagaagtatcacgtcctcaagtaattttaaaaacgattaatgaattaatacaagaacctatggaaacagtagtattagacattgaaaataaatatcaaggaacgatcatgaaaactataggacaaagaaaaggtacgatatcaaatattactcctgatcaaaacaatgagcgtactagactagactgtataataagtagtcgttctttaattggatttagaacagaattttcaactttaacatctggatctggattattttattctacttttagccactatcaaaaaatagaatctaacaaaattaaaagacatagaaatggtgtattaatcgcaaacaaaacaggacaagctattggattttctttatttaatttacaaaaccgtggtaaattatttataacacacggaacaaaagtctatgaaggtcagattgtcggaattcataatcgggtcaacgatttaacagtaaattgtttatcaggaaaaaaattgaccaatatgagagcatcaggttctgacgaagctataacgttaacgacaccaattaaaatgaccttagaatacgcaattagttttattaatgatgacgaattagtagaaattacaccaaaatctataagattaagaaaacgttacttaaaagaaaacgaacgaaaaattttacttcgaaatattaaagaataa

SEQ ID NO: 3534 - protein, 616 aa, Buchnera aphidicola str. Bp (Baizongia pistaciae)
MSLNIMQKKTNKNLRNIAIIAHVDHGKTTLVDKLLQQSGTFKKHEEFSERIMDSNDLEKERGITILAKNTAIQWKKYRINIIDTPGHADFGGEVERILSMVDSVLLVVDALEGPMPQTRFVTQKAFSYGIKPIVVINKIDRKHARPNWVIDQIFDLFVNLNATDEQLDFPTIYTSALLGTSGVSYNHMNPDMIPLYNAIVKYTPPPTVYPNCPFQMQISQLDYDNYLGIIGIGRINKGSVTSNQSISIINNTEVKRTGKIGKILQYLGLNKIEINEAQSGDIIAITGIDKLNISDTICDPQYISALPMLKIDEPTVEMLFSVNKSPFSGTEGKYITSRQIFNRLKKEENYNVALKIKETNDTNTFSVSGRGELHLSILIENMRREGFELEVSRPQVILKTINELIQEPMETVVLDIENKYQGTIMKTIGQRKGTISNITPDQNNERTRLDCIISSRSLIGFRTEFSTLTSGSGLFYSTFSHYQKIESNKIKRHRNGVLIANKTGQAIGFSLFNLQNRGKLFITHGTKVYEGQIVGIHNRVNDLTVNCLSGKKLTNMRASGSDEAITLTTPIKMTLEYAISFINDDELVEITPKSIRLRKRYLKENERKILLRNIKE

SEQ ID NO: 3535 - DNA, 1830 bp, Xylella fastidiosa Temecula1
  CDS (1)..(1830): transl_table=11
atgtccatagaaaatctccgtaatatcgccatcgttgctcacgttgaccatggtaagaccactcttgttgatcagttgcttaagcaatctgggactttcagcgaacgtgcccaggtgggtgagcgcgtgatggacagcaatgaccaggaaaaggaacgcggtatcacaattcttgctaaaaatacggcaatcaaatggaatggtaaccgcatcaacattgttgatactcctgggcatgctgattttggaggggaggttgaacgcgtattgtcgatggttgattcagtcctactgttggtggatgcaatggatgggccaatgccgcagacgcgcttcgtgactcagaaggcttttgcaatggggtttaagccgattgtggtggtcaacaagattgatcgtcctggtgctcgtccggattgggttgttgagcaggtttgggacttattcgaccgtctcggtgctacaccggagcagatggactttccgattgtctatgcctcggcactaaatggctatgccagcttggagtcaagtgcgcgggcgggggatatgaatccgctgtacgaagcgatcatgcagcacgttcaaccgccgcaagttgacctgcatggcccatttcagatgcgtatcagtcaattggactacaacagttacgttggcctcattggtattggtcggattcaacgtggcaaggtgtctactaacatgccggtgacggtcattgatcgcatgggtaataaacataatggtaaagttctccaggtactcggtttccttggtctggagcgtcatgaggttgaggaagcccaggcaggcgatatcgttgctatttcaggtattgagtcactcagtatttccgatacccttactgacccaacggccccagatgcgctgccagcattgagcgttgatgaaccgacaatcagtatgacctttcaagttaataattcgccatttgctgggcagaaggaatattcgggtgggaagttcctgacaagccgtcagatccgtgagcgcttggctcgcgaaactttacataatgttgcgttgcgtgttgaggataccgaggatcctgacagatttaaggtttccggtcgaggtgagctgcacttgtctgtcttgattgagactatgcggcgtgagggctatgaattgggtgtatcgcgcccggaagtcatcatcaaggaaatcgatggaatactccaagagccttacgagcagttagtcgtggacgtggaggaggagcatcaaggtggtgtgatagagcgcttgggcactcgtaaagctcagttgtcgaatatggagttggatggtaaggggcgcgtacgtttggattacattatcccggcgcgtggtttgattggtttccagactgagtttaaaaccatcacttctgggagcggccttctgttccacatctttgatcactacggcccgaaagctgatggtccgattgctaagcgtatcaacggtgtcatgatttctaatggtcatggcaaagcacctgggtacgctttgatgggtttgcaagaacgtgggcgtttgttgattgatgctggtgaggatatttacgaaggcatgttagttggcatccattccaaggataatgacctgaccgtcaatgcacttcgcgagaagcaattgacaaatattcgtgcttctgggaaggacgacgcaatctcattgaccccgcccattaagatgtccttggagcaggcgttagagtttatcgaagatgacgagttggttgaggtcacgccgaaggcaatccggttacggaaaaaatatcttagtgaaaatgatcgcaagcgtgccagtcgtactggctga

SEQ ID NO: 3536 - protein, 609 aa, Xylella fastidiosa Temecula1
MSIENLRNIAIVAHVDHGKTTLVDQLLKQSGTFSERAQVGERVMDSNDQEKERGITILAKNTAIKWNGNRINIVDTPGHADFGGEVERVLSMVDSVLLLVDAMDGPMPQTRFVTQKAFAMGFKPIVVVNKIDRPGARPDWVVEQVWDLFDRLGATPEQMDFPIVYASALNGYASLESSARAGDMNPLYEAIMQHVQPPQVDLHGPFQMRISQLDYNSYVGLIGIGRIQRGKVSTNMPVTVIDRMGNKHNGKVLQVLGFLGLERHEVEEAQAGDIVAISGIESLSISDTLTDPTAPDALPALSVDEPTISMTFQVNNSPFAGQKEYSGGKFLTSRQIRERLARETLHNVALRVEDTEDPDRFKVSGRGELHLSVLIETMRREGYELGVSRPEVIIKEIDGILQEPYEQLVVDVEEEHQGGVIERLGTRKAQLSNMELDGKGRVRLDYIIPARGLIGFQTEFKTITSGSGLLFHIFDHYGPKADGPIAKRINGVMISNGHGKAPGYALMGLQERGRLLIDAGEDIYEGMLVGIHSKDNDLTVNALREKQLTNIRASGKDDAISLTPPIKMSLEQALEFIEDDELVEVTPKAIRLRKKYLSENDRKRASRTG

SEQ ID NO: 3537 - DNA, 1827 bp, Clostridium tetani E88
  CDS (1)..(1827): transl_table=11
atggaattatttacaagaaatgacattaggaatatagcaataattgctcacgttgatcatggtaaaactactttagtagatgctatgcttaaagaaagtcacgttttcagagaaaacgaaaaagttgaagaaagagtaatggattctaatgatctagaaagagaaagaggaattactatactttcaaaaaatacatctgtaatgtatgatggagttaaaataaatataatagatactccaggtcacgcggactttggaggagaagttgaacgtgttcttaagatggtagatagtgtacttttagttgtagattcttatgaaggacctatgccacaaacaaaatttgttttaaaaaaggcattagagcttgatttaaaaccaatagttgtaataaataaaatagatagaccagatgctagagcagaagatgttttagatgaaattttcgatttgtttgtagaattaggagcttctgatgaccaattggattttcctgtagtatattgttctgctagaagtggaatagcaaaaaaacaattggaagatgaagcagaaaatatgataccattattcgacacaataataaaaaatgtaaaagcaccagaaggatatatagataaaccattccaaattcttataacaacaatagattctaatgaatatgtaggtagaattggagtaggtaaagttgaaagaggtgttgttaagcgtaatcaacaggcagcacttatgagaaaagatggcaaaatagataatgttaagataagtaaactatatacttatagcggattacaaagagaagaaacagaagaagctaaaattggagatattgttgcagttgcaggaatagatgatataaacataggagaaaccctagcagatatacaaaatcctgaagctcttccttttgtagagatagatgaaccgactcttacaatgaatttcatggtaaatgactcaccttttgcaggaaaagaaggagattatttaacttcaagacatttaagagatagactattgaaagagttggagactaatgtaagtttaaaagtagaagaaactgattcagcagattgctttaaggttagcggtagaggggagttacatctttctgtacttattgaaactatgagaagacaaggatatgaatttcaagtttcaaaaccaagcgtaatatttaaagaagaagatggtaaaaagttagaaccaatagaatacttaactatagatgttccagaagagtatatgggaacagtaatggaaaaactaggacctagaaaaggagatatggtgaacatgacttctgcattgaatggatattcaagactagaatttagaatacctgcaagaggattaataggttttagaagtgaatttatgacagatactagaggaaacggtataatgaatcatatttttgatggatatgaaccttataaaggagaaatgccaagtaaaccaagaggatctctagtagtatttgaaactggtacagcaataacttatggactgtataatgctcaagaaagaggagaattattcataggaccaggaactgaagtttaccaaggtatgatagcaggagaatattcaagagctggggatatagaagtaaatgtatgtaagaagaaacatttaagtaatacaagatcatcaggagcagatgatgcattaaaattaacaccaattactcctatgtctttagaagaatgtttggaatttatagctgcagatgaattagttgaagtcacacctattagtataaggatgagaaagaaaatattagatcctgataaaagaaaaagggcacaaatgagaaaaaaataa

SEQ ID NO: 3538 - protein, 608 aa, Clostridium tetani E88
MELFTRNDIRNIAIIAHVDHGKTTLVDAMLKESHVFRENEKVEERVMDSNDLERERGITILSKNTSVMYDGVKINIIDTPGHADFGGEVERVLKMVDSVLLVVDSYEGPMPQTKFVLKKALELDLKPIVVINKIDRPDARAEDVLDEIFDLFVELGASDDQLDFPVVYCSARSGIAKKQLEDEAENMIPLFDTIIKNVKAPEGYIDKPFQILITTIDSNEYVGRIGVGKVERGVVKRNQQAALMRKDGKIDNVKISKLYTYSGLQREETEEAKIGDIVAVAGIDDINIGETLADIQNPEALPFVEIDEPTLTMNFMVNDSPFAGKEGDYLTSRHLRDRLLKELETNVSLKVEETDSADCFKVSGRGELHLSVLIETMRRQGYEFQVSKPSVIFKEEDGKKLEPIEYLTIDVPEEYMGTVMEKLGPRKGDMVNMTSALNGYSRLEFRIPARGLIGFRSEFMTDTRGNGIMNHIFDGYEPYKGEMPSKPRGSLVVFETGTAITYGLYNAQERGELFIGPGTEVYQGMIAGEYSRAGDIEVNVCKKKHLSNTRSSGADDALKLTPITPMSLEECLEFIAADELVEVTPISIRMRKKILDPDKRKRAQMRKK

SEQ ID NO: 3539 - DNA, 1839 bp, Lactobacillus plantarum WCFS1
  CDS (1)..(1839): transl_table=11
ttgaaatttagagatgatatccgcaacattgccattattgcccacgttgaccacggtaaaacgacgttggttaacgaaatgcttaaacaatcggatacccttgacgaacatgtccagattgacgatcgggcgatggacactaatgccattgaaaaggaacgcggtatcacgatcctttcgaaaaacacggccgtacgttacggcgacaaacaaattaacattctagatacaccaggacatgctgacttcggtggtgaagtcgaacgaatcatgcgcatggttgacggggtattactcgttgttgatgcgtttgaaggaacgatgcctcaaactcggtttgttttgaaaaaagctttggaacaacacctaacaccaatcgttgttattaacaaaatcgaccgccccggtgcacgtcctgaagaggtcgttgacgaagtgttagacctcttcatcgaattaggtgctgacgaatcacaattagacttcccagtggtctatgtttcagctttaaatgggacttctagttatgaatcagatcctgctaagcaggaacatacgatgcaaccaatcttcgatacgatcatcaagacgattccatcaccaattgacaactctgacgaacctttacaattccaagtggccttattagactacaacgattatgttggtcgggttggtatcggtcgggtcttccgtggtacgatcaaggttggtgacagtgtttctgtcatgaaacttgatggtagtaagaagaatttccgcgtaactaagttgtttgggttctttggtcttcaacgtttggaaatcaatgaagcccacgccggtgacttagttgctgtttctgggatggaagatatcaacgttggtgaaacggttgctgattcagctaatcctgaagctttgccaatcttacggattgacgaaccaactttacaaatgactttcggtacgaactcctcaccatttgcgggtaaggaaggtaagttcgtaactgcccgtcaacttgaaatgcggttgaaggctgaacttgaaaccgatgtttcacttcgggttgatgatactgacgaacctggttcatgggtcgtttctggtcgtggggaattgcatttgtcaatcttaatcgaaacgttacggcgtgaaggttatgaactacaagcatctcgtccagaagttatctatcgcgaaattgatggtaagcgttgcgaaccatttgaatctgttcaaatcgatacgccagacgaatatactggttcaattattgataccttatcaaagcgtaaggctgaaatgaagaacatggaaagtactggtaataaccaaacccggttgactttcttagcaccttcacgaggcttgatcggttattcaactgaattcctttcattgacacgtggttacggaatcatgaaccatactttctctgaatacctcccagttattcctaactggaacccaggccgtcgtaacggtgctttggtttcaatcaaccagggtaagaccacgacatacgccacaatgggaatcgaagaccggggaacgatttttgttgatccaggtaccgaagtatatgaaggcatgatcgtgggccaaaacagccgcgaaaatgacatttcagttaacattactaagggtaagaacatgaccaacgtgcgttcttctaacaaggatttgacggcgacaatcaagacaccaacgcatttgacattggaagaatcgcttgaattcttgaatagtgatgaattctgtgaaattacgccagatcatgttcgcttgcggaaacgcattttgaacacgaactcccgtgaaaaagaagctaaaaagcgtaaaatgaacaagtaa

SEQ ID NO: 3540 - protein, 612 aa, Lactobacillus plantarum WCFS1
MKFRDDIRNIAIIAHVDHGKTTLVNEMLKQSDTLDEHVQIDDRAMDTNAIEKERGITILSKNTAVRYGDKQINILDTPGHADFGGEVERIMRMVDGVLLVVDAFEGTMPQTRFVLKKALEQHLTPIVVINKIDRPGARPEEVVDEVLDLFIELGADESQLDFPVVYVSALNGTSSYESDPAKQEHTMQPIFDTIIKTIPSPIDNSDEPLQFQVALLDYNDYVGRVGIGRVFRGTIKVGDSVSVMKLDGSKKNFRVTKLFGFFGLQRLEINEAHAGDLVAVSGMEDINVGETVADSANPEALPILRIDEPTLQMTFGTNSSPFAGKEGKFVTARQLEMRLKAELETDVSLRVDDTDEPGSWVVSGRGELHLSILIETLRREGYELQASRPEVIYREIDGKRCEPFESVQIDTPDEYTGSIIDTLSKRKAEMKNMESTGNNQTRLTFLAPSRGLIGYSTEFLSLTRGYGIMNHTFSEYLPVIPNWNPGRRNGALVSINQGKTTTYATMGIEDRGTIFVDPGTEVYEGMIVGQNSRENDISVNITKGKNMTNVRSSNKDLTATIKTPTHLTLEESLEFLNSDEFCEITPDHVRLRKRILNTNSREKEAKKRKMNK

SEQ ID NO: 3541 - DNA, 1845 bp, Tropheryma whipplei str. Twist
  CDS (1)..(1845): transl_table=11
gtgataaccaaggatataagaaatattgctgttgtagcacatgtagaccacggcaagacaaccctgattagcgcgatgcttcaacagacgagcgattcaaccactgcagaagatagggtgcttgactcgcatgagctcgagcgtgaaaagggaatcacgattctcgcaaagaataccgcagttacctacaagtcatccggaagatctgtgacactaaatatagtcgacacacccgggcatgcggatttcggcggagaggtcgaacggggaatgtctatggtcgacggtgttgttgtactggttgatgcaagcgaaggcccacttccacaaacccgctttgttctgaaaaaggcattactcaaaaagcttccgattgttcttgcggttaataaaacagatagaagtgatgctcgtatagatgatgttgtttctgaatttcaggacttattaatatccctggcagaagagataaacgatccggccctatacagtatccttgatgtcccgattgtatatgtttctggcagggcaggccgggcgagcataaataagccagataatggacaattgccagatagaaataatctcgatgacctatttgaaaaaataataagctatatcccggcaccggaatatgataaaaacgccccgctccaagcacatgttgccaatatcgatgcctcggcgttcttgggtcgccttgctcttacaagaatttataacggcagcatatcaaaggggcagacagtttgctgggtaaatgcctcatctaaacagcgggtgaatgtcagggtaactgagctgctcaagacagttgctttggatcgcgtgcccgtcccttcagtctctgctggtgatatagtcgccatcgctggcataccggatgtaatgataggtgactccatatgcgaccctgatgatgtcagacccctgcccggtatatccattgatgagccggcaatttcggttgttatcggtgtcaacacatctcctttggcagggggtgtcccgggccataagctcacggcaacgcaaataaaagagcgacttgacagagagacaattggcaatgtttctatacgggtcattccaacccggggaaccgatgcctgggaagtgcagggtagaggagagctggcccttgcagttcttatcgagcaaatgcgaagagaagggtttgagctaaccgttggaaagcccagcgccgtaacacgtattgtagatggtagtctccatgaaccatatgaactattgaccgtaaacctcatggacgagtattttggttcagtgacaaaattacttgccgaacggaagggtagggtggagagcgttatatccaatgccgggtggacaaatgctgattttgttgtcccttcaagggggttaattggatttcgtactgagtttttgacaattactcgcggcactgggactgcaaatgcgatttttcattcctatgctccgtggtccggtcagattaaccagcgagcacaaggatcagccgtagccgatagggcagggcatgtgacatcttatgcaatccttgggcttcaggagagggtcttgttttttgtatccccatccgagcaggtttatgaaggtatggttgttggcagaaactctcgtcccggcgacctaaatgttaatgttacaaaaggaaaaaaacttactaatacccgctcttccacggctgaagagctggagaaaatagtccccgccagacatttgtcacttgaagaatgtcttgagttcgcgggaccggatgagtgtgttgaggtaacaccagaggctattaggattcgtaagattgaactcagtcaatcggtgcgcagtaagcaaaggtga

SEQ ID NO: 3542 - protein, 614 aa, Tropheryma whipplei str. Twist
MITKDIRNIAVVAHVDHGKTTLISAMLQQTSDSTTAEDRVLDSHELEREKGITILAKNTAVTYKSSGRSVTLNIVDTPGHADFGGEVERGMSMVDGVVVLVDASEGPLPQTRFVLKKALLKKLPIVLAVNKTDRSDARIDDVVSEFQDLLISLAEEINDPALYSILDVPIVYVSGRAGRASINKPDNGQLPDRNNLDDLFEKIISYIPAPEYDKNAPLQAHVANIDASAFLGRLALTRIYNGSISKGQTVCWVNASSKQRVNVRVTELLKTVALDRVPVPSVSAGDIVAIAGIPDVMIGDSICDPDDVRPLPGISIDEPAISVVIGVNTSPLAGGVPGHKLTATQIKERLDRETIGNVSIRVIPTRGTDAWEVQGRGELALAVLIEQMRREGFELTVGKPSAVTRIVDGSLHEPYELLTVNLMDEYFGSVTKLLAERKGRVESVISNAGWTNADFVVPSRGLIGFRTEFLTITRGTGTANAIFHSYAPWSGQINQRAQGSAVADRAGHVTSYAILGLQERVLFFVSPSEQVYEGMVVGRNSRPGDLNVNVTKGKKLTNTRSSTAEELEKIVPARHLSLEECLEFAGPDECVEVTPEAIRIRKIELSQSVRSKQR

SEQ ID NO: 3543 - DNA, 1845 bp, Tropheryma whipplei TW08/27
  CDS (1)..(1845): transl_table=11
gtgataaccaaggatataagaaatattgctgttgtagcacatgtagaccacggcaagacaaccctgattagcgcgatgcttcaacagacgagcgattcaaccactgcagaagatagggttcttgactcgcatgagctcgagcgtgaaaagggaatcacgattctcgcaaagaataccgcagttacctacaagtcatccggaagatctgtgacactaaatatagtcgacacacccgggcatgcggatttcggtggagaggtcgaacggggaatgtctatggtcgatggtgttgttgtactggttgatgcaagcgaaggcccacttccacaaacccgctttgttctgaaaaaggcattactcaaaaagcttccgattgttcttgcggttaataaaacagatagaagtgatgctcgtatagatgatgttgtttctgaatttcaggacttattaatatccctggcagaagagataaacgatccggccatatacagtatccttgatgtcccgattgtatatgtttctggcagggcaggccgggcgagcataaataagccagataatggacaattgccagatagaaataatctcgatgacctatttgaaaaaataataagttatatcccggcaccggaatatgataaaagcgccccactccaagcacatgttgccaatatcgatgcctcagcgttcttgggtcgccttgctcttacaagaatttataacggcagcatatcaaagggacagacagtttgctgggtaaatacctcatctaaacagcgggtgaatgtcagggtaactgagctgctcaagacagttgctttggatcgcgtgcccgtcccttcagtctctgctggtgatatagtcgccattgctggcataccggatgtaatgataggtgactccatatgcgaccctgatgatgtcagacccctgcccggtatatccattgatgagccggcaatttcggttgttatcggtgtcaacacatctcctttggcagggggtgtcccgggccataagctcacggcaacgcaaataaaagagcgacttgacagagagacaattggcaatgtttctatacgggtcattccaacccggggaaccgatgcctgggaagtgcagggtagaggagagctggcccttgcagttcttatcgagcaaatgcgaagagaagggtttgagctaaccgttggaaagcccagcgccgtaacacgtattgtagatggtagtctccatgaaccatatgaactattgaccgtaaacctcatggacgagtattttggttcagtgacaaaattacttgccgaacggaagtgcagggtggagagcgttatatccaatgccgggtggacaaatgctgattttgttgtcccttcaagggggttaattggatttcgtactgagtttttgacaattactcgcggcactgggactgcaaatgcgatttttcattcctatgctccgtggtccggtcagattaaccagcgagcacaaggatcagccgtagccgatagggcagggcatgtgacatcttatgcaatccttgggcttcaggagagggtcttgttttttgtatccccatccgagcgggtttatgaaggtatggttgtcggcagaaactctcgtcccggcgacctaaatgttaatgttacaaaaggaaaaaaacttactaatacccgctcttccacggctgaggagctggagaaaatagtccccgccagacatttgtcacttgaagaatgtcttgagttcgcgggaccggatgagtgtgttgaggtaacaccagaggctattaggattcgtaagattgaactcagtcaatcggttcgcagtaagcaaaggtga

SEQ ID NO: 3544 - protein, 614 aa, Tropheryma whipplei TW08/27
MITKDIRNIAVVAHVDHGKTTLISAMLQQTSDSTTAEDRVLDSHELEREKGITILAKNTAVTYKSSGRSVTLNIVDTPGHADFGGEVERGMSMVDGVVVLVDASEGPLPQTRFVLKKALLKKLPIVLAVNKTDRSDARIDDVVSEFQDLLISLAEEINDPAIYSILDVPIVYVSGRAGRASINKPDNGQLPDRNNLDDLFEKIISYIPAPEYDKSAPLQAHVANIDASAFLGRLALTRIYNGSISKGQTVCWVNTSSKQRVNVRVTELLKTVALDRVPVPSVSAGDIVAIAGIPDVMIGDSICDPDDVRPLPGISIDEPAISVVIGVNTSPLAGGVPGHKLTATQIKERLDRETIGNVSIRVIPTRGTDAWEVQGRGELALAVLIEQMRREGFELTVGKPSAVTRIVDGSLHEPYELLTVNLMDEYFGSVTKLLAERKCRVESVISNAGWTNADFVVPSRGLIGFRTEFLTITRGTGTANAIFHSYAPWSGQINQRAQGSAVADRAGHVTSYAILGLQERVLFFVSPSERVYEGMVVGRNSRPGDLNVNVTKGKKLTNTRSSTAEELEKIVPARHLSLEECLEFAGPDECVEVTPEAIRIRKIELSQSVRSKQR

SEQ ID NO: 3545 - DNA, 1821 bp, Pseudomonas syringae pv. tomato str. DC3000
  CDS (1)..(1821): transl_table=11
gtgatcgaaaatctacgcaacatcgccatcattgctcacgttgaccatggtaagaccaccctggtagacaaactcctgcgtcaatccggcactctggagcgcggcgagctcaacgatgagcgcgtgatggactccaacgaccaggaaaaagagcgcggtattaccattctcgcgaagaacaccgcgatcaactggaatggctaccacatcaacatcgtggacaccccgggccacgccgacttcggtggtgaagtagagcgcgtgatgtcgatggttgactccgtactgctgctggtcgatgcccaggacggccctatgccgcaaacccgctttgtgaccaagaaggctttcgaagccggcctgcgtccaatcgtggtcatcaacaaggttgaccgtccaggcgcgcgtccggactgggttctggatcagatcttcgacctgttcgacaacctgggtgctaccgaagaacagctggacttcaaagtcgtctacgcctctgccctgaacggcattgccggtctggaccacaccgaaatggctgaagacatgaccccgctgtatcagtccatcgtcgacaacgttccggcacctgccgttgaccgtgacggcccgttccagatgcaaatctcggcactggactacaacagcttcctgggcatcatcggcgttggccgtattgctcgcggcaaggtcaagccaaacacccaggttgtggctatcgacgccaacggcaagcgccgtaacggtcgtatcctgaaactgatgggtcaccacggtctgcaccgtgtagacgtcgaagaagcagctgccggcgacatcgtctgcatcagcggcttcgaagagctgttcatctccgacaccctgtgcgacccacagaacgttgaagcgatgaagccgctgaccgttgacgaacctaccgtttccatgacgttccaggtaaacgactcgcctttctgcggtaaagaaggcaagttcgtcaccagccgtaacatcaaggaacgtctggacaaagaactgctgtacaacgttgccctgcgcgttgaagaaggcgacaccgccgacaagttcaaggtctccggccgtggtgagctgcacctctcggtactgatcgaaaccatgcgtcgcgaaggcttcgaaatgggtgttggtcgtcctgaagtgatcatccgcatggttgatggcgtcaagcacgaaccgttcgagaacgtcaccatcgacctgccggaagaatcccagggttccatcatggaacagatcggtatccgtaagggcgacctgaccaacatggttccggatggcaagggccgtgttcgtcttgaatacaacatccctgctcgtggcctgatcggtttccgtaacgaattcctgaccctgacttccggcgcaggcattctgaccagcatcttcgaccgttacgacgtgatgaagtctggcgacatgtccggccgtcagaacggcgttctggtttcggttgctaccggcaaggcactgacctactccctggaaacactgcaagcccgtggcaagctgttcctgggtcatggcgaagatgtgtacgaaggtcagatcgtcggcatcaacagccgcgacaacgacctgggtgtaaacccaaccaagggcaagaagctcgacaacatgcgtgcttccggtaaagacgaaaccatcgctctggttccgcctatccgcttcactctggaacaagcgctggaattcgtacaagaagacgaactctgcgaagtgactccaaagtcgatccgcctgcgtaagaaaatccttggcgaaagcgagcgtacccgcgctgccaagaagtcgggcaactga

SEQ ID NO: 3546 - protein, 606 aa, Pseudomonas syringae pv. tomato str. DC3000
MIENLRNIAIIAHVDHGKTTLVDKLLRQSGTLERGELNDERVMDSNDQEKERGITILAKNTAINWNGYHINIVDTPGHADFGGEVERVMSMVDSVLLLVDAQDGPMPQTRFVTKKAFEAGLRPIVVINKVDRPGARPDWVLDQIFDLFDNLGATEEQLDFKVVYASALNGIAGLDHTEMAEDMTPLYQSIVDNVPAPAVDRDGPFQMQISALDYNSFLGIIGVGRIARGKVKPNTQVVAIDANGKRRNGRILKLMGHHGLHRVDVEEAAAGDIVCISGFEELFISDTLCDPQNVEAMKPLTVDEPTVSMTFQVNDSPFCGKEGKFVTSRNIKERLDKELLYNVALRVEEGDTADKFKVSGRGELHLSVLIETMRREGFEMGVGRPEVIIRMVDGVKHEPFENVTIDLPEESQGSIMEQIGIRKGDLTNMVPDGKGRVRLEYNIPARGLIGFRNEFLTLTSGAGILTSIFDRYDVMKSGDMSGRQNGVLVSVATGKALTYSLETLQARGKLFLGHGEDVYEGQIVGINSRDNDLGVNPTKGKKLDNMRASGKDETIALVPPIRFTLEQALEFVQEDELCEVTPKSIRLRKKILGESERTRAAKKSGN

SEQ ID NO: 3547 - DNA, 1830 bp, Vibrio parahaemolyticus RIMD 2210633
  CDS (1)..(1830): transl_table=11
atggctactccacagattgataaattaagaaatatcgcgattatcgcgcacgttgaccacggtaaaacaacgttggttgacaagctgctacaacaatcaggcacgctagagtctcgcggtgaagctgaagagcgagtcatggactcgaacgacatcgagaaagagcgcggtattacaatccttgctaaaaacacagcaattaactggaacgattaccgtatcaacatcgtagatactccgggacacgcggacttcggtggtgaagtagaacgtatcatgtcgatggtagactctgtactacttatcgttgacgcggttgacggcccaatgccacaaacgcgcttcgtaacgcaaaaagcatttgcgcacggtcttaagccaatcgttgtaatcaacaagattgaccgcccaggcgctcgtcctgattgggttatggaccaagtgttcgacctattcgacaacctaggtgcaactgatgaccagctagactttaaagtggtttacgcatcagcacttaacggttgggcttctctagaagaaggcgaaactggcgagaatatggaaccactattccaaactatcgttgacgttgttgacgcaccaaatgttgaccttgatggtccactacagatgcaagtttctcagctagactacagctcttacgttggtgttatcggtgttgctcgtgtaactcgtggtagcgttaaagcaaaccaacaagtaaccatcattggtgctgacggtaaaactcgtaacggtaaagttggcacagtaatgggctacctaggcctagagcgtcacgaagttgagcaagctaacgcaggtgatatcattgcgatcactggtcttggcgagctaaaaatctctgacactatctgtgcacaaaacgcagtagaagcactacctgcactgtctgttgatgaaccaacagtaacgatgacgttccaagtaaacacgtctccattcgctggtaaagaaggtaagtttgtaacttcacgtaacatccttgagcgtctagagaaagaactggtacacaacgttgcactacgcgttgagcaaacagacgatccagacaaattccgcgtttcaggccgtggtgaacttcacctatctatcctgatcgaaaacatgcgtcgtgaaggcttcgagcttgcagtatctcgtccagaagtaatcatcaaagaagaagatggtcagctaatggaaccgttcgaaaccgtaactatcgacgttatggaagagcaccaaggcggtatcatggagaacatcggcctacgtaaaggtgagctaaaagatatggctccagacggcaaaggccgtgtacgtatggacttcatcatgccatctcgtggtctgatcggtttccaaacggaattcatgacactaacttctggttctggtcttctttaccatacgttcgatcattacggccctcacaaaggcggtaacatcggtcaacgtgttaacggtgtacttatcgcgaacgcagctggtaaagcactaacgaacgcactgttcaaccttcaagagcgtggtcgtctattcatcggtcacggtgtagaagtttacgaaggcatggttatcggtattcacagccgcgacaatgacctaacagtaaacgcactgaaaggtaagcagctaaccaacgttcgtgcatctggtacagatgacgcacaggttcttactccgccaatcgttatgactctagaacaagctctagaattcatcgatgacgacgaactagtagaagtaacacctgaaagcatccgtatccgtaagaaattcctaacggaaagcgaccgtaagcgtgcttcacgttcagcaaaataa

SEQ ID NO: 3548 - protein, 609 aa, Vibrio parahaemolyticus RIMD 2210633
MATPQIDKLRNIAIIAHVDHGKTTLVDKLLQQSGTLESRGEAEERVMDSNDIEKERGITILAKNTAINWNDYRINIVDTPGHADFGGEVERIMSMVDSVLLIVDAVDGPMPQTRFVTQKAFAHGLKPIVVINKIDRPGARPDWVMDQVFDLFDNLGATDDQLDFKVVYASALNGWASLEEGETGENMEPLFQTIVDVVDAPNVDLDGPLQMQVSQLDYSSYVGVIGVARVTRGSVKANQQVTIIGADGKTRNGKVGTVMGYLGLERHEVEQANAGDIIAITGLGELKISDTICAQNAVEALPALSVDEPTVTMTFQVNTSPFAGKEGKFVTSRNILERLEKELVHNVALRVEQTDDPDKFRVSGRGELHLSILIENMRREGFELAVSRPEVIIKEEDGQLMEPFETVTIDVMEEHQGGIMENIGLRKGELKDMAPDGKGRVRMDFIMPSRGLIGFQTEFMTLTSGSGLLYHTFDHYGPHKGGNIGQRVNGVLIANAAGKALTNALFNLQERGRLFIGHGVEVYEGMVIGIHSRDNDLTVNALKGKQLTNVRASGTDDAQVLTPPIVMTLEQALEFIDDDELVEVTPESIRIRKKFLTESDRKRASRSAK

SEQ ID NO: 3549 - DNA, 1824 bp, Salmonella enterica subsp. enterica serovar Typhi Ty2
  CDS (1)..(1824): transl_table=11
gtgatcgaaaatttgcgtaacatcgccatcatcgcgcacgttgaccatggtaaaactaccctggttgataagctgctccagcaatccggtacgttcgacgcgcgtgccgaaactcaagagcgagtgatggactccaacgatttggagaaagagcgtggtattactatcctcgctaaaaacaccgctattaaatggaatgattatcgtatcaacatcgttgatactcccgggcacgctgacttcggtggtgaagtagagcgcgtcatgtccatggttgactctgtgctgctggtggttgacgcatttgacggcccgatgccgcaaacgcgcttcgtgaccaaaaaagcctttgctcatggcctgaaacccattgtggttatcaacaaggttgaccgtcctggcgcgcgccctgactgggttgtcgaccaggtattcgacctgtttgttaacctcgacgcgaccgacgaacagctggacttcccgatcatctacgcttcggcgctgaacggtatcgcgggtctggaccacgaagatatggcggaagacatgaccccgctgtatcaggcgatcgttgatcatgttccggcgccggacgttgacctcgatggtccgttgcagatgcagatctcccagctggactacaacaactacgttggcgttatcggcattggccgtatcaaacgcggcaaagtgaagccgaaccagcaggtcactatcatcgatagtgaagggaaaacccgtaacgcgaaagtaggtaaggtgctgacgcatctgggtctggagcgtatcgacagcgatatcgccgaagcgggcgatatcattgcgatcaccggtctgggcgagctgaacatttccgacaccatctgcgacccgcagaacgttgaagcgctgccggcgctgtccgttgatgagccgaccgtgtctatgttcttctgcgttaacacctcgtcgttctgcggtaaagaaggtaagtttgtgacttctcgtcagattcttgaccgtctgaacaaagagctggtgcataacgtggcgctgcgcgttgaagaaaccgaagatgcggatgcgttccgtgtatccggtcgtggcgaactgcacctgtccgtgctgattgaaaacatgcgtcgtgaaggtttcgaactggcggtttcccgtccgaaagttatcttccgtgaaatcgacggtcgtaaacaagagccgtacgaaaacgtgacgctggacgtcgaagagcagcaccaggggtctgtcatgcaggcgctgggcgagcgtaaaggcgatctgaaaaacatgaatccggacggtaaaggccgcgtacgtctcgactacgtgatcccaagccgcgggctgattggtttccgttcagaattcatgaccatgacttccggtacgggtctgctgtactccaccttcagccattacgacgatattcgtccgggtgaagtgggccagcgtcagaacggcgtactgatctccaacggtcagggtaaagcggtggcgtttgcgctgttcggtttgcaggatcgcggtaagctgttcctgggtcacggcgcggaagtttacgaaggccagattattggtattcacagtcgctccaacgacctgacggtaaactgcctgaccggtaagaaactgaccaacatgcgtgcgtccggtacggatgaagcggtgattctggttccgccaattaaaatgagtcttgagcaagcgctggagttcattgatgacgacgaactggtagaagtcactccaacctctatccgtatccgtaaacgtcacctgacggaaaacgatcgccgccgtgcgaaccgtggtcagaaagaagagtaa

SEQ ID NO: 3550 - protein, 607 aa, Salmonella enterica subsp. enterica serovar Typhi Ty2
MIENLRNIAIIAHVDHGKTTLVDKLLQQSGTFDARAETQERVMDSNDLEKERGITILAKNTAIKWNDYRINIVDTPGHADFGGEVERVMSMVDSVLLVVDAFDGPMPQTRFVTKKAFAHGLKPIVVINKVDRPGARPDWVVDQVFDLFVNLDATDEQLDFPIIYASALNGIAGLDHEDMAEDMTPLYQAIVDHVPAPDVDLDGPLQMQISQLDYNNYVGVIGIGRIKRGKVKPNQQVTIIDSEGKTRNAKVGKVLTHLGLERIDSDIAEAGDIIAITGLGELNISDTICDPQNVEALPALSVDEPTVSMFFCVNTSSFCGKEGKFVTSRQILDRLNKELVHNVALRVEETEDADAFRVSGRGELHLSVLIENMRREGFELAVSRPKVIFREIDGRKQEPYENVTLDVEEQHQGSVMQALGERKGDLKNMNPDGKGRVRLDYVIPSRGLIGFRSEFMTMTSGTGLLYSTFSHYDDIRPGEVGQRQNGVLISNGQGKAVAFALFGLQDRGKLFLGHGAEVYEGQIIGIHSRSNDLTVNCLTGKKLTNMRASGTDEAVILVPPIKMSLEQALEFIDDDELVEVTPTSIRIRKRHLTENDRRRANRGQKEE

SEQ ID NO: 3551 - DNA, 1800 bp, Bacteroides thetaiotaomicron VPI-5482
  CDS (1)..(1800): transl_table=11
atgcaaaatattcgaaacattgcaatcattgcccatgttgaccatgggaaaacaacgctggttgacaagatgttgctggccggaaatctattccgcagcaatcaaaatagtggtgaacttatcctggataacaacgacctggaacgtgaacgtggtataacgatcctttctaaaaatgtatccatcaattacaacggtactaaaattaacatcattgatactccgggacacagcgacttcggtggtgaagtagaacgcgtattgaatatggcagatggctgcattctgttagtcgacgctttcgaaggtccgatgccccaaacacgtttcgtacttcagaaggcactggaaatcggtttgaaaccaatcgtggtagtaaataaggtagataagcctaactgccgccctgaagaagtttacgaaatggttttcgacctgatgttcagcctcaacgcaacagaagaccaactggacttccccgttatttacggttccgccaaaaataactggatgagcacagactggcaaaagccgacagataccattaccccgctactggattgtattattgaaaatattcctgctcccgaacaactggaaggtactccgcagatgctgattacttctctggattattcttcttataccggtcgtattgccgtaggtcgcgtacatcgcggtaccttgaaagaaggaatgaacatcacgctggtaaaacgtaatggcgatatgttcaaatctaaaattaaagagcttcatgtatttgaaggtttgggacgtgtaaaaacaaacgaagtttcatcaggagatatctgtgcattggtaggtatcgagggttttgagatcggagatacggtctgcgatttcgaaaatccggaagcattaccgccaatcgctatcgacgagccgacgatgagcatgctatttgccatcaatgactctccattcttcggaaaagacggtaagttcgtgacttcacgccacatccacgaccgtctgatgaaagaacttgataagaatctggcactccgtgtaagaaagagtgaggaagacggcaaatggattgtttccggccgtggcgtacttcacctttctgtattgatcgagaccatgcgtcgtgaaggatacgaactgcaggtaggtcagccacaggttatctttaaagaaatcgacggcgtcaagtgcgaaccgatcgaagaactgacaatcaacgtaccggaagaatattcaagcaagattatcgatatggttacccgccgcaaaggtgaaatggtgaagatggaaaatacgggcgaacgtatcaaccttgaatttgacatgccttcacgtggtatcatcggtcttcgtaccaacgtactgactgcttctgccggtgaagctatcatggcacaccgttttaaagaatatcagccgcacaagggagaaatcgaacaccgtaccaatggttccatgatcgcaatggaaagcggaactgcttttgcctatgccatcgataaattgcaggatcgcggtaagttcttcatcttcccgcaggacgaagtatatgcaggccaggtagtaggagaacactcccatgacaacgatctggttatcaacgttacaaaatccaaaaagcttaccaacatgcgtgcttccggatctgatgacaaagttcgtttgattccgcctgttcagttctcactcgaagaggcattggaatacatcaaagaagatgaatacgtagaggtaactccgaaagcaatgcgtatgcgcaaagtcattctggacgaaatcgagcgtaaacgcgcgaacaaatcataa

SEQ ID NO: 3552 - protein, 599 aa, Bacteroides thetaiotaomicron VPI-5482
MQNIRNIAIIAHVDHGKTTLVDKMLLAGNLFRSNQNSGELILDNNDLERERGITILSKNVSINYNGTKINIIDTPGHSDFGGEVERVLNMADGCILLVDAFEGPMPQTRFVLQKALEIGLKPIVVVNKVDKPNCRPEEVYEMVFDLMFSLNATEDQLDFPVIYGSAKNNWMSTDWQKPTDTITPLLDCIIENIPAPEQLEGTPQMLITSLDYSSYTGRIAVGRVHRGTLKEGMNITLVKRNGDMFKSKIKELHVFEGLGRVKTNEVSSGDICALVGIEGFEIGDTVCDFENPEALPPIAIDEPTMSMLFAINDSPFFGKDGKFVTSRHIHDRLMKELDKNLALRVRKSEEDGKWIVSGRGVLHLSVLIETMRREGYELQVGQPQVIFKEIDGVKCEPIEELTINVPEEYSSKIIDMVTRRKGEMVKMENTGERINLEFDMPSRGIIGLRTNVLTASAGEAIMAHRFKEYQPHKGEIEHRTNGSMIAMESGTAFAYAIDKLQDRGKFFIFPQDEVYAGQVVGEHSHDNDLVINVTKSKKLTNMRASGSDDKVRLIPPVQFSLEEALEYIKEDEYVEVTPKAMRMRKVILDEIERKRANKS

SEQ ID NO: 3553 - DNA, 1836 bp, Enterococcus faecalis V583
  CDS (1)..(1836): transl_table=11
ttgaaatacagagatgatattcgtaacgtggcaattatcgcccacgttgaccatggtaaaacaaccttagtagatgaacttttaaaacaatctgacactttagatggacacacacaattacaagaacgtgcaatggattccaatgcacttgaaagtgaacgtggaattactatcttagcaaaaaatacagccgtagattataacggtacacgtatcaacattctagatacaccaggacacgcggacttcggtggtgaagtagaacgtatcatgaaaatggtagacggtgttgttttagttgtcgatgcgtatgaaggaacaatgcctcaaacacgtttcgtattgaaaaaagcattagaacaaaaagtaacaccaatcgtggttgttaacaaaattgacaaaccttctgctcgtcctgaacacgtagtagatgaagttttagagttattcatcgaattaggtgcagacgacgatcaattagatttcccagttgtttatgcttctgctttaaacggaacttcaagtgaatcagatgatccagcagatcaagagccaacaatggccccaatttttgataaaattattgaacatgtgccagctccagttgacaattcagacgaaccacttcaattccaagtctcattactagactacaacgattacgttggacgtattgggattggccgtgtgttccgtggcacaatgaaagtcggcgaccaagttgcgttgatgaaattagatggcagcgtgaaaaatttccgtgtaacgaaaattttaggtttctttggcttacaacgtgtggaaattgatgaagcaaaagcgggcgatttaattgccgtttctggaatggaagacattttcgttggggaaacagttgtagatgttcacaatcaagaagcattaccaattctacacattgatgagccaaccttacaaatgactttcttagttaacaattctccatttgcgggacgtgaaggaaaatacatcaccgctcgtaaaatcgaagaacgtttaatggctgagttacaaacagacgtatctttacgtgttgatccaattggcccagattcttggactgtatcaggtcgtggcgaattgcatttatcaattttaattgaaaacatgcgtcgtgaaggctatgaattacaagtttctcgtccagaagttattgaacgtgaaattgatggagttaaatgtgaaccatttgaacgtgttcaaattgacacacctgaagaatacatgggtagcgtgattgaatcactaagtttacgtaaaggcgaaatgcaagatatgattaatgccggtaacggacaaatgcgtttaatcttcttagcaccagctcgtggcttaattggttattcaacagaattcttatcaatgactcgtggttatggtattatgaaccacaccttcgatcaatacttaccaatgattcaaggaacgattggtggccgtcatcaaggtgcactagtttcaatcgatactggtaaagcaacgacttactcaatcatgagtattgaagaacgtggtacagttttcgttgaaccaacgacagaagtttacgaaggaatgattgttggggaaaacaaccgcgacaacgatttaactgtgaacatcacaaaagctaaacaaatgactaacgttcgttcggcaacgaaagaccaaacatcagtcattaaaaaaccgaaaaaattaacgttagaagaatcattagaattcttgaatgaagatgaatactgtgaagtaacaccagaaagcatccgtttaagaaaacaaattcttaacaaaaacgaacgcgaaaaagcaagcaagaaaaagaaaaaagctgaataa

SEQ ID NO: 3554 - protein, 611 aa, Enterococcus faecalis V583
MKYRDDIRNVAIIAHVDHGKTTLVDELLKQSDTLDGHTQLQERAMDSNALESERGITILAKNTAVDYNGTRINILDTPGHADFGGEVERIMKMVDGVVLVVDAYEGTMPQTRFVLKKALEQKVTPIVVVNKIDKPSARPEHVVDEVLELFIELGADDDQLDFPVVYASALNGTSSESDDPADQEPTMAPIFDKIIEHVPAPVDNSDEPLQFQVSLLDYNDYVGRIGIGRVFRGTMKVGDQVALMKLDGSVKNFRVTKILGFFGLQRVEIDEAKAGDLIAVSGMEDIFVGETVVDVHNQEALPILHIDEPTLQMTFLVNNSPFAGREGKYITARKIEERLMAELQTDVSLRVDPIGPDSWTVSGRGELHLSILIENMRREGYELQVSRPEVIEREIDGVKCEPFERVQIDTPEEYMGSVIESLSLRKGEMQDMINAGNGQMRLIFLAPARGLIGYSTEFLSMTRGYGIMNHTFDQYLPMIQGTIGGRHQGALVSIDTGKATTYSIMSIEERGTVFVEPTTEVYEGMIVGENNRDNDLTVNITKAKQMTNVRSATKDQTSVIKKPKKLTLEESLEFLNEDEYCEVTPESIRLRKQILNKNEREKASKKKKKAE

SEQ ID NO: 3555 - DNA, 1809 bp, Coxiella burnetii RSA 493
  CDS (1)..(1809): transl_table=11
atgatcgaaaatatccgtaatattgccattattgcccacgtggaccatgggaaaacgacgctcgttgaccagttgcttcagcagtcagggacgttgaatgagcgggccgcgccggtggagcggatgatggattctaatatattagaacgggagcgggggattaccattttagcgaagaatacggcgatccggtggcggaattatcggatcaacatagtggatacgccgggccacgcggattttgggggtgaggttgagcgtattttatcgatggtcgattcggttttgttattggtggatgcggtagaaggccctatgccgcaaacacggtttgtaacgcgtaaggcattttcgtggggtttgaagccgattgtagtggtgaataaaattgaccgtccgggcgcgcgtcccgactgggtagtggaacaggtgtttgatttatttgtcagtctagatgccaccgatgcccagttggattttcctgttgtttatgcgtctgccttgaaggggtatgcgacgttggatctctctcatccatcgacggatatgaccccgttgtttgagactattgtctccaaagtggtcccgcctcaggtcgatttaaacggcccttttcaaatgcaaatctcgtcgctggattattcgagttatgtgggggctattggaatcgggcgtattcagcgtggcacgattcgacggaatacgcctgttattattattgaccgcgaagggaaaaggcgttcggggcgtgtattacaattgttgggatttttagggttgcagcgagttgacatcgaaacagcagaagcgggtgatatcgtcgcagtgacgggcatcgaaaatcttcgaatttcggataccctctgcgatccacagcaggtagaagcactcccgccgctaacggtggatgaaccgactgttagcatgactttccaagtgaataattcgccctttgcagggcgcgaaggtaaatttctcacgagccgacaaattaaagagcgactagaaaaagaattaattgcaaatgtcgcgttacgcgttgccgccggggctgatgctgataaatttattgtgtcaggtcgaggtgaacttcatttatcaatattaattgaaaatatgcgtcgcgaaggctatgaattttcggtatcgcgtcccgaagttattaagaaaatggtcgatgacattgaatgcgaaccgtttgaaaacttagtgttggatattgatgaagaacatcaaggcgatattatccaaaatttagcaaagcgcaaaggcgatttaaaaaatatgatgcctggcggaaaagggcgagtgcgattggattatctcattcccacgcgcggattgattggttttcattctcactttttgacgctgacgtctgggtctggcgtgatgtatcacgtatttgatcattatgcgccgttaattgaggagtctttacaaactcgtcaccgtggcgtgctaatatcgaatagtcagggtgtggcaactgcttacgcgctatggaatttacaatcgcggggtaatttatttattggtccccaacaggcggtttacgaaggcatgattgtcggtcaacattcccgggataatgatttagtcgttaacgtctgccgtgaaaaacagcttaccaacattcgcgccgctggtagtgatgagaatattattttaacgccaccgattaaattcagcttagaacaagccttgcaatttattgctgatgacgagctagtcgaaatcaccccagcggctattcgtttacgtaaaaaattattaaaagaacacgaacgccgccgagcagaaaggtag

SEQ ID NO: 3556 - protein, 602 aa, Coxiella burnetii RSA 493
MIENIRNIAIIAHVDHGKTTLVDQLLQQSGTLNERAAPVERMMDSNILERERGITILAKNTAIRWRNYRINIVDTPGHADFGGEVERILSMVDSVLLLVDAVEGPMPQTRFVTRKAFSWGLKPIVVVNKIDRPGARPDWVVEQVFDLFVSLDATDAQLDFPVVYASALKGYATLDLSHPSTDMTPLFETIVSKVVPPQVDLNGPFQMQISSLDYSSYVGAIGIGRIQRGTIRRNTPVIIIDREGKRRSGRVLQLLGFLGLQRVDIETAEAGDIVAVTGIENLRISDTLCDPQQVEALPPLTVDEPTVSMTFQVNNSPFAGREGKFLTSRQIKERLEKELIANVALRVAAGADADKFIVSGRGELHLSILIENMRREGYEFSVSRPEVIKKMVDDIECEPFENLVLDIDEEHQGDIIQNLAKRKGDLKNMMPGGKGRVRLDYLIPTRGLIGFHSHFLTLTSGSGVMYHVFDHYAPLIEESLQTRHRGVLISNSQGVATAYALWNLQSRGNLFIGPQQAVYEGMIVGQHSRDNDLVVNVCREKQLTNIRAAGSDENIILTPPIKFSLEQALQFIADDELVEITPAAIRLRKKLLKEHERRRAER

SEQ ID NO: 3557 - DNA, 1908 bp, Streptomyces avermitilis MA-4680
  CDS (1)..(1908): transl_table=11
atggccacgcgccacgacatccgcaacgtcgccatcgtcgcccacgtcgaccacgggaagacgaccctcgtcgacgccatgctgaagcaggccggtgccttcgcggcgcacgccgccgaatcgctcgacgaccgcatgatggactcgaacgatctggagcgtgagaagggcatcacgatcctggccaagaacacggccgtgaagtaccacccgaaggatggcggcgacgtcatcacgatcaacatcatcgacacccccggccacgccgacttcggtggtgaggtcgagcgcggcctgtcgatggtggacgcggtggtgctgctcgtcgacgcctccgagggcccgctgccgcagacccgcttcgtgctgcgcaaggcgctgcaggcccgcctgcccgtcatcctgtgcatcaacaagacggaccgccccgactcgcgcatcgacgaggtcgtcaacgaggcctacgacctcttcctcgacctcgacgccgacgaggaccagatcgagttcccgatcgtctacgcgtgtgcgcgtgacggtgtggcctcgctgaccaagccgcaggacggcaccgtcccggccgacagcgacagcctggagccgttcttctccacgatcctccagcacgtcccggccccgacgtacgacgaggcggcccccctccaggcgcacgtcaccaacctggacgcggacaacttcctcggccgtatcgcgctgctgcgcgtcgagcagggcgagctccgcaagggccagacggtcgcgtggatcaagcgcgacggcaccgtctccaacgtccgcatcaccgagctgatgatgaccgaggcgctcacccgcaagcccgccgagatggcggggccgggtgacatctgtgccgtcgccggtatcccggacatcatgatcggtgagaccctcgccgaccccgagaacccgatcgcgctcccgctgatcacggtcgacgagcccgcgatctccatggtcatcggtacgaacacctcgccgctggtcggccgtggcggcaccggcaagggtgcctccgccaaggcggccgtcaaggaccgcaaggtcaccgcccgccaggtcaaggaccgtctggaccgcgagctggtcggtaacgtctcgctccgtgtgctcgacaccgagcgcccggacgcgtgggaggtccagggccgtggtgagctcgcgctcgccatcctggtcgagcagatgcgccgcgagggcttcgagctcaccatcggcaagccgcaggtcgtcaccaaggaggtcgacggcaaggtccacgagcccgtcgagcgcctcacggtcgacgtgcccgaggagcacatgggcgcggtcacgcagctcatgggcgtccgcaagggccggatggacaacatgtccaaccacggctccggctgggtccgcatggagttcgtcgtcccgtcccgtggcctgatcggcttccgtacggagttcctcaccggcacgcgtggcacgggcatcgcccactccatccacgagggccacgagccgtggttcggcaccctgacgacccgtaacaacggttcgctggtcgccgaccgcgcgggcgccgtcaccgccttcgcgatgacgaacctccaggagcgcggcgtgctgttcaccgaccccggcaccgaggtgtacgagggcatgatcgtcggcgagaactcgcgcgccgacgacatggacgtgaacatcaccaaggagaagaagctcaccaacatgcgctcctcctcggccgactcgttcgaggcgatcgtcccgccgcgcaagctctcgctcgagcagtcgctggagttctgccgcgacgacgagtgcgtcgaggtgactccggaggccgtgcgcatccgcaaggtcgtcctggaccagaaggagcgcggtcgcaccgccagccgagccaagcacggctga

SEQ ID NO: 3558 - protein, 635 aa, Streptomyces avermitilis MA-4680
MATRHDIRNVAIVAHVDHGKTTLVDAMLKQAGAFAAHAAESLDDRMMDSNDLEREKGITILAKNTAVKYHPKDGGDVITINIIDTPGHADFGGEVERGLSMVDAVVLLVDASEGPLPQTRFVLRKALQARLPVILCINKTDRPDSRIDEVVNEAYDLFLDLDADEDQIEFPIVYACARDGVASLTKPQDGTVPADSDSLEPFFSTILQHVPAPTYDEAAPLQAHVTNLDADNFLGRIALLRVEQGELRKGQTVAWIKRDGTVSNVRITELMMTEALTRKPAEMAGPGDICAVAGIPDIMIGETLADPENPIALPLITVDEPAISMVIGTNTSPLVGRGGTGKGASAKAAVKDRKVTARQVKDRLDRELVGNVSLRVLDTERPDAWEVQGRGELALAILVEQMRREGFELTIGKPQVVTKEVDGKVHEPVERLTVDVPEEHMGAVTQLMGVRKGRMDNMSNHGSGWVRMEFVVPSRGLIGFRTEFLTGTRGTGIAHSIHEGHEPWFGTLTTRNNGSLVADRAGAVTAFAMTNLQERGVLFTDPGTEVYEGMIVGENSRADDMDVNITKEKKLTNMRSSSADSFEAIVPPRKLSLEQSLEFCRDDECVEVTPEAVRIRKVVLDQKERGRTASRAKHG

SEQ ID NO: 3559 - DNA, 1845 bp, Bacillus cereus ATCC 14579
  CDS (1)..(1845): transl_table=11
atgttgaaaaaacgacaagatttacgtaatatagcaattattgcccacgttgaccatggtaaaacaacacttgttgaccagttattacgtcaagcggggactttccgtgcgaacgaacacgttgaagaacgcgcaatggattcaaatgatctagaaagagaacgcggtattacaattttagcgaaaaatacagcgattcactatgaagataaaagaattaacattttagatacacctggtcacgctgacttcggtggagaagtagaacgtatcatgaaaatggttgatggtgttttacttgttgttgatgcatatgaaggttgtatgccacaaacacgatttgttttaaagaaagctcttgagcaaaacttaactccaatcgtagttgtaaacaaaattgaccgtgacttcgctcgtccagatgaagtagttgatgaagtaatcgacttattcattgagcttggtgcaaacgaagatcaattagagttcccagttgtatttgcatcagcaatgaacggaacagcaagcttagattcaaatccagcaaatcaagaagagaatatgaaatcattattcgatacaattatcgaacatattccagcaccaattgataacagcgaagagccacttcaattccaagtagcacttcttgattacaacgactacgttggacgtattggagttggtcgcgtattccgcggtacaatgaaggttggacaacaagttgctttaatgaaagtagacggaagcgtgaagcaattccgcgtaacgaaattattcggttacatgggattaaaacgtcaagaaattgaagaagcaaaagcaggggacttagtagccgtttctggtatggaagacattaacgtaggtgaaacagtatgtccagttgaacatcaagatgcgttaccattattacgtattgatgagccaacactacaaatgacgttccttgtaaataacagcccatttgcaggtcgtgaaggtaaatacattacatctcgtaaaattgaagagcgtcttcgttcacaattagaaacagatgtaagtttacgtgtagataatacagattctcctgatgcgtggatcgtatctggacgtggggaactacatttatctatcttaattgaaaacatgcgtcgtgaaggttatgaattacaagtatctaagccagaagtaatcattaaagaagttgatggcgtaagatgtgagcctgtagagcgcgtacaaatcgatgtacctgaagaatacactggttctattatggaatctatgggtgcacgtaaaggtgaaatgttagatatggtgaataacggaaacggtcaagttcgtcttactttcatggttccagcacgtggtttaattggttacacaacagaattcttaacattaactcgtggttacggtattttaaaccatacattcgattgctaccaaccagtacacgctggacaagttggtggacgtcgccaaggtgttctagtttcacttgaaacaggaaaagcatcacaatacggtattatgcaagttgaagaccgtggtgtaatcttcgttgaaccaggtacagaagtatatgctggtatgattgtcggagaacacactcgtgagaacgacttaacagttaacgttgtgaaaatgaaacaacaaactaacattcgttctgcgacgaaagatcaaacttcaacaatgaagaaaccacgcctaatgactttagaagaatcattagagtacttaaacgatgacgagttctgtgaagtaactccagaatcaattcgtctacgtaaaaagattcttgataagagtgagcgcgaaagagctgctaagaaaaagaaatctgttgaagcgtaa

SEQ ID NO: 3560 - protein, 614 aa, Bacillus cereus ATCC 14579
MLKKRQDLRNIAIIAHVDHGKTTLVDQLLRQAGTFRANEHVEERAMDSNDLERERGITILAKNTAIHYEDKRINILDTPGHADFGGEVERIMKMVDGVLLVVDAYEGCMPQTRFVLKKALEQNLTPIVVVNKIDRDFARPDEVVDEVIDLFIELGANEDQLEFPVVFASAMNGTASLDSNPANQEENMKSLFDTIIEHIPAPIDNSEEPLQFQVALLDYNDYVGRIGVGRVFRGTMKVGQQVALMKVDGSVKQFRVTKLFGYMGLKRQEIEEAKAGDLVAVSGMEDINVGETVCPVEHQDALPLLRIDEPTLQMTFLVNNSPFAGREGKYITSRKIEERLRSQLETDVSLRVDNTDSPDAWIVSGRGELHLSILIENMRREGYELQVSKPEVIIKEVDGVRCEPVERVQIDVPEEYTGSIMESMGARKGEMLDMVNNGNGQVRLTFMVPARGLIGYTTEFLTLTRGYGILNHTFDCYQPVHAGQVGGRRQGVLVSLETGKASQYGIMQVEDRGVIFVEPGTEVYAGMIVGEHTRENDLTVNVVKMKQQTNIRSATKDQTSTMKKPRLMTLEESLEYLNDDEFCEVTPESIRLRKKILDKSERERAAKKKKSVEA

SEQ ID NO: 3561 - DNA, 1824 bp, Shigella flexneri 2a str. 2457T
  CDS (1)..(1824): transl_table=11
gtgatcgaaaaattgcgtaatatcgccatcatcgcgcacgtagaccatggtaaaaccaccctggtagacaagctgctccaacaatccggtacgttcgactctcgtgccgaaacccaagagcgcgtgatggactccaacgatttggagaaagagcgtgggattaccatcctcgcgaaaaacaccgctatcaaatggaatgattaccgtatcaacatcgttgataccccggggcacgccgacttcggtggtgaagttgaacgtgtaatgtccatggtagactcagtgctgctggtggttgacgcatttgacggcccgatgccgcaaacgcgcttcgtaaccaaaaaagcgtttgcttacggcctgaagccgattgttgttatcaacaaagttgaccgccctggcgcgcgtcctgattgggttgtggatcaggtattcgatctgttcgttaacctcgacgcgaccgacgagcagctggacttcccgatcgtttacgcttctgcgctgaacggtatcgcgggtctggaccacgaagatatggcggaagacatgaccccgctgtatcaggcgattgttgaccacgttcctgcgccggacgttgaccttgacggtccgttccagatgcagatttctcagctcgattacaacagctatgttggcgttatcggcattggccgcatcaagcgtggtaaagtgaagccgaaccagcaggttactatcatcgatagcgaaggcaaaacccgtaacgcgaaagtcggtaaagtgctgggccacctcggtctggaacgtatcgaaaccgatctggcggaagctggcgatatcgtggcgatcacgggcctgggcgaactgaacatttctgacaccgtttgcgacacgcaaaacgttgaagcgctgccggcactctccgttgatgagccgaccgtttctatgttcttctgcgttaacacctccccgttctccggtaaagaaggtaagttcgtaacgtctcgtcagatcctcgatcgtctgaacaaaaaactggtacacaacgttgcgctgcgcgtagaagaaaccgaagacgccgatgcgttccgcgtttctggtcgtggtgaactgcacctctctgttcttatcgaaaacatgcgtcgtgaaggtttcgaactggcggtatcccgtccgaaagtaatcttccgtgaaatagacggtcgtaaacaagagccgtatgaaaacgtgacgctggacgttgaagaacagcatcagggttctgtgatgcaggcgctgggcgaacgtaaaggcgacctgaaaaacatgaatccagacggtaaaggccgcgtacgtctcgactacgtgatcccaagccgtggtctgattggcttccgttctgagttcatgaccatgacttccggtactggtctgctgtactccaccttcagccactacgacgacgtacgtccgggcgaagtgggtcagcgtcagaacggtgtactgatctctaacggtcagggtaaagctgtcgcgttcgcgctgttcggtctgcaggatcgcggtaagctgttcctcggtcacggtgcagaagtttacgaaggtcagattatcggtattcatagccgctctaacgacctgactgtaaactgcctgaccggtaagaaactgaccaacatgcgtgcttccggtactgacgaagctgttgttctggttccgcctatccgcatgactctggaacaagctctggagttcatcgatgatgacgaactggtagaagtgactccgacctctatccgtattcgtaaacgtcacctgacggaaaacgatcgtcgccgcgccaaccgcgcaccgaaagacgattaa

SEQ ID NO: 3562 - protein, 607 aa, Shigella flexneri 2a str. 2457T
MIEKLRNIAIIAHVDHGKTTLVDKLLQQSGTFDSRAETQERVMDSNDLEKERGITILAKNTAIKWNDYRINIVDTPGHADFGGEVERVMSMVDSVLLVVDAFDGPMPQTRFVTKKAFAYGLKPIVVINKVDRPGARPDWVVDQVFDLFVNLDATDEQLDFPIVYASALNGIAGLDHEDMAEDMTPLYQAIVDHVPAPDVDLDGPFQMQISQLDYNSYVGVIGIGRIKRGKVKPNQQVTIIDSEGKTRNAKVGKVLGHLGLERIETDLAEAGDIVAITGLGELNISDTVCDTQNVEALPALSVDEPTVSMFFCVNTSPFSGKEGKFVTSRQILDRLNKKLVHNVALRVEETEDADAFRVSGRGELHLSVLIENMRREGFELAVSRPKVIFREIDGRKQEPYENVTLDVEEQHQGSVMQALGERKGDLKNMNPDGKGRVRLDYVIPSRGLIGFRSEFMTMTSGTGLLYSTFSHYDDVRPGEVGQRQNGVLISNGQGKAVAFALFGLQDRGKLFLGHGAEVYEGQIIGIHSRSNDLTVNCLTGKKLTNMRASGTDEAVVLVPPIRMTLEQALEFIDDDELVEVTPTSIRIRKRHLTENDRRRANRAPKDD

SEQ ID NO: 3563 - DNA, 1815 bp, Nitrosomonas europaea ATCC 19718
  CDS (1)..(1815): transl_table=11
atgacacgcctgctccgtaatatcgccattatcgcccatgtggaccatggcaagaccacgatggtggataagctgctgcaccaggccggcaccttcgccgctcaccagactgttgctgaacgagtgatggattcggatgatatcgagcgcgaacgcggaatcacgattttttccaagaattgtgcaatcgactacgcgggtgtacatatcaatatcgtggatacgccgggccatgccgatttcggtggagaggtcgagcgcgtactgtcgatggtggatggcgtgctgctgctggtggatgccgttgagggtcccatgccgcaaacccggttcgtgacccgtaaagcactggcttccggtttgcgtccgatcgtggtcgtcaacaaaatcgatcgtcctggcgcacggccggactgggtcgtgaaccagacgttcgatctgttcgataaattgaatgctactgaggagcagctcgattttccggtggtttatgcttctgcactcaacggctatgccacgctggatgccaatcagcctggcagcgacatgcgcccgctgttcgacatgatactcaaacatgttccggcgccggtgggtgatcccgaccagccgctgcagctgcagatcagtgcgctcgattattcgagtttcgtcggacgtctcggtattggaaggatcaatcgtggtcgcctgaagccggggcaggaagtcatggtgctgacaggtgagcgggcaccgaaaaaagcacgtgtcaatcaggtatccggatttcgcgggctggatcggatccagctgagcgaagccgcggccggtgacattgtgctgatcagcggtatcgaggaactcggtatcggaacgaccctggcggatatcgatcatccggaggcattgccgatgccggtagtcgatgaaccgacgctttcgatgaattttcaggtcaacacctcgccttttgcaggtaaggaaggtaaattcgttaccagccgccagttgcgtgaacgtcttgaaaaggagctgctgaccaatgttgcgttgcggctggaagaaaccggtgaaaccgactcgtttctcgtttccggccgcggcgaattgcatttgacgattctgctcgaaaacatgcgccgggaaggttatgaactggcggtgtcccgtcccaaggtggtgatccgtgaaattgatggtgaaaagtgtgaaccgttcgaggttctgaccgtcgatatcgatgaagccaatcagggcgcggtaatggaagcgctgggaacacgccgtggtgacctgctggatatggtgactgacgggcgcggtcgggtcaggttggattaccgtattcccgcacgcggcctgatcggattccagtcggaatttatgacgctgacgcgtggtaccggcatcatgagtcatgtttttgatgaatatgcaccaatgcggccggatatggcctcacgcaaaaacggggtgctgatttcagcagaaatgggcgaggcggtggcctacgcgctgtggaagctgcaggaacgcggacgtatgttcgtcagccccggagagccattgtatgaaggcatggtgattggtatccacagccgtgagaatgatctggttgttaacccgatcaagggcaagcaactgaccaatatccgggcatccggccatgacgaggcagtggtgctgacaccgccgattcagttgacgctggaatcagccatcgaattcatcgcagatgacgagctggttgaaattacgccgaaaagcattcgcatccgtaaacgcttcctgctggaacacgaacgtaaacgggcatcccgcagcgcagcctga

SEQ ID NO: 3564 - protein, 604 aa, Nitrosomonas europaea ATCC 19718
MTRLLRNIAIIAHVDHGKTTMVDKLLHQAGTFAAHQTVAERVMDSDDIERERGITIFSKNCAIDYAGVHINIVDTPGHADFGGEVERVLSMVDGVLLLVDAVEGPMPQTRFVTRKALASGLRPIVVVNKIDRPGARPDWVVNQTFDLFDKLNATEEQLDFPVVYASALNGYATLDANQPGSDMRPLFDMILKHVPAPVGDPDQPLQLQISALDYSSFVGRLGIGRINRGRLKPGQEVMVLTGERAPKKARVNQVSGFRGLDRIQLSEAAAGDIVLISGIEELGIGTTLADIDHPEALPMPVVDEPTLSMNFQVNTSPFAGKEGKFVTSRQLRERLEKELLTNVALRLEETGETDSFLVSGRGELHLTILLENMRREGYELAVSRPKVVIREIDGEKCEPFEVLTVDIDEANQGAVMEALGTRRGDLLDMVTDGRGRVRLDYRIPARGLIGFQSEFMTLTRGTGIMSHVFDEYAPMRPDMASRKNGVLISAEMGEAVAYALWKLQERGRMFVSPGEPLYEGMVIGIHSRENDLVVNPIKGKQLTNIRASGHDEAVVLTPPIQLTLESAIEFIADDELVEITPKSIRIRKRFLLEHERKRASRSAA

SEQ ID NO: 3565 - DNA, 2028 bp, Arabidopsis thaliana
  CDS (1)..(2028)
atggagctcagcttgagcacttcctccgcttctcctgcggttttgaggagacaagcttctcctctgcttcacaagcagcaagtgctcggcgtcagctttgcttccgcgctcaaacctggaggaggagctcttcgatttccttcccgccgtccgcttcctcgtcccatcacttgctccgcctctccatcaactgccgaaccagcctccgaggtgaagaagaagcagttggataggagggataacgtgaggaatatcgcaatcgttgcacatgttgatcatggcaaaactactttggttgattctatgcttaggcaagctaaggttttccgagataaccaagtcatgcaagagaggatcatggactcaaatgaccttgagcgtgaaagaggaatcactattcttagcaaaaatacctccatcacttacaaaaacactaaagtaaatattatagatactcctggccattctgactttgggggtgaagtggagcgtgtcttgaacatggttgatggagtgcttcttgtggtggactctgttgagggaccaatgccccagacaaggtttgttttaaagaaggctcttgagtttggacatgcagtggtcgtggtcgtaaacaagattgacaggccttctgctcgtcctgaatttgttgtcaattccacttttgaactatttattgaactaaatgcaacagatgaacagtgtgatttccaagcgatatatgctagtgggattaaaggaaaggcggggctttctccggatgaccttgcagaagacctgggacccctgttcgaagctataatcagatgcgtacctgggccaaatattgaaaaagatggtgcacttcagatgcttgccacaaatattgagtatgatgagcataaaggacgcattgctattggacgactacacgcaggggtactgcgcaaaggaatggatgtcagggtgtgcacttctgaagattcctgtagatttgcaagagttagtgagctttttgtatatgagaaattctacagagtacctactgattcagtggaagctggagatatttgcgctgtatgtggcatagacaacattcagattggggagactattgctgataaagtacatgggaagcctctacctacaatcaaagtagaagagccaactgtgaaaatgtccttctctgtaaacacctctccattttctggtcgtgaggggaagtatgtaacaagcaggaacttacgagatcgtttaaaccgtgaacttgaaagaaatctagctatgaaagtggaagatggtgagacagcagacacattcattgttagtgggcgtggtacattacacattaccatcctgatagaaaacatgcgaagagaaggatatgaatttatggttggccccccgaaagttatcaacaaaagggttaacgataaattgctggagccatatgagatagcaactgttgaagtaccagaggctcacatggggcctgttgttgaacttcttggcaaaaggcgtggacagatgtttgatatgcagggtgttgggtcggaaggaacaacctttctgcggtacaaaatcccaacacgtggacttcttggattgaggaacgcaattttaacagcttctcgcgggacagctatccttaacactgtatttgacagttatggaccttgggccggtgatattagcacccgcgatctaggttcgctggttgcctttgaagatggaacatcaacatcatatgccctggcgagtgcgcaggagagagggcaaatgtttgtaggttctggagtggatgtatacaaaggtcagatagttgggatccaccagagacccggcgacttgggtcttaatatctgcaagaagaaggcagcgacaaacataagatccaacaaagatgtaacagtgattcttgacactcccttaacatatagtctggacgactgcatcgaatacattgaagaggatgagttggtggaggttacaccttctagtattaggatgtgcaagaatcagaaaatggcaaagaaaggcaggcagtaa

SEQ ID NO: 3566 - protein, 675 aa, Arabidopsis thaliana
MELSLSTSSASPAVLRRQASPLLHKQQVLGVSFASALKPGGGALRFPSRRPLPRPITCSASPSTAEPASEVKKKQLDRRDNVRNIAIVAHVDHGKTTLVDSMLRQAKVFRDNQVMQERIMDSNDLERERGITILSKNTSITYKNTKVNIIDTPGHSDFGGEVERVLNMVDGVLLVVDSVEGPMPQTRFVLKKALEFGHAVVVVVNKIDRPSARPEFVVNSTFELFIELNATDEQCDFQAIYASGIKGKAGLSPDDLAEDLGPLFEAIIRCVPGPNIEKDGALQMLATNIEYDEHKGRIAIGRLHAGVLRKGMDVRVCTSEDSCRFARVSELFVYEKFYRVPTDSVEAGDICAVCGIDNIQIGETIADKVHGKPLPTIKVEEPTVKMSFSVNTSPFSGREGKYVTSRNLRDRLNRELERNLAMKVEDGETADTFIVSGRGTLHITILIENMRREGYEFMVGPPKVINKRVNDKLLEPYEIATVEVPEAHMGPVVELLGKRRGQMFDMQGVGSEGTTFLRYKIPTRGLLGLRNAILTASRGTAILNTVFDSYGPWAGDISTRDLGSLVAFEDGTSTSYALASAQERGQMFVGSGVDVYKGQIVGIHQRPGDLGLNICKKKAATNIRSNKDVTVILDTPLTYSLDDCIEYIEEDELVEVTPSSIRMCKNQKMAKKGRQ

SEQ ID NO: 3567 - DNA, 1923 bp, Rhodopirellula baltica SH 1
  CDS (1)..(1923): transl_table=11
gtgggcttccgcctgaaacgtttatccattgaaagctgtcctttgtcttccaccgcatccccttctcaagacgccggcaccgatacctcgagcaacaccgccgttcgagatgagatccgaaatgtcgtcatcatcgctcacgttgaccacgggaaaaccacactggtggattgtctgctgcggcaaagtggacagtatcgcgatgcggaactcaaaggagaacggattctggattcgaacgacatcgaaaaagaacgcggaatcaccattctgtcgaagaacatcgcggttcactaccgcggtgtgaaaatcaatttgatcgacactcctggtcacgcggacttcgggggcgaagtcgaacgtgttgtccaaatggccgatggtgcattggtgctcgtcgatgccgcagaaggcccgatgccacaaactcggttcgtgcttgaaaaagcactgcaagccggcgtcaagccgatcgttgtggtgaacaaggtggaccgccccgacggccgtcctcccgaagccctcgatgaagctctcgaactgctagcggatctgggtggagaagaacaactcgacagtgctgcttacgtctttgcaagtgccaaagaaggttacgcgactgacgatccagcaaaaccaaccgaagacatgcgtcctctcttggacctgctggttgaccatttgcctggtccgacggtcgataccaagtccgattttcagatgatggtcaccactctggattggagcgaatacgtcggccggatcgccgtcggccgcgtcaatgcgggaacgattcaaacgggccaagcggtggacgttcacacgatcgactcctcgggaaacccaatcgttcgaaaaatcaaagcatcaggcctttacgttttcgacaaactcggccgggttcctgctgaatccgccggagcaggcgacctgattgcactcgaaggtcttgatgacgtcgaaatcggcgacacgatcaccgcgcccgaaacaggcaaagctctgccgagactgaaagtcgatgaaccgactttggaaatggtcttcagcgtcaactcatcgccattggctggacgtgaaggcaagtacgtcacgacccgtcagatcaaagctcgcttggagaaagaactcgaacgcaacgtcgctctccgagtttcaatgattgaaggcaccgaagcgtatgccgtcgcaggacgtggtgttcttcacttggccgtgttgatcgaaaccatgcgtcgcgaaggttacgaactgagcgtcggaaaacctcgcgtggtcttcaaagagatcgacggcaaaaagcacgaaccattcgaaacccttcgcgtggaagttccaaccgaggtaatgggtccggtcatggaactcgtcggtttgcgtcgcggccaactggaagagatgaagcaacgtggcgaatacagcctattgcgattcatcgttccgtcacgcggtctgattggcttgcgtacccgattgctcaacgcaactcgcggaaccgccatcatccaccaccgttttgaaagctatcgtatggtcgaaggcgatgtgcctcgtcgagccaacggtgttctgatctcgatggttggcggtaaaaccatgccattcgccctgttcgctttgcaggatcgggctgagctgttcgttccgccgagcaccgaggtttacgaaggaatgatcgttggcgaaaacgctcgcgaaaacgacatgacagtgaacccctgtcgcgaaaagaagctgaccaatatgcgtgctagcggcagtgatgaaaacgtcatcctgaagccaccacgtgacatgtcgctggaagctgcccttgagtacatcgaggacgacgaactggttgaggtaactccggaatcgattcgcttgcgcaagattttgctgaaggaatcggatcgtcgtcggcaaggccgaaacggctga

SEQ ID NO: 3568 - protein, 640 aa, Rhodopirellula baltica SH 1
MGFRLKRLSIESCPLSSTASPSQDAGTDTSSNTAVRDEIRNVVIIAHVDHGKTTLVDCLLRQSGQYRDAELKGERILDSNDIEKERGITILSKNIAVHYRGVKINLIDTPGHADFGGEVERVVQMADGALVLVDAAEGPMPQTRFVLEKALQAGVKPIVVVNKVDRPDGRPPEALDEALELLADLGGEEQLDSAAYVFASAKEGYATDDPAKPTEDMRPLLDLLVDHLPGPTVDTKSDFQMMVTTLDWSEYVGRIAVGRVNAGTIQTGQAVDVHTIDSSGNPIVRKIKASGLYVFDKLGRVPAESAGAGDLIALEGLDDVEIGDTITAPETGKALPRLKVDEPTLEMVFSVNSSPLAGREGKYVTTRQIKARLEKELERNVALRVSMIEGTEAYAVAGRGVLHLAVLIETMRREGYELSVGKPRVVFKEIDGKKHEPFETLRVEVPTEVMGPVMELVGLRRGQLEEMKQRGEYSLLRFIVPSRGLIGLRTRLLNATRGTAIIHHRFESYRMVEGDVPRRANGVLISMVGGKTMPFALFALQDRAELFVPPSTEVYEGMIVGENARENDMTVNPCREKKLTNMRASGSDENVILKPPRDMSLEAALEYIEDDELVEVTPESIRLRKILLKESDRRRQGRNG

SEQ ID NO: 3569 - DNA, 1848 bp, Haemophilus ducreyi 35000HP
  CDS (1)..(1848): transl_table=11
atgcaacatttagatattaataaattgcgtaatatcgcaattattgctcacgtcgaccacggtaaaaccacccttgtagataaacttttacaacaatcaggcacattaggcgaaacgcgtggtgatgctgatgaacgtgtgatggacagtaacgatcttgagaaagaacgtggtattacaattttagcgaaaaatacggcaatcaattggaacgattaccgtatcaatatcgtagatacaccgggacacgccgattttggtggtgaggtagaacgtgtactttcaatggtagactcagtgttattggtggtagatgcctttgatggcccaatgccacagacgcggtttgtaacacaaaaagcgtttgcacatggtctaaaacctattgtggtgatcaataaagttgaccgaccaggcgctagaccagattgggttgttgatcaagtattcgatttatttgttaacttaggtgcaactgatgagcaattggacttcccgattatttatgcatcagccttaatgggtgtagcaggtcttgaacacgaagcacttgcggaagatatgacgccgttatttgaagcgattgtgaaacacgtacaagccccgtcagttgaattagatgcgccattccaaatgcaaatttcacaactagattataataattatgttggtgttattggtattggtcgtattaagcgtggttcaattaaaccgaatcaaactattacggtgattgatgcaaatggaaaaacgcgtaatggtaaagtagggcaagtgttaggccatttaggtttacaacgttatgaagccacggaagcttttgctggtgatattattgcgattacaggtttagttgagttaaatatttcagacacgatttgtgatattaataatgttgaaatgctacctgccttaacggttgatgagccaacagtaacaatgttcttctgtgttaatacttcaccattctgtggtcaggaaggaaaatttgtcacttctcgccaaattttagagcgcttgaacaaagagctagtgcataatgtagcattacgcgtagaagaaaccccgaaccctgatgagttccgtgtttcaggccgtggtgaattacatttgtcggtattaattgaaaatatgcgccgtgaaggctatgaattagccgtatcacgtccaaaagtaatctataaagaagaaaacggtaagaaacaagagccttttgagcaagttacgattgatattgaagaacaacatcaaggttcagtgatggaagcattaggtattcgtaaaggtgaggtcaaagatatgatcccagatggtaagggacgtactcgcttagaatatgtgattccaagccgcggtttaattggtttccgtaatgaatttatgacaatgacatcgggaaccggtttactttattcaagttttagccattatgatgatgttaagctaggtgaaattggtcagcgtaaaaatggtgtattaatttcaaatgctaccggtaaagcgttagcttatgcgctatttggtttacaagaacgcggtaagttgatgattgagcacggtgtagatgtatatgaaggccaaattattggtattcatagccgttcaaatgatttaactgtaaattgtttacaaggtaaaaaactaacaaatatgcgcgcatcaggcaaagatgatgcgattgtgttaactacaccggttaaaatgacgttggaacaagcattagaatttattgatgatgatgagttagtagaagtaacgccacaatctgtgcggatccgtaaacgactattaactgagaatgatcgtaaacgtgcaagtcgtacgactagtagtacaagtacacgttaa

SEQ ID NO: 3570 - protein, 615 aa, Haemophilus ducreyi 35000HP
MQHLDINKLRNIAIIAHVDHGKTTLVDKLLQQSGTLGETRGDADERVMDSNDLEKERGITILAKNTAINWNDYRINIVDTPGHADFGGEVERVLSMVDSVLLVVDAFDGPMPQTRFVTQKAFAHGLKPIVVINKVDRPGARPDWVVDQVFDLFVNLGATDEQLDFPIIYASALMGVAGLEHEALAEDMTPLFEAIVKHVQAPSVELDAPFQMQISQLDYNNYVGVIGIGRIKRGSIKPNQTITVIDANGKTRNGKVGQVLGHLGLQRYEATEAFAGDIIAITGLVELNISDTICDINNVEMLPALTVDEPTVTMFFCVNTSPFCGQEGKFVTSRQILERLNKELVHNVALRVEETPNPDEFRVSGRGELHLSVLIENMRREGYELAVSRPKVIYKEENGKKQEPFEQVTIDIEEQHQGSVMEALGIRKGEVKDMIPDGKGRTRLEYVIPSRGLIGFRNEFMTMTSGTGLLYSSFSHYDDVKLGEIGQRKNGVLISNATGKALAYALFGLQERGKLMIEHGVDVYEGQIIGIHSRSNDLTVNCLQGKKLTNMRASGKDDAIVLTTPVKMTLEQALEFIDDDELVEVTPQSVRIRKRLLTENDRKRASRTTSSTSTR

SEQ ID NO: 3571 - DNA, 1803 bp, Prochlorococcus marinus subsp. marinus str. CCMP1375
  CDS (1)..(1803): transl_table=11
atgatttctaatcaacaagctcttcggaatatagcaatcgttgctcatgttgatcatggaaaaacgacgcttgtcgatgctctgcttggtcaatcaggaatattcagggataacgaagctgttcctacatgcgtaatggattcaaatgatttggaacgtgaaagaggtataaccatactttcaaaaaacactgcagttatatataacgatacgaggatcaatattgtagatacccctgggcatgctgatttcggaggagaagtagaacgagtgcttggaatggttgatggttgcttgttgattgttgatgctaacgaaggcccaatgcctcaaacacgttttgtacttaaaaaggcgcttgagcaaggtttaagaccaattgtttttgttaataaaattgatagagcaagagttgaaccagaaacggctgtcgacaaggttttagatctcttccttgaacttggagctgatgacgatcaatgtgactttccttatttgtttgggagtggattaggaggttttgctaagccggacatgcaaacggaaagtgagaatatgaagcctctttttgatgcgattattaggcatgttccacctccaattggagatcagacgaaaccattgcaattacaaattacttcattagattattctgattttcttgggcgaataattatagggagagttcacaatggtgttattcgaagcggacaaagggcttcattaataaaagaaagtgggaaattaaaacaaggtaggatctctaaattaatgggtttcgaaggccttcaaagaatagatattgaggaagcatatgcaggaaatatagttgcagtctctggctttgatgatgtgaatattggggagactattgcttgcccagatgagcctaaagctttaccacttattaaagttgatgaacctactctgcagatgacatttgttgtcaatgattctccttttgctggtaaagaaggaaaatttgtaacaagcaggcaattaagagaaagactatttaaagaattgcttaccaatgttgctttacgtgttgaagaaacagattctcctgatcgctttgctgtttgtggtagaggagagctgcatttaggaatattaattgaaaccatgcgaagagaaggctatgaatttcaggtttctcaacctcaagtgattttccgtacgattgaagataccctctgtgaaccattagaaactttggtcttagatgtaccagaaatatcagttgggacatgtatagaaaagcttggttctagaagaagtgaaatgcaaaatatgataaatacaaatgatggaagaactcaattggaatttcttattccatcaagaggtttaattggtttcagaggagaatttataagagccactagaggagaagggattatgagccattcgttttttgaatatcgaccaatggtgggggagtttgagtccagaagaaatggcgtattaatttcttttgaggaaggagtctcaaccttttatgccttgaaaaacgcagaggatagagggcaattctttattgaacccggaacaaaggtttataaaggaatgattattggtgaacataatagacagcaagatctagaaattaatatatgcaaatcaaagcaacttactaacatgagatctgctggagctgaagagctagatactttgcagtcaccgattgatataacattagaaagagcattggaatatataggccctggtgaaatgttagaagtaaccccagaatcaataagattaagaaagatgcctagcaagaaatataataaacgttag

SEQ ID NO: 3572 - protein, 600 aa, Prochlorococcus marinus subsp. marinus str. CCMP1375
MISNQQALRNIAIVAHVDHGKTTLVDALLGQSGIFRDNEAVPTCVMDSNDLERERGITILSKNTAVIYNDTRINIVDTPGHADFGGEVERVLGMVDGCLLIVDANEGPMPQTRFVLKKALEQGLRPIVFVNKIDRARVEPETAVDKVLDLFLELGADDDQCDFPYLFGSGLGGFAKPDMQTESENMKPLFDAIIRHVPPPIGDQTKPLQLQITSLDYSDFLGRIIIGRVHNGVIRSGQRASLIKESGKLKQGRISKLMGFEGLQRIDIEEAYAGNIVAVSGFDDVNIGETIACPDEPKALPLIKVDEPTLQMTFVVNDSPFAGKEGKFVTSRQLRERLFKELLTNVALRVEETDSPDRFAVCGRGELHLGILIETMRREGYEFQVSQPQVIFRTIEDTLCEPLETLVLDVPEISVGTCIEKLGSRRSEMQNMINTNDGRTQLEFLIPSRGLIGFRGEFIRATRGEGIMSHSFFEYRPMVGEFESRRNGVLISFEEGVSTFYALKNAEDRGQFFIEPGTKVYKGMIIGEHNRQQDLEINICKSKQLTNMRSAGAEELDTLQSPIDITLERALEYIGPGEMLEVTPESIRLRKMPSKKYNKR

SEQ ID NO: 3573 - DNA, 1821 bp, Bordetella parapertussis 12822
  CDS (1)..(1821): transl_table=11
atgacccgcgccctgcgcaacgtcgccatcattgcccacgtggaccacggcaaaacgaccctggtcgaccaattgctacgccaatccggcactttccgcgagaaccaatcggtggccgaacgggtcatggattcgaacgacatcgagaaagaacgcggcatcaccattctggccaagaactgcgccgtcgaatacgaaggcacgcacatcaacatcgtcgacaccccgggacacgccgacttcggcggcgaagtcgagcgggtgctgtcgatggtcgatggcgtcctgctgctggtcgatgccgtcgaaggccccatgccgcagaccatcttcgtcacgcgcaaggcgctggccctgggcctcaagcccatcgtggtggtcaacaagatcgaccgtccgggcgcgcgtccggatttcgtgatcaatgccaccttcgagcttttcgacaagctgggcgccacggaagagcagctggacttcccggtggtgtacgcctcgggcctgtcgggctacgccggactgaccgacgacgtgcgttcgggcgacatgcggccgctgttcgaggccatcatgaagtacgtgccgcagcgcgatgacgatgccaacgggccgctgcagatgcagatcatctcgttggactacaacagctacgtcggcaagatcggcgtgggccgcatcaaccgcggccgcatgcgcggcaacatggatgtcgcgttccgcttcgggcccgatggcgaggtccagcgcggccgcatcaaccaggtgatgaaattcagcggcctggagcgcgttgtcgtggacgaggccgaagccggcgacatcgtgctggtcaacggcatcgaagacctgcacatcggttcgaccatcaccgacccgtccacgcccgagggcttgccggtactgcgcatcgacgaacccacgttgaccatgaacttcatggtcaacacctcgccgctggccggccgcgaaggcaagttcgtgaccagccgccagatccgcgaccgcctggagcgcgagctgaagtccaacgtggcgctgcgcgtacgcgacaccggcgacgatacggtgttcgaggtctcgggccgtggcgaactgcacctgaccatcctgctggagaacatgcgtcgcgagggctacgagctggccgtgtcgcgcccgcgcgtggtcttcaaggaaatcgacggcgtgaaatgcgagccgttcgaggcgctgacggtcgatgtcgaggacgcccaccagggcggcgtgatggaagagctgggccgccgcaagggcgacctgcaggacatgcagcccgatggccgtggccgtacccgcctggaatacatcattccggcgcgcggcttgatcggctttcagaacgagttcctgacgctgacgcgcggcaccggcctgatgagccatatcttccacgagtacgcgccgctgcgcgaaggttcgatcggcgagcgccgcaacggcgtgctgatcagccaggataacggcgacgcggtggcctacgccctgtggaagctgcaggatcgcggccgcatgttcgtcagccccggcgagccgctgtacgaaggcatgatcattggcatccacagccgcgacaacgacctggtggtcaaccccatcaagggcaagcagctgaccaacgttcgcgcgtcgggcaccgacgaggccgtgcgcctggtgccgccgatccagatgtcgctcgagtatgcggtcgagttcatcgacgacgatgaactggtcgagatcacgcccaagtcgatccgcctgcgcaagcgctacctgcaggagcacgagcgccgccgcgcttcgcgcgaaaacgcgtaa

SEQ ID NO: 3574 - protein, 606 aa, Bordetella parapertussis 12822
MTRALRNVAIIAHVDHGKTTLVDQLLRQSGTFRENQSVAERVMDSNDIEKERGITILAKNCAVEYEGTHINIVDTPGHADFGGEVERVLSMVDGVLLLVDAVEGPMPQTIFVTRKALALGLKPIVVVNKIDRPGARPDFVINATFELFDKLGATEEQLDFPVVYASGLSGYAGLTDDVRSGDMRPLFEAIMKYVPQRDDDANGPLQMQIISLDYNSYVGKIGVGRINRGRMRGNMDVAFRFGPDGEVQRGRINQVMKFSGLERVVVDEAEAGDIVLVNGIEDLHIGSTITDPSTPEGLPVLRIDEPTLTMNFMVNTSPLAGREGKFVTSRQIRDRLERELKSNVALRVRDTGDDTVFEVSGRGELHLTILLENMRREGYELAVSRPRVVFKEIDGVKCEPFEALTVDVEDAHQGGVMEELGRRKGDLQDMQPDGRGRTRLEYIIPARGLIGFQNEFLTLTRGTGLMSHIFHEYAPLREGSIGERRNGVLISQDNGDAVAYALWKLQDRGRMFVSPGEPLYEGMIIGIHSRDNDLVVNPIKGKQLTNVRASGTDEAVRLVPPIQMSLEYAVEFIDDDELVEITPKSIRLRKRYLQEHERRRASRENA

SEQ ID NO: 3575 - DNA, 1821 bp, Bordetella bronchiseptica RB50
  CDS (1)..(1821): transl_table=11
atgacccgcgccctgcgcaacgtcgccatcattgcccacgtggaccacggcaaaacgaccctggtcgaccaattgctacgccaatccggcactttccgcgagaaccaatcggtggccgaacgggtcatggattcgaacgacatcgagaaagaacgcggcatcaccattctggccaagaactgcgccgtcgaatacgaaggcacgcacatcaacatcgtcgacaccccgggacacgccgacttcggcggcgaagtcgagcgggtgctgtcgatggtcgatggcgtcctgctgctggtcgatgccgtcgaaggccccatgccgcagaccatcttcgtcacgcgcaaggcgctggccctgggcctcaagcccatcgtggtggtcaacaagatcgaccgtccgggcgcgcgtccggatttcgtgatcaatgccaccttcgagcttttcgacaagctgggcgccacggaagagcagctggacttcccggtggtgtacgcctcgggcctgtcgggctacgccggcctgaccgacgacgtgcgttcgggcgacatgcggccgctgttcgaggccatcatgaagtacgtgccgcagcgcgatgacgatgccaacgggccgctgcagatgcagatcatctcgctggactacaacagctacgtcggcaagatcggcgtgggccgcatcaaccgcggccgcatgcgcggcaacatggacgtcgcgttccgcttcgggcccgatggcgaggtccagcgcggccgcatcaaccaggtgatgaaattcagcggcctggagcgcgtcgtggtggacgaggccgaagccggcgacatcgtgctggtcaacggcatcgaagacctgcacatcggttcgaccatcaccgacccgtccacgcccgagggtttgccggtactgcgcatcgacgaacccacgctgaccatgaacttcatggtcaacacctcgccgctggccggccgcgaaggcaagttcgtgaccagccgccagatccgcgaccgcctggagcgcgagctgaagtccaacgtggcgctgcgcgtacgcgacaccggcgacgatacggtgttcgaagtctcgggccgtggcgaactgcacctgaccatcctgctggagaacatgcgtcgcgagggctacgagctggccgtgtcgcgcccgcgcgtggtcttcaaggaaatcgacggcgtgaaatgcgagccgttcgaggcgctgacggtcgacgtcgaggacgcccaccagggcggcgtgatggaagagctgggccgccgcaagggcgacctgcaggacatgcagcccgatggccgtggccgtacccgcctggaatacgtcattccggcgcgcggcttgatcggctttcagaacgagttcctgacgctgacgcgcggcaccggcctgatgagccatattttccacgagtacgcgccgctgcgcgaaggttcgatcggcgagcgccgcaacggcgtgctgatcagccaggataacggcgacgcggtggcctacgccctgtggaagctgcaggatcgcggccgcatgttcgtcagccccggcgagccgctgtacgaaggcatgatcattggcatccacagccgcgacaacgacctggtggtcaaccccatcaagggcaagcagctgaccaacgttcgcgcgtcgggcaccgacgaggccgtgcgcctggtgccgccgatccagatgtcgctcgagtatgcggtcgagttcatcgacgacgatgaactggtcgagatcacgcccaagtcgatccgcctgcgcaagcgctacctgcaagagcacgagcgccgccgcgcttcgcgcgaaaacgcgtaa

SEQ ID NO: 3576 - protein, 606 aa, Bordetella bronchiseptica RB50
MTRALRNVAIIAHVDHGKTTLVDQLLRQSGTFRENQSVAERVMDSNDIEKERGITILAKNCAVEYEGTHINIVDTPGHADFGGEVERVLSMVDGVLLLVDAVEGPMPQTIFVTRKALALGLKPIVVVNKIDRPGARPDFVINATFELFDKLGATEEQLDFPVVYASGLSGYAGLTDDVRSGDMRPLFEAIMKYVPQRDDDANGPLQMQIISLDYNSYVGKIGVGRINRGRMRGNMDVAFRFGPDGEVQRGRINQVMKFSGLERVVVDEAEAGDIVLVNGIEDLHIGSTITDPSTPEGLPVLRIDEPTLTMNFMVNTSPLAGREGKFVTSRQIRDRLERELKSNVALRVRDTGDDTVFEVSGRGELHLTILLENMRREGYELAVSRPRVVFKEIDGVKCEPFEALTVDVEDAHQGGVMEELGRRKGDLQDMQPDGRGRTRLEYVIPARGLIGFQNEFLTLTRGTGLMSHIFHEYAPLREGSIGERRNGVLISQDNGDAVAYALWKLQDRGRMFVSPGEPLYEGMIIGIHSRDNDLVVNPIKGKQLTNVRASGTDEAVRLVPPIQMSLEYAVEFIDDDELVEITPKSIRLRKRYLQEHERRRASRENA

SEQ ID NO: 3577 - DNA, 1803 bp, Prochlorococcus marinus subsp. pastoris str. CCMP1986
  CDS (1)..(1803): transl_table=11
atgtcagtttcaattaaagaaataagaaatgtagcaattatagcccatgtagatcatggaaaaacaaccctagtcgatgcattattatctcaatctggaatatttagagataacgaagtagttccaacttgtgtaatggattcaaatgatctcgagagagaaagaggtataacaatactttcaaaaaatacggctgttaattataaaaacacgagaatcaatattatcgatacacctggacatgctgactttggaggagaggttgagagggttttgggcatggttgatggttgtttattaatcgttgatgctaatgagggtccaatgccacaaacaaggtttgtattaaaaaaagctttagaaaaaggtcttagacctatagtttttgtaaataaaattgataggcctagagtagtcccagaaattgctgtggataaagttcttgatttgttccttgaattaggtgcagatgatgatcaatgtgattttccttatttattcggtagtggattatctggtttcgcaaaagaagaaatggaatctaataatgataatatgatgcccctttttgaagctattcttaggcatgttccaccacctgtaggggatctaaacaagcctctgcagcttcaaattacaactttggattattctgatttcttaggaagaattgtgattggaaagattcataatggaactataaaaaatggccaacaagcaagcctaataaaagaaagtgggaaaactatcaagggtaaagtaagtaaacttttaggattcgaaggattacaaagaattgatattaatgaggcctttgcaggagatattgttgcagtttcaggttttgatgatgtaaatattggagaaacgattgcttgtcctgattctcctcatccacttcctttaattaaagttgacgaacctacactaaacatgacctttgttgtgaatgattctccatttgcgggtaaagaagggaaattcgttacgagtagacaattaaaaaatagattagagagggaattattaactaacgtagccctaagagttgaagaaaccgattctccagatagattttctgtctctgggagaggtgagcttcatttagggattttaattgaaacaatgagaagagaaggttttgaattccaaatctcgcaaccgcaagttatttttagagaaattgatgatgttcaatgcgaacccatagaaacattagtcttagatgttccagaagtagcggttggctcttgtattgaaaaactgggatcaagaaaagctgagatgaaaaacatgcagacaagttcagatggaagaacccagttagaatttcttgtaccatcaagaggacttataggatttcgtggtgaatttgttcgaataactagaggtgaaggaattatgagtcactctttttatgaatataaacctaaagctggagattttgaaacgagaagaaatggtgttcttatttcttttgaagagggtgtcgctactttctatgctttaaaaaatgctgaagatagaggtgtttattttatcaaaccaggagtgaaagtttataaaggtatgattattggcgagaataataggtcacaagatttagagttaaatatctgtaaaacaaagcaattgactaatatgagatctgctggagcagaagagttagatactttacaatctccagttgatattacacttgagagagctcttgaatatataggtcctgatgaaatgttagaggtgacgccggattcaataagaatgaggaaattaaataaaaagaagacaatgaaaaaataa

SEQ ID NO: 3578 - protein, 600 aa, Prochlorococcus marinus subsp. pastoris str. CCMP1986
MSVSIKEIRNVAIIAHVDHGKTTLVDALLSQSGIFRDNEVVPTCVMDSNDLERERGITILSKNTAVNYKNTRINIIDTPGHADFGGEVERVLGMVDGCLLIVDANEGPMPQTRFVLKKALEKGLRPIVFVNKIDRPRVVPEIAVDKVLDLFLELGADDDQCDFPYLFGSGLSGFAKEEMESNNDNMMPLFEAILRHVPPPVGDLNKPLQLQITTLDYSDFLGRIVIGKIHNGTIKNGQQASLIKESGKTIKGKVSKLLGFEGLQRIDINEAFAGDIVAVSGFDDVNIGETIACPDSPHPLPLIKVDEPTLNMTFVVNDSPFAGKEGKFVTSRQLKNRLERELLTNVALRVEETDSPDRFSVSGRGELHLGILIETMRREGFEFQISQPQVIFREIDDVQCEPIETLVLDVPEVAVGSCIEKLGSRKAEMKNMQTSSDGRTQLEFLVPSRGLIGFRGEFVRITRGEGIMSHSFYEYKPKAGDFETRRNGVLISFEEGVATFYALKNAEDRGVYFIKPGVKVYKGMIIGENNRSQDLELNICKTKQLTNMRSAGAEELDTLQSPVDITLERALEYIGPDEMLEVTPDSIRMRKLNKKKTMKK

SEQ ID NO: 3579 - DNA, 1803 bp, Prochlorococcus marinus str. MIT 9313
  CDS (1)..(1803): transl_table=11
atgagtgcccaggccaaggcgatccgcaacattgcaattatcgctcacgtggatcacggcaaaacaaccttggtggatgccctgctctctcagtccgggatcttccgagacaacgaggctgtacctacatgtgtcatggactccaatgatttggaaagggaacgaggcattacgatcctttcaaagaacacggccgttacctacgacgatacgcggatcaacattgttgatacccctgggcatgccgattttggcggtgaagttgagcgggtgcttggcatggttgatggctgtttgctgatcgttgacgccaacgaggggcctatgccacagacgcgtttcgtgctcaagaaggcgcttgagcagggattgcgtccgattgtgttcgtaaacaagattgatcgtgcgcgggtggatcctgaaaccgctgtcaacaaggtgctcgatctgtttgttgaactcggtgcagatgatgaccaatgtgatttcccgtacttattcggcagtggaatgggtggttttgccaagccggatatggcaactgaaagtcaaacaatgaagccactatttgatgccatcctgcgtcatgttccaccacctgttggagatgagaacaagcctcttcagctacagataactactctcgattattcagacttcctgggcaggattgtgattggtcgggtccataacggggttatccgtaatggtcagagtgcttcgttgattaaggatgatggcagcattaaacgtggccgaattagcaaactactcggtttcgaaggattgcaacggattgagatacaagaagccggagctggagatcttgttgctttagccggtttcgatcaagtcaatattggcgagaccattgcctgtccagatgaaccaaaggctttacctctaatcaaggtggatgaacccactttgcagatgacatttgtcgtcaatgattcaccctttgctggcaaagaaggcaaattcgtcacgagccggcagctgcgagatcgtttacgcaaggaattactcaccaatgttgccctacgggttgaggacactgattcccctgaccgttttgcggttagcggacgtggtgagctacacctgggcatcctgattgagaccatgcgccgcgagggttttgagtttcaggtaacccagcctcaggtgatcttccgaacgattgacggcactccttgtgagcccgttgagaccttggtcatggatgtaccagaggcagcagttggctcctgcattgagaagttgggtgtgcgtcggggtgaaatgcagaatatggaaaccggtaacgacggtcgcacccagcttgaatttgttgttccttctcgagggttgatcggttttcgtggtgagtttgtacgtgctaccaggggggaaggaattatgagccactctttttttgaatatcgcccaatgttgggtgagtttgatgctcgtcggaatggtgttctgattgcttttgagcagggcactgcgaccttctacgcactcaagaatgctgagggtcgaggtcagttcttcatctctccaggtgtcaaggtttataaggggatgatcgttggcgaaaacaatcgacctcaggatctggagttaaacgtttgcaaggccaaacaactcacaaatatgcgctctgctggtgcagaagaactcgacaccttgcagacacctgttcagatgacccttgaacgtgctcttgagtacatcggtccagacgagatgcttgaggtcactccagagtccattcgtttgcgcaagttgcctgccaagaagatggccaaacgctaa

SEQ ID NO: 3580 - protein, 600 aa, Prochlorococcus marinus str. MIT 9313
MSAQAKAIRNIAIIAHVDHGKTTLVDALLSQSGIFRDNEAVPTCVMDSNDLERERGITILSKNTAVTYDDTRINIVDTPGHADFGGEVERVLGMVDGCLLIVDANEGPMPQTRFVLKKALEQGLRPIVFVNKIDRARVDPETAVNKVLDLFVELGADDDQCDFPYLFGSGMGGFAKPDMATESQTMKPLFDAILRHVPPPVGDENKPLQLQITTLDYSDFLGRIVIGRVHNGVIRNGQSASLIKDDGSIKRGRISKLLGFEGLQRIEIQEAGAGDLVALAGFDQVNIGETIACPDEPKALPLIKVDEPTLQMTFVVNDSPFAGKEGKFVTSRQLRDRLRKELLTNVALRVEDTDSPDRFAVSGRGELHLGILIETMRREGFEFQVTQPQVIFRTIDGTPCEPVETLVMDVPEAAVGSCIEKLGVRRGEMQNMETGNDGRTQLEFVVPSRGLIGFRGEFVRATRGEGIMSHSFFEYRPMLGEFDARRNGVLIAFEQGTATFYALKNAEGRGQFFISPGVKVYKGMIVGENNRPQDLELNVCKAKQLTNMRSAGAEELDTLQTPVQMTLERALEYIGPDEMLEVTPESIRLRKLPAKKMAKR

SEQ ID NO: 3581 - DNA, 1803 bp, Synechococcus sp. WH 8102
  CDS (1)..(1803): transl_table=11
atgagcgcccagcacaaggcgattcgcaacatcgcgatcatcgctcacgttgaccatggcaaaacgaccctggttgattccctgctggcgcaatcaggcatcttccgcgacaacgaagcggtgcccacctgcgtcatggactccaacgatctggagcgtgagcgcggcatcaccattctgtcgaaaaacacggctgtcgattacaacgacacccgcatcaacattgttgacacccctggtcacgccgatttcggcggtgaagtggagcgggtgctcggaatggtggatggctgtctgctgattgtcgacgccaacgaggggccgatgccccagactcgattcgtgctgaagaaggcattggagcagggtctgcgcccgatcgtgttcgtcaacaaaatcgaccgtgcccgggtggatcccgagacggctgtggacaaggtgctggatctgttcatcgagctcggcgccgatgacgatcagtgcgatttcccttacctgttcggaagcggtctcggcggattcgccaagccagacatgaagacggacagcgacaacatgcaaccgctgtttgacgcaatcctgcgtcacgttccgcccccggtcggtgatgtggagaagccgttgcagcttcagatcaccaccctcgattactccgatttccttggacgcatcatcatcggccgtgttcataacggtgtgatcaagcagggccagagcgcttcgttgattaaggacgacggcagcatcaagcgtggccgcatcagcaaactgctgggattccaaggcctgcagcgggttgagatcgatgaggccagtgccggtgatctggtggccgtggctggttttgacgacgtcaacatcggtgaaaccattgcctgcccggatgagcccaccgctctgccgctgatcaaggtggatgagcccaccctgcagatgacttttgtggtcaacgactcccccttcgccggtaaggagggcaagttcgtgaccagtcgccaggtgcgcgaccgtctccaacgggagctgctcaccaacgtggccctgcgtgtcgaagacaccgactcaccagatcgctttgccgtcagtggccgtggcgagctgcacctgggcatcctgatcgagaccatgcgccgcgagggctacgagttccaggtgtcgcagccgcaagtgatctttcgcaccattgacggcactccctgcgaaccggtggaaacgctggtgatggacgtgcccgaggaggccgtcggtggctgcatcgaaaaactgggcacccgcaagggcgaaatgcagaacatggagaccggccaggacggccggacccagctggaattcatcgttccgtcccgtggtctgatcggcttccggggtgagttcattcgcaccacccgcggcgaagggatcatgagccattccttcttcgaataccgcccgatgctgggcgagttcgacacgcgtcggaacggggtcctgattgccttcgaggaaggcaccgccaccttctatgcccttaagaacgccgaggaccgtggtcagttcttcatctcgccaggcaccaaggtgtacaagggcatgatcatcggtgagaacaaccgcccacaggaccttgagatcaacgtctgcaaggccaagcagctcaccaacatgcgttccgccggtgcagaggaactcgacacccttcaggcaccggtgcagatgacgcttgagcgggctctcgagtacatcggtcccgatgagatgctcgaggtgacacctgaatccatccgactgcgcaagctgccggccaagaagatggccaagcgctga

SEQ ID NO: 3582 - protein, 600 aa, Synechococcus sp. WH 8102
MSAQHKAIRNIAIIAHVDHGKTTLVDSLLAQSGIFRDNEAVPTCVMDSNDLERERGITILSKNTAVDYNDTRINIVDTPGHADFGGEVERVLGMVDGCLLIVDANEGPMPQTRFVLKKALEQGLRPIVFVNKIDRARVDPETAVDKVLDLFIELGADDDQCDFPYLFGSGLGGFAKPDMKTDSDNMQPLFDAILRHVPPPVGDVEKPLQLQITTLDYSDFLGRIIIGRVHNGVIKQGQSASLIKDDGSIKRGRISKLLGFQGLQRVEIDEASAGDLVAVAGFDDVNIGETIACPDEPTALPLIKVDEPTLQMTFVVNDSPFAGKEGKFVTSRQVRDRLQRELLTNVALRVEDTDSPDRFAVSGRGELHLGILIETMRREGYEFQVSQPQVIFRTIDGTPCEPVETLVMDVPEEAVGGCIEKLGTRKGEMQNMETGQDGRTQLEFIVPSRGLIGFRGEFIRTTRGEGIMSHSFFEYRPMLGEFDTRRNGVLIAFEEGTATFYALKNAEDRGQFFISPGTKVYKGMIIGENNRPQDLEINVCKAKQLTNMRSAGAEELDTLQAPVQMTLERALEYIGPDEMLEVTPESIRLRKLPAKKMAKR

SEQ ID NO: 3583 - DNA, 1818 bp, Chromobacterium violaceum ATCC 12472
  CDS (1)..(1818): transl_table=11
atgacccgacaaatccgcaacatcgccatcatcgcccacgtcgaccatggcaagaccaccctggtcgaccaactgctgaaacaaagcggcaccttccgcgagaaccagcaggtcgacgaacgcgtaatggacagcaacgatcttgaaaaagagcgcggcatcaccattctcgccaagaacaccgccatcaactacgaaggcgtgcacatcaacatcgtcgacaccccggggcacgccgacttcggcggcgaagtggagcgcgtattgggcatggttgacggcgtggtgctgctggtcgatgcggttgaaggtccgatgcctcaaacccgcttcgtaaccaagaaggcgctggccctgggcctgcgtccgatcgtggtgatcaacaagatcgaccgcccgggctcccgtccggactgggtggtggaccagaccttcgacctgttcgacaagctgggcgccaccgacgagcaactggacttcccgatcatctacgcatccggcctgaccggcttcgccaagcatgagctggacgaagagtccgacaacatgcgcccgctgttcgagaccgtgctgaagcacgttccgaccccggccggcagcccggacgcgccgctgcagctgcagatttccgctctggactactccacctacaccggccgcctgggcctgggccgcatcctgaacggccgcatcaagccgggccagcaagtggtggtgatgaaccacgacgagcaagtggcctccggccgcatcaaccaggtgctgggcttcaagggcctggagcgcgtggaagtgcaggaagccgaagccggcgacatcgtgatcatctccggcatcgaggatatcggcatcggcgtgaccatctgcgacaaggagcagccggtaggcctgccgatgctgtcggtggacgagccgacgctgaccatggacttcatggtgaactcctcgccgctggccggcaccgagggcaagttcgtcaccagccgccagatccgcgaccgcctgaccaaggagctgctgaccaacgtggcgctgcgcgtggaagacaccggcgacgccgacgtgttccgcgtgtcgggccgcggcgagctgcacctgaccatcctgctggaaaacatgcgccgcgaaggctttgaaatggctgtggccaagccgcgcgtggtgttcaaggaaatcaacggccagaagtgcgagccgtatgagaacctgaccatcgacctggaagacgaccaccagggcggcgtgatggaagaaatcggccgccgccgcggcgagctgaccaatatggaatcggacggcaacggccgcacccgcctggaataccacattccggcgcgcggcctgatcggcttccagtccgacttcatgaccatgacccgcggcaccggcctgatgagccacgtgttcgacgactacgcgccggtgaagccggatctgccgggccgccacaacggcgtgctgatctcgcaggagcatggcgaggccgtggcctacgcgctgtggaacctggaagaccggggccgcatgttcgtctccccgggcgacaagctgtacgaaggcatgatcatcggcatccacagccgcgacaacgacctagtcgtcaacccgatcaagggcaagaaactgaccaacgtccgcgcctccggcaccgacgaagcggttcgcctgaccaccccgatcaaactgacgctggaatcggcggtggagttcatcgacgacgacgaactggtggaaatcacgccgaagtccatccgcatccgcaagcgctacctgcaagagcatgagcgtcgcaagatggccaaggtggaaagcatctga

SEQ ID NO: 3584 - protein, 605 aa, Chromobacterium violaceum ATCC 12472
MTRQIRNIAIIAHVDHGKTTLVDQLLKQSGTFRENQQVDERVMDSNDLEKERGITILAKNTAINYEGVHINIVDTPGHADFGGEVERVLGMVDGVVLLVDAVEGPMPQTRFVTKKALALGLRPIVVINKIDRPGSRPDWVVDQTFDLFDKLGATDEQLDFPIIYASGLTGFAKHELDEESDNMRPLFETVLKHVPTPAGSPDAPLQLQISALDYSTYTGRLGLGRILNGRIKPGQQVVVMNHDEQVASGRINQVLGFKGLERVEVQEAEAGDIVIISGIEDIGIGVTICDKEQPVGLPMLSVDEPTLTMDFMVNSSPLAGTEGKFVTSRQIRDRLTKELLTNVALRVEDTGDADVFRVSGRGELHLTILLENMRREGFEMAVAKPRVVFKEINGQKCEPYENLTIDLEDDHQGGVMEEIGRRRGELTNMESDGNGRTRLEYHIPARGLIGFQSDFMTMTRGTGLMSHVFDDYAPVKPDLPGRHNGVLISQEHGEAVAYALWNLEDRGRMFVSPGDKLYEGMIIGIHSRDNDLVVNPIKGKKLTNVRASGTDEAVRLTTPIKLTLESAVEFIDDDELVEITPKSIRIRKRYLQEHERRKMAKVESI

SEQ ID NO: 3585 - DNA, 1800 bp, Porphyromonas gingivalis W83
  CDS (1)..(1800): transl_table=11
atgcaggacatcaggaacattgccatcattgcccacgtagaccacggtaaaaccacgctcgtggacaagatgctcttagccggcaagcttttcagggatgacaaggctgccgaagtggatactttcctcgatagcaacgacttggaacgcgaacgcggtatcaccattctttccaaaaacgtcagtattcgctataagggttgtaaaatcaatatcatcgataccccgggacacgccgacttcggcggtgaagtggagcgcgtgctcaatatggccgatggatgcctcctgctggtggatgccttcgaggggccgatgccgcagactcggtttgtgctgcaaaaagccatcgagatgggactcaaacccatcgtcgtcatcaacaaagtagacaaactcaactgccgtccgagcgaagtgcaggatatggtgttcgacctcatgtacagcctcgatgcttcggaggatcagctcgatttccccaccatatacggctcggccaagcagggttggatgagtaccgactacaaacatcccacacaggacattgctccgctactcgatgccatcatccgacacatccccgctcccgaacagccggagggtgccacgcagatgctcattacatcgcttgactatacttcctatgtggggcgtattgccgtcgggcgagtacatcgcggcacactccgcgaagggcaggatattatgctctgcaagcgtgatggtacgatgcagaagcagcgaatcaaggagctgaataccttcgaaggcttgggacgagccaaagccgaccatgtggatgcaggagatatatgcgctatcatcggtttggaaagtttcgaaatcggagagaccattgccgatgccaatgctcccgaagctcttcaggctattgcgatcgatgagccgacgatgagtatgctctttaccatcaacaactcgccgttctacggcaaggagggtaagtatgtcaccagccggcatattcacgaccgtctgatgcgagaactggacaagaatctggctcttcgtgtggagaccaccgataacgccgacagctggctcgtattcgggcgtggcgtactgcatctttccgttcttatcgagaccatgcgccgcgaggggtacgaacttcaagtggggcagccccaagtgatcatcaaagagatagacggcgagcggtgcgaaccgatagagcttctttcgatcaatctgccggaagagtcctccagtcgtatcatagacatagtgacccgtcgcaagggagagatggtgatgatggaaaacaagaacgaccgggtgtttatggagttccatatcccttcacgagggatcatcggactcaacaatgccgtactgacagcatcggcaggagaggccgtaatcgcgcaccgcttcttggaattccaaccgtggaaaggggagatagagcggcgcagcaacgggtcgatcattgcgctcgaaagcggaacggcctatgcctatgccctgaataatctccaaagccgtggacgcttcttcatctctccgcaggaggaggtctatgccggtcaggtcgtaggcgagcacacgaaggagggcgatctctgcgtcaacgtctgcaagagcaaaaagcttaccaatatgcgtgcttccggtagcgatgataaggtgtcactggctccaccggtggtattcagcctcgaagatgctttggagtatatcaagtatgacgagtatgtggaggtgacgccgaaaagcatgcgcatgcgtaaaattatcctcgacgagacagaacgtaaacgacaaggacgataa

SEQ ID NO: 3586 - protein, 599 aa, Porphyromonas gingivalis W83
MQDIRNIAIIAHVDHGKTTLVDKMLLAGKLFRDDKAAEVDTFLDSNDLERERGITILSKNVSIRYKGCKINIIDTPGHADFGGEVERVLNMADGCLLLVDAFEGPMPQTRFVLQKAIEMGLKPIVVINKVDKLNCRPSEVQDMVFDLMYSLDASEDQLDFPTIYGSAKQGWMSTDYKHPTQDIAPLLDAIIRHIPAPEQPEGATQMLITSLDYTSYVGRIAVGRVHRGTLREGQDIMLCKRDGTMQKQRIKELNTFEGLGRAKADHVDAGDICAIIGLESFEIGETIADANAPEALQAIAIDEPTMSMLFTINNSPFYGKEGKYVTSRHIHDRLMRELDKNLALRVETTDNADSWLVFGRGVLHLSVLIETMRREGYELQVGQPQVIIKEIDGERCEPIELLSINLPEESSSRIIDIVTRRKGEMVMMENKNDRVFMEFHIPSRGIIGLNNAVLTASAGEAVIAHRFLEFQPWKGEIERRSNGSIIALESGTAYAYALNNLQSRGRFFISPQEEVYAGQVVGEHTKEGDLCVNVCKSKKLTNMRASGSDDKVSLAPPVVFSLEDALEYIKYDEYVEVTPKSMRMRKIILDETERKRQGR

SEQ ID NO: 3587 - DNA, 1806 bp, Wolinella succinogenes DSM 1740
  CDS (1)..(1806): transl_table=11
atgcaaagtataagaaacatcgcggttatcgcgcacgttgaccacggcaaaacaacgcttgtggatgggcttttgaagcagtcaggaactttcgcctcacatgagcaggtcgatgagcgcgccatggatagcaacgccatcgaaagagaacgagggatcaccatcctctctaaaaacacggctatccgatacaagggacacaaaatcaatatcatcgacacccctggacacgccgactttggcggtgaggtggagcgcgtgctcaaaatggttgatggcgttttactcctagtggatgcccaagagggcgtcatgccccaaactaagtttgtcgtcaaaaaagcgcttagcatcggccttagacccattgttgtggtgaacaaaatcgacaaacctgccgctgatcctgatcgagtggtcaatgaggtctttgacctttttgccgccatggatgcgaccgaagagcagcttgaattccccgtcatctacgccgcggcaagagatggctatgcaatgaaagagctaaacgatgagaagaaaaatcttgagcccctttttgaggcgattttagagcacgttcctgctcctagtggctcagcccaaaaaccccttcagattcaagttttcacgcttgactatgataattatgtcggcaaaatcggaatcgcacgaatcttcaacggtgtggtcaaaaaaggtgaaaccgtcatgctcgccaaagccaatggcgagaagagtagcggaaagatcactaagctaattggcttccacggcttggctaggatggagattgacgaggccgaggcgggagatatcgtcgcagtagcaggattccactccatcgatgtgggcgatagcctagtggaccccaataaccccatgcctcttgaccctatgcaccttgaagagccaaccatgtcggtctattttgccgtcaatgattctcctctagcgggcaccgagggcaagcatgtcaccgccaacaaagtcaaagaccgtctcgaaaaagagatgcagactaacatcgccatgaaaatggaggagatgggcgaaggaaagttcaaagtctcagggcgaggcgagcttcagatcactatcctagcggagaatcttcgccgtgaagggtttgagtttagtatctctagacccgaagtgatcgtcaaagaagaggatggcgtgcgcatggagccttttgaaaatctcgtggttgacactccccaagattacgcggggaatgtcattgagaagctcggacgaagaaaggcagagatgcgcgccatgaaccctatgggcgatggctacactcgattggagtttgagattcctgctcgtggcctcatcggctaccgaagcgaattcctcacggacaccaagggtgaaggcgtcatgaaccactctttcttggagtttagaccctttagtggaagcgtggaaagccgaagcaacggggcgcttgtctccatggaaaatggtgaaacgacaggattctccctctttaacatccaagagcgcggcgtgctctttgtgggtcctcagaccaaagtctatgtcggcatgatcatcggcgagcatagccgagacaatgatcttgatgtcaatccaatcaaagccaaaaacctcaccaacatgagaaccagcggcagcgaagaggcgatcaagctcattccccctagagagctcacgctagagagagccttagagtggattgaggatgatgagattctagaggtcaccccccttaacattcgaatccgcaaaaaatatcttgaccccaccgtcagacgaagatacgctagacaatcttaa

SEQ ID NO: 3588 - protein, 601 aa, Wolinella succinogenes DSM 1740
MQSIRNIAVIAHVDHGKTTLVDGLLKQSGTFASHEQVDERAMDSNAIERERGITILSKNTAIRYKGHKINIIDTPGHADFGGEVERVLKMVDGVLLLVDAQEGVMPQTKFVVKKALSIGLRPIVVVNKIDKPAADPDRVVNEVFDLFAAMDATEEQLEFPVIYAAARDGYAMKELNDEKKNLEPLFEAILEHVPAPSGSAQKPLQIQVFTLDYDNYVGKIGIARIFNGVVKKGETVMLAKANGEKSSGKITKLIGFHGLARMEIDEAEAGDIVAVAGFHSIDVGDSLVDPNNPMPLDPMHLEEPTMSVYFAVNDSPLAGTEGKHVTANKVKDRLEKEMQTNIAMKMEEMGEGKFKVSGRGELQITILAENLRREGFEFSISRPEVIVKEEDGVRMEPFENLVVDTPQDYAGNVIEKLGRRKAEMRAMNPMGDGYTRLEFEIPARGLIGYRSEFLTDTKGEGVMNHSFLEFRPFSGSVESRSNGALVSMENGETTGFSLFNIQERGVLFVGPQTKVYVGMIIGEHSRDNDLDVNPIKAKNLTNMRTSGSEEAIKLIPPRELTLERALEWIEDDEILEVTPLNIRIRKKYLDPTVRRRYARQS

SEQ ID NO: 3589 - DNA, 1809 bp, Gloeobacter violaceus PCC 7421
  CDS (1)..(1809): transl_table=11
atggaaaccaaccgtctgagtccggctcagattcgcaacgtcgcgattattgcccacgtcgaccacggcaagaccaccctggttgacgctctgctcaggcagtccgggatcttccgggacaacgaagtggtggaaacctgcgtgatggactctaacgacctcgagcgcgagcgcggaatcacgatcctggccaagaacacggcggtaagctacctcgaccatctcatcaatatcgtggacactcccggccacgccgattttggcggcgaagtcgagcgggtgctgggcatggtcgaaggttgcctgctcatcgtcgacgccaacgaagggccgatgccccagacgcgcttcgtgctcagaaaggcactcgaaaagggtctcaagcccatcttgctggtcaacaagatcgaccggccccaggccgacccgcaccgcgctatcgacaaggtgctggatctgtttatcgaactgggggccgacgacgatcagatcgattttccggtgctctttgcctcggggctgtcgggttacgccaaaaacgatctggccgatgaatccaaggacatgcagcctctgttcgaggccatcttgcgccacgttccggcgccggtgggcgatccgaccaagcctttgcagctgcaggtaaccactctcgattactccgagtacctgggccgcatcgtcgtgggcaagatccacaacggttcgatccgcgccaacgagaccatcgccatcgtcaaagactccggcaagatcgagcggggcaaggtggtcaaactctttggtttcgagggcctcagccgcatcgaacttaccgaggcttacgcgggcaatatcgtggcggtggcgggctttgccgacgccaacatcggcgagacgctcaccagcgccgagcaccccgaggcgctgccgctcatcaaagtcgacgaaccgaccctgcagatgaccttctcagtcaacgactcgccctttgcgggccaggagggcaagcacgtcacctcccgcaagctgcgcgagcgcctcttcaaagagcttgagaccaacgtctcgctaagggtcgaggagaccgattcgcccgatcgctttttggtctccggccgcggcgagctgcacctgggcatcttgattgagacgatgcgccgggagggttatgagtttcaagtctccaaaccccgagtgatcttccgcgtggtagacggccaggtctacgagccgttcgaactattggtgctcgatgtgcccgacgacgcggcgggcggctgcatctccaacctcggccgccgccgtgccgagatgcagaacatgcagagcttcggcaacggccgcacccagctcgaatttgtgatccccgctcgcgggttgatgggctttcgcaccgagtgcctgcgcctcacgcgcggcgaagggatcatgagccactccttcctcgactaccgctcgacggtgggcgaaatggaaacgctcagaaacggtgtgctcatcgccttcgaggaaggcgatgcgacgtactactccctgcagaacgccgaggaccggggcatcttcttcatcacccccggcacccgcgtctacgccggcatgatcatcggcgagaacaaccgccagcaggatctcgaactgaacatctgcaagaccaagaagctcaccaacatgcgctccgccgggggcgaagaactggtgcagctcaagacgcctgtgattatgagcctggagcgcgctcttgagtacatcaacgacgacgaactggtggaagtgactcccaagtccatccgcctgcgcaagctggccctcaaagccgcccgcaagtag

SEQ ID NO: 3590 - protein, 602 aa, Gloeobacter violaceus PCC 7421
METNRLSPAQIRNVAIIAHVDHGKTTLVDALLRQSGIFRDNEVVETCVMDSNDLERERGITILAKNTAVSYLDHLINIVDTPGHADFGGEVERVLGMVEGCLLIVDANEGPMPQTRFVLRKALEKGLKPILLVNKIDRPQADPHRAIDKVLDLFIELGADDDQIDFPVLFASGLSGYAKNDLADESKDMQPLFEAILRHVPAPVGDPTKPLQLQVTTLDYSEYLGRIVVGKIHNGSIRANETIAIVKDSGKIERGKVVKLFGFEGLSRIELTEAYAGNIVAVAGFADANIGETLTSAEHPEALPLIKVDEPTLQMTFSVNDSPFAGQEGKHVTSRKLRERLFKELETNVSLRVEETDSPDRFLVSGRGELHLGILIETMRREGYEFQVSKPRVIFRVVDGQVYEPFELLVLDVPDDAAGGCISNLGRRRAEMQNMQSFGNGRTQLEFVIPARGLMGFRTECLRLTRGEGIMSHSFLDYRSTVGEMETLRNGVLIAFEEGDATYYSLQNAEDRGIFFITPGTRVYAGMIIGENNRQQDLELNICKTKKLTNMRSAGGEELVQLKTPVIMSLERALEYINDDELVEVTPKSIRLRKLALKAARK

SEQ ID NO: 3591 - DNA, 1821 bp, Photorhabdus luminescens subsp. laumondii TTO1
  CDS (1)..(1821): transl_table=11
gtgatcgaaaaattgcgtaatatcgccattatcgcgcacgttgaccacggtaaaacgaccctggttgacaagctgctgcaacaatccggtactttcggtgaccgtgcgacaacgacagagcgtgtgatggactccaatgatctggagaaagagcgtggaattactattctcgcaaaaaataccgccattaaatggaatgactaccgtattaatatcgtagacactccgggacatgccgatttcggcggtgaagtagaacgtgttatgtctatggtcgacagcgtactcttgctggtcgatgctatggacgggccaatgcctcagacccgttttgtgacacagaaagcgttcgctcatggtttgaaaccgattgtggtcattaacaaagttgaccgtcctggcgcacgccctgattgggttgtggatcaggtatttgacctgtttgtcaatctgggtgcgactgatgagcaactggacttccccattatctatgcatcggcattgatgggaattgccggtactgatcatgaagatatggcggaagatatgacgccgttgtatcaggcgattgtcgatcatgtagaaccaccgaaagttgaccttaatggttcattccagatgcagatttctcagctggactataacaattatgttggtgttatcgggattggccgtattaagcgcggtactgttaagccaaaccagaacgttacaattattgatagtgaaggtaaaacccggaacggcaaaatcggtaaggtactgggtcatctggggctggagcgtattgagagtgagcaagcggaagcgggcgacatcgttgcgattaccggcttgggtgagctgaatatttccgatacgctgtgtgatactaatgctgttgaagcattgccacccttggctgttgatgagccgacggtaagcatgtatttctgtgttaacacctcccctttctgtggacgtgaaggcaaatatgtcacctcacgtcaaatccttgagcgtctaaagaaagagttggttcacaatgtcgccctgcgtgtcgaagaaaccgaagatccggatgcgttccgtgtttctggccgtggtgaattgcacttatctgttctgattgagaacatgcgccgtgaaggttttgaactggcggtatcccgtccgaaagttatcttccgtgagatcgatggtcgtaagcaagaacctttcgaacaagtaacgctggatattgaagagcagcatcagggagatgtgatgcagggcttgggtgagcgtaaagcggatctgcgcgatatgttaccagacggtaaaggtcgtgtgcgtcttgattatgttattccaagccgtggtctgattggctttcgtactgagttcatgacgatgacctccggtaccggtctgctgtatgcaacattcagccactatgatgatattcgtccgggtgaaatcggtcgccgtcagaacggcgtgatgatttccaatggtcagggtaaagcagttgcttatgcactttacagcttacaggagcgcggtaagttattccttggtcatggtgcagaagtgtatgaaggtcaagtgatcggtattcattctcgttctaatgacctgacagttaactgtctgacaggtaagaaactgactaacgtccgtgcatctggtactgacgaagcgacaaccctgtctccacatattaagaaaaccctggagcaggctttggagtttattgatgatgacgagctggtggaagtgaccccggtgtctattcgtctgcgtaaacgccatttgacggaaaacgaacgccgtcgtgcgtatcgcagtaaagaagcataa

SEQ ID NO: 3592 - protein, 606 aa, Photorhabdus luminescens subsp. laumondii TTO1
MIEKLRNIAIIAHVDHGKTTLVDKLLQQSGTFGDRATTTERVMDSNDLEKERGITILAKNTAIKWNDYRINIVDTPGHADFGGEVERVMSMVDSVLLLVDAMDGPMPQTRFVTQKAFAHGLKPIVVINKVDRPGARPDWVVDQVFDLFVNLGATDEQLDFPIIYASALMGIAGTDHEDMAEDMTPLYQAIVDHVEPPKVDLNGSFQMQISQLDYNNYVGVIGIGRIKRGTVKPNQNVTIIDSEGKTRNGKIGKVLGHLGLERIESEQAEAGDIVAITGLGELNISDTLCDTNAVEALPPLAVDEPTVSMYFCVNTSPFCGREGKYVTSRQILERLKKELVHNVALRVEETEDPDAFRVSGRGELHLSVLIENMRREGFELAVSRPKVIFREIDGRKQEPFEQVTLDIEEQHQGDVMQGLGERKADLRDMLPDGKGRVRLDYVIPSRGLIGFRTEFMTMTSGTGLLYATFSHYDDIRPGEIGRRQNGVMISNGQGKAVAYALYSLQERGKLFLGHGAEVYEGQVIGIHSRSNDLTVNCLTGKKLTNVRASGTDEATTLSPHIKKTLEQALEFIDDDELVEVTPVSIRLRKRHLTENERRRAYRSKEA

SEQ ID NO: 3593 - DNA, 1911 bp, Corynebacterium diphtheriae NCTC 13129
  CDS (1)..(1911): transl_table=11
ttgacacgtccagagtttcgtaacgtcgctatcgtcgcgcacgttgaccatggaaagaccacgctagtcgacgctatgctgcgccagtccggagccttcgatgagcatgctgagcttgttgaccgcgtgatggactctggtgaccttgaaaaagaaaaaggcatcaccatcctcgcaaagaacaccgctgtgcgtcgccgcggtgctggcaaagatggcaatgacgttgttattaacgttattgacaccccaggccacgctgacttcggtggcgaggtagaacgcgcgctgtccatggtggacggcgttgttttgcttgttgacgcctccgaaggcccactgccacagacccgcttcgtgcttggcaaggctttggccgcgaagatgccagtcgtaattttggtgaacaagaccgatcgtccagacgctcgtatcgacgaggttgtcgaagagtctcaggatctcctcctagagttggcatcggcactcgatgatccagaggctgccgaagctgcagaacagctgctcgacctgccagttctttacgcttccggccgtgagggcaaggcaagcaccgttaaccctggcaacggaaacgttccagacgctgaggatctgcaggcattgttcgacgtgatctacgaggtcatgccagagccaaccgtgaacgtcgatggcccactgcaggcacacgtgaccaacttggactcctcttccttcttgggtcgtatcggcctgatccgtgtgcactccggttctttgaagaagggccagcaagttgcgtggattcactacgacgaagaaggcaaccagcacaccaagaccgctaagatcgcagaattgctgcgcaccgttggcgtgacccgtgttcctgcagacgaggttgttgcaggcgacattgctgctatctccggtatcgactccatcatgatcggtgacaccctcgctgatcttgagcacccagtggctctgcctcgtatcaccgttgatgagccagcgatctccatgaccatcggtgtgaacacctcgccacttgctggccgtggtggcggcgacaagctcaccgcacgtgtggtcaaggcacgccttgagcaggaactcatcggtaacgtttctctgcgcgttttgcctactgagcgtccagacgcttgggaggttcagggccgcggcgaaatggctctgtccgttctcgttgaaaccatgcgtcgcgaaggcttcgagttgactgtgggcaagccacaggttgttactcagactgtcgatggcaagctcttcgagccatacgagcacatggtcatcgacattccttccgagtaccaaggcaacgtcacccagctcatggccgctaggaagggccagatgctgtccatggacaacatctccgatgagtgggttcgcatggaatacaaggttccagcccgtggcctgatctctttccgcaccatgttcatgaccgaaacccgtggtaccggtatcgcaaactcctactccgaaggccttgacgagtgggctggcgaaatcaagggccgtgctaccggttcgctcgtggctgaccgctccggtcagatcactgcctacgcacttcagcagcttgccgaccgcggtaacttcttcgtcgagccaggcaccgaagcctacgagggcatggttgttggtgccaacaaccgtgacgaggacatggatgttaacatcacccgtgaaaagaagctgaccaacatgcgttccgcaacagcagacgcaaccgtcaccttggcaaaagctcgtagcctctccttggatgaagcgatggagttctgtggccaagacgagtgcgttgaggtcacccctgacgtgctgcgcgtacgcaaggtcatcctaaatgcaaccgagcgtggtcgcgcgcgtgcacgcgaaaaggctcgtaacaagtaa

SEQ ID NO: 3594 - protein, 636 aa, Corynebacterium diphtheriae NCTC 13129
MTRPEFRNVAIVAHVDHGKTTLVDAMLRQSGAFDEHAELVDRVMDSGDLEKEKGITILAKNTAVRRRGAGKDGNDVVINVIDTPGHADFGGEVERALSMVDGVVLLVDASEGPLPQTRFVLGKALAAKMPVVILVNKTDRPDARIDEVVEESQDLLLELASALDDPEAAEAAEQLLDLPVLYASGREGKASTVNPGNGNVPDAEDLQALFDVIYEVMPEPTVNVDGPLQAHVTNLDSSSFLGRIGLIRVHSGSLKKGQQVAWIHYDEEGNQHTKTAKIAELLRTVGVTRVPADEVVAGDIAAISGIDSIMIGDTLADLEHPVALPRITVDEPAISMTIGVNTSPLAGRGGGDKLTARVVKARLEQELIGNVSLRVLPTERPDAWEVQGRGEMALSVLVETMRREGFELTVGKPQVVTQTVDGKLFEPYEHMVIDIPSEYQGNVTQLMAARKGQMLSMDNISDEWVRMEYKVPARGLISFRTMFMTETRGTGIANSYSEGLDEWAGEIKGRATGSLVADRSGQITAYALQQLADRGNFFVEPGTEAYEGMVVGANNRDEDMDVNITREKKLTNMRSATADATVTLAKARSLSLDEAMEFCGQDECVEVTPDVLRVRKVILNATERGRARAREKARNK

SEQ ID NO: 3595 - DNA, 1824 bp, Rhodopseudomonas palustris CGA009
  CDS (1)..(1824): transl_table=11
atgaccctccgtaacatcgccattatcgcccacgtcgaccacggcaagaccactcttgtcgacaaactgctgcagcagtccggcacctatcgcgacaaccagcgccaggtcgaacgggcgatggactccaacgatctcgaacgcgaacgtggcatcaccattctggcgaagtgtacttcggtggtctggggcgacacccacatcaacatcgtcgacacacccggccacgccgacttcggcggcgaagtcgagcgtatcctgtcgatggtcgacggcgtgatcgtgctggtcgacgctgccgagggcccgatgccgcagaccaagttcgtggtcggcaaggcgctgaagcttggcctcaagccgatcgttgcgatcaacaaggtcgaccgctccgacgcccgcgtcaccgaagtggtcaacgaggtgttcgacctgttcgccgcgctcgacgccaccgacgagcagctcgacttcccgatcctgtacggctccggcaagaacggctggatgtcggacaagccggacggcgatccgagcgaaggcatgaagccgctgttcgagctggtgctcaagcacgttcatccgccggtggtggaagaaggtccgttccgcctgctcggcaccatcctcgaagccaatccctatctcggccgcatcatcaccggccgcatcgcgtcgggctcggtgaagccgaaccaggctgtcaaggtgctgtcgcgcgacggcaagctggtcgagcagggccgcatcagcaagatcctcgcctttcgcggcctcgagcgcgtgccgctcgatatcgccgaagccggtgacatcgtggcgatcgccggcctgaccaaggggaccgtcgccgacaccttctgcgatccggcggtcgataccccgatccaggcccaggcgatcgatccgccgaccgtgtcgatgtcgttcatcgtcaacaactcgccgcttgccggcaccgaaggcgacaaggtcaccagccgcctgatccgcgaccgcctgctccgcgaggccgagggcaacgtcgcgctgcgcgtggtcgaatccgccgacaaggacgcgatggaagtgtcgggtcgcggcgaattgcagctcgcgatcctgatcgagaacatgcgccgtgaaggtttcgaactcagcgtgtcgcgtccgcgcgtcgtgctgacccgcgacgagaacggccagctgctcgagccggtcgaggaagtcgtgatcgacgtcgacgaggaattctccggcgtcgtcgtgcagaagatgagcgaacgcaaggccgagatgatcgagatgcggccgtcgggcggcaatcgtctccggctggtgttctacgcgccgacccgcggcctgatcggctaccagggcgaactgatgaccgacaccaagggcacggccatcatgaaccggctgttccacaactacctgccgtatcgcggcgagatccagggccgccgcaacggcgtgctgatctccaacgatcagggcgaggcggttgcctacgcgatgttcaagctggaagatcgcggcccgatgatgatcgagccgggctggaaggtctacaagggcatgatcgtcggtgagcacacccgcgacaacgatctcgagatcaacgtcctcaagggcaagcagctcaccaacatccgcaccacctcgaaggacgaagcggtgcgcctgacgccgccgatccggatgacgctggaaaaggcgctggcctatatcgaagacgacgagctggtcgagatcacgccgaagtcgatccggctgcgcaagcgcctgctcgaccccaacgagcgcaagcgcgccgagaagagcaagcaggcggtcgcctga

SEQ ID NO: 3596 - protein, 607 aa, Rhodopseudomonas palustris CGA009
MTLRNIAIIAHVDHGKTTLVDKLLQQSGTYRDNQRQVERAMDSNDLERERGITILAKCTSVVWGDTHINIVDTPGHADFGGEVERILSMVDGVIVLVDAAEGPMPQTKFVVGKALKLGLKPIVAINKVDRSDARVTEVVNEVFDLFAALDATDEQLDFPILYGSGKNGWMSDKPDGDPSEGMKPLFELVLKHVHPPVVEEGPFRLLGTILEANPYLGRIITGRIASGSVKPNQAVKVLSRDGKLVEQGRISKILAFRGLERVPLDIAEAGDIVAIAGLTKGTVADTFCDPAVDTPIQAQAIDPPTVSMSFIVNNSPLAGTEGDKVTSRLIRDRLLREAEGNVALRVVESADKDAMEVSGRGELQLAILIENMRREGFELSVSRPRVVLTRDENGQLLEPVEEVVIDVDEEFSGVVVQKMSERKAEMIEMRPSGGNRLRLVFYAPTRGLIGYQGELMTDTKGTAIMNRLFHNYLPYRGEIQGRRNGVLISNDQGEAVAYAMFKLEDRGPMMIEPGWKVYKGMIVGEHTRDNDLEINVLKGKQLTNIRTTSKDEAVRLTPPIRMTLEKALAYIEDDELVEITPKSIRLRKRLLDPNERKRAEKSKQAVA

SEQ ID NO: 3597 - DNA, 1797 bp, Geobacter sulfurreducens PCA
  CDS (1)..(1797): transl_table=11
atgcaggagagaatcagaaacatcgccatcattgcccacgttgaccacggcaagaccactctcgtggatgccatgctcaagcacgccggagtgttccgggaaaacgaagccatcaccgagcgggtcatggattccaacgacctggagaaggagcggggcatcaccatcctggcaaaaaacctgtcggtccaccatggccgctacaagatcaacattgtcgataccccgggccacgccgacttcggcggcgaggtggagcgggtgctcaagatggtcgattcggtgctgcttctggtcgatgccctggacggccccatgccccagacccgcttcgtgctcaagaagtccctcgacctcggtctgaagccgatcgtggtcatcaataagattgaccgccccggttcacgccccgacgaggtggtggacatggttttcgacctgttttgcgaactgaacgcgaccgatgagcagctcgacttccccatcgtctataccagtgccaagctcggattcgccaaactcgacctcaattccgactctaacagcatggagcccctcttcgcggtaatcgagagtaacgtccatccgccggccggcgattcgaaggccccgttccagctcctcgtgaccaatatcgactacaacgactacatcggccggatcgccaccggcaggatattcaacggccgggtgaaggccggcgagaccgtggcgctcgtgcggcgcgacgggagcatcgagcggggacgcatcaccaagctcctgggatacgaggggctcaagcaggtggagatccccgaggcgtgtaccggcgacatcgttaccgtggccggttttgacgacgtgggcatcggcgagacgctggccgctgcagacaatccggtggcgcttccctatgtgtcgatcgacgagccgaccatttcaatgaacttcattgtcaattcctccccctttgccggccgtgaggggaagttcgtcacctcccgcaacatccgggagcgccttgaccgggagttgcgcaccaacgtgtcgctacgggtggaggatacggccaacgcggacacgttcaaggtttccggcaggggcgagcttcacctgtccatccttatcgagaacatgcggcgcgaaggattcgagatggcggtttccaagccggaggtcatcttgcgggtgatcgacggcacgaagatggagccgatggagtacctggtggtggacgttccctccgagttccagggtgccatcatcgagaagatgggacctcgcaagggggagatgacctccctgcagcccatgggcgagacagtgcggctggagtttgtcgtgccggcccgggggctcatcgggctgcggggagaactcctcaccgagacgcggggcactgcggtcatgacccacaccttccacgactatgccccttacaagggtgatatcccggggcgcaagaacggcgtcctcattgccatggaactcggcgaaaccactgcctatgccctcgacgcactccagccccggggaatcctcttcatcggtcccggtgtggaagtctacggggggatgatcatcggccagcacgccaaggacaacgatctggacgtgaacccctgcaagggaaagaaacttaccaatgtccgtgcctccggttcggacgacgccatcaagctcaccccgccgcgcatccttaccctggagcaggccctggagttcattgacgacgacgaactggtagaagtgaccccgcagtccatcaggctcagaaagaaagaactcgacccgaacaagcggaaacggaagtga

SEQ ID NO: 3598 - protein, 598 aa, Geobacter sulfurreducens PCA
MQERIRNIAIIAHVDHGKTTLVDAMLKHAGVFRENEAITERVMDSNDLEKERGITILAKNLSVHHGRYKINIVDTPGHADFGGEVERVLKMVDSVLLLVDALDGPMPQTRFVLKKSLDLGLKPIVVINKIDRPGSRPDEVVDMVFDLFCELNATDEQLDFPIVYTSAKLGFAKLDLNSDSNSMEPLFAVIESNVHPPAGDSKAPFQLLVTNIDYNDYIGRIATGRIFNGRVKAGETVALVRRDGSIERGRITKLLGYEGLKQVEIPEACTGDIVTVAGFDDVGIGETLAAADNPVALPYVSIDEPTISMNFIVNSSPFAGREGKFVTSRNIRERLDRELRTNVSLRVEDTANADTFKVSGRGELHLSILIENMRREGFEMAVSKPEVILRVIDGTKMEPMEYLVVDVPSEFQGAIIEKMGPRKGEMTSLQPMGETVRLEFVVPARGLIGLRGELLTETRGTAVMTHTFHDYAPYKGDIPGRKNGVLIAMELGETTAYALDALQPRGILFIGPGVEVYGGMIIGQHAKDNDLDVNPCKGKKLTNVRASGSDDAIKLTPPRILTLEQALEFIDDDELVEVTPQSIRLRKKELDPNKRKRK

SEQ ID NO: 3599 - DNA, 2037 bp, Mycobacterium avium subsp. paratuberculosis K-10
  CDS (1)..(2037): transl_table=11
gtgcagccaggtaggcgacacgccgatggggcccgcccaggatgcacactgaaacgcccaggattcacactcgacgagcggacccgagcggcccgggttatccagccggttcgctatcggtggccccgcgctgccagaatctccgacgtgccatttcgcaacgtcgccatcgtcgcccacgtcgaccacggcaagaccaccctggtggacgcgatgctgcggcagtccggggcgctgcaccaccgcggcgacgacacccaggagcgcatcctggacagcggtgacctggagaaggaaaagggcatcaccatcctggccaagaacaccgccgtgcaccgccatcaccccgacggcagcgtcacggtcatcaacgtcatcgacacccccgggcacgccgacttcggcggcgaggtggagcgcgggctgtccatggtggacggggtgctgctgctggtcgacgcctcggaggggccgctgccgcagacccggttcgtgctgcgcaaggcgctggccgcgcacctgccggtgatcctggtggtcaacaagaccgaccggccggacgcccggatcgccgaggtggtggaggccagccacgacctgctgctcgacgtcgcctccgacctggacgacgaggccgccaaggccgccgagcacgcgctgggcctgccgacgctgtacgcctccggccgcgccggcgttgcgagcaccgagcaaccggccgacggcgaggtgcccgccggggagaacctcgacccgctgttcgacgtgctgctcgagcacatcccggcgccgtcgggcgacccggaggcgccgctgcaggcgctggtgaccaacctcgacgcgtcgaccttcctgggccggctcgccctgatccgcatctacaacggcaaactgcgcaagggccaacaggtggcctggatgcgcgaggtcgacgggctgccggtgatcaccagcgccaagatcaccgaactgctggccaccgagggcgtcgagcgcagccccaccgacgaggcgatcgccggcgacatcgtcgcggtggccgggctgcccgagatcatgatcggcgacaccctggccgaccccgaccacgcccacgcgctgccccggatcaccgtcgacgagccggcgatctcggtgaccatcggcaccaacacctcgccgctggccggcaaggtgcccggccacaagctgaccgcccggctggtccgcaaccggctggaccaggagctggtcggcaacgtgagcatccgggtcgtcgacatcggccggcccgacgcctgggaggtgcagggccgcggcgagctcgccctggccgtgctggtcgaacagatgcgccgggagggcttcgagctcaccgtcggcaagccgcaggtggtgacccgcaccatcgacggccagctgcacgagccgttcgaggcgatgacgatcgactgccccgaggagttcgtcggcgccatcacccagctgatggccgcccgcaagggccgcatggaggagatgaccaaccacgcggcgggctgggtccggatggacttcatcgtgcccagccgcgggctgatcggcttccgcaccgacttcctcaccatcacccgcggcaccggcatcgccaacgccgtgttcgacggctaccggccgtgggcgggggagatccgggcccgccacaccgggtcgctggtctccgaccgcgccggcaccatcacgccgttcgccatgatccagctcgccgaccgcggccagttcttcgtcgaacccggccaggacacctacgagggcatggtcgtcggaatcaacccgcgcgcagaggatctcgacatcaacgtcacccgggagaagaagctgaccaacatgcggtcctcgaccgccgatgtcagcgagacgctggccaagccgctcgagctggacctggagcaggcgatggaattctgcgcggccgacgaatgcgtcgaggtgactccggagatcgtgcgggtgcgcaaggtcgagctggacgccacctcgcgggcgcgcagccgggcccgcgccaaggcccggggctga

SEQ ID NO: 3600 - protein, 678 aa, Mycobacterium avium subsp. paratuberculosis K-10
MQPGRRHADGARPGCTLKRPGFTLDERTRAARVIQPVRYRWPRAARISDVPFRNVAIVAHVDHGKTTLVDAMLRQSGALHHRGDDTQERILDSGDLEKEKGITILAKNTAVHRHHPDGSVTVINVIDTPGHADFGGEVERGLSMVDGVLLLVDASEGPLPQTRFVLRKALAAHLPVILVVNKTDRPDARIAEVVEASHDLLLDVASDLDDEAAKAAEHALGLPTLYASGRAGVASTEQPADGEVPAGENLDPLFDVLLEHIPAPSGDPEAPLQALVTNLDASTFLGRLALIRIYNGKLRKGQQVAWMREVDGLPVITSAKITELLATEGVERSPTDEAIAGDIVAVAGLPEIMIGDTLADPDHAHALPRITVDEPAISVTIGTNTSPLAGKVPGHKLTARLVRNRLDQELVGNVSIRVVDIGRPDAWEVQGRGELALAVLVEQMRREGFELTVGKPQVVTRTIDGQLHEPFEAMTIDCPEEFVGAITQLMAARKGRMEEMTNHAAGWVRMDFIVPSRGLIGFRTDFLTITRGTGIANAVFDGYRPWAGEIRARHTGSLVSDRAGTITPFAMIQLADRGQFFVEPGQDTYEGMVVGINPRAEDLDINVTREKKLTNMRSSTADVSETLAKPLELDLEQAMEFCAADECVEVTPEIVRVRKVELDATSRARSRARAKARG

SEQ ID NO: 3601 - DNA, 1833 bp, Lactobacillus johnsonii NCC 533
  CDS (1)..(1833): transl_table=11
ttgcaaagaagagacgatattagaaatattgccattatcgcacacgttgaccacggtaagactactttggttaaccaattgttaaaacaatcagatacattgccagagcacatgaatctagaagatcgtgctatggactccaatgctattgaacgtgaacgtggtattactatcttatctaagaacactgctgttaagtacggtgatactactattaacatcttggatacaccaggacacgctgacttcggtggtgaagtagaacgtatcatgcacatggttgacggatgtttattgcttgttgatgcttacgaaggtactatgccacaaactcgttttgtgcttaagaaggctttggaagctggcgttaagccaatcgtagttattaataagattgaccgtccaggtgctcgtccaaaggaagtattggatgaagttcttgaattattcatcgaattaggtgctagtgatgaacaacttgatttcccagttgtttacgcatctgctttaaacggtacttcttcatacgaatcagacccagctaagcaagaagaaacaatggatcctatttttgatactattgttaagaacattcctgctccagttgataattctgatgaaccattacaattccaaatcactatgcttgattgggatgactacgtaggtcgtatcggtgtaggacgtatttaccgcggaaaagttaaagttggtgacaacattactgttatgaaacgtgatggttcaactcaaaacttccgtgttactaaattatttggttacttcggtttgaagcgtaacgaaattcaagaagcaaaagccggcgatatcattgctatttctggtattaatgatatttatgttggtgaaactattgcttctgctgacaagcctgaagcattaccacttcttaagattgatccaccaactcttcaaatggactttgttgcaaacgattcaccatttgctggtcgtgaaggtgatcaagttacacctaagaaacttgaagaccgtttaattcgtcaaactcgtactgatgtttctttaaaggttgaaccaactgaccaattaaatgcctggactgtttctggtcgtggtgaattacacttgtcaattttagttgaagaacttcgtcgtgaaggatttgaattacaactttcacgtcctaaagttatttaccgtgaagttgatggacaaatgtgtgaaccatttgaagcagttcaagtagatactccagatgcttatgtaggttctgttattgactctctttcacaaagaaaaggtgaaatgaagaatatggaatctactggtaacggccaaactagacttgaattcttagtaccatcacgtggtttgattggttacaacaatgaattcatgtcccaaactgctggttacggaattatgaaccatacttttgattcatacaagcctgttgttaagaactgggaaccaggtcgtcgtaacggtgccttagtttcaatcaatcaaggtcaatcaacaacttactcacttcaatcagttgaacaacgtggtgaattattcatcggtgctggtgttgaagtttacgaaggtatgattgttggtcaatcatcacgtgaacgtgatattgctgttaacgtaactaagggtaagaacttaactaacactcgtgctgcaggtaaggaccactcagcttcaattaagactcctaagactatgactttggaagaagctattgaattcttgaacgatgatgaatactgtgaagtaactccagaaagtattcgtttacgtaagaagatcttaaacactaacgaaagaaaaaaggcagataagaaacgtaacaaatag

SEQ ID NO: 3602 - protein, 610 aa, Lactobacillus johnsonii NCC 533
MQRRDDIRNIAIIAHVDHGKTTLVNQLLKQSDTLPEHMNLEDRAMDSNAIERERGITILSKNTAVKYGDTTINILDTPGHADFGGEVERIMHMVDGCLLLVDAYEGTMPQTRFVLKKALEAGVKPIVVINKIDRPGARPKEVLDEVLELFIELGASDEQLDFPVVYASALNGTSSYESDPAKQEETMDPIFDTIVKNIPAPVDNSDEPLQFQITMLDWDDYVGRIGVGRIYRGKVKVGDNITVMKRDGSTQNFRVTKLFGYFGLKRNEIQEAKAGDIIAISGINDIYVGETIASADKPEALPLLKIDPPTLQMDFVANDSPFAGREGDQVTPKKLEDRLIRQTRTDVSLKVEPTDQLNAWTVSGRGELHLSILVEELRREGFELQLSRPKVIYREVDGQMCEPFEAVQVDTPDAYVGSVIDSLSQRKGEMKNMESTGNGQTRLEFLVPSRGLIGYNNEFMSQTAGYGIMNHTFDSYKPVVKNWEPGRRNGALVSINQGQSTTYSLQSVEQRGELFIGAGVEVYEGMIVGQSSRERDIAVNVTKGKNLTNTRAAGKDHSASIKTPKTMTLEEAIEFLNDDEYCEVTPESIRLRKKILNTNERKKADKKRNK

SEQ ID NO: 3603 - DNA, 1830 bp, Wolbachia endosymbiont of Drosophila melanogaster
  CDS (1)..(1830): transl_table=11
atgaacgaatttaaatcgatccgaaatatagcaataatcgcacacgttgaccacggtaaaactactttacttgataacatgttaaaacaaagtggcacattccgcgagaatcaagaagttcaagaacgagtgatggatagtggtgatcaagagcgtgaacgcggaattacaatacttgcaaaatgtacatcaataatgtggggcgatgaaaagatcaatattattgacacgccagggcacgcggactttggtggggaagtggaaagggtattgtgcatggcagatggtgtgttgctgctggttgacgctgcagaaggtcccatgccacaaacaaaatttgtgctctcaaaagcactaaaagcaaatttgaagccaattgtgataatcaataaggtcgaccgaccagatagcagaattgatgaagtattaaatgaaatatatgagttattttttaaccttgatgcaaccaacgagcagctagattttccagtgttgtatgcttcaggtagaaatggctggtgtgctaaggagctttctgatgaaagaaaagatttaagcccattattttcaacggttatagattatataaaaccttctgtttataatcaaaatgcaccttttgctatgttggtcactctacttgagtctgataagtttcttggcagaatattgacaggaaaggtttatcagggcattgcaaaagtcaattcagatcttaaggtgcttgacctcgatggcaaagtaattgaacgaggaagattaactaagttgctctcattttctggcttgaaacgcattccagtagaacaagctgtggcgggagacataattgcaattgcaggacttgaggaagcttcggtttcagatactatagcagcaccagaagttacaactgcagtaagctcaactccagttgatccgccaacaatggcgattactctgagcgttaatgattcaccttttgctgggcaagaaggtacaaagcttacttcaactgctataaaggatcgtttatatgcggaagcagaaacaaatgttgcaattactgtgactttggcaccaagcggtgaagcatttgaagtaggtgggcgtggtgagttacagcttggagtgttaattgaaaatatgaggagagaaggttttgagctttcggtatcacgccctcgcgtgttatttaaagaagaaggcggtaaaaaacttgaacctatagaggaagtagtaattgatgtagatgatgaatatagtggaatcatcatggaaaaactcagcttccgtaaaggtgaagtaactgacatgagaccttctggtaatggcaggacaagattaacgtttttagtgccatcaagaggattaatcggttatcaaggagagtttttaactgattctcgtggcacaggcataattaaccgtttatttcacagttatgctccacatagaggtccaatttctggaaggcgcaatggagttttaatttctacagataagggtgaggctgtggcatatgcaattttcaatttgcaagacaggggaattatgtttattaagccacaggataaggtatattgtggcatggttgtcggccagcatagccgtgacaatgatttggagataaatgtgttaaagggtaagcaattaacaaacgtaagagcttcaggtagtgatgaagctataaagctcactccaccaaagataatgacactggaggatatgatagcgtatatagatgatgatgaattggtggaagtaactccaaaatctatacgtttacgcaagaaattccttgatccaaatgaacgtaagcgtgcaggaagggcaaagaataaggagtaa

SEQ ID NO: 3604 - protein, 609 aa, Wolbachia endosymbiont of Drosophila melanogaster
MNEFKSIRNIAIIAHVDHGKTTLLDNMLKQSGTFRENQEVQERVMDSGDQERERGITILAKCTSIMWGDEKINIIDTPGHADFGGEVERVLCMADGVLLLVDAAEGPMPQTKFVLSKALKANLKPIVIINKVDRPDSRIDEVLNEIYELFFNLDATNEQLDFPVLYASGRNGWCAKELSDERKDLSPLFSTVIDYIKPSVYNQNAPFAMLVTLLESDKFLGRILTGKVYQGIAKVNSDLKVLDLDGKVIERGRLTKLLSFSGLKRIPVEQAVAGDIIAIAGLEEASVSDTIAAPEVTTAVSSTPVDPPTMAITLSVNDSPFAGQEGTKLTSTAIKDRLYAEAETNVAITVTLAPSGEAFEVGGRGELQLGVLIENMRREGFELSVSRPRVLFKEEGGKKLEPIEEVVIDVDDEYSGIIMEKLSFRKGEVTDMRPSGNGRTRLTFLVPSRGLIGYQGEFLTDSRGTGIINRLFHSYAPHRGPISGRRNGVLISTDKGEAVAYAIFNLQDRGIMFIKPQDKVYCGMVVGQHSRDNDLEINVLKGKQLTNVRASGSDEAIKLTPPKIMTLEDMIAYIDDDELVEVTPKSIRLRKKFLDPNERKRAGRAKNKE

SEQ ID NO: 3605 - DNA, 1815 bp, Bdellovibrio bacteriovorus HD100
  CDS (1)..(1815): transl_table=11
atgattcaagatccgaagaaaattagaaatatcgcgatcatcgcgcacgtcgaccacggtaagacgacactggttgaccacttgattaaacaagcaggtactttccgtgacaatgagcacgttgaagagcgcctgatggactccatggatcttgagagagagcgtgggatcacgatcgcggcaaagaacgcctccttcatgtacaaagatatcaaagttaacatcgtcgatacaccggggcacagtgacttcggcggcgaggttgagcgtattttgaacatggttgatggttgtatccttctttgcgatgcttccgaaggtccattgccacagactcgtttcgttttgaaaaaagctcttgagggcggcaaaaaagttatcgtttgtatcaacaaaattgaccgttctgatgctcgtattcaggaggttcacaatgagttgttcgatttgttcatcgatttggatgcaactgaagaacaatgtgatttccacactgtttacgctatcgcgcgtgaaggtatggcgactttggatccagcggttaacaccggatccctggaagttctttacgatgcaatcgtaaacctggttccgcctccaacaattgaagaaaacgctccacttcaagttatggtttccaacatctcttacaatgattacgtaggtcgtctggcgatcggtcgtatgagagctggtaccatcaaagtgggtgacgaagttctttgtgttcaggcgaacgctcagaagaaagttaaagtatccgctttgttccagtacaaagtgaactcccaggttcctgcccaggaagttggcgcgggtgacatggttgttatcgcgggtatggaagatttcactatcggtgacaccatcacttccgttgtggatcctcgtccacttccgcgtatccgcgttgaagagccgacagtgggcatggtcttctccgtcaacaacggtcctttcgccggtcttgatggtaagaacgtaacttcccgtaaaatcatcgaccgtctggacagagagttgttgtacaacgtggctatccgcgtggaaaaaacggactctacagacgcgttcaaagttgtgggtcgtggtgagcttcagttgggcgttttgatcgaacaaatgcgccgtgaaaacttcgagcttctggtttccaaaccgactgttgtcttcaaagaagaaaacggcaagaaaatggaaccaatggagatcgcggttatcgatatcgaagacgcttacgttggtgccgtaactgaaaagttgggtaaacgtaaaggtgtgatgactaacatggttcaaaaaggttccggacgcactcgtcttgagttccgtattccttcccgtggtctgatcggttaccgttctgagttcctgacggacactcgtggtaccggtttgttgaacacccagtttgacggttgggatgactaccgtggtgaaatcgaacaccgtttgaacggtgcgatgatctctgaccgtaaaggtactgcgacatcctatgcgatctggaatcttcaagagcgcggtgtcatgatggttgaacacggtgatgaagtgtacgaaggcatgatcgttggtgaacacgccaaggaaaatgatctagaagtgaacatcactcgtgaaaagaaattgtcaaacgtacgtgcttcgggttctgatgaagctatccgtctggttccggtgaaaaaattcactctggaaagagcgatggaatggatcaaagaatctgagctgatcgaagtgacgccgaagcacatccgtcttcgtttgcgtgaacttgatccgcataaacgtgcaaaagcagcgaaggaataa

SEQ ID NO: 3606 - protein, 604 aa, Bdellovibrio bacteriovorus HD100
MIQDPKKIRNIAIIAHVDHGKTTLVDHLIKQAGTFRDNEHVEERLMDSMDLERERGITIAAKNASFMYKDIKVNIVDTPGHSDFGGEVERILNMVDGCILLCDASEGPLPQTRFVLKKALEGGKKVIVCINKIDRSDARIQEVHNELFDLFIDLDATEEQCDFHTVYAIAREGMATLDPAVNTGSLEVLYDAIVNLVPPPTIEENAPLQVMVSNISYNDYVGRLAIGRMRAGTIKVGDEVLCVQANAQKKVKVSALFQYKVNSQVPAQEVGAGDMVVIAGMEDFTIGDTITSVVDPRPLPRIRVEEPTVGMVFSVNNGPFAGLDGKNVTSRKIIDRLDRELLYNVAIRVEKTDSTDAFKVVGRGELQLGVLIEQMRRENFELLVSKPTVVFKEENGKKMEPMEIAVIDIEDAYVGAVTEKLGKRKGVMTNMVQKGSGRTRLEFRIPSRGLIGYRSEFLTDTRGTGLLNTQFDGWDDYRGEIEHRLNGAMISDRKGTATSYAIWNLQERGVMMVEHGDEVYEGMIVGEHAKENDLEVNITREKKLSNVRASGSDEAIRLVPVKKFTLERAMEWIKESELIEVTPKHIRLRLRELDPHKRAKAAKE

SEQ ID NO: 3607 - DNA, 1854 bp, Mycoplasma mycoides subsp. mycoides SC str. PG1
  CDS (1)..(1854): transl_table=4
ttgcttaaatttagaagtgttagaatgaataatcaaaaaataataaatattgctgttattgcacacgttgatgctggtaaatctacacttgttgatgctttattaaaacaaagtggagtttttagacaaaatcaagaagtaattgaacaagttatggattcaaatgatcaagaaagagaaagaggaattacaatttattctaaaaactgttctattacttataaagattacaaaattaatatagtagatactccaggacatgctgatttttctagtgaagttgaaagaattatgaaaacagttgatactgtaattttattagttgattcaagtgaaggaccaatgtctcaaaccagatttgttttacaaaaagctttagaaattggattaaacccaattttatttattaataaaatagataaaaaagatcaaagaagtttagaagtagttgaagaagtaattgaattatttttagaactaaatgcaacagatgaacaacttgattttaaaactttatatggaattgcaaaaaatggaattgctcaatatagtctagaagaacaaagtaatgatttaacacctttatttgaaactattattaatcaagttggatcatatccaactgaactatctaataatgatctagtaatgcaagtttcaagtttagcttatgatagttttattggaagaattggaattggaagaatttttgaaggaagtattaaagaaaatcaaatcgtaagtattgttaaaaatgatagaattattaagcaaggaaaaattgcaaaattaatggtttatcaaggattaaatagagttcaagttaaacaagcatttgctggagatattattacatttgctggaattgaagatatttcaattggagatactattaataatttaaatattattaaaccattaaaaccaatccatattgaagaaccaacaatgtctatgaactttttagtaaatacttcaccatttgctggaagagttggtaaatttgttacttcaagaaatattaaagagcgtttagaaaaagaagttgaagtcaatgttggtttaagaattgaacctttgattaattctgaaattgaaggatttaaagttttaggacgtggagaattacatatttcagttttaattgaagcaatgagaagagaaggttttgaactagcaatttcaaaaccagaagtaatttttcaacgtaatccaatgaccggagatttattagaaccaattgaaaaagtaattattaatacaccaactgaatattctggaactgttattaataaattaaatcaaagaaaaggaattatgttagatatggattctgatggtattagagataaaattacttattctataccattaagaggattaattggatttagatcagaatttacaaatgatactcatggtgagggtattatggttaaaagtagtagtggatatgaactatataaaggtgaaattgtctcaagacaaaacggagtattagtatcaatggcaaatggtaaaagtttaccttatgctttaaataatcttgaagaacgcggaattttatttataggtcctcaagttgatgtttatgaaggaatgattattggtcagcattcaagagataatgatttatatgtaaatccaacaacagcaaaaaaattaactaatactagagctagtgggactgatgatgctgttaaattaacaccagctagaaaaatgagtctagaagaagctttagaatatatttcaaatgatgagttagttgaaattacaccaacagacattaggttgagaaagcgttgattaactcaagcagaacaaaaacaacacagaaacgataaatactag

SEQ ID NO: 3608 - protein, 617 aa, Mycoplasma mycoides subsp. mycoides SC str. PG1
MLKFRSVRMNNQKIINIAVIAHVDAGKSTLVDALLKQSGVFRQNQEVIEQVMDSNDQERERGITIYSKNCSITYKDYKINIVDTPGHADFSSEVERIMKTVDTVILLVDSSEGPMSQTRFVLQKALEIGLNPILFINKIDKKDQRSLEVVEEVIELFLELNATDEQLDFKTLYGIAKNGIAQYSLEEQSNDLTPLFETIINQVGSYPTELSNNDLVMQVSSLAYDSFIGRIGIGRIFEGSIKENQIVSIVKNDRIIKQGKIAKLMVYQGLNRVQVKQAFAGDIITFAGIEDISIGDTINNLNIIKPLKPIHIEEPTMSMNFLVNTSPFAGRVGKFVTSRNIKERLEKEVEVNVGLRIEPLINSEIEGFKVLGRGELHISVLIEAMRREGFELAISKPEVIFQRNPMTGDLLEPIEKVIINTPTEYSGTVINKLNQRKGIMLDMDSDGIRDKITYSIPLRGLIGFRSEFTNDTHGEGIMVKSSSGYELYKGEIVSRQNGVLVSMANGKSLPYALNNLEERGILFIGPQVDVYEGMIIGQHSRDNDLYVNPTTAKKLTNTRASGTDDAVKLTPARKMSLEEALEYISNDELVEITPTDIRLRKRWLTQAEQKQHRNDKY

SEQ ID NO: 3609 - DNA, 1797 bp, Prochlorococcus marinus str. AS9601
  CDS (1)..(1797): transl_table=11
atgtcatcttcgataaaagaaattagaaatgttgcaattattgctcacgtagatcatgggaagacaacgcttgtagatgcattgttatctcaatcaggaatatttagagacaatgaagttatacctacatgtgtaatggattcaaatgatcttgagagagaaagggggataacaatactctcaaaaaatactgcagttaactacaaagacaccagaattaatattatagatacacctggacatgctgattttggaggagaagttgaaagggttttgggaatggtggatggttgtctgcttattgttgatgcaaatgagggacctatgcctcaaacaagatttgttttaaaaaaagcattagaaaaaggacttagacctatcgtctttgtaaataaaattgatagaccacgagtagtaccagaaatagcaattgataaggtccttgatttgtttttggagttaggagctgatgatgatcaatgtgatttcccttatctttttgggagtggattatctggttttgcaaaagaagagatggaatctaatagtgacaatatgatgcctctttttgaagctattatcagacacgttcctcctccagtaggtgactctaataagcctcttcagctacaaataactactttggactattctgatttcttaggcagaatagtaatcggaaagatccacaacgggactataaaaaatggccaacaggctagtttaataaaggaaaacggaaaaactattaaaggtaaggttagtaaacttttaggatttgaaggattacaaagaattgatataaatgaagcatttgcaggtgatattgttgctgtttctggtttcgatgacgtcaatattggtgagaccatagcatgtcccgactctcctcatcctcttccattaatcaaagtagatgaacctaccttaaatatgacttttgttgtaaatgattcaccatttgcgggtaaggaagggaaatttgttactagtagacaattaaaaaatagattggagagggaacttttaacaaatgttgccttgagagtggaagaaactgattctcccgataagttctcagtttcaggaagaggagaattacatttaggtattttgattgaaaccatgagaagagaagggttcgagtttcaaatctcacaacctcaagtaatttttagagaaattgataatgttgaatgtgagcctatagagactttggtccttgatgtgcctgaagtatccgttggttcttgtatagaaaaacttggatcgagaaaggcagagatgaaaaatatgcagacaagttcagatgggagaacccaattagagttccttgtgccatcaaggggactaattggatttcgtggagaatttgtccggataacaagaggtgaaggtatcatgagtcattcgttttatgaatacaaacctaaaacaggagattttgaaactagaagaaatggagtccttatagcttttgaggaaggtgtggccacgttctatgcattaaagaatgctgaagataggggagtctatttcattaaacctggagttaaagtttataagggaatgataattggagagaataatcgacctcaagatcttgagttaaatatatgtaaaactaagcagttgactaatatgaggtctgcaggggcagaagaacttgatactttgcagtcacctgttgacattacccttgaaagagcactcgaatatattggtccagatgaaatgcttgaggtaacaccagattcaataagaatgagaaaaataaataaaaagaaaagaaattaa

SEQ ID NO: 3610 - protein, 598 aa, Prochlorococcus marinus str. AS9601
MSSSIKEIRNVAIIAHVDHGKTTLVDALLSQSGIFRDNEVIPTCVMDSNDLERERGITILSKNTAVNYKDTRINIIDTPGHADFGGEVERVLGMVDGCLLIVDANEGPMPQTRFVLKKALEKGLRPIVFVNKIDRPRVVPEIAIDKVLDLFLELGADDDQCDFPYLFGSGLSGFAKEEMESNSDNMMPLFEAIIRHVPPPVGDSNKPLQLQITTLDYSDFLGRIVIGKIHNGTIKNGQQASLIKENGKTIKGKVSKLLGFEGLQRIDINEAFAGDIVAVSGFDDVNIGETIACPDSPHPLPLIKVDEPTLNMTFVVNDSPFAGKEGKFVTSRQLKNRLERELLTNVALRVEETDSPDKFSVSGRGELHLGILIETMRREGFEFQISQPQVIFREIDNVECEPIETLVLDVPEVSVGSCIEKLGSRKAEMKNMQTSSDGRTQLEFLVPSRGLIGFRGEFVRITRGEGIMSHSFYEYKPKTGDFETRRNGVLIAFEEGVATFYALKNAEDRGVYFIKPGVKVYKGMIIGENNRPQDLELNICKTKQLTNMRSAGAEELDTLQSPVDITLERALEYIGPDEMLEVTPDSIRMRKINKKKRN

SEQ ID NO: 3611 - DNA, 1803 bp, Prochlorococcus marinus str. MIT 9515
  CDS (1)..(1803): transl_table=11
atgtcaacttcaattaaagatataagaaatgtcgcaattatagctcatgtagatcatgggaaaacaacccttgtcgatgcattattatctcaatcaggaatttttagagataacgaagtagttcctacttgcgtaatggactcgaatgatttggagagagaaagaggtattacaatcctttcaaaaaatacagctgttaattataaaaacacccgaattaatattattgacaccccgggacatgctgactttggaggtgaagttgaaagggttttgggaatggttgatggttgtttattaatcgttgatgctaatgaagggcctatgccccaaacaaggtttgtattaaaaaaagctttagaaaaaggtctaagacctatagtcttcgtaaataaaattgatagacctagagtagttccagaaatagcagttgataaagttcttgatttattccttgaattaggtgcagatgatgatcaatgcgattttccttatttattcggtagtggattatcaggttttgcaaaagaagaaatggagtcaaataatgataatatgatgcccctttttgaagctattcttaggcatgttcctccacctgtaggtgatttaaataagccattgcagcttcaaattacaactttggattactctgatttcttaggaagaattgtaattggaaagattcataatggaactataaaaaatggtcaacaagcaagccttataaaagaaagtggaaaaactatcaaaggaaaagtaagcaaacttttaggatttgagggattgcaaagaattgatattaatgaagcttttgccggagatattgttgcagtttctggtttcgatgatgtaaatattggagagaccatagcttgtcctgattctcctcatccacttcctttgattaaagttgatgagcctacactaaatatgacatttgtcgtaaatgattctccatttgctggcaaagaagggaaatttgttacaagcagacaattaaaaaatagattagaaagagaattattaactaatgtagccctaagagttgaagaaacagattcaccagatagattttctgtctctgggagaggcgaactgcatttagggattttgatagaaacaatgagaagagagggctttgaattccaaatatcgcaaccgcaagttatttttagagagattgataatgttcaatgcgaacctatagaaacattagttttagatgttccagaagccgcagttggttcttgcattgaaaaacttggttcaagaaaggctgagatgaaaaacatgcagacaagttcagatggaagaacacaactagaatttcttgtgccatcaagaggtcttataggctttcgtggggaatttgtgagaataactagaggggaaggaattatgagccactcattctatgaatataaacctaaagctggagattttgagacaagaagaaatggtgtacttatttcctttgaagagggtgttgctacattctatgctttaaaaaatgcagaagatagaggtgtttattttattaaaccgggagcaaaggtttataaaggtatgattattggcgagaataatagatcacaagatttagagttaaatatttgcaaaacaaagcaactgacaaacatgagatctgcaggagcagaagaattggatactttacaatctcctgtagatattacacttgagagagcgcttgaatatataggtcccgatgaaatgttagaagtaacgcctgattcaataagaatgagaaaattaaataagaaaaaggccttaaaaaaatag

SEQ ID NO: 3612 - protein, 600 aa, Prochlorococcus marinus str. MIT 9515
MSTSIKDIRNVAIIAHVDHGKTTLVDALLSQSGIFRDNEVVPTCVMDSNDLERERGITILSKNTAVNYKNTRINIIDTPGHADFGGEVERVLGMVDGCLLIVDANEGPMPQTRFVLKKALEKGLRPIVFVNKIDRPRVVPEIAVDKVLDLFLELGADDDQCDFPYLFGSGLSGFAKEEMESNNDNMMPLFEAILRHVPPPVGDLNKPLQLQITTLDYSDFLGRIVIGKIHNGTIKNGQQASLIKESGKTIKGKVSKLLGFEGLQRIDINEAFAGDIVAVSGFDDVNIGETIACPDSPHPLPLIKVDEPTLNMTFVVNDSPFAGKEGKFVTSRQLKNRLERELLTNVALRVEETDSPDRFSVSGRGELHLGILIETMRREGFEFQISQPQVIFREIDNVQCEPIETLVLDVPEAAVGSCIEKLGSRKAEMKNMQTSSDGRTQLEFLVPSRGLIGFRGEFVRITRGEGIMSHSFYEYKPKAGDFETRRNGVLISFEEGVATFYALKNAEDRGVYFIKPGAKVYKGMIIGENNRSQDLELNICKTKQLTNMRSAGAEELDTLQSPVDITLERALEYIGPDEMLEVTPDSIRMRKLNKKKALKK

SEQ ID NO: 3613 - DNA, 1797 bp, Prochlorococcus marinus str. NATL1A
  CDS (1)..(1797): transl_table=11
atgagttttgatatacaagctattaggaatatcgcaataattgctcacgttgatcacggtaagacaactttggttgatgctcttttaaatcaatctggaacttttcgagataacgaggaagtcccaacttgtgcgttggattcgaatgaattggaacgtgaaagaggtataacaattctttcgaaaaacacagctgttacttataacgatactcggataaacattgttgatacaccaggccacgctgattttggaggagaagtcgagagggttttgggaatggtagatggctgtcttcttgttgttgatgctaacgagggaccaatgccacaaactcgattcgttctgaaaaaagctttagagcaaggattaagacctattgtgtttgtgaataaaattgatcgtgcaagggtagaaccagaaaccgcggtagacaaggttttagatctgtttttggagttaggcgctgatgatgatcaatgtgattttccttatctatttgggagtggattaggggggtttgccaagactgaagtaaaaagtgaaaacgataatatgaaacctttatttgaagcaattattagacaagttcctcctccagttggcgatgtgaataagcctttacaattacaagtcacgaccctagattactcagatttcttaggaacaattattattggaagagtacataatggtgtaattaaaaacggccaaaggacatgtttgataaaggaagacggtagtttaaaaaaaggaaggattaataaattattaggatttaagggattaaaaagaattgaaattgaagaagcaaatgctggagatatagttgccttggctggctttgatgaagtttctattggtgaaactgtagcctgccctgatgagccgaaacctttacctctaattaaggtagatgagccaaccttgcagatgacttttgttgtcaatgattctccttttgcagggaaagagggcaagttcgtaaccagtcggcagttgaaggatcgtttaaataaagaacttctaacgaatgttgctttaagagttgaagatacggattctcctgaccgtttttctgttagtggaaggggagagttacatctaggaattcttatagagacaatgagaagagaggggtatgaatttcaagtttctcaaccacaagtaattttcaggacaatagatgaaattaaatgtgaacctgttgaaacgcttgtccttgacgtccctgaagcttcgattggtgcttgtattgagagccttggggtaagaaaaggtgaaatgcaaaacatggaaactggtactgatcaccgaactcaacttgagtttgttattccctcaagaggcttgattggatttaggggtgaatttattcgtgcaacaagaggagaagggattatgagtcattcattttttgaatacaggccatctgtaggagattttgagcaaaggagaaatggagtccttatttcatttgaagagggtgtcgctacgttctattccctaaagaatgcagaagaccgtggacaattttttattactcctggagccaaggtttataaaggaatgattattggggagaataaacgcccacaggatcttgaattaaatatctgtagggctaaacaacttaccaatatgcgatcagctggtgcagaggagctagatcaattgcaatccccaattgaaatgacattagaaagagctcttgaatacattggaccaggtgagatgttggaagttactcctgaatcaataaggcttagaaaaattaaagcaaagaaaaatttgtaa

SEQ ID NO: 3614 - protein, 598 aa, Prochlorococcus marinus str. NATL1A
MSFDIQAIRNIAIIAHVDHGKTTLVDALLNQSGTFRDNEEVPTCALDSNELERERGITILSKNTAVTYNDTRINIVDTPGHADFGGEVERVLGMVDGCLLVVDANEGPMPQTRFVLKKALEQGLRPIVFVNKIDRARVEPETAVDKVLDLFLELGADDDQCDFPYLFGSGLGGFAKTEVKSENDNMKPLFEAIIRQVPPPVGDVNKPLQLQVTTLDYSDFLGTIIIGRVHNGVIKNGQRTCLIKEDGSLKKGRINKLLGFKGLKRIEIEEANAGDIVALAGFDEVSIGETVACPDEPKPLPLIKVDEPTLQMTFVVNDSPFAGKEGKFVTSRQLKDRLNKELLTNVALRVEDTDSPDRFSVSGRGELHLGILIETMRREGYEFQVSQPQVIFRTIDEIKCEPVETLVLDVPEASIGACIESLGVRKGEMQNMETGTDHRTQLEFVIPSRGLIGFRGEFIRATRGEGIMSHSFFEYRPSVGDFEQRRNGVLISFEEGVATFYSLKNAEDRGQFFITPGAKVYKGMIIGENKRPQDLELNICRAKQLTNMRSAGAEELDQLQSPIEMTLERALEYIGPGEMLEVTPESIRLRKIKAKKNL

SEQ ID NO: 3615 - DNA, 1803 bp, Prochlorococcus marinus str. MIT 9303
  CDS (1)..(1803): transl_table=11
atgagtgcccaggccaaggcgatccgcaacattgcaattatcgctcacgtggatcacggcaaaacaaccttggttgatgccctgttgactcagtccgggatcttccgagacaacgaggctgtgcccacatgtgtcatggactccaatgatttggaaagggaacggggcattacgatcctttcaaagaacacggccgttacctacgacgagacgcggatcaacattgttgatacccctggtcatgccgattttggcggtgaggttgagcgggtgctcggcatggttgatggctgtttgctgatcgttgacgccaacgaggggcctatgccacagacgcgtttcgtgctcaagaaggcgcttgagcagggattgcggccgattgtgttcgtaaacaagattgatcgtgcgcgggtggatcctgaaaccgctgtcaacaaggtgctcgatctgtttattgaactcggtgcagatgatgaccaatgtgatttcccgtacttattcggcagtggaatgggaggttttgccaagccggatatggcaactgaaagtcaaacaatgaagccactatttgatgccatcctgcgtcatgttccaccacctgttggagatgagaacaagcctcttcagctacagatcactactctcgattattcagacttcctgggcaggattgtgattggtcgggtccataacggggttatccgtaatggtcagagtgcttcgttgattaaggatgatggcagcattaaacgtggccggattagcaaactactcggtttcgaagggttgcaacggattgagatacaagaagctggagcgggagatctcgttgctttggccggtttcgatcaagtcaatattggcgagaccattgcctgtccagatgaaccaaaagctttacctctaatcaaggtggatgaacccactttgcagatgacatttgtcgtcaatgattcaccctttgctggcaaagaaggcaaattcgtcactagccggcagctgcgagatcgtttacgcaaggaattactcaccaatgttgccttacgcgttgaggacactgattctcctgatcgttttgcggttagcgggcgtggtgaactacacctgggcatcctgattgaaaccatgcgccgcgagggatttgagtttcaggtaacccagcctcaggtgatcttccgaacgattgacggcactccttgcgagcccgttgaaaccttggtgatggatgtaccagaggcagccgttggcgcctgcattgagaagttgggtgtgcgtcggggtgaaatgcagaacatggaaaccggtaacgacggtcgcacccagcttgaatttgttgttccttctcgggggttgatcggtttacgtggtgagtttgtacgtgctaccaggggtgagggaattatgagccactctttttttgaatatcgcccaatgttgggagagtttgatgctcgtcggaatggtgttctgattgcttttgaacagggcactgcgaccttctacgcactcaagaatgctgagggtcgtggtcagttcttcatctctccgggtgtcaaggtttataaggggatgatcgttggcgaaaacaatcgacctcaggatatggagttaaacgtttgcaaggccaaacaactcacaaatatccgctctgctggtgcagaagagctcgataccttgcagacacctgttcagatgacccttgaacgtgctcttgagtacatcggtccagatgaaatgcttgaggtcaccccagagtccattcgcttgcgcaagttgcctgccaagaagatggccaaacgctga

SEQ ID NO: 3616 - protein, 600 aa, Prochlorococcus marinus str. MIT 9303
MSAQAKAIRNIAIIAHVDHGKTTLVDALLTQSGIFRDNEAVPTCVMDSNDLERERGITILSKNTAVTYDETRINIVDTPGHADFGGEVERVLGMVDGCLLIVDANEGPMPQTRFVLKKALEQGLRPIVFVNKIDRARVDPETAVNKVLDLFIELGADDDQCDFPYLFGSGMGGFAKPDMATESQTMKPLFDAILRHVPPPVGDENKPLQLQITTLDYSDFLGRIVIGRVHNGVIRNGQSASLIKDDGSIKRGRISKLLGFEGLQRIEIQEAGAGDLVALAGFDQVNIGETIACPDEPKALPLIKVDEPTLQMTFVVNDSPFAGKEGKFVTSRQLRDRLRKELLTNVALRVEDTDSPDRFAVSGRGELHLGILIETMRREGFEFQVTQPQVIFRTIDGTPCEPVETLVMDVPEAAVGACIEKLGVRRGEMQNMETGNDGRTQLEFVVPSRGLIGLRGEFVRATRGEGIMSHSFFEYRPMLGEFDARRNGVLIAFEQGTATFYALKNAEGRGQFFISPGVKVYKGMIVGENNRPQDMELNVCKAKQLTNIRSAGAEELDTLQTPVQMTLERALEYIGPDEMLEVTPESIRLRKLPAKKMAKR

SEQ ID NO: 3617 - DNA, 1845 bp, Clostridium thermocellum ATCC 27405
  CDS (1)..(1845): transl_table=11
gtggaaaacgctggtgaatatatcagagaaaatatcagaaatgtcgctataattgcacatgttgatcacgggaaaacaacccttgtggacgcaatgctgaaacaaagcggtatattcagagaaaatgaacaggtccaggaaagagtaatggactcaaatgatctggagagagaaagaggtattaccattctggcaaaaaacactgccataacctataaaaatatcaaaattaatattgtggacacaccgggtcacgctgatttcggcggcgaagtcgagcgggttctcgggatggtcgacggtgtccttttgttggttgactcctttgaaggcacaatgcctcagacaagattcgtacttagaaaagctcttcaggctaatttaaaacccatagtcgtcataaataaaattgacagacccgaagcaagaccggttgaagtcgtggatgaggtccttgagttgttcatcgaacttggagccgatgatgaacagctcgattttcctgttgtatacgcttccgcaagagaaggttatgctctatacaacttgaatgacgatccgaaaaaccttgagccgctgtttgaaaccttaataaatcacataccggctcccaaaggatttatggacaaacctcttcagcttttggtatcaaacatagactatgatgattatgttggaagaatagctgtgggaagaattgaaagaggcatgattaaaacaggacaacaggccgctttgtgcaaaaaggacggaagcattgaaaatgtcaaaataagccggctctatgtattcagcggtcttaaaagaattgaagccgattctgcaatgatgggagacattgttgcagtctcaggcatcagcaatattaacatcggtgagacaatttgtaatgttgatgcaccagaacccttaccttttattgagatagaagaaccgacaatcaccatgaccttcagcgtaaacaacagtccttttgccggtcgggaaggaacttttgtaacttcaaggcatctaagggaaagactctttaaagaactggaaaccaatgttagccttagagtcgaagaaactgattcccctgactcctttaaagtatccggaaggggtgaacttcatctttcaatcctgattgaaaccatgagacgtgaaggctacgagtttcaggtttccaagcccaatgtaattttgaaggaaatcgacggtgtactgtgtgaacctgtggaatatctgattattgacgttcctgaagagttcatgggcgttgtcatggaaaaactgggaagccgcaaggccgaaatggtaaacatgcattcttcccatcagggatatatgagactggaatttaaaataccctcaagaggtcttatcgggtacaggtcggaatttttgactgacacaaagggaaatggtataatgaatcatatattccacggttttgaacctttcaagggagaaataccgaaaaggcaaagaggctcaatggttgcatgggaagacggagaagctgtaacgtacggcctttacaatgcccaggaaaggggtacgttgttcatcacgcccggcacaaaggtatatgaaggcatgatagtcggagaaaattcaaggccggaggatattgtcataaatgtttgcaaaaagaaacatgttaccaacatgagagcagccggttccgatgaagctttgaggcttacgcctccggtgatactcagtcttgagcagtgtctggagtttatagaggatgacgaactggtggaagtcacaccaaaaaacatacgactgagaaaaaagattctcgacacggagcttagggcaaaaacaaaggcaagaaaaaaagaacagccttga

SEQ ID NO: 3618 - protein, 614 aa, Clostridium thermocellum ATCC 27405
MENAGEYIRENIRNVAIIAHVDHGKTTLVDAMLKQSGIFRENEQVQERVMDSNDLERERGITILAKNTAITYKNIKINIVDTPGHADFGGEVERVLGMVDGVLLLVDSFEGTMPQTRFVLRKALQANLKPIVVINKIDRPEARPVEVVDEVLELFIELGADDEQLDFPVVYASAREGYALYNLNDDPKNLEPLFETLINHIPAPKGFMDKPLQLLVSNIDYDDYVGRIAVGRIERGMIKTGQQAALCKKDGSIENVKISRLYVFSGLKRIEADSAMMGDIVAVSGISNINIGETICNVDAPEPLPFIEIEEPTITMTFSVNNSPFAGREGTFVTSRHLRERLFKELETNVSLRVEETDSPDSFKVSGRGELHLSILIETMRREGYEFQVSKPNVILKEIDGVLCEPVEYLIIDVPEEFMGVVMEKLGSRKAEMVNMHSSHQGYMRLEFKIPSRGLIGYRSEFLTDTKGNGIMNHIFHGFEPFKGEIPKRQRGSMVAWEDGEAVTYGLYNAQERGTLFITPGTKVYEGMIVGENSRPEDIVINVCKKKHVTNMRAAGSDEALRLTPPVILSLEQCLEFIEDDELVEVTPKNIRLRKKILDTELRAKTKARKKEQP

SEQ ID NO: 3619 - DNA, 1824 bp, Clostridium difficile 630
  CDS (1)..(1824): transl_table=11
atgtcacaaaaacataaaattataaatatcgcagttatagcccacgttgacgctggaaaatcaacattggttgatgctttcctttctcaaagcggtgtttttagaaagaacgaagtagttaaagactgcgttatggacagtaacgaccttgaaaaagaaagaggcataactatatattcaaaaaactgtgcaataaactatgaagattacaaaataaacatagttgatactccaggacacagtgacttttcttctgaagttgaacgtgttatgaaaactgttgacacagttattctattagttgatgctagtgaaggcccaatgcctcaaactagattcgttttacaaaaatctttagagttcggtttaaaaccaatattatttataaacaagattgataaaaaagaccagagagcggaagaagtagttaatgaagttttcgatttatttgtagacttaaatgcaacagatgagcaatgcgaatttcctataatatatggtattgctaaacaaggtattgctaaacttgaaatggatgatgatagtgaagacctttctcctctatttaaaactattgtaaatcacgttgaagcttatcctaattacgataatgaacctctacagttccaaatatcagctcttgcatatgatgattatgtaggtagacttggtataggtagaatttacaaaggtactcttaaaaacaatacacaagttgctatatgtagagaagattctgttgtatctaaaggaaaagtatcaaaactttctgtgtatgaaggtttaaaacaagttgaagttgatgaagctactagtggagaaatagttgttatagctggtattcctgatatatctataggtgaaactatatgcgatttagatagtccactacctatggaaatgataaaaatagaagagcctactctttctatgaacttcttagtaaacgactctccattcgttggaaaaagtggaaaattcgttacaactagacatttgaaagatagacttgaaaaagaacttgaagtaaatgttggtcttaaagttgaacctcttgatactactgatggatacaaagtttctggacgtggagagcttcacttatctatactacttgaaaatatgagacgtgaaggttatgaagttggtgtttctaaacctgaagttttaatgcataaagaagatggaaaactaatggaaccaatagaaagagttgttgtaaactgtcctgaagtttactctggtactattataaatgaattaaacatgagaaaaggtatgatggagtctatgtcaatagaaggagactatgtaaaaatagagttcttagcacctactcgtggtcttttaggatatcgaagtgaatttataaacgctactcgtggagaaggtactttagttcgttcatttgaaaaatttgaagaatttaaaggagaaataccttcaagaggaaatggtgttttaatagcacaaggacctggtgttactatggggtattctcttaatgccttaagtgatagagctgtaatgtttgtagaccctggtgtagaagtttacgaaggtatgataattggtatgaattccagaaaagatgatatggtagtcaacccttgtaaaaacaagaaaatgagtaacgtacgtgcttctggttcagatgatgctataaaattatctcctcctagaatatttactcttgaagaagcactagagtttatagaagatgatgaattagttgaaattacacctgattctataagacttagaaaaagattcttaaatgaacatgatagattaagatataacaaatctagacaaggtaaataa

SEQ ID NO: 3620 - protein, 607 aa, Clostridium difficile 630
MSQKHKIINIAVIAHVDAGKSTLVDAFLSQSGVFRKNEVVKDCVMDSNDLEKERGITIYSKNCAINYEDYKINIVDTPGHSDFSSEVERVMKTVDTVILLVDASEGPMPQTRFVLQKSLEFGLKPILFINKIDKKDQRAEEVVNEVFDLFVDLNATDEQCEFPIIYGIAKQGIAKLEMDDDSEDLSPLFKTIVNHVEAYPNYDNEPLQFQISALAYDDYVGRLGIGRIYKGTLKNNTQVAICREDSVVSKGKVSKLSVYEGLKQVEVDEATSGEIVVIAGIPDISIGETICDLDSPLPMEMIKIEEPTLSMNFLVNDSPFVGKSGKFVTTRHLKDRLEKELEVNVGLKVEPLDTTDGYKVSGRGELHLSILLENMRREGYEVGVSKPEVLMHKEDGKLMEPIERVVVNCPEVYSGTIINELNMRKGMMESMSIEGDYVKIEFLAPTRGLLGYRSEFINATRGEGTLVRSFEKFEEFKGEIPSRGNGVLIAQGPGVTMGYSLNALSDRAVMFVDPGVEVYEGMIIGMNSRKDDMVVNPCKNKKMSNVRASGSDDAIKLSPPRIFTLEEALEFIEDDELVEITPDSIRLRKRFLNEHDRLRYNKSRQGK

SEQ ID NO: 3621 - DNA, 1797 bp, Prochlorococcus marinus str. MIT 9301
  CDS (1)..(1797): transl_table=11
atgtcatcttcgataaaagaaattagaaatgttgcaattattgctcacgtagatcatggcaagacaacgcttgtagatgcattgttatctcaatcaggaatatttagagacaatgaagttatccctacatgtgtaatggattcaaacgatcttgaaagagaaagggggataacaattctctcaaaaaatactgcagttaactataaagataccagaattaatattatagatacacctggacatgctgattttggaggagaagttgagagggttttgggaatggttgatggttgtctgcttattgttgatgcaaatgagggacctatgcctcaaacaagatttgttttaaaaaaagcattagaaaaaggacttaggcctatagtctttgtaaataaaattgatagaccacgagtagtgccagaactagcaattgataaggtccttgatttgtttttggaattaggagctgatgatgatcaatgtgattttccttatctttttgggagtggcttatctggtttcgcaaaagaagagatggaatctaatagtgacaatatgatgcctctttttgaagctattataagacatgttcctcctccagtaggtgactctaataagcctcttcagctacaaataactaccttggactattctgatttcttgggcagaatagtaattggaaagatccacaatggaactataaaaaatggccaacaggctagtttaattaaagaaaacggaaaaactattaaaggtaaggttagtaagcttttaggatttgaaggattacaaagaattgatataaatgaagcatttgcaggagatattgttgctgtttctggttttgatgacgtcaatattggtgagaccatagcatgtcccgattctcctcatcctctcccattaatcaaagttgatgaacctaccttaaatatgacttttgttgtcaatgattcaccattcgcgggaaaggaagggaaatttgttaccagtagacaattaaaaaatagattggagagggaacttctaacaaatgttgccctaagagtagaagaaactgattctcctgacaggttctcagtttcaggaagaggagaattacatctagggatattgattgaaaccatgagaagagagggttttgagttccaaatatcacaacctcaagtaattttcagagaaattgataacgttgaatgtgagcctatagagactttggttttagatgtgcctgaagtatctgttggttcttgcatcgaaaaacttggatctagaaaggcagagatgaaaaacatgcagacaagttcagatggtagaactcaattagaatttcttgttccatcaagaggattaatcggatttcgtggggaatttgtaaggataaccagaggtgaaggcatcatgagccactcattttatgaatataaacctaaaacaggagattttgaaaccaggagaaacggagtccttatagcttttgaagaaggtgttgccacattttatgcattaaagaatgctgaagataggggagtctatttcattaaacctggagtcaaagtttataaggggatgataattggagagaataatcgaccgcaagatcttgagttgaatatatgtaaaactaagcagttgactaatatgaggtctgcaggagcagaagaacttgatactttgcagtcacctgttgatattacccttgaaagagcactcgaatatattggtccagatgaaatgctagaggtaacaccagattcaataagaatgagaaaaattaataaaaagaaaaaaaattaa

SEQ ID NO: 3622 - protein, 598 aa, Prochlorococcus marinus str. MIT 9301
MSSSIKEIRNVAIIAHVDHGKTTLVDALLSQSGIFRDNEVIPTCVMDSNDLERERGITILSKNTAVNYKDTRINIIDTPGHADFGGEVERVLGMVDGCLLIVDANEGPMPQTRFVLKKALEKGLRPIVFVNKIDRPRVVPELAIDKVLDLFLELGADDDQCDFPYLFGSGLSGFAKEEMESNSDNMMPLFEAIIRHVPPPVGDSNKPLQLQITTLDYSDFLGRIVIGKIHNGTIKNGQQASLIKENGKTIKGKVSKLLGFEGLQRIDINEAFAGDIVAVSGFDDVNIGETIACPDSPHPLPLIKVDEPTLNMTFVVNDSPFAGKEGKFVTSRQLKNRLERELLTNVALRVEETDSPDRFSVSGRGELHLGILIETMRREGFEFQISQPQVIFREIDNVECEPIETLVLDVPEVSVGSCIEKLGSRKAEMKNMQTSSDGRTQLEFLVPSRGLIGFRGEFVRITRGEGIMSHSFYEYKPKTGDFETRRNGVLIAFEEGVATFYALKNAEDRGVYFIKPGVKVYKGMIIGENNRPQDLELNICKTKQLTNMRSAGAEELDTLQSPVDITLERALEYIGPDEMLEVTPDSIRMRKINKKKKN

SEQ ID NO: 3623 - DNA, 1839 bp, Herminiimonas arsenicoxydans
  CDS (1)..(1839): transl_table=11
atgtcaaactcaaaacgcgctattcgtaacattgccatcatcgctcacgttgatcacggcaaaaccacgcttgttgaccaattattgcgtcaatcaggcactttccgtgacaatcagcaaattgatgcacgcgtgatggactccggcgatatcgaaaaggaacgtggcatcacgattctgtcgaagaactgcgcggttgagtacaaaggcacacatatcaacatcgttgataccccaggccacgccgacttcggtggcgaagtggaacgcgtgttgtcgatggttgacagcgtgctgctgctggttgatgcgcaagaaggtccgatgccgcaaacgcgcttcgtgacgcgcaaggctttggcactcggtttgaaacctatcgttgtgttgaacaagatcgatcgtccgggcgcacgcgcagaatgggcaatcaatgcgacctttgaattgttcgacaagctgggcgcgactgaagagcaactcgatttccctatcgtttacgcttccggcctgaacggctacgccggcctgacccctgacgtccgtggcggcaatatggaaccattgttcgacgcgattctggaacacgttccggcgcgtcaggacgatcctgatgcaccgctgcaattgcaaatcacttcgctggaatactcttcctacgtcggcaagatcggtgtcggtcgtattctggcaggtcgtgtcaaggcactgcaggatgtggtctggatgaacggtccggatgacaagccaaccaaggcgcgtatcaatcaagtgctgacattcaagggcctggatcgcgtactggtagatgaagcgctggcaggcgacatcgtactgatcaacggtatcgaagaaatcggtatcggtaccacgatctgcgcaccggatcacccgaatggtttgccgatgctgaaggttgatgagccgacgctgaccatgaatttcatggtcaacaactcgccattggccggccgcgaaggcaagttcgtgaccacacgccaaattcgcgatcgtctggaacgcgaattgaaagccaacatggcgctacgcgtcgtgcaatcggaaaacgatgattcgacctacgaagtgtcgggtcgcggtgaattgcatctgaccatcctgatcgaaaacatgcgtcgcgaaggcttcgagctggctgtatcacgtccacgcgtcgtgttcaaaatggtggatggcgtacgccacgagccgtttgaaaacctgaccattgacgtcgaagaaaccaatcagggcggcgtgatggaagaactcggtcgtcgtcgcggcgatctgcaaaacatggaaccggacggcaaaggtcgtgtgcgtctggaatatcatattcctgcgcgtggcctgatcggcttccagggcgagttcatgacattgacacgcggtaccggcttgatgagccacgtgttcgacgactacgctccggttgacgtatccaaaggtgagctcggcggccgtcgcaacggcgtgctgatttcgcaggatgacggtgctgccgttgcctatgcaatctggaaactgcaggatcgcggccgcatgttcgtcagccacaacgatccagtgtacgaaggcatgatcatcggcatccactcgcgtgacaacgatctggttgtgaacccgatcaagggcaagcaattgaccaacgtgcgttcgtcgggcaccgatgaagcggtgcgcctggtaccacctatcgaaatgtcgctggaatatgcagttgagtttatcgacgacgacgaactggttgaagtcacaccgaaaagcattcgtttgcgcaaacgttatttgaaagaacacgagcgcaaaaaagcaggccgtgacgctgcgtaa

SEQ ID NO: 3624 - protein, 612 aa, Herminiimonas arsenicoxydans
MSNSKRAIRNIAIIAHVDHGKTTLVDQLLRQSGTFRDNQQIDARVMDSGDIEKERGITILSKNCAVEYKGTHINIVDTPGHADFGGEVERVLSMVDSVLLLVDAQEGPMPQTRFVTRKALALGLKPIVVLNKIDRPGARAEWAINATFELFDKLGATEEQLDFPIVYASGLNGYAGLTPDVRGGNMEPLFDAILEHVPARQDDPDAPLQLQITSLEYSSYVGKIGVGRILAGRVKALQDVVWMNGPDDKPTKARINQVLTFKGLDRVLVDEALAGDIVLINGIEEIGIGTTICAPDHPNGLPMLKVDEPTLTMNFMVNNSPLAGREGKFVTTRQIRDRLERELKANMALRVVQSENDDSTYEVSGRGELHLTILIENMRREGFELAVSRPRVVFKMVDGVRHEPFENLTIDVEETNQGGVMEELGRRRGDLQNMEPDGKGRVRLEYHIPARGLIGFQGEFMTLTRGTGLMSHVFDDYAPVDVSKGELGGRRNGVLISQDDGAAVAYAIWKLQDRGRMFVSHNDPVYEGMIIGIHSRDNDLVVNPIKGKQLTNVRSSGTDEAVRLVPPIEMSLEYAVEFIDDDELVEVTPKSIRLRKRYLKEHERKKAGRDAA

SEQ ID NO: 3625 - DNA, 1827 bp, Burkholderia vietnamiensis G4
  CDS (1)..(1827): transl_table=11
atgacccgcgcccttcgcaacatcgccatcatcgctcacgtcgaccacggcaagaccacgctcgtcgaccaactgcttcgccagtccggcaccttccgcgagaaccagcagattgccgagcgggtgatggactcgaacgacatcgaaaaagagcgcgggatcaccatcctcgcgaagaactgcgcggtcgaatacgaaggcacgcacatcaacatcgtcgacacgccggggcacgcggacttcggcggcgaggtggagcgcgtgctgtcgatggtcgactcggtgctgctgctggtcgacgcggtcgaaggcccgatgccgcagacgcgcttcgtcacgaagaaggcgctcgcgctcggtctgaagccgatcgtcgtgatcaacaagatcgatcgtccgggcgcgcggatcgactgggtgatcaaccagaccttcgacctgttcgacaagctcggtgccaccgaagagcagctggacttcccgatcgtctacgcatcgggcctgaacggctacgcgtcgctcgatccggcgacccgcgaaggcgacatgcgcccgctgttcgaggcgatcctcgcgcacgtgccggttcgcccggccgatccggaagcgccgctgcagctgcagatcacgtcgctcgactattcgacgtacgtcggccgcatcggcgtgggccgcatcacgcgtggtcgcatcaagccgggtcagccggtcgtgatgcgcttcggtccggaaggcgaggtgctgaaccgcaagatcaaccaggtgctgtcgttcaaggggctcgagcgcgtgcaggtcgagtcggccgaagccggcgacatcgtgctgatcaacggcattgaagatgtcggcatcggcgcgacgatctgcgcggtcgacacgcccgaagcgctgccgatgatcaccgtcgacgaaccgacgctgacgatgaacttcctcgtcaactcgtcgccgctggcaggccgcgaaggcaagttcgtgacgagccgccagatccgcgaccgcctgatgaaggaactgaaccacaacgtcgcgctgcgcgtgaaggacaccggcgacgaaaccgtgttcgaagtgtcgggccgcggcgaactgcacctgacgatcctcgtcgagaacatgcgccgcgaaggctatgagctcgcggtgtcgcgtccgcgcgtcgtgatgcaggaaatcgacggcgtgaagcacgagccgtacgagctgctgacggtcgacgtcgaagacgagcaccagggcggcgtgatggaagagctcggccgccgcaagggcgagatgctcgacatggcgtcggacggccgcggccgtacgcgtctggaataccgcatctcggcgcgcggcctgatcggcttccagagcgaattcctgacgctcacgcgcggcacgggcctgatgagccacatcttcgactcgtacgcaccggtcaaggaaggctcggtgttcgagcgtcgcaacggcgtgctgatctcgcaggacgacggcgccgcggtggcgtacgcgctgtggaagctgcaggatcgcggccgcatgttcgtgaagccgggcgacgcgctgtatgagggcatgatcatcggcattcacagccgcgacaacgacctggtcgtgaacccgatcaagggcaagcagctgaccaacgtgcgtgcgtcgggcaccgacgaagccgtgcgcctcgtgccgccggtccagatgtcgctcgaatatgcggtcgaattcatcgacgacgacgagctcgtcgaagtcacgccgcaatcgatccgtctgcgcaagcgcttcctgaaggaacacgagcgtcgtcgcgcaagccgtgaaggcgcggtcgactga

SEQ ID NO: 3626 - protein, 608 aa, Burkholderia vietnamiensis G4
MTRALRNIAIIAHVDHGKTTLVDQLLRQSGTFRENQQIAERVMDSNDIEKERGITILAKNCAVEYEGTHINIVDTPGHADFGGEVERVLSMVDSVLLLVDAVEGPMPQTRFVTKKALALGLKPIVVINKIDRPGARIDWVINQTFDLFDKLGATEEQLDFPIVYASGLNGYASLDPATREGDMRPLFEAILAHVPVRPADPEAPLQLQITSLDYSTYVGRIGVGRITRGRIKPGQPVVMRFGPEGEVLNRKINQVLSFKGLERVQVESAEAGDIVLINGIEDVGIGATICAVDTPEALPMITVDEPTLTMNFLVNSSPLAGREGKFVTSRQIRDRLMKELNHNVALRVKDTGDETVFEVSGRGELHLTILVENMRREGYELAVSRPRVVMQEIDGVKHEPYELLTVDVEDEHQGGVMEELGRRKGEMLDMASDGRGRTRLEYRISARGLIGFQSEFLTLTRGTGLMSHIFDSYAPVKEGSVFERRNGVLISQDDGAAVAYALWKLQDRGRMFVKPGDALYEGMIIGIHSRDNDLVVNPIKGKQLTNVRASGTDEAVRLVPPVQMSLEYAVEFIDDDELVEVTPQSIRLRKRFLKEHERRRASREGAVD

SEQ ID NO: 3627 - DNA, 1827 bp, Bradyrhizobium sp. ORS278
  CDS (1)..(1827): transl_table=11
atgaacctccgcaacatcgccatcatcgcccacgtcgaccacggcaagaccaccctggtcgacaagctcctgcagcagtccggtacctatcgcgaaaaccagcgcacggttgagcgcgcgatggattccaacgatctggagcgcgagcgcggcatcaccattttggccaagtgcacctcggtgcaatggcaggacacccagatcaacatcgtcgacacccccggccacgccgatttcggcggcgaggtcgagcgcatcctgtcgatggtcgacggcgtgatcgtgctggtggacgccgccgaaggcccgatgccgcagacgaagttcgtggtcggcaaggcgctcaagctcggcctgaagccgatcgtcgccatcaacaaggtcgaccgccccgacgcccgtatcaccgaggtcgtcaacgaggtgttcgacctgttcgcggcgctcgacgccaccgatgagcagctcgatttcccgatcctctatgggtcgggcaagaacggctggatggctaccacgccagatggctcgcatgaggacggcatgaagccgctgttcgacctcgtgctcaagcacgtggcgcccccggtggtcgaggaaggtccgttccggctgctcggcaccatcatcgaggccaacaactatctcggccgtatcatcaccggccgcatcgcgtcgggctcggtgaagccgaaccaggccgttaaggtgctgtcgcgcgacggcaagctgatcgagaccggtcgcatcaccaagatcctcgccttccgcggcctcgagcgccagccgctcgactacgccgaggccggcgacatcgtcgccatcgcgggcctgaccaagggcaccgtggccgacacgttctgcgatccctcggttgagacgccgctccaggcgcagccgatcgatccgccgaccgtgtcgatgtcgttcatcgtcaacaactcgccgctcgccggcaccgagggcgacaaggtcacaagccgcctgatccgcgaccgcctgctgcgcgaggccgagggcaacgtcgcgctgcgcgtcgtcgagtcccaggacaaggacgcgatggaagtgtcgggccgcggcgaattgcagctggcgatcctgatcgagaccatgcgccgcgagggttttgagctgtcggtgtcgcgtccgcgcgtcgtgttcgagaaggacccggccaccggccagactctggagccgatcgaggaggtcgtgatcgacgtcgacgaggagcattccggcgtcgtcgtgcagaagatgagcgagcgcaaggccgagctgatcgagatgcgcccctccggcggcaaccgtctgcgcctggtgttctacgcgccgacccgcggcctgatcggctaccagggcgagctgatgaccgacaccaagggcacggcgatcatgaaccggctgttccacaactacatgccctacaagggcgcgatccagggccgccgcaacggcgtcctgatctccaacgaccagggcgaggccgtggcctacgccatgttcaagctggaggaccgcggtccgatgatgatcgagcccggctggaaggtctacaagggcatgatcgtcggcgagcatacccgcgacaacgacctcgagatcaacgtgctgaagggcaagcagctcaccaacatccgcaccacgtcgaaggacgaggccgtccgcctcaccccgccgatccggatgactctggagaaggcgttggcctatatcgaggacgacgagctggtggagattaccccgaagtccatccgcctgcgcaagaagcacctcgacccgaacgagcgcaagcgcgccgagaagcagaaggaagcggtggcgtaa

SEQ ID NO: 3628 - protein, 608 aa, Bradyrhizobium sp. ORS278
MNLRNIAIIAHVDHGKTTLVDKLLQQSGTYRENQRTVERAMDSNDLERERGITILAKCTSVQWQDTQINIVDTPGHADFGGEVERILSMVDGVIVLVDAAEGPMPQTKFVVGKALKLGLKPIVAINKVDRPDARITEVVNEVFDLFAALDATDEQLDFPILYGSGKNGWMATTPDGSHEDGMKPLFDLVLKHVAPPVVEEGPFRLLGTIIEANNYLGRIITGRIASGSVKPNQAVKVLSRDGKLIETGRITKILAFRGLERQPLDYAEAGDIVAIAGLTKGTVADTFCDPSVETPLQAQPIDPPTVSMSFIVNNSPLAGTEGDKVTSRLIRDRLLREAEGNVALRVVESQDKDAMEVSGRGELQLAILIETMRREGFELSVSRPRVVFEKDPATGQTLEPIEEVVIDVDEEHSGVVVQKMSERKAELIEMRPSGGNRLRLVFYAPTRGLIGYQGELMTDTKGTAIMNRLFHNYMPYKGAIQGRRNGVLISNDQGEAVAYAMFKLEDRGPMMIEPGWKVYKGMIVGEHTRDNDLEINVLKGKQLTNIRTTSKDEAVRLTPPIRMTLEKALAYIEDDELVEITPKSIRLRKKHLDPNERKRAEKQKEAVA

SEQ ID NO: 3629 - DNA, 1824 bp, Dichelobacter nodosus VCS1703A
  CDS (1)..(1824): transl_table=11
atgactaataacgatacggcgtatattcgtaacattgcgattgtcgcccacgtcgaccacggtaaaacaactttggttgatcagctgctgcgccaatccgataccttagcgaaacgggcagaaattcatgaacgtatgatggattcaatggatttggaacgcgagcgcgggattactattttggcgaagaatacggcgattcgttggcacgattatcagattaatattgtcgatactccagggcacgccgattttggcggcgaagttgaacgcgttttatcgatggtagatagcgttattttattggttgacgcgaccgatggcccgatgccgcaaacgcgttttgttacgcaaaaagcttttaatatgggactgcgcccaattgtactcatcaataaaattgaccgccccgaagcgcgtccggattgggttttaaatgaaacttttgatttatttgaccgtttgggtgccaccgatgaacagttagattttccaattgtttatgcttctggattaaatggttacgccggcgataatcccgatatccgctcgggagatatgacttatctttttgaaacgattgtcaaatatgtaaaagcgccgcaagttgatcgtacaaaaccatttcaaatgcgggtttcttcattggattattcgcgttataccggcgtgattggcgtgggacgcgttgagcgcggcacaatcaataaaaatacgccggttaaaatcgttggacgagatggcgccatgcgcagcggacgcattttgcaaatgtttcgttttttaggtttggaaaaagtagaaatcgaacaagccgccgccggcgatattatttcttttaccggcattgatccgctctatatttccgatacgttatgtgatcctaattgcgtggaagcattgccgagtttgacggttgacgaaccaacaatgagcatgacgtttcaagtaaacacttctccatttgccggacgggaaggcaaatttgttacctcgcggcaaattcaagaacgtttagaacgtgaattaattcataacgttgctttgcgcgtggaagcaatggcagatgccgataaatttaaagtttctggtcgcggcgaactgcatttatctgttttgattgaaacgatgcggcgcgaaggttacgagcttggcgtttcgcgtccggaagtaatttttaaagaaattgacggcgtcaaacatgaaccttatgagcttgttttgcttgatattgatgaagaacatcaaggcgcggtgatggagcgcatgggcgaacgtaaaggcgatttgcaaaatatggtggttgacggcaaaggacgcgtgcggctggaatatttgattccaacgcgcggcttgattggttttcaaacagaatttatgacgatgacttccggcacgggtttaaaattccaatcttttgatcattatgcgccggttaaagaaggtttgggcaaaacacggcgaaacggcgtattaattgccaacggttccggcaaagcgctggcttatgccttgtttaatttgcaagaacgcggacgtttatttatcgggcacggcgatgaagtttatgaaggcatgattattggcatgcacagccgcgataatgatttagtggttaatccattgaaagcaaaacaattaaccaatattcgcgctgccggttcagatgaaaatattattttaacgccgccgattcatcattctttagagcaagctttggaatttattgatgatgatgaattggtggaagtgacgccgaaatcgattcgtttgcgcaaaaaatatttgcacgaactcgaacgccgacgcgccccaaaagaataa

SEQ ID NO: 3630 - protein, 607 aa, Dichelobacter nodosus VCS1703A
MTNNDTAYIRNIAIVAHVDHGKTTLVDQLLRQSDTLAKRAEIHERMMDSMDLERERGITILAKNTAIRWHDYQINIVDTPGHADFGGEVERVLSMVDSVILLVDATDGPMPQTRFVTQKAFNMGLRPIVLINKIDRPEARPDWVLNETFDLFDRLGATDEQLDFPIVYASGLNGYAGDNPDIRSGDMTYLFETIVKYVKAPQVDRTKPFQMRVSSLDYSRYTGVIGVGRVERGTINKNTPVKIVGRDGAMRSGRILQMFRFLGLEKVEIEQAAAGDIISFTGIDPLYISDTLCDPNCVEALPSLTVDEPTMSMTFQVNTSPFAGREGKFVTSRQIQERLERELIHNVALRVEAMADADKFKVSGRGELHLSVLIETMRREGYELGVSRPEVIFKEIDGVKHEPYELVLLDIDEEHQGAVMERMGERKGDLQNMVVDGKGRVRLEYLIPTRGLIGFQTEFMTMTSGTGLKFQSFDHYAPVKEGLGKTRRNGVLIANGSGKALAYALFNLQERGRLFIGHGDEVYEGMIIGMHSRDNDLVVNPLKAKQLTNIRAAGSDENIILTPPIHHSLEQALEFIDDDELVEVTPKSIRLRKKYLHELERRRAPKE

SEQ ID NO: 3631 - DNA, 1869 bp, Dehalococcoides sp. BAV1
  CDS (1)..(1869): transl_table=11
gtgtgcccttgtatccaggctattttcaggagaaagattttggaaaactaccagagaaccgacattcgtaatattgctattattgcccacgtagaccacggcaaaaccagcctggtagacgtgatgcttaaacaaagccgcattttccgtgagaaccagcatgtgggcgaactgattatggaccgcaacactctggaacgggaaaaaggcattactattctggctaaaaacacggctatcacctaccgcggagtaaaaataaatattatagatactcccggacatgctgacttttcgggtgaagttgagcgggtgctgaatatggctgacggctgtcttttggtgattgacagcattgacggccccatgccccaaacccgttttgtacttaaggaagccatgcagaaaaaactgaagcctatcgtagttataaacaagattgaccgcgaaaattcacgccccgaagtagtgcttggactggtacaggacttgtttctggaactggccactactgaagaacagctggatttcccggtggtttatacctctgcccgcgagggttatgccgttaacacccccggcaccaagaatactgatttggtacccctgtttgagtgcatactttccaaaatccccccgcccagcattgcccagggtgaattccagatgctgatttccaacctggattatgatacccataaaggcaggatagctatcgggcgcattcaacggggcaaaatatgctcccgtgaccggatagttaatatagactcccaaaataaggctcattcttttgaagtaggtcaggtatttacctttatgggacttggcaagcaggaagttgaatgtgccgaggcgggtgaaattgtggccattaccggtctggaaaatgcatctataggtgataccgttaccagcccgctccagcctgaagccctgccccgtattgagataggtgaacccacagtcagaatgactttcggggtaaatacctcccctttcggcgggcgggacggcaaattctgtacttcacgccagcttcgggaaagactttaccgtgagcttgagactaatatcggactgagagtggaagaaaccgattccccggactcgtttttgatttccggacggggtgaactgcatctgtccatactggtagaaaccatgcgccgtgaaggatatgaatttgaaatatccaaaccggaggccattaccaagactattgacggcaaaatccatgaaccggtggaagctttgactatagatgtccgcgaggattttgtaggtgaggttaccgaacttctgggtaagcggcaggcacgcatgactgacatgcataatgacggcgaaggaaacgtaaggctggaatacaatatccccacccgcggtcttatcggcttccgcaactcgttcctgacggctaccagaggcacaggcgtacttaacagccagtttctggagtttcaaccctggtgcggcgaaatagaacaaagccgaaccggcgcacttgtagcggctgaagcaggattatcctgcacttacggcctgagcaattcgcaggaacggggtataataatgatagatgccaatatacccgtttatgaaggcatgattgtcggactgcatgccagaggccttgacttggctgtgaatgtctgcaagcagaagaaaatgaccaatatccgttcctcaacctcggatattgccatcaaactggtgccacccctcaaacttagccttgagcaatctatggatttcatcgctgatgacgaactggttgagataactcccaagggtatccgcctgcgcaagaagatactcaataccgacctgcggcttcgggcacgcaaacgcactgacaacaattaa

SEQ ID NO: 3632 - protein, 622 aa, Dehalococcoides sp. BAV1
MCPCIQAIFRRKILENYQRTDIRNIAIIAHVDHGKTSLVDVMLKQSRIFRENQHVGELIMDRNTLEREKGITILAKNTAITYRGVKINIIDTPGHADFSGEVERVLNMADGCLLVIDSIDGPMPQTRFVLKEAMQKKLKPIVVINKIDRENSRPEVVLGLVQDLFLELATTEEQLDFPVVYTSAREGYAVNTPGTKNTDLVPLFECILSKIPPPSIAQGEFQMLISNLDYDTHKGRIAIGRIQRGKICSRDRIVNIDSQNKAHSFEVGQVFTFMGLGKQEVECAEAGEIVAITGLENASIGDTVTSPLQPEALPRIEIGEPTVRMTFGVNTSPFGGRDGKFCTSRQLRERLYRELETNIGLRVEETDSPDSFLISGRGELHLSILVETMRREGYEFEISKPEAITKTIDGKIHEPVEALTIDVREDFVGEVTELLGKRQARMTDMHNDGEGNVRLEYNIPTRGLIGFRNSFLTATRGTGVLNSQFLEFQPWCGEIEQSRTGALVAAEAGLSCTYGLSNSQERGIIMIDANIPVYEGMIVGLHARGLDLAVNVCKQKKMTNIRSSTSDIAIKLVPPLKLSLEQSMDFIADDELVEITPKGIRLRKKILNTDLRLRARKRTDNN

SEQ ID NO: 3633 - DNA, 1809 bp, Synechococcus sp. WH 7803
  CDS (1)..(1809): transl_table=11
atgagcgcccagcaaaaggcgatccgcaatatcgcgatcatcgcccacgttgaccacggcaaaacgaccttggtcgactctctgctggcccagtcgggcatcttccgggataacgaggccgttcccacctgcgtgatggactccaacgatctggagcgtgagcgcggaatcaccattctctccaaaaacacagcggtcacctacaacgacacgcgaatcaacatcgttgatacccctggccacgccgacttcggtggtgaggttgagcgcgtgctcggcatggtggacggttgcctgctgatcgttgacgccaacgagggccccatgccccagacccgcttcgtgctgaagaaagcactggagcagggactgcgtccgatcgtgttcgtcaacaagattgaccgagcccgcgtcgaccccgagacagcggtcgacaaagtgctggatctgtttatcgaactgggtgctgacgacgatcagtgcgattttccctatctgttcggaagtggcttgggaggttttgccaagccggacatgaagaccgacagcgaaaacatgcgcccgctgtttgatgcgatcctgcggcatgttccgcccccggtcggcgatcccgaaaagccgctgcagctacagatcacaaccctggattactcagattttctgggtcgaatcatcatcggccgggttcacaatggtgtgatcaaacaggggcaaaatgctgcgttgatcaaggatgacggcaacgtcaagaaaggtcgtattagcaaattgcttggatttgaaggtctccagcgcgtggagattgatcaggcctccgctggtgaccttgtggctgtcgccggctttgacgacgtcaacatcggtgaaaccatcgcttgtcctgacgagccttcggcattgcctctgatcaaggtcgatgaacccacgctgcagatgaccttcgtggtcaatgattcaccctttgccggtcaggaaggcaaattcgtgaccagccgccaggtcagagaccggcttcagcgcgagctgctcaccaatgtcgctctgcgggttgaggacactgactctccggatcgcttcgctgtcagtggtcgtggtgagcttcacctcggcattttgattgaaaccatgcgtcgtgagggctacgagttccaggtctcccagccgcaggtgatctatcgcacgattgatggcactccctgtgagccagtggaaaccctggtgatggatgtaccggaggaatctgtgggcagctgcattgagaagctcgggactcgcaagggtgaaatgcaaaacatggaaaccggtcaggacggccgcacacagcttgaattcgtggtgccatcccgcggcttgatcggcttccgcggtgaattcatccgagcgactcgcggcgaagggatcatgagtcactcattcttcgaataccgcccgatgcttggcgatttcgacacccgacgcaatggtgtgctgatcgccttcgaggagggaactgcaaccttctatgccctcaagaatgccgaagaccgcggccagttctttatctcccctggaaccaaggtgtacaagggaatgattattggtgagtacaaccgtccccaggatttggagatcaacgtctgcaagacgaaacagctcaccaacatgcgctcagctggtgccgaagaactcgacacccttcaatctcctgttcagatgacgctcgagcgagccctcgagtacatcggtcccgacgaaatgctcgaagtcacgcctgaatcgatccgtctgcgcaaacttccttccaagaaggcggccaagtccaagcgttga

SEQ ID NO: 3634 - protein, 602 aa, Synechococcus sp. WH 7803
MSAQQKAIRNIAIIAHVDHGKTTLVDSLLAQSGIFRDNEAVPTCVMDSNDLERERGITILSKNTAVTYNDTRINIVDTPGHADFGGEVERVLGMVDGCLLIVDANEGPMPQTRFVLKKALEQGLRPIVFVNKIDRARVDPETAVDKVLDLFIELGADDDQCDFPYLFGSGLGGFAKPDMKTDSENMRPLFDAILRHVPPPVGDPEKPLQLQITTLDYSDFLGRIIIGRVHNGVIKQGQNAALIKDDGNVKKGRISKLLGFEGLQRVEIDQASAGDLVAVAGFDDVNIGETIACPDEPSALPLIKVDEPTLQMTFVVNDSPFAGQEGKFVTSRQVRDRLQRELLTNVALRVEDTDSPDRFAVSGRGELHLGILIETMRREGYEFQVSQPQVIYRTIDGTPCEPVETLVMDVPEESVGSCIEKLGTRKGEMQNMETGQDGRTQLEFVVPSRGLIGFRGEFIRATRGEGIMSHSFFEYRPMLGDFDTRRNGVLIAFEEGTATFYALKNAEDRGQFFISPGTKVYKGMIIGEYNRPQDLEINVCKTKQLTNMRSAGAEELDTLQSPVQMTLERALEYIGPDEMLEVTPESIRLRKLPSKKAAKSKR

SEQ ID NO: 3635 - DNA, 1824 bp, Klebsiella pneumoniae subsp. pneumoniae MGH 78578
  CDS (1)..(1824): transl_table=11
gtgatcgaaaatctgcgtaatatcgccatcatcgcgcacgttgaccatggtaaaactaccctggttgacaagctgctacagcaatccggtacgttcgacgcacgtactgaagcacaagaacgtgtgatggactccaacgatttggagaaagagcgtgggattaccatcctcgcgaaaaacaccgcaatcaaatggaatgattaccgtatcaacatcgttgataccccagggcacgccgacttcggaggtgaagttgagcgtgttatgtccatggttgactctgtgctgctggtggtagatgcctttgatggcccgatgccgcaaacgcgcttcgtgaccaaaaaagcttttgcccacggtctgaagccgatcgtggtcatcaacaaagttgaccgcccgggcgcgcgtccggactgggttgtcgatcaggtgttcgacctgttcgttaacctcgatgcgaccgacgaacagctggacttcccgatcgtttacgcgtccgcgctgaacggtatcgcgggtctggatcacgaagacatggctgacgacatgaccccgctgtaccaggcgattgtcgatcgcgtgccggcgccggacgttgatcttgacggtccgctgcagatgcagatctcccagctggactacaacaactacgttggtgttatcggcatcggccgcatcaagcgcggtaaagtgaagccgaaccagcaggtcactatcatcgatagcgaaggcaaaacccgtaatggtaaagtcggtaaggtactgactcacctgggtctggagcgaattgagagcgacgtagctgaagctggcgacattatcgcgatcaccggtctgggcgagctgaacatctccgacaccatctgcgacccgcagaatgtcgaagcgctgccggccctgtccgttgatgagccgaccgtttccatgttcttcaacgtcaacacctctccgttctgcggtaaagaaggtaagttcgttacctctcgccagatcctggaccgtctgaataaagagctggtgcacaacgtggcgctgcgcgttgaagaaaccgaagacgctgatgcgttccgcgtttccggccgtggtgaactgcacctgtccgttctgattgaaaacatgcgtcgtgaaggtttcgagatggcggtttcccgtccgaaagttatcttccgcgaaatcgacggccgtaaacaagagccgttcgagaacgtgacgctggacgtcgaagagcagcaccagggttctgtcatgcaggcgctgggcgagcgtaaaggcgacctgaaaaacatgaatccggacggtaaaggccgcgtacgtctcgactacgtgatcccaagccgcggtctgatcggcttccgttcagagttcatgaccatgacctccggtaccggtctgctttactccaccttcagccactacgacgacgttcgtccgggcgaagtgggccagcgtaacaacggcgtactgatctccaacggtcagggtaaagcggtagcgttcgcgctgttcggtctgcaggatcgcggtaagctgttcctcggccacggcgctgaagtttacgaaggccagatcatcggtattcacagccgttccaacgacctgacggtaaactgcctgaccggtaagaaactgaccaacatgcgtgcgtctggtactgacgaagccacggttctggttccgccggttaagatgaccctggagcaggctctggagttcatcgatgacgacgaactggtagaagttactccgacctctatccgtatccgtaaacgtcacctgaccgagaacgaccgtaaacgcgcgatgcgcggtgcaaaagaagagtaa

SEQ ID NO: 3636 - protein, 607 aa, Klebsiella pneumoniae subsp. pneumoniae MGH 78578
MIENLRNIAIIAHVDHGKTTLVDKLLQQSGTFDARTEAQERVMDSNDLEKERGITILAKNTAIKWNDYRINIVDTPGHADFGGEVERVMSMVDSVLLVVDAFDGPMPQTRFVTKKAFAHGLKPIVVINKVDRPGARPDWVVDQVFDLFVNLDATDEQLDFPIVYASALNGIAGLDHEDMADDMTPLYQAIVDRVPAPDVDLDGPLQMQISQLDYNNYVGVIGIGRIKRGKVKPNQQVTIIDSEGKTRNGKVGKVLTHLGLERIESDVAEAGDIIAITGLGELNISDTICDPQNVEALPALSVDEPTVSMFFNVNTSPFCGKEGKFVTSRQILDRLNKELVHNVALRVEETEDADAFRVSGRGELHLSVLIENMRREGFEMAVSRPKVIFREIDGRKQEPFENVTLDVEEQHQGSVMQALGERKGDLKNMNPDGKGRVRLDYVIPSRGLIGFRSEFMTMTSGTGLLYSTFSHYDDVRPGEVGQRNNGVLISNGQGKAVAFALFGLQDRGKLFLGHGAEVYEGQIIGIHSRSNDLTVNCLTGKKLTNMRASGTDEATVLVPPVKMTLEQALEFIDDDELVEVTPTSIRIRKRHLTENDRKRAMRGAKEE

SEQ ID NO: 3637 - DNA, 1893 bp, Kineococcus radiotolerans SRS30216
  CDS (1)..(1893): transl_table=11
atgcccttgagcacccgcgaggacctgcgcaacgtcgcgatcgtcgcccacgtcgaccacgggaagacgacgctcgtcgacgcgatgctctggcagtccggcgccttccgcgccaacgccgacgtcaacgagcgagtcatggactccggggacctcgagcgcgagaagggcatcacgatcctcgcgaagaacacctcggtgcactacaccggcccgggctcgcccgagggcggcatgaccatcaacatcatcgacacccccggccacgccgacttcggcggtgaggtcgagcgcggcctgtcgatggtcgacggcgtcgtgctcctcgtcgacgcctccgagggcccgctgccgcagacccgcttcgtgctgcgcaaggcgctcgcggccggtatgcccgtcgtcatcctcgtcaacaaggtcgaccgccccgacgcgcgcatcgccgccgtcgtggaggagacctacgacctgctgctggacctcgccgctgacgtcgagggcatcgacgccgacaagctcctcgaggtccccgtcgtctacgcctcggccaagaacggccgcgcctcgctgaaccagcccgaggacggcggcctgcccgaccacgaggacctcgtcccgctcttccagacgatcctcgacaccatcccggcgccggtctacgaccccgagaccccgctgcaggcgcacgtcaccaacctcgacgcctccccgttcctgggtcgcctggccctgctgcgcatcttctccggcgagctgatcaagggtcagcaggtcgcgtggtgcaagcacgacggcacgatcgagcgcgtcaagatcaccgagctgctcgtcaccgaggccgtcacccgcgtcccgggcgagaaggccggccccggggacatcgtcgccgtcgccggcatcgaggggatcaccatcggcgagaccctcgccgaccccgacgacccgcgcccgctgccgctgatcaccgtcgacgagcccgccatctcgatggtcatcggcaccaacacctccccgctggccgggcgggtcaagggctccaaggtcaccgcgcgcctggtcaaggaccgcctggagtccgagctcgtcggcaacgtctccatccgcgtcctgcccaccgagcgccccgacgcgtgggaggtgcagggccgcggcgagctggcgctggccatcctcgtcgagcagatgcgccgcgagggctacgagctgaccgtcggcaagccgcaggtcgtgctgcgcaaggacgagaacggcaagaccctcgagcccttcgagaacctcaccatcgacgcgcccgaggagtacctgggggccatcacccagctgctggccgcccgcaagggccgcatggagacgatgaccaaccacggcaccggctgggtgcgcatggagttctacgtcccctcccgcgggctcatcggcttccgcacccagttcctcaccgacacccgcggcaccggcatcgcgcacgcgctcttcgcccagtacgaccactgggccggcgagatccgcacccgccagtccggctcgctggtcgccgaccgcgccggggcggccaccgcgttcgcgatgacgaacctgcaggagcgcgggcagatgttcatcgagccgacctccgaggtgtacgagggcatgatcgtcggggagaactcccgcgccgacgacatggacgtcaacatcaccaaggagaagaagctcacgaacatgcgctcgtcgacctccgacgagttcgagcgcctcatccccccgcgccacctgtccctggagcagtgcctggagttctgccgcgaggacgagtgcgtcgaggtgaccccggagtccgtgcgcatccgcaaggtcgtcctggaggccaacgcccgcgccaagacggcctcgaaggccaagaagggctga

SEQ ID NO: 3638 - protein, 630 aa, Kineococcus radiotolerans SRS30216
MPLSTREDLRNVAIVAHVDHGKTTLVDAMLWQSGAFRANADVNERVMDSGDLEREKGITILAKNTSVHYTGPGSPEGGMTINIIDTPGHADFGGEVERGLSMVDGVVLLVDASEGPLPQTRFVLRKALAAGMPVVILVNKVDRPDARIAAVVEETYDLLLDLAADVEGIDADKLLEVPVVYASAKNGRASLNQPEDGGLPDHEDLVPLFQTILDTIPAPVYDPETPLQAHVTNLDASPFLGRLALLRIFSGELIKGQQVAWCKHDGTIERVKITELLVTEAVTRVPGEKAGPGDIVAVAGIEGITIGETLADPDDPRPLPLITVDEPAISMVIGTNTSPLAGRVKGSKVTARLVKDRLESELVGNVSIRVLPTERPDAWEVQGRGELALAILVEQMRREGYELTVGKPQVVLRKDENGKTLEPFENLTIDAPEEYLGAITQLLAARKGRMETMTNHGTGWVRMEFYVPSRGLIGFRTQFLTDTRGTGIAHALFAQYDHWAGEIRTRQSGSLVADRAGAATAFAMTNLQERGQMFIEPTSEVYEGMIVGENSRADDMDVNITKEKKLTNMRSSTSDEFERLIPPRHLSLEQCLEFCREDECVEVTPESVRIRKVVLEANARAKTASKAKKG

SEQ ID NO: 3639 - DNA, 1830 bp, Xanthobacter autotrophicus Py2
  CDS (1)..(1830): transl_table=11
atgaagcttcgcaacatcgccatcatcgcccacgtcgaccacggcaagaccacgctggtggacgagttgctcaagcagtcgggctcctaccgcgagaaccagcgcgtggccgagcgcgtgatggattccaacgatctggaaaaggagcgcggcatcaccatcctcgccaaggccacctcggtggtctggaaggacacgcgcatcaacatcgtggacacccccggccacgccgacttcggcggcgaggtggagcgcatcctgaacatggtggacggtgccatcgtgctggtggacgccgccgagggccccatgccccagaccaagttcgtggtgggcaaggcgctgaaggtggggctcaagcccatcgtggccatcaacaaggtggaccgctccgacgcccgcatcaccgaggtggtgaacgaggtgttcgacctgttcgccgcgctcgacgccaccgacgagcagctcgacttccccatcctctacggctccggccgcaacggctggatggccgagagcccggaaggcccctccgaccagggcatgtcgcccctgttcgacctggtgctgaagcatgtgcccgagcccaccgtggatgacggcccgttccgcatgatcggcacgctgctggaggccaaccccttcctcggccgcatgatcaccgggcgcatcacctccggctcgatcaagccgaaccagcccatcaaggtgctggcgcaggacggctcgctggtggagcagggccgggtctccaagatcctcgcctttcgcggcatcgagcgccagcccatcgaggaaggcgtgcagggcgacatcgtcgccatcgccggcctctccaagggcacggtggccgacactttctgcgcgctcgaagtgaccgagccgctggcggcccagcccatcgatccgcccaccgtcaccatgaccttcatcgtcaacgattcgccgctggccggcaccgagggcgacaaggtgacgagccgcgtcatccgcgaccgcctgctgcgcgaggcggaaggcaacgtggcgctcaagatcgaggaatccaccgagaaggattccttcttcgtctccggccgcggcgaactgcagctcgccgtgctgatcgagaccatgcgccgcgagggcttcgagctcgccgtgtcgcgtccccgcgtggtgttccagaaggatgaggccaccggccaggcgctggagcccatcgaggaagtcctcatcgacgtggacgaggaatattccggcaccgtggtgcagaagatgagcgagcgccgcgccgagatggtggagatgcgcccctccggcggcaaccgccagcgtctggtgttctatgctcccacccgcggcctcatcggctaccagtcggagctgctcaccgacacccgcggcaccgcgatcatgaaccggctgttccacgaatacgccccctacaagggcgagatcgcgggccgggtgaacggcgtgctgatctccaacgagcagggtgaggcggtggcctatgccctgtggaacctcgaagaccgcggcccgatgatcatcgagccgggctggaaggtgtaccagggcatgctggtgggcatccacaaccgggacaacgacctggaagtgaacgtgctcaagggcaagaagctcaccaacatccgcaccacctccaaggacgaggcggtgcgcctgaccccgccgatccgcatgacgctggagcgcgcgctggcctggatccaggacgacgagctggtggaggtgacccccaagtccatccgcctgcgcaagcgctacctcgatcccaacgagcgcaagcgcgaggagcgcaagaaggaaaccgagctggcctga

SEQ ID NO: 3640 - protein, 609 aa, Xanthobacter autotrophicus Py2
MKLRNIAIIAHVDHGKTTLVDELLKQSGSYRENQRVAERVMDSNDLEKERGITILAKATSVVWKDTRINIVDTPGHADFGGEVERILNMVDGAIVLVDAAEGPMPQTKFVVGKALKVGLKPIVAINKVDRSDARITEVVNEVFDLFAALDATDEQLDFPILYGSGRNGWMAESPEGPSDQGMSPLFDLVLKHVPEPTVDDGPFRMIGTLLEANPFLGRMITGRITSGSIKPNQPIKVLAQDGSLVEQGRVSKILAFRGIERQPIEEGVQGDIVAIAGLSKGTVADTFCALEVTEPLAAQPIDPPTVTMTFIVNDSPLAGTEGDKVTSRVIRDRLLREAEGNVALKIEESTEKDSFFVSGRGELQLAVLIETMRREGFELAVSRPRVVFQKDEATGQALEPIEEVLIDVDEEYSGTVVQKMSERRAEMVEMRPSGGNRQRLVFYAPTRGLIGYQSELLTDTRGTAIMNRLFHEYAPYKGEIAGRVNGVLISNEQGEAVAYALWNLEDRGPMIIEPGWKVYQGMLVGIHNRDNDLEVNVLKGKKLTNIRTTSKDEAVRLTPPIRMTLERALAWIQDDELVEVTPKSIRLRKRYLDPNERKREERKKETELA

SEQ ID NO: 3641 - DNA, 1821 bp, Leptospira interrogans serovar Copenhageni str. Fiocruz L1-130
  CDS (1)..(1821): transl_table=11
atggaaatccgcaatatagcaatcattgcccacgtagaccacgggaaaaccacacttctggacggaattctccgtcaaaccggcgccgtcacagccaaagaggacggagaaagaatcatggattccaatgacttggaaaaggaaaaaggaatcacgatcaaagcaaaaaatacagcggtggtttataaagggactagaatcaacgtagtagatactcccggtcacgcggatttcggcggagaagtggaacgcgttcttgcaactgcggattcttgtcttcttcttgtggacgcttttgacggaccgatgcctcagactcgtttcgtattaggaaaatctcttcaactcggacacagacctattttagtaattaataaaatagaccgtccaggcgcgagaccagaagcggttgtagatatggcgtttgatctattttccgatttaggagccacagacgaacagttagattttccaatcgtatatgcatctgcaaaacaaggttgggcggttcacaatctgagcgaatctccgggtacaaacctggatcctcttttggacaccgttcttaaacacgttccgcctgttcaagcggacacggaagccccgcttcaattccaagtgacttccttggattataacgactatgtaggaagaattgcagtcggaaaaatttatgcgggaaaaatggcgctcggaatgaacgttatacaacttgcggcaaaaaaaaccgaaacggctccatcagcggatactgcattatttaggattacaaaattatacaattttgaaggactcaaaagaaacgaagtcaatacggcggaagcaggagacatcgtggcgattgcgggtcttccggatgtgtttatcggagatacaatttgtgaacctggaaaaccggcccccagaccagcgatcgaggtagaagaaccgaccgtatctatgttttttatggtaaacaattctccgtttgccggaaaagaaggaaagttcgtaacgacccgaaatattcgagaacgtttggatcgagaactagaaactaacgtagcgatgagactcgaagaaaccgaagataaggatcgttttaaggtgttagggcgtggagaacttcatttgtcggttcttatcgaaacaatgagaagagaaggatttgaaatccaagtctctcgtcctgaagtcattttaaaaactaacgagcaagggcaaaaactcgaaccttacgaatatttggtaatggatgttcctgatcaatttacaggagcgatcattgccgagttaaaccgtagaaagggagaactacaattgatggacgcacatccgtccggaatgacccgagtagaatttgtaatacctacaaggggaattataggttttagaggattttttatttcagaaaccagaggagaaggagtgatgtcttctcgttttcttaggttcgatgtatataaaggggatattcctggtcgtaagaacggcgcattgatttcaatggactcaggagaatccactgcatatgctctttggaagattcaagaaagaggggaattggtgatcgggccgaatacctctgtttatcccggaatgatcatcggaattcattctcgtgataatgatctagaagtgaatcctgtaaaggaaaagaaactgagtaacgttcgttcttctggagcggatgaggcgatacgtctggttcctcctagaaaattttctttagaacaaaacatagaatttttagatgatgacgaacttttggaagtaactcccacgagtttacgtcttcgtaaaaagtttttagacgcaaatatgcgtaaacgtaacaaataa

SEQ ID NO: 3642 - protein, 606 aa, Leptospira interrogans serovar Copenhageni str. Fiocruz L1-130
MEIRNIAIIAHVDHGKTTLLDGILRQTGAVTAKEDGERIMDSNDLEKEKGITIKAKNTAVVYKGTRINVVDTPGHADFGGEVERVLATADSCLLLVDAFDGPMPQTRFVLGKSLQLGHRPILVINKIDRPGARPEAVVDMAFDLFSDLGATDEQLDFPIVYASAKQGWAVHNLSESPGTNLDPLLDTVLKHVPPVQADTEAPLQFQVTSLDYNDYVGRIAVGKIYAGKMALGMNVIQLAAKKTETAPSADTALFRITKLYNFEGLKRNEVNTAEAGDIVAIAGLPDVFIGDTICEPGKPAPRPAIEVEEPTVSMFFMVNNSPFAGKEGKFVTTRNIRERLDRELETNVAMRLEETEDKDRFKVLGRGELHLSVLIETMRREGFEIQVSRPEVILKTNEQGQKLEPYEYLVMDVPDQFTGAIIAELNRRKGELQLMDAHPSGMTRVEFVIPTRGIIGFRGFFISETRGEGVMSSRFLRFDVYKGDIPGRKNGALISMDSGESTAYALWKIQERGELVIGPNTSVYPGMIIGIHSRDNDLEVNPVKEKKLSNVRSSGADEAIRLVPPRKFSLEQNIEFLDDDELLEVTPTSLRLRKKFLDANMRKRNK

SEQ ID NO: 3643 - DNA, 1821 bp, Candidatus Protochlamydia amoebophila UWE25
  CDS (1)..(1821): transl_table=11
atgtattctcctgaaaaaatccgtaatattgcgatcattgcgcacattgaccacggtaaaacaacattgttagatgctttgcttaaacagtctaaaatttttcgcgataatcaacaagttcgcgaacgcgttatggactcatatgatcaagaacaagaacgtggaattactatttttgctaaacatacgtctgtttactttgatgatttcaaaattaatattattgacactccaggacacgctgatttctcaggtgaagtcgaacgtattttaggaatggtagattcagtcctactacttgtagatgcccaagagggaccgatgcctcaaacccgctttgttctttctaaatcattaaaaatgggcattaaacctattgtcgtcttaaataaaattgaccgacctcatgccaacccagatagagtattagacttaacatttgatctatttagtgaacttggtgcaacagatgaacaacttgatttccgctattgctatgcatcagggttatcaggatttgcgatgcaccacatgcacgatacacataaagatatgcgtcctttatttgaacttattacttacgccgtacaacagcctaaaggtagcctcgaaaatcctttcttaatgcatgtatctacaattacttatgatgattatgttggccgtcaagcttgtggaaaaattttagaagggactgtcaaaaaaggacagcagctcattcatatcgatgaaaatggggtggaaaccaaatgcacaattacccgtattgaagggcatttaggaattgaaaaagttgaaatggaagaagctggcgtaggcgacattgtcatcttatcaggtattccagaagtgacaattggtgacacaatttgcgatcctaaaaaaattgttcgacttcctcgtattaagctagatgaacctacagtttccgtcgatatgacagttaataatagcccatttgttggtcgtagtggtaaacacgttacaatgaataaaattcgcgatcgcttagaaaaagaaaaacgcgctaatatttccctcagaatcgaagatgagagcggagatcaagataaaattactgtatcaggtcgcggagagcttcacttagctgttttagtagaagctatgcgccgtgaacaatacgagtttagcatttctaaacctcgagttattattaaagaagtcaatggcgagaaatacgaaccgattgaacgggtacatattgaggttccacaagactactcaggaacagtgattgaagaactttcccgacgcaaaggagaacttcaactactagatacagatgaaaatggaattactgctatagactttttgattcctacaagagggctcatgggttatcgcaatgactttttaaccgcgactagaggtctcggaattttgacgtctgtttttgaaaacttttctccttggaaaggaactattcctggtcgtacaaggggtgtcttactctctaatggaccaggcaaaaccagcggttacgcttgctttaatttacaagatcgtggagtcatgtttgttgctcccggggatgaggtttacgaaggaatggtcgttggagagaatagtcgcgataatgacttagtggtcaacgtaactaaaggaaaacaattgacaaacgtcagagcttctggaagtgatgaaaacattatcttaatccctgctcgccggtttactcttgaacaggcaattgattatatccaagatgatgaattaatcgaagtcactcctgacagcatccgtatgcgaaaacgtcatcttttagagaatgaccgcaaacgagctggtggaaaagcctaa

SEQ ID NO: 3644 - protein, 606 aa, Candidatus Protochlamydia amoebophila UWE25
MYSPEKIRNIAIIAHIDHGKTTLLDALLKQSKIFRDNQQVRERVMDSYDQEQERGITIFAKHTSVYFDDFKINIIDTPGHADFSGEVERILGMVDSVLLLVDAQEGPMPQTRFVLSKSLKMGIKPIVVLNKIDRPHANPDRVLDLTFDLFSELGATDEQLDFRYCYASGLSGFAMHHMHDTHKDMRPLFELITYAVQQPKGSLENPFLMHVSTITYDDYVGRQACGKILEGTVKKGQQLIHIDENGVETKCTITRIEGHLGIEKVEMEEAGVGDIVILSGIPEVTIGDTICDPKKIVRLPRIKLDEPTVSVDMTVNNSPFVGRSGKHVTMNKIRDRLEKEKRANISLRIEDESGDQDKITVSGRGELHLAVLVEAMRREQYEFSISKPRVIIKEVNGEKYEPIERVHIEVPQDYSGTVIEELSRRKGELQLLDTDENGITAIDFLIPTRGLMGYRNDFLTATRGLGILTSVFENFSPWKGTIPGRTRGVLLSNGPGKTSGYACFNLQDRGVMFVAPGDEVYEGMVVGENSRDNDLVVNVTKGKQLTNVRASGSDENIILIPARRFTLEQAIDYIQDDELIEVTPDSIRMRKRHLLENDRKRAGGKA

SEQ ID NO: 3645 - DNA, 1839 bp, Listeria monocytogenes str. 4b F2365
  CDS (1)..(1839): transl_table=11
ttgaatttaagaaatgatattcgtaatgtagcaattattgcccacgttgaccatggtaaaacaactctagtagaccaattactacgccagtcaggcacattccgcgataatgaaacagttgcagaacgcgcaatggacaacaatgatttagaaagagaacgcggtattacaattttagcgaaaaatacagcgattaagtatgaagatacacgtgtaaacatcatggatacacctggacacgccgatttcggtggagaagtagaacgtatcatgaaaatggtagatggtgttcttttagtagtggacgcgtatgaaggtactatgcctcaaacacgttttgtactaaaaaaagcactagaacaaaacttaacaccgatcgttgtagtaaacaaaattgaccgtgattttgctcgcccagaagaagttgttgatgaagtattagaattattcatcgaattaggtgcgaacgacgatcaattagaattcccagttgtttatgcttctgcaatcaacggaacttcaagctatgattctgatccagcagaacaaaaagaaacaatgaaaccacttttagacacaattatcgaacatatcccggctccagttgataatagcgacgaaccattacaattccaagtatcattacttgattataatgactatgttggtcgtatcggtattggccgcgtattccgtggaacaatgcacgtgggacaaacagttgctttaattaaacttgatggcacagtaaaacaattccgtgtaacgaaaatgttcggtttcttcggactaaaacgtgacgaaattaaagaagcaaaagcgggtgacttagtagcacttgcgggaatggaagacattttcgttggtgaaacagtaacacctttcgatcaccaagaagcacttccacttttacgtattgatgagccaacattgcaaatgacttttgttacaaataacagtcctttcgcaggccgtgaaggtaaacacgtaacaagccgtaaaattgaagaacgcttacttgcagaacttcaaacggatgtatctttacgcgttgaaccaacagcttctccagacgcttgggtagtttctggtcgtggtgagcttcatttatccattctgatcgaaacaatgcgtcgcgaaggttatgaattacaagtttctaaaccagaagtaatcatccgtgaaattgatggcgtgaaatgtgaaccagtagaagatgttcaaattgatactccagaagaattcatgggttctgttattgaatctattagccaacgtaaaggcgaaatgaaaaacatgattaacgacggtaacggccaagttcgtttacaattcatggttccagctcgtggcttaatcggttatacaactgatttcctttcaatgactcgtggttatggtattatcaaccacacattcgatagctaccaaccaatccaaaaaggacgcgttggcggacgtagtcgtggtgttcttgtatccatggaaacaggtaaatctactacttacggaacaatgcaagtagaagaccgtggtactatttttatagaacctggtacggatatttacgaaggtatgatcgttggggaaaacaatcgtgaaggcgatatcgctgtaaacattgtgaaagcaaaacaaatgactaacattcgttctgctaacaaagaccaaacaaacgtaatcaaaaaacctcgtcatttatcactagaagaatcattagaattcctaaacgaagatgaatactgtgaagtaacaccagaatccatccgtttacgtaaaaaaatcctaaacaaaaacgaacgtgaaaaagcagcaaaacgttcaaaaactgctgaataa

SEQ ID NO: 3646 - protein, 612 aa, Listeria monocytogenes str. 4b F2365
MNLRNDIRNVAIIAHVDHGKTTLVDQLLRQSGTFRDNETVAERAMDNNDLERERGITILAKNTAIKYEDTRVNIMDTPGHADFGGEVERIMKMVDGVLLVVDAYEGTMPQTRFVLKKALEQNLTPIVVVNKIDRDFARPEEVVDEVLELFIELGANDDQLEFPVVYASAINGTSSYDSDPAEQKETMKPLLDTIIEHIPAPVDNSDEPLQFQVSLLDYNDYVGRIGIGRVFRGTMHVGQTVALIKLDGTVKQFRVTKMFGFFGLKRDEIKEAKAGDLVALAGMEDIFVGETVTPFDHQEALPLLRIDEPTLQMTFVTNNSPFAGREGKHVTSRKIEERLLAELQTDVSLRVEPTASPDAWVVSGRGELHLSILIETMRREGYELQVSKPEVIIREIDGVKCEPVEDVQIDTPEEFMGSVIESISQRKGEMKNMINDGNGQVRLQFMVPARGLIGYTTDFLSMTRGYGIINHTFDSYQPIQKGRVGGRSRGVLVSMETGKSTTYGTMQVEDRGTIFIEPGTDIYEGMIVGENNREGDIAVNIVKAKQMTNIRSANKDQTNVIKKPRHLSLEESLEFLNEDEYCEVTPESIRLRKKILNKNEREKAAKRSKTAE

SEQ ID NO: 3647 - DNA, 1827 bp, Bartonella quintana str. Toulouse
  CDS (1)..(1827): transl_table=11
atgcaattgcgtaacattgccattattgcccacgttgaccatgggaaaacaacgctcgtagacgaactcctcaagcaatcaggaaatttccgcgataatcagcgtaccagtgagcgtatgatggattcaaatgatattgaaaaagaacgcggaattacaatcctagcaaaagtgacatccgttgtttggaaagatacccgaattaatattgttgatacaccaggtcatgccgactttggtggagaagttgaacgtattttaaacatggtagacggagcaattgtacttgttgatgccgctgaaggtccaatgccacaaacaaaatttgtcgttggcaaagcattgaaagtaggattgcaccctattgttgctattaataaaattgaccgtgctgatgcacgcactgatgaagtcatcaatgaggtttttgaccttttcgcggctcttgatgcaaccgatgaacagcttgattttcccattctctatggatcaggacgcgatggatggatggctgaagctccagaaggacctaaagatcaaggactaagtcctttgtttgatcttgtaacgcgccatgtcccttctcctactgtagcagaagggccatttcgcatgatcggaactattcttgaagcagatccttttctaggacgaattattacaggccgcattcattcgggcactattaaaccaaatcaaagtgtcaaagttcttggacaagatggaaaacttttagaaactaggcgcatttcaaaaattctagcatttcgcgggctagaacggcaacccattgaagaaagtattgccggcgatattgtagcaattgcaggtctccaaaaaggtaccgttgctgatactttctgtgatcctgcggtcaatgaacctctcatcgctcaaccaattgatcctcctactgttactatgagctttctcgtcaatgatagcccctttgcgggaactgaaggtgataaagtaacaagccgtcttatacgtgaccgtttgttaaaagaagcagaaggtaatgtagcccttaaaattgaagaagcaaccgataaagattctttccatgtttcaggacgaggagaattacaacttgcagtcctcatcgaaaatatgcgccgtgaaggatttgagtttagtgtttcacgtcctcgtgtcgttatgcaaaaagatgaaaacggaataactcttgaaccaatcgaagaggttgtcatcgatgttgatgaggaatattctggaactgttgttcaaaaaatgtccggacgtaaaggcgaaatgattgaattacgtccctctggaggcaaccgtgtacgccttgtcttttacgcaccaactcgaggtcttatcggctatcaatccgagcttttaactgatacacgtggtacagcaattatgaatcgcctcttccacacctatgaaccttacaaaggagacattgctggtcgtgtcaatggtgttatgatttcaaatgatactggtgaatctgtcgcttatgctctttttaatcttgaagaccgtggacctatagtgatcgatgctggcgttaaagtttatcagggtatgattattggcatacactcacgtgataacgacttagaagtgaatgttttaaaaggaaaaaagctaaccaatatgcgtgcttctggaaaagatgaagccgtaaaactaacccctccacttaaaatgacgttagaacgcgctctatcgtggatacaagatgatgaacttgtagaagtaactcctaaaaatattcgtctccgcaaactctatcttgacccaaatgaacgcaaacgttttgaaaaaacacgcgcatcaatttcaaactaa

SEQ ID NO: 3648 - protein, 608 aa, Bartonella quintana str. Toulouse
MQLRNIAIIAHVDHGKTTLVDELLKQSGNFRDNQRTSERMMDSNDIEKERGITILAKVTSVVWKDTRINIVDTPGHADFGGEVERILNMVDGAIVLVDAAEGPMPQTKFVVGKALKVGLHPIVAINKIDRADARTDEVINEVFDLFAALDATDEQLDFPILYGSGRDGWMAEAPEGPKDQGLSPLFDLVTRHVPSPTVAEGPFRMIGTILEADPFLGRIITGRIHSGTIKPNQSVKVLGQDGKLLETRRISKILAFRGLERQPIEESIAGDIVAIAGLQKGTVADTFCDPAVNEPLIAQPIDPPTVTMSFLVNDSPFAGTEGDKVTSRLIRDRLLKEAEGNVALKIEEATDKDSFHVSGRGELQLAVLIENMRREGFEFSVSRPRVVMQKDENGITLEPIEEVVIDVDEEYSGTVVQKMSGRKGEMIELRPSGGNRVRLVFYAPTRGLIGYQSELLTDTRGTAIMNRLFHTYEPYKGDIAGRVNGVMISNDTGESVAYALFNLEDRGPIVIDAGVKVYQGMIIGIHSRDNDLEVNVLKGKKLTNMRASGKDEAVKLTPPLKMTLERALSWIQDDELVEVTPKNIRLRKLYLDPNERKRFEKTRASISN

SEQ ID NO: 3649 - DNA, 1827 bp, Bartonella henselae str. Houston-1
  CDS (1)..(1827): transl_table=11
atgcaattgcgtaacattgccattattgcccatgttgaccatgggaaaacaacgctcgtagatgaactcctcaagcaatcaggaaacttccgtgataatcagcgtaccagcgcacgtatgatggattcaaacgatattgaaaaagaacgtggaattacaattctagcaaaagtgacatccgttgtttggaaagatacccgaattaacattgtagatacaccaggtcatgctgattttggtggagaagttgaacgtatcctaaacatggtagatggagcaattgtgcttgttgatgccgctgaaggtccaatgccgcaaacaaaatttgtcgttggtaaagcactgaaagtaggattgcgccctattgttgctattaataaaattgaccgtgctgatgcgcgcgccgatgaagtcatcaatgaggtttttgatcttttcgctgctcttgatgcaaatgatgaacagcttgatttccctattctctatggatcagggcgtgatggatggatggctgaaacccccgaaggaccaaaagatcaaggtctgagtcctttgtttgatcttgtaactcgccatgttccttctcctagtatagcagaaggaccattccgcatgatcggaactattcttgaagcagatccatttttggggcgaattattacaggacgcattcattcgggttctataaagcccaatcaaaatgtcaaggttcttaggcaagatggaaaagttttagagactgggcgtatttcaaaaattttggcatttcgtgggctggaacgacaacccattgaagagagtattgctggtgatattgtagcaattgcaggtctccaaaaaggcaccgttgctgatactttctgtgatcctgcagtcaatgaacctctcactgctcaaccaattgatcctcctactgtaactatgagctttctcgtcaatgatagccctcttgccggaactgaaggagataaagtcacaagccgtgttatccgtgaccgtttgttaaaagaagcagagggtaatgtagcccttaaaattgaagaatcaaccgataaagattctttctatgtttcgggacgaggagaattgcaactcgcagtcctcatcgaaaatatgcggcgtgaaggatttgagcttagcgtttcacgtccacgcgttgttatgcaaaaagatgaaaatggaacaactcttgaaccaatcgaggaagttgtcatcgatgttgatgaggaatattctggaactgttgttcaaaaaatgtccgaacgtaaaggtgaaatgattgaactacgtccctctggaggtaatcgtgtacgcttggtcttttacgcaccaacgcgcggtctgatcggctaccaatccgagcttttaactgacacacgtggtacagcaattatgaatcgcctcttccatgcctatgaaccttataaaggagacattggtggtcgtgtcaatggtgttatgatttcaaatgataacggtgaatccgtcgcttatgctctttttaatcttgaagatcgtggacctatgataatcgatgctggcgttaaagtctatcaaggcatgattattggtatacactcacgcgataacgacctagaagtcaatgttttaaaagcaaaaaaactaaccaatatgcgcgcttctggaaaagatgaggctgtaaaattaactcctcctgttaaaatgacattagaacgtgctctatcgtggatacaagatgatgaacttgtagaagtaactcctaaaaatattcgtctacgcaaactctatctagatcccaatgaacgaaaacgttttgaaaaaacacgctcatcactttcaaactaa

SEQ ID NO: 3650 - protein, 608 aa, Bartonella henselae str. Houston-1
MQLRNIAIIAHVDHGKTTLVDELLKQSGNFRDNQRTSARMMDSNDIEKERGITILAKVTSVVWKDTRINIVDTPGHADFGGEVERILNMVDGAIVLVDAAEGPMPQTKFVVGKALKVGLRPIVAINKIDRADARADEVINEVFDLFAALDANDEQLDFPILYGSGRDGWMAETPEGPKDQGLSPLFDLVTRHVPSPSIAEGPFRMIGTILEADPFLGRIITGRIHSGSIKPNQNVKVLRQDGKVLETGRISKILAFRGLERQPIEESIAGDIVAIAGLQKGTVADTFCDPAVNEPLTAQPIDPPTVTMSFLVNDSPLAGTEGDKVTSRVIRDRLLKEAEGNVALKIEESTDKDSFYVSGRGELQLAVLIENMRREGFELSVSRPRVVMQKDENGTTLEPIEEVVIDVDEEYSGTVVQKMSERKGEMIELRPSGGNRVRLVFYAPTRGLIGYQSELLTDTRGTAIMNRLFHAYEPYKGDIGGRVNGVMISNDNGESVAYALFNLEDRGPMIIDAGVKVYQGMIIGIHSRDNDLEVNVLKAKKLTNMRASGKDEAVKLTPPVKMTLERALSWIQDDELVEVTPKNIRLRKLYLDPNERKRFEKTRSSLSN

SEQ ID NO: 3651 - DNA, 1845 bp, Bacillus thuringiensis serovar konkukian str. 97-27
  CDS (1)..(1845): transl_table=11
atgttgaaaaaacgacaagatttacgtaatatagcaattattgcccacgttgaccatggtaaaacaacacttgttgaccagttattacgtcaagcggggactttccgtgcgaacgaacacgttgaagaacgcgcaatggattcaaatgatctagaaagagaacgcggtattacaattttagcgaaaaatactgcgattcactatgaagataaaagaattaacattttagatacaccaggtcacgctgacttcggtggagaagtagaacgtattatgaaaatggttgatggtgtattacttgttgttgatgcatatgaaggttgtatgccacaaacacgatttgttttaaagaaagctcttgagcaaaacttaactccaatcgtagttgtaaataaaattgaccgtgacttcgctcgtcctgatgaagtagttgatgaagtaatcgacttattcatcgaacttggtgcaaacgaagatcaattagagttcccagttgtatttgcatcagcaatgaacggaacagcaagcttagattcaaacccagcaaatcaagaagagaatatgaaatcattatttgatacaatcattgaacatattcctgcaccaattgataacagcgaagagccacttcaattccaagtagcacttcttgattacaacgactatgttggacgtatcggggttggacgcgtattccgcggtacaatgaaggttggacaacaagttgctttaatgaaagtagacggaagtgtaaaacaattccgcgtaacgaaactatttggttatatgggattaaaacgtcaagaaatcgaagaagcaaaagctggagacttagtagctgtttctggtatggaagacattaacgtaggtgaaacagtatgtccagttgaacatcaagatgcgttaccattattacgtattgatgagccaacactacaaatgacattccttgtaaataacagcccatttgcaggccgtgaaggtaaatacattacatctcgtaaaattgaagagcgtcttcgttcacaattagaaacagatgtaagtttacgtgtagataatacagaatctcctgatgcgtggattgtatctgggcgtggggaactacatttatctatcttaatcgaaaacatgcgtcgtgaaggttatgaactacaagtatctaaaccagaagtaatcattaaagaagttgatggcgtaagatgtgagcctgtagagcgtgtgcaaattgatgtacctgaagaatacactggttctattatggaatctatgggtgcacgtaaaggtgaaatgttagatatggtgaataacggaaacggtcaagttcgccttactttcatggttccagcacgtggtttaattggttacacaacagaattcttaacattaactcgtggttacggtattttaaaccatacattcgattgctaccaaccagtacacgctggacaagttggtggacgtcgtcaaggtgttctagtttcacttgaaacaggaaaagcatcacaatacggtattatgcaagttgaagaccgtggtgtaatcttcgttgaaccaggtacagaagtatatgctggtatgattgttggagaacacactcgtgagaatgacttaacagttaacgttgtgaaaatgaaacaacaaactaacattcgttctgcgacaaaagatcaaacttcaacaatgaaaaaaccacgcttaatgactttagaagagtcattagagtacttaaacgatgacgagttctgtgaagtaactccagaatcaattcgtttacgtaaaaagattcttgataagagcgaacgtgaaagagctgctaagaaaaagaaatctgtagaagcgtaa

SEQ ID NO: 3652 - protein, 614 aa, Bacillus thuringiensis serovar konkukian str. 97-27
MLKKRQDLRNIAIIAHVDHGKTTLVDQLLRQAGTFRANEHVEERAMDSNDLERERGITILAKNTAIHYEDKRINILDTPGHADFGGEVERIMKMVDGVLLVVDAYEGCMPQTRFVLKKALEQNLTPIVVVNKIDRDFARPDEVVDEVIDLFIELGANEDQLEFPVVFASAMNGTASLDSNPANQEENMKSLFDTIIEHIPAPIDNSEEPLQFQVALLDYNDYVGRIGVGRVFRGTMKVGQQVALMKVDGSVKQFRVTKLFGYMGLKRQEIEEAKAGDLVAVSGMEDINVGETVCPVEHQDALPLLRIDEPTLQMTFLVNNSPFAGREGKYITSRKIEERLRSQLETDVSLRVDNTESPDAWIVSGRGELHLSILIENMRREGYELQVSKPEVIIKEVDGVRCEPVERVQIDVPEEYTGSIMESMGARKGEMLDMVNNGNGQVRLTFMVPARGLIGYTTEFLTLTRGYGILNHTFDCYQPVHAGQVGGRRQGVLVSLETGKASQYGIMQVEDRGVIFVEPGTEVYAGMIVGEHTRENDLTVNVVKMKQQTNIRSATKDQTSTMKKPRLMTLEESLEYLNDDEFCEVTPESIRLRKKILDKSERERAAKKKKSVEA

SEQ ID NO: 3653 - DNA, 1848 bp, Staphylococcus aureus subsp. aureus MRSA252
  CDS (1)..(1848): transl_table=11
atgactaataaaagagaagatgtccgcaatatagcaattattgctcacgttgaccatggtaaaacaactttagtagatgagttgttaaaacaatctggtatattcagagaaaatgaacatgtcgatgaacgtgcaatggactctaacgatatcgaaagagagcgtggaattacgattctagccaaaaatacggctgttgattataaaggtacacttattaatattttggatacaccaggacatgctgactttggtggagaagtagaacgtattatgaaaatggttgatggggttgtcttagtagtagatgcgtatgaaggtacaatgcctcaaacacgttttgtacttaaaaaagcgctagaacaaaacctaaaacctgttgttgttgttaataaaattgataaaccatcagcacgtccagagggtgttgtagatgaagttttagatttatttattgaattagaagcaaacgatgaacaattagaattccctgttgtttatgcttcagcagtaaatggtacagctagcttagatcctgaaaaacaagatgataatttacaatcattatatgaaacaattattgattatgtaccagctccaattgataacagtgatgagccattacaattccaagtagcattgttggactacaatgattatgttggtcgtattggtattggtcgtgtattcagaggtaaaatgcgtgtcggagataatgtatcactaattaaattagacggtacagtgaaaaacttccgtgtaactaaaatctttggttactttggattaaaacgtttagaaattgaagaagcacaagctggagatttaattgctgtttcaggtatggaagacattaatgttggtgaaactgtaacaccacatgaccatcaagaagcattgccagttctacgtattgatgagcctactcttgaaatgacatttaaagttaacaattcaccatttgctggccgtgaaggtgactttgtaacagcgcgtcaaattcaagaacgtttaaatcaacaattagaaacagatgtatctttgaaagtttctaacacagattctccagatacatgggtagttgctggtcgaggtgaattgcatttatcaatccttattgaaaatatgcgtcgtgaaggttatgaattacaagtttcaaaaccacaagtaattattaaagaaattgatggtgtaatgtgtgaaccatttgaacgtgtgcaatgtgaagtgccacaagaaaatgcaggtgcggttattgaatcattaggtgcacgtaaaggtgaaatggttgatatgactacaactgataatggacttacacgtttaatctttaatgtaccggctcgtggtatgattggttatacgactgaatttatgtcaatgacaagaggttacggtattattaaccatacatttgaagaatttagaccacgtattaaagcgcaaattggcggtcgtcgtaatggtgcgttaatttcaatggatcaaggttctgcaagtacttatgccattttaggacttgaagatagaggtgtaaacttcatggaacctggtactgaagtttatgaaggtatgattgttggtgaacataatcgtgaaaatgatttaactgttaatatcactaaaacaaaacatcaaactaacgtacgttctgcaacgaaagaccaaacacaaacaatgaatagaccgcgtatactaacattggaagaagcgttacaattcattaatgatgatgaacttgttgaggttactccagaaagcatacgtttaagaaagaaaattttaaacaaaaatgttcgtgaaaaagaagcaaagcgtatcaaacaaatgatgcaagaaaatgaataa

SEQ ID NO: 3654 - protein, 615 aa, Staphylococcus aureus subsp. aureus MRSA252
MTNKREDVRNIAIIAHVDHGKTTLVDELLKQSGIFRENEHVDERAMDSNDIERERGITILAKNTAVDYKGTLINILDTPGHADFGGEVERIMKMVDGVVLVVDAYEGTMPQTRFVLKKALEQNLKPVVVVNKIDKPSARPEGVVDEVLDLFIELEANDEQLEFPVVYASAVNGTASLDPEKQDDNLQSLYETIIDYVPAPIDNSDEPLQFQVALLDYNDYVGRIGIGRVFRGKMRVGDNVSLIKLDGTVKNFRVTKIFGYFGLKRLEIEEAQAGDLIAVSGMEDINVGETVTPHDHQEALPVLRIDEPTLEMTFKVNNSPFAGREGDFVTARQIQERLNQQLETDVSLKVSNTDSPDTWVVAGRGELHLSILIENMRREGYELQVSKPQVIIKEIDGVMCEPFERVQCEVPQENAGAVIESLGARKGEMVDMTTTDNGLTRLIFNVPARGMIGYTTEFMSMTRGYGIINHTFEEFRPRIKAQIGGRRNGALISMDQGSASTYAILGLEDRGVNFMEPGTEVYEGMIVGEHNRENDLTVNITKTKHQTNVRSATKDQTQTMNRPRILTLEEALQFINDDELVEVTPESIRLRKKILNKNVREKEAKRIKQMMQENE

SEQ ID NO: 3655 - DNA, 1833 bp, Acinetobacter sp. ADP1
  CDS (1)..(1833): transl_table=11
atgtcagatatcaaaaatctccgcaatattgcaattattgcacacgtcgaccacgggaaaactacccttgtcgataaacttcttcaacaatcaggtgcacttggcgatcgcgcgggtgagattgagcgtgtcatggactcgaatgcgcttgaaagtgagcgtggtattaccattcttgcaaaaaatacgtcaatcaagtggttagataaacgtaccgacactgaataccgtatcaacatcgtggacaccccgggacacgccgacttcggtggcgaagttgaacgtgtgatgtcgatggttgactgtgtattgttgctggttgactctcaagaaggtccaatgccgcaaactcgctttgtaactcaaaaagcgtttgcacgtggtttgaaaccaatcgtgattatcaacaaagttgacaaaccaagtgcgcgtccagactgggtcatcgatcaagtatttgacttgtttgataatcttggtgcgactgatgaacagttagactttccaatcgtttacgcttcaggcttacgtggtgttgcaggtccttcaccagaagaattggctgaagacatgaccccgttgtttgaaacgattgtagatatcgttgaaccaccagcagttgatgcagatggtccattccagatgcaaatttcttcacttgactataacagcttcgttggtgttatcggtgttggtcgtattcagcgtggttcagtgaaattaaatacacctgtgactgtgattgacaaagaaggcaatacacgtaacggccgtattttgaaaatcatgggctatcatggtcttgagcgtattgatgttgaatctgcatctgcgggtgacatcgtgtgtatcactggtattgatgcactcaacatttcagacaccatttgtgatcctaaaaatgtagaagcattaccgccattgtctgttgatgaaccgactgtatcgatgaccttccaagtgaacaactcaccgtttgctggtaaagaaggtaagttcgtgacttcacgtaatattcgtgaacgtcttgatcgtgaattgattcacaacgtagcacttcgcgtagaagatactgacagtccagaccgcttcaaagtatctggccgtggtgagcttcacctttcagttttaattgaaaacatgcgtcgtgaaggtttcgagttgggtgtatcgcgtccacaagtgatcatcaaagaaattgatggtgaaaagcaagaaccttacgaaaacgtaacgtttgacgtagaagaacagcatcaaggcgctgtgatggaacaaatgggccatcgtaaaggcgaaatgaccaatatggaagtggatggtaaaggccgtatccgtattgaagcaactgttccatcgcgtggtttgattggtttccgttctgaattcttgaccatgacgtctggtacaggaatcatgacgtcaagcttctcgcattatggtcctgtgaaacaaggtactgttgcgaagcgtcaaaacggtgtgttgatttcaatggttcaagggacttgcttgggctatgcattgtttagcttgcaagaccgtggtcgtttgtttgctaagccacagcttgaagtttatgaaggtatgatcgtgggaattaactcacgttcagacgatatggtggttaacccaaccaaagcgaaacagttaaccaacgtacgtgcgtctggtacggacgatgcgttgacgcttacgcctgcaattgaatacacgcttgaacaagcgcttgaattcattgaagacgatgagttggttgaagtaacgccaaaatcgatccgtattcgtaagcgttatttgactgaaaacgaacgtaagcgtaatcgcgcataa

SEQ ID NO: 3656 - protein, 610 aa, Acinetobacter sp. ADP1
MSDIKNLRNIAIIAHVDHGKTTLVDKLLQQSGALGDRAGEIERVMDSNALESERGITILAKNTSIKWLDKRTDTEYRINIVDTPGHADFGGEVERVMSMVDCVLLLVDSQEGPMPQTRFVTQKAFARGLKPIVIINKVDKPSARPDWVIDQVFDLFDNLGATDEQLDFPIVYASGLRGVAGPSPEELAEDMTPLFETIVDIVEPPAVDADGPFQMQISSLDYNSFVGVIGVGRIQRGSVKLNTPVTVIDKEGNTRNGRILKIMGYHGLERIDVESASAGDIVCITGIDALNISDTICDPKNVEALPPLSVDEPTVSMTFQVNNSPFAGKEGKFVTSRNIRERLDRELIHNVALRVEDTDSPDRFKVSGRGELHLSVLIENMRREGFELGVSRPQVIIKEIDGEKQEPYENVTFDVEEQHQGAVMEQMGHRKGEMTNMEVDGKGRIRIEATVPSRGLIGFRSEFLTMTSGTGIMTSSFSHYGPVKQGTVAKRQNGVLISMVQGTCLGYALFSLQDRGRLFAKPQLEVYEGMIVGINSRSDDMVVNPTKAKQLTNVRASGTDDALTLTPAIEYTLEQALEFIEDDELVEVTPKSIRIRKRYLTENERKRNRA

SEQ ID NO: 3657 - DNA, 1824 bp, Erwinia carotovora subsp. atroseptica SCRI1043
  CDS (1)..(1824): transl_table=11
gtgatcgaaaatttgcgtaacatcgccattattgcgcacgttgaccatgggaaaaccaccctggttgacaagctgttgcaacaatccggaacgttcggtgaacgtgtcgaagcaactgagcgtgtgatggactccaacgatttggagaaagagcgtggaattactatcctcgcaaaaaataccgccattaattggaaagactaccgtattaacatcgtagataccccgggacacgccgacttcggcggcgaggttgagcgtgttatgtcgatggttgactcggtactgctggttgttgatgcgatggatggccctatgccgcaaactcgtttcgtgaccaaaaaagcgtttgccaacggtctgaaacctattgtggttatcaacaaagttgaccgtcctggtgcgcgtcctgactgggttgtcgatcaggtattcgacctgttcgtgaacctggatgcgactgacgagcaactggatttcccgatcatttatgcttctgcgctgaatggtatcgcgggtctcgaccataacgacatggcggaagatatgactccgctgtatcaagctattgtcgatcacgtttctccgcctctggttgagatggatgcgccgttccagatgcagatctctcagctggactacaacaactatgttggcgttatcggtatcggccgtatcaagcgcggtaaagttaagcctaaccaacaagttactattgttgatagcgaaggcaaaacccgtaacggtaaagtcggtaaagttctgactcacctgggtctggagcgtatcgatgctaccgaagcggaagcaggcgatatcatcgcgattaccggtttgggcgagctgaacatttccgacactatctgcgatccgcagaatgtcgaagcgctgccagcactgagcgtggatgaacctaccgttaccatgttcttcaacgtcaatacctcaccattctgtggtaaagaaggtaagtatgtgacgtcgcgccagattctggagcgtctgaacaaagagctggtgcacaacgttgccctgcgtgttgacgaaaccgaagacgctgatgcgttccgtgtttctggccgtggtgaattgcacttgtcagttctgatcgaaaacatgcgtcgtgaaggctttgaactggccgtatcacgtccgaaggttattaaccgtgttattgacggtcgtaaccaagagccgtttgaaaacgttacgctggacatcgaagaacagcaccagggttcagtcatgcaagccatgggtgagcgtaaaggtgatgtgaaagacatgatcccagatggcaagggtcgtatccgtctggattacctgatccctgctcgtggtctgatcggtttccgtaccgaattcatgaccatgacgtctggtactggtctgctgtactccactttcagtcactacgatgacgtgcgtcagggtgaaatcggtcaacgtcagaacggcgtgctggtctctaacggtcagggtaaagcagtcgcgtttgcgctgttcagcctgcaagatcgcggtaagctgttccttggacacggtgcagaagtgtatgaaggccagatcatcggtattcactcacgttctaacgatctgaccgtaaactgtctgaccggtaagaaactgaccaacatgcgtgcatcaggtactgatgaagcaaccacgctggttccggctatcaaaatgtctctggaacaagcgctagagttcattgatgatgacgaattggttgaagttacgccgcagtctgttcgtattcgtaagcgtcacctgaccgaaaacgatcgtaagcgcgcgagccgcggcagcaaagacgtctaa

SEQ ID NO: 3658 - protein, 607 aa, Erwinia carotovora subsp. atroseptica SCRI1043
MIENLRNIAIIAHVDHGKTTLVDKLLQQSGTFGERVEATERVMDSNDLEKERGITILAKNTAINWKDYRINIVDTPGHADFGGEVERVMSMVDSVLLVVDAMDGPMPQTRFVTKKAFANGLKPIVVINKVDRPGARPDWVVDQVFDLFVNLDATDEQLDFPIIYASALNGIAGLDHNDMAEDMTPLYQAIVDHVSPPLVEMDAPFQMQISQLDYNNYVGVIGIGRIKRGKVKPNQQVTIVDSEGKTRNGKVGKVLTHLGLERIDATEAEAGDIIAITGLGELNISDTICDPQNVEALPALSVDEPTVTMFFNVNTSPFCGKEGKYVTSRQILERLNKELVHNVALRVDETEDADAFRVSGRGELHLSVLIENMRREGFELAVSRPKVINRVIDGRNQEPFENVTLDIEEQHQGSVMQAMGERKGDVKDMIPDGKGRIRLDYLIPARGLIGFRTEFMTMTSGTGLLYSTFSHYDDVRQGEIGQRQNGVLVSNGQGKAVAFALFSLQDRGKLFLGHGAEVYEGQIIGIHSRSNDLTVNCLTGKKLTNMRASGTDEATTLVPAIKMSLEQALEFIDDDELVEVTPQSVRIRKRHLTENDRKRASRGSKDV

SEQ ID NO: 3659 - DNA, 1839 bp, Mesoplasma florum L1
  CDS (1)..(1839): transl_table=4
atgtcaaatcaaaaaattattaacattgcggttattgctcacgttgatgcaggtaagtcaacattggttgatgcacttttaaaacaaggtggagcttttagagataaccaagaagttgtagaacaaatcatggattcaaacgatcaagaaagagaacgtgggattaccatctattcaaaaaactgtgctattgagtacaaaggaacaaaaattaacatcgtggatactccaggtcacgccgacttctcaagtgaagttgaacgtattatgaaaactgttgatactgttattttattagttgattcaagtgaagggccaatgcctcaaacacgttttgttttatctaaagcattagaattaggattgaacccaatcttaatgattaataaaattgataaaaaagatcaaagagctgaagaagttgttgaagaagtattagagttatttatggaattagatgcaactgatgaacaattagaattcaaaacattatatggtattgctcgtgaagggattgctcaattaaacttaagcgatcaaggagtcgatctttcaccaatgtttgatactattattgagcaagttggaacatacccaattgaattagctgaaaaaccattaaaaatgcaagttagttcattagcttatgattcatttattggaagattaggaattggaagaatctttgaaggtaaaattgctgaaggtcaaacagttagtgttgttaaaaacaatggtgaagttaaacaagccaaaatttctaaattaacagtttaccaaggattaaacaaagttgctgttaaagaagcattcgctggagatattattacattcgctggtattgagcatatttcaattggagatactattaatgaattaaataatattaatccaatggaaccaattacaattgaagaacctacaatgagtatgaacttcttagttaacacttctccttttgctggtaaagttggtaaatttgttacttcaagaaacattaaagaacgtttagaaaaagaattagaagtaaacgttggtttaaaggttgaaccattagataacccaacaattgaaggattcaaagttttaggacgtggagaacttcacttatctgttttaattgaacaaatgagaagagaaggttttgaattagctatttctaaacctgaggtaatttttagaaaaggtgataatggaacattattagaacctatggaaaaagttatcttaaacattcctactgaatattcaggaactgttattaataaattaaaccaacgtaaaggtttaatgacagatatggattctgatggagttagagataaaattgtttacaacatcccattaagagctttaattggatttagaagtgaatttactaatgatactcatggtgaaggaatcatggttagaagttcaaatggatttgaaccatacaaaggtgaaattgaatcacgtaaaaacggagttcttatttcaatggcttcaggtaaaacattaccttacgctttaaataacttagaagaacgtggaattttatttgtaggccctcaagttgaagtttatgatggaatgatcgttggacaacactcaagagataatgacttagaagttaacccaacaactggtaaaaaattaactaacactcgtgctagtggtagtgatgactcagttaaattaactccacctaaattaatgactctagaagaagcattagaatacatcgaatgagatgaattagttgaagttacaccagatgatattcgtttaagaaaaagatgattatcaaatactgaaagacgtcaacacagaaacgataataaaaaagtttttgattaa

SEQ ID NO: 3660 - protein, 612 aa, Mesoplasma florum L1
MSNQKIINIAVIAHVDAGKSTLVDALLKQGGAFRDNQEVVEQIMDSNDQERERGITIYSKNCAIEYKGTKINIVDTPGHADFSSEVERIMKTVDTVILLVDSSEGPMPQTRFVLSKALELGLNPILMINKIDKKDQRAEEVVEEVLELFMELDATDEQLEFKTLYGIAREGIAQLNLSDQGVDLSPMFDTIIEQVGTYPIELAEKPLKMQVSSLAYDSFIGRLGIGRIFEGKIAEGQTVSVVKNNGEVKQAKISKLTVYQGLNKVAVKEAFAGDIITFAGIEHISIGDTINELNNINPMEPITIEEPTMSMNFLVNTSPFAGKVGKFVTSRNIKERLEKELEVNVGLKVEPLDNPTIEGFKVLGRGELHLSVLIEQMRREGFELAISKPEVIFRKGDNGTLLEPMEKVILNIPTEYSGTVINKLNQRKGLMTDMDSDGVRDKIVYNIPLRALIGFRSEFTNDTHGEGIMVRSSNGFEPYKGEIESRKNGVLISMASGKTLPYALNNLEERGILFVGPQVEVYDGMIVGQHSRDNDLEVNPTTGKKLTNTRASGSDDSVKLTPPKLMTLEEALEYIEWDELVEVTPDDIRLRKRWLSNTERRQHRNDNKKVFD

SEQ ID NO: 3661 - DNA, 1863 bp, Propionibacterium acnes KPA171202
  CDS (1)..(1863): transl_table=11
atgcccgtacgcaaggatctgcgcaacattgccatcgtggcccacgttgaccacggaaagaccactttggtcgacgctatgttgtggcagtcgggagccttccgcgagggtgccgaagtcgagaaacgcgttatggactcgatggatcttgagcgcgagaaggggatcacgatcctcgccaagaacaccgccgtcaagcacgtcatgagtgacggcgaggaaatcaccctcaacattatcgacacccccggccacgccgactttggcggcgaggtggaacgcggcctagagatggtcgatggcgtcattctgctcgtcgacgcctccgaggggccactgccgcagacccgcttcgtgctgcgcaaagcactagccaagaagctgcctctcatcttggtgctcaacaaggttgaccgttccgacgcccgtatcgacgaggttgtcgaagaaacctacgacctcttcatggacctttccgacgacgacgatgcctccctgcttgacgtcccggtggtctatgcctccgcgaaagccggacgcgcatccctcaacaaacccggggatggcgagttacccgattcccccgacctacagccgctgttcgattgcatcctcgagaacatcccagcccccacctacgacgagggcggggtgctacaggctcacgtcaccaacctcgacgcctccccctatcttggccgtctagccctgtgccgtgtcgtctccggtgaactcaccaagggacagacggtggcctggtgcaagcgcgacggctcggtccaaaacgtcaagctctccgaactactcatgaccgaggccctggaacgcgtccccgctgagaaagctggccccggtgacatcgtcgctatcgctggtatccccgagatcaccatcggcgagaccctctcagatcccgagaacccggtccctttgccgctcatccacgtcgatgaaccgtcgatgtcgatgacgatcggtatcaatacctcaccgctgtcaggtcggtccggtgacaagctcaccgctcgtcttctcaaggctcgtctcgatcaagaactcatcggaaacgtgtcgatcaaagtggctgacaccgaccgccccgacatgtgggaagtgcaaggccgcggcgaattgcagctggccgtcctcgtcgagcagatgcgccgcgagggattcgaactcaccgttggcaaaccgcaggtcgtcaccaaaaccattgacggcaagctgcacgaacctttcgagcgcgtcaccattgatgccccagaagagttcatgggccccgtcacccagatgatgggcctacgcaagggccagatgatgcacatggtcaaccacggctccggctgggtgcgcatggagttcgtcgtcccagcccgtggccttatcggcttccgcaccgagttcctcacccagacccgcggtcagggcatcatgaaccagatcttcgagaacttccagccctgggtaggcgaattgcgcacccgtcagagtggctcgatggtcgccgaccgtcagggggtcgtcacctcctacgccttgttcaacttgcaggagcgcggcacgatgttcgtctcgccgggcgaggacacctacgagggcatggtcgtcggcgaaaactcgcgccccgacgacatggacgtcaaccccaccaaagaaaagcacctcaccaacgtgcgctcttccaccggcgacgagttggagcgcctgatcccggcgacgaaactctcgatggagcagcagcttgagttctgccgcgaagacgagtgcctggaggtcaccccagacgttgtgcgcatccgcaagaccgaactcaatgcccacgagcgggccaaagcccgcacccgcgcaaaacatagctga

SEQ ID NO: 3662 - protein, 620 aa, Propionibacterium acnes KPA171202
MPVRKDLRNIAIVAHVDHGKTTLVDAMLWQSGAFREGAEVEKRVMDSMDLEREKGITILAKNTAVKHVMSDGEEITLNIIDTPGHADFGGEVERGLEMVDGVILLVDASEGPLPQTRFVLRKALAKKLPLILVLNKVDRSDARIDEVVEETYDLFMDLSDDDDASLLDVPVVYASAKAGRASLNKPGDGELPDSPDLQPLFDCILENIPAPTYDEGGVLQAHVTNLDASPYLGRLALCRVVSGELTKGQTVAWCKRDGSVQNVKLSELLMTEALERVPAEKAGPGDIVAIAGIPEITIGETLSDPENPVPLPLIHVDEPSMSMTIGINTSPLSGRSGDKLTARLLKARLDQELIGNVSIKVADTDRPDMWEVQGRGELQLAVLVEQMRREGFELTVGKPQVVTKTIDGKLHEPFERVTIDAPEEFMGPVTQMMGLRKGQMMHMVNHGSGWVRMEFVVPARGLIGFRTEFLTQTRGQGIMNQIFENFQPWVGELRTRQSGSMVADRQGVVTSYALFNLQERGTMFVSPGEDTYEGMVVGENSRPDDMDVNPTKEKHLTNVRSSTGDELERLIPATKLSMEQQLEFCREDECLEVTPDVVRIRKTELNAHERAKARTRAKHS

SEQ ID NO: 3663 - DNA, 1917 bp, Leifsonia xyli subsp. xyli str. CTCB07
  CDS (1)..(1917): transl_table=11
atgtctgagaacgccgtcgcccaccgcgacgatctgcgcaacgttgcgatcgtcgcccacgtcgaccacggcaagaccacgctggtcgacgccatgctccggcagacgaactccttcggcgaccacgagcacgtggaagagcgcgcgatggactcgaacgagctcgagcgcgagaaggggatcaccatcctcgccaagaacacggcgatctcctacaaaggcaagcacgccccgaacgggccgatcacgatcaacgtgatcgacacccccggccacgccgacttcggcggcgaggtcgagcgcggcctctcgatggtcgacggcgtcgtgctgctggtggactcctccgagggtccgctgccgcagacccgcttcgtgctgcgcaaagcgctggaggcgaagctgccggtcatcctcgcggtgaacaagaccgaccgcagcgacgcccgcatcgaggaggtcgtgggggaggcgcaggatctactgctcgggctcgccagcgaccttgccgatgatgtgcccgacctcgacctggacgctgtgctcgacgtccccgtcgtctacgcgtccggccgcgccggggccgccagccgaaaccggcccgcgaacggcgagctgcccgacaacgacgatctggagccgctgttcgaggcgatcctggagcacatcccggctcccagctacgatcccggcgcgcctctgcaggcgcatgtcaccaacctcgacgcctcgccgttccttggccgcctcgcgctgctgcgcgtacacaacggcacgctgaagaagggccagacggtcgcctgggtgcgccacgacggcgacatccacaacgtccgcgtcaccgagctgctgatgaccaaggcgctcgagcgctaccccgccgagtccgccggccccggcgatatcgtggcggtcgcgggtttcgccgacatcatgatcggcgacacgctggccgacccggaggacgtgcgtccgctcccggccatccacgtggacgaccccgccatctccatgaccatcggcaccaacacctccccgctggtcggcaagacgaagggccacaagctcaccgcccgcatggtcaaggaccgcctcgaccgcgagctcatcggcaatgtgtcgctgcgtgtgttcgacatcggccgcccggacgcctgggaggtgcagggacgcggcgagctggcgctggccatcctggtcgagcagatgcgccgcgagggcttcgagctgaccgtgggcaagccgcaggtggtcacccgcaccgtagacggcaagacgcacgagccgtatgagcacctgacgatcgacatccccgaggagcatctcggcgcgatcacgcagctgctcgccgcgcgcaagggccgcatggaaaacatgacgaaccacggcaccggctgggtgcgcatggagttcatcgtcccctcgcgtggcctgatcggcttccgcaccgagttcatgaccacgactcgcggcaccggcatcgccaacgccatatcgcacggctacgaccagtgggcggggcccatcgtgacccgcagcaacggctccattgtcgccgaccgccaaggtgtcgtcacaccgtacgcgatcatccagttgcaggagcgcatgactttcttcgtgaaccccacggaggaggtctacgagggcatggtcatcggcgagaactcacgcgccgacgatatggatgtcaacatcaccaaggagaagaagctcaccaacatgcgctcctcgacggccgacacgttcgagtcgatgacgccgtcgcgccagctcaccctggaggagtcgctcgaattcgcccgcgaggacgagtgcgtcgaggtgaccccggaggccgtgcgcatccgcaaggtcgagctcgacgccaccgcgcgcggccgcgctgcggcgcgcctgaagcggcaggattcctga

SEQ ID NO: 3664 - protein, 638 aa, Leifsonia xyli subsp. xyli str. CTCB07
MSENAVAHRDDLRNVAIVAHVDHGKTTLVDAMLRQTNSFGDHEHVEERAMDSNELEREKGITILAKNTAISYKGKHAPNGPITINVIDTPGHADFGGEVERGLSMVDGVVLLVDSSEGPLPQTRFVLRKALEAKLPVILAVNKTDRSDARIEEVVGEAQDLLLGLASDLADDVPDLDLDAVLDVPVVYASGRAGAASRNRPANGELPDNDDLEPLFEAILEHIPAPSYDPGAPLQAHVTNLDASPFLGRLALLRVHNGTLKKGQTVAWVRHDGDIHNVRVTELLMTKALERYPAESAGPGDIVAVAGFADIMIGDTLADPEDVRPLPAIHVDDPAISMTIGTNTSPLVGKTKGHKLTARMVKDRLDRELIGNVSLRVFDIGRPDAWEVQGRGELALAILVEQMRREGFELTVGKPQVVTRTVDGKTHEPYEHLTIDIPEEHLGAITQLLAARKGRMENMTNHGTGWVRMEFIVPSRGLIGFRTEFMTTTRGTGIANAISHGYDQWAGPIVTRSNGSIVADRQGVVTPYAIIQLQERMTFFVNPTEEVYEGMVIGENSRADDMDVNITKEKKLTNMRSSTADTFESMTPSRQLTLEESLEFAREDECVEVTPEAVRIRKVELDATARGRAAARLKRQDS

SEQ ID NO: 3665 - DNA, 1803 bp, Desulfotalea psychrophila LSv54
  CDS (1)..(1803): transl_table=11
atggaacaaagtaaaattcgtaacgttgctattatcgcccacgttgatcatggaaaaacaaccttggttgatgagctttttaaacagtctggtatgttcagagataaccaggcagtgtccgagcgtcttatggactccggcgatattgaaaaagagcgcggaattaccattaccgctaaaaacggttcataccattacgacgatcatatgattaacatcattgataccccaggccatgccgatttcggtggccaggtagagcgtgttttgcgtatggcggatggagccctgctcctcgttgatgctcaggaaggaccaatgccacagacctactttgttcttaagaaggcccttgagaaccatcttcctgtaatcgtggtaattaacaaaattgacaagccagcagctcgttgtgactgggttgtagatcaggttttcgacctctttgttaagttgaatgcccctgatcatatccttgactttcctattgtctacgcctcggcgaaagagggctatgcccttcttaatcctgatgatgagatcgttgatggtggtagtatggagtgtatctccaggatgatcatcgaacagactccagcaccagtgggttctgttgatgctcctctgcagatgcaggttggtaccattgattattctccataccttggtcgtcttggcattggtaaagttgtgaatggcaccatgaccatcaatcaacccattgctgtggcccgtcgtgatggatctctcacccctgttcgtatcaccaaaatttaccgttttgagtgtgatggcaaggtgtcaatagagagtgccagcgttggtgaaattgttgctgttgccggtatggatgatgtaaacgttggtgtaacatttaccgaccttgcgaatccaacccctctgccactcattgagatcgatccacctaccatctccatgcatttcattccaaacgattcaccttttgctggtcgtgaaggaaagtatgttacctcacgtcatattggtgatcgtcttgaaaaagagattctctccgatgttgcccttcgctatgagcctctcaccgatgctgtaggttttaaggtatctggtcgtggtgaattgcatctttccattcttattgagaatatgcgtcgtgaaggatttgagtttcaggtaacccgtcctcaagttatcatgcgcgaagatgataatggtcaggtacttgagccatacgaaacccttaccgttgacgttgatgaactctatcagggaccggttattgagaagcttggtaaattgaaaggtcagatggaagagatgacccttgcaaatggcatggttcgtttgatttacaagattccaacccgtggtcttttgggttataaatcacaatttatgaccgataccaagggaatgggcatgatggcttatgtcttctccgagtacggtccatatgctggtgatattattaaccgtgtgaacggcgttctgattgcaaaagagacctgtgtagccgtagccttcgcactcttcaaccttcaggatcgtggttaccttattgttaagccgggcgatcccctttatgcgggacagattgttggtgagcatgctcgtgcagctgatttggttgttaacccagctaagggcaagaaacttaccaatatgcgtgcctctggttccgatgaagccgttattcttgttccagcaaaggcaatgaccttggaagattgtattgcctatatcaacgatgatgagctcgttgaggtaactcctcagtccattcgtctgcgtaagaagccaggcgtacgaattcgtagttag

SEQ ID NO: 3666 - protein, 600 aa, Desulfotalea psychrophila LSv54
MEQSKIRNVAIIAHVDHGKTTLVDELFKQSGMFRDNQAVSERLMDSGDIEKERGITITAKNGSYHYDDHMINIIDTPGHADFGGQVERVLRMADGALLLVDAQEGPMPQTYFVLKKALENHLPVIVVINKIDKPAARCDWVVDQVFDLFVKLNAPDHILDFPIVYASAKEGYALLNPDDEIVDGGSMECISRMIIEQTPAPVGSVDAPLQMQVGTIDYSPYLGRLGIGKVVNGTMTINQPIAVARRDGSLTPVRITKIYRFECDGKVSIESASVGEIVAVAGMDDVNVGVTFTDLANPTPLPLIEIDPPTISMHFIPNDSPFAGREGKYVTSRHIGDRLEKEILSDVALRYEPLTDAVGFKVSGRGELHLSILIENMRREGFEFQVTRPQVIMREDDNGQVLEPYETLTVDVDELYQGPVIEKLGKLKGQMEEMTLANGMVRLIYKIPTRGLLGYKSQFMTDTKGMGMMAYVFSEYGPYAGDIINRVNGVLIAKETCVAVAFALFNLQDRGYLIVKPGDPLYAGQIVGEHARAADLVVNPAKGKKLTNMRASGSDEAVILVPAKAMTLEDCIAYINDDELVEVTPQSIRLRKKPGVRIRS

SEQ ID NO: 3667 - DNA, 1818 bp, Rickettsia typhi str. Wilmington
  CDS (1)..(1818): transl_table=11
atgacatctattcgtaatatagcaattattgcacacgttgatcacggaaaaactacacttgtagataatatgctgaaacaaagcggaacatttagagctaatcagacagttgccgagcgtgccatggattctaacgagcttgaacgcgaacgtggaattacaatacttgctaaatgtacagctcttatgtggaatgagattcgtatcaatatagtagatacaccaggacacgctgattttggtggtgaagtagaacgcatacttagcatggttgatggtgttgtgttacttgttgacgcatcagaaggaccaatgccacaaacaaaattcgtactatctaaagctttaaatcttggcttaaaacctattgtagttattaataaaatcgatagagatgaccaaagaattaaggaagttatagatgaagtgtttgaactatttgtggcacttgaagcaaataatgatcaacttgacttccctatagtctatgcatcaggtagagcaggtacagcatctttaaactttgataataaaataaatcctttagataatttatctccactttttaacctaatagtaacacacgtacctacgccttcagctgataataaagcaccgttttctatgcttgtgacaacacgagaatataatcctttcttcggtagggttttaacagggcgtatacaaagcggaactgttaaaatcaaccaaaacgtaaaagtattaaatcatgagaataaagtacttgaaactggtcgtattactaaaatattagcctttagaggtttagagcgaattgctatagaccatgctacagcaggcgatattattgccctagcaggcgttgaaaatgctaacgttgctgatactatctgtgcacctgaagtaaccgaggctataccttctctacctatagatccaccaactttatccatgacttttagtattaatgactcaccacttgcaggaagtgaaggtactaaaattacatcaagcttaatcggagctagattaatgcgtgagcttgagagtaacgtcgctcttaaagtaacagaaaccgctaataaaaatgcttttcaagtcgcaggacgaggtgagttacagcttggtatattaatcgaaactatgcgtcgtgaagggtttgagttgtctatcagtagaccagaagtattataccatactgataagacaggtaataagcaagaacctattgaagaaatccaagttgatgttgatgacgattatattggagtagttgtaaaatctttagcacttagaaaagctgaaatgactaatatgagaccatcaggtggcggcaaaagccgtattacattcattggcccatctagaggattaattggctattacaatcaatttttaacagaaacacgaggaacagggattataaatcgtattttctacggatatactgattataaaggtcctatcgagggaagacgtaaaggcgtacttatctctaactgtgatggagcagcagttgcatatgctctatggaatctagaagaaagggggaaaatgtttataaaccccggcgataaagtatatagaggtatgattattggtgaacataatcgcgataatgatttagatgtaaacccactaaaagcaaaacaactaagcaatgttagagcagttggtaaagacgaagcaataagacttactccacctatgcttttaacacttgagcaggccataagctatatacaggatgacgaactagttgaagtaacgccaaaatctattcgtttacgtaaagttctccttaacccaaacgatcgtaaaagagctgcacaatga

SEQ ID NO: 3668 - protein, 605 aa, Rickettsia typhi str. Wilmington
MTSIRNIAIIAHVDHGKTTLVDNMLKQSGTFRANQTVAERAMDSNELERERGITILAKCTALMWNEIRINIVDTPGHADFGGEVERILSMVDGVVLLVDASEGPMPQTKFVLSKALNLGLKPIVVINKIDRDDQRIKEVIDEVFELFVALEANNDQLDFPIVYASGRAGTASLNFDNKINPLDNLSPLFNLIVTHVPTPSADNKAPFSMLVTTREYNPFFGRVLTGRIQSGTVKINQNVKVLNHENKVLETGRITKILAFRGLERIAIDHATAGDIIALAGVENANVADTICAPEVTEAIPSLPIDPPTLSMTFSINDSPLAGSEGTKITSSLIGARLMRELESNVALKVTETANKNAFQVAGRGELQLGILIETMRREGFELSISRPEVLYHTDKTGNKQEPIEEIQVDVDDDYIGVVVKSLALRKAEMTNMRPSGGGKSRITFIGPSRGLIGYYNQFLTETRGTGIINRIFYGYTDYKGPIEGRRKGVLISNCDGAAVAYALWNLEERGKMFINPGDKVYRGMIIGEHNRDNDLDVNPLKAKQLSNVRAVGKDEAIRLTPPMLLTLEQAISYIQDDELVEVTPKSIRLRKVLLNPNDRKRAAQ

SEQ ID NO: 3669 - DNA, 1860 bp, Symbiobacterium thermophilum IAM 14863
  CDS (1)..(1860): transl_table=11
atgaagcggaccgacctgcgcaacgtggcgatcatcgcccacgtcgaccacggcaagaccacgctggtggacggcctgctccgccagtccggcaccttccgggccaacgagcaggtcgccgagcgggtcatggactcgttcgacctggagcgggagcggggcatcaccatcctttcgaagaacacggggatcacgtataaaggggttcggatcaacatcgtcgacacgccgggacacgccgacttctccggcgaggtggaacggatcatgacgatggtcgacggctgcctgctgatcgtggacgcggccgaggggccgatggcgcagaccaagttcgtgctgcgcaaggccatggaggccggcctgaagccggtggtggtgatcaacaagatcgaccggcccgaccggcggatcgccgaggtggaggacgaagtcctcgacctgttcatcgagctgggcgccgacgaggaccagctggactacccggtgctgtacgcctccgcccgcaagggcgtcgcaacctaccggctggaggaggaggggaaggacctccagccgatcttcgacaccatcctggagcgcatcccctgcccggagggcgacccggatgcgccgctgcaggccatggtgacgtcgctggattacgacgagtacgtgggccgcgtggccatcgcccgggtgcggcagggcaccgtgcgggccggccagcaggtagccgtggccaaactggacggctccgtggcgaagttccgggcggcccagctcttcggcttccacggcctgaagcgggtgccggtggaggtggccacggtcggcgacatcatcgccatgaccggcctggaggacgtgaacatcggcgagaccatcaccgatccggagaacccgcagcctctgccgccgatcaaggtcgacgagccgaccctgcagatgaccttccgcaccaacgactcgccgtttgccgggcaggagggcaagtacgtcacctcccgccacctgcgggcacggctcttcaaggagctggagcggaacgtcgccctgcgagtggaggagaccgattcgccggacgtcttcatcgtttcgggccgcggcgagttgcacctgtccatcctcatcgaaaccatgcgccgggaagggtacgagctggcggtctccaagcccaaggtcatctaccggtacgacgaggccggcaaccggttggagccgctggaggagctcatcatcgacgtgcccgaggagtacatgggcgcggtgatggaggccctgggcatccgcaaggccgagatgactaacatggtcaaccacggcaacggcaacgtgcggctggagttcatcatcccggcccgcggcctggtgggcttccgctcggagttcctgaccatgacccggggttacggcgtcatgcaccacatgttccacggctacgggccctaccggggcgagatccccacccgccagcggggctcgctggtggcctcggagaccggcaccgccacccagtacgccctgtaccagatccaggagcggggcacgctgttcatcgagccgggcaccgaggtctacgtgggcatggtggtgggcgagaacagccgcggccaggatatggacgtcaacgtctgcaagaccaagcacctcaccaacatccgggcggcgggggccgacgagaagctgctgctggacccgccccggaagctgaccctggaggaggcgctggagcagatcgcggacgacgagctggtggagatcaccccgaagtcgatccgcctgcggaagcagtacctggaccccgccatccgggcgcgcatcgccaaggggaaggagatcaacgcggaggtgctgcagcggctgcagcagggacggtag

SEQ ID NO: 3670 - protein, 619 aa, Symbiobacterium thermophilum IAM 14863
MKRTDLRNVAIIAHVDHGKTTLVDGLLRQSGTFRANEQVAERVMDSFDLERERGITILSKNTGITYKGVRINIVDTPGHADFSGEVERIMTMVDGCLLIVDAAEGPMAQTKFVLRKAMEAGLKPVVVINKIDRPDRRIAEVEDEVLDLFIELGADEDQLDYPVLYASARKGVATYRLEEEGKDLQPIFDTILERIPCPEGDPDAPLQAMVTSLDYDEYVGRVAIARVRQGTVRAGQQVAVAKLDGSVAKFRAAQLFGFHGLKRVPVEVATVGDIIAMTGLEDVNIGETITDPENPQPLPPIKVDEPTLQMTFRTNDSPFAGQEGKYVTSRHLRARLFKELERNVALRVEETDSPDVFIVSGRGELHLSILIETMRREGYELAVSKPKVIYRYDEAGNRLEPLEELIIDVPEEYMGAVMEALGIRKAEMTNMVNHGNGNVRLEFIIPARGLVGFRSEFLTMTRGYGVMHHMFHGYGPYRGEIPTRQRGSLVASETGTATQYALYQIQERGTLFIEPGTEVYVGMVVGENSRGQDMDVNVCKTKHLTNIRAAGADEKLLLDPPRKLTLEEALEQIADDELVEITPKSIRLRKQYLDPAIRARIAKGKEINAEVLQRLQQGR

SEQ ID NO: 3671 - DNA, 1845 bp, Bacillus cereus E33L
  CDS (1)..(1845): transl_table=11
atgttgaaaaaacgacaagatttacgcaatatagcaattattgcccacgttgaccatggtaaaacaacacttgttgaccagttattacgtcaagcggggactttccgtgcgaacgaacacgttgaagagcgcgcaatggattcaaatgatctagaaagagaacgcggtattacaattttagcgaagaatactgcgattcactatgaagataaacgaattaacattttagatacaccaggtcacgctgacttcggtggagaagtagaacgtattatgaaaatggttgatggcgttttacttgttgttgatgcatatgaaggttgtatgccacaaacacgatttgttttaaagaaagctcttgagcaaaacttaactccaatcgtagttgtaaataaaattgaccgtgacttcgctcgtcctgatgaagtagttgatgaagtaatcgacttattcatcgaacttggtgcaaacgaagatcaattagagttcccagttgtatttgcatcagcaatgaacggaacagcaagcttagattcaaacccagcaaatcaagaagagaatatgaaatcattatttgatacaattattgaacatattcctgcaccaattgataacagcgaagagccacttcaattccaagtagcacttcttgattacaatgactatgttggacgtattggggttggacgcgtattccgcggtacaatgaaggttggacaacaagttgcattaatgaaagttgacggaagtgtaaaacaattccgcgtaacgaaattattcggttacattggattaaaacgtcaagaaattgaagaagcaaaagctggagatttagtagctgtttctggtatggaagacattaacgttggtgaaacggtatgtccggttgagcatgaagatgcgttaccattattacgtattgatgagccaacactacaaatgacgttccttgtaaataacagcccatttgcaggtcgtgaaggtaaatatattacatctcgtaaaattgaagagcgtcttcgttcacaattagaaacagatgtaagtttacgtgtagataatacagaatctccggatgcgtggatcgtatctggacgtggggaactacatttatctatcttaatcgaaaacatgcgtcgtgaaggttatgaactacaagtatctaagccagaagtaatcattaaagaagttgatggcgtaagatgtgagcctgtagaacgtgtgcaaattgatgtacctgaagaatacactggttctattatggaatctatgggtgcacgtaaaggtgaaatgttagatatggtgaataacggaaacggtcaagttcgccttactttcatggttccagcacgtggtttaattggttacacaacagaattcttaacattaactcgtggttacggtattttaaaccatacattcgattgctaccaaccagtacacgctggacaagttggtggacgtcgtcaaggtgttctagtttcacttgaaacaggaaaagcatcacaatacggtattatgcaagttgaagaccgtggtgtaatcttcgttgaaccaggtacagaagtatatgctggtatgattgttggagaacacactcgtgagaatgacttaacagttaacgttgtgaaaatgaaacaacaaactaacattcgttctgcgacaaaagatcaaacttcaacaatgaaaaaaccacgcttaatgacgttagaagagtcattagagtacttaaacgatgacgagttctgtgaagtaactccagaatcaattcgtttacgtaaaaagattcttgataagagcgaacgtgaaagagctgctaagaaaaagaaatctgtagaagcgtaa

SEQ ID NO: 3672 - protein, 614 aa, Bacillus cereus E33L
MLKKRQDLRNIAIIAHVDHGKTTLVDQLLRQAGTFRANEHVEERAMDSNDLERERGITILAKNTAIHYEDKRINILDTPGHADFGGEVERIMKMVDGVLLVVDAYEGCMPQTRFVLKKALEQNLTPIVVVNKIDRDFARPDEVVDEVIDLFIELGANEDQLEFPVVFASAMNGTASLDSNPANQEENMKSLFDTIIEHIPAPIDNSEEPLQFQVALLDYNDYVGRIGVGRVFRGTMKVGQQVALMKVDGSVKQFRVTKLFGYIGLKRQEIEEAKAGDLVAVSGMEDINVGETVCPVEHEDALPLLRIDEPTLQMTFLVNNSPFAGREGKYITSRKIEERLRSQLETDVSLRVDNTESPDAWIVSGRGELHLSILIENMRREGYELQVSKPEVIIKEVDGVRCEPVERVQIDVPEEYTGSIMESMGARKGEMLDMVNNGNGQVRLTFMVPARGLIGYTTEFLTLTRGYGILNHTFDCYQPVHAGQVGGRRQGVLVSLETGKASQYGIMQVEDRGVIFVEPGTEVYAGMIVGEHTRENDLTVNVVKMKQQTNIRSATKDQTSTMKKPRLMTLEESLEYLNDDEFCEVTPESIRLRKKILDKSERERAAKKKKSVEA

SEQ ID NO: 3673 - DNA, 1965 bp, Mannheimia succiniciproducens MBEL55E
  CDS (1)..(1965): transl_table=11
ttgtgcggcgttccaaaaatatttttcttatcgctaaaaataaccgatatcgcaaatctttttgaaacgtccgcaagccctatattattcgttaaacaattaagaacatttcaaatggcagaattagatattcataaattgcgcaatatcgcaattattgcgcacgttgaccacggcaaaaccaccctcgttgataaactgttacaacaatccggtacattagaaacagcgcgtaacggcgattccgacgagcgtgtgatggactcgaacgatctggaaaaagaacgcggtattaccattttagcgaaaaataccgccattaactggaacgactaccgcattaatatcgtagacaccccgggacacgcggacttcggcggcgaagtggaacgggtactgtccatggtggattccgtattactggtagtggatgcttttgacggcccgatgccgcaaacccgttttgtaactcaaaaagcctttgcccacggtttgaaacctatcgtggtaatcaacaaagtcgaccgcccgggcgcacgtccggactgggtagtggatcaggtttttgatttattcgtaaaccttggcgccaccgacgaacagttagacttcccgattatttacgcctccgccctaaacggcgtggcgggtctggaacacgaagaactggcggaggatatgacgccgttattcgaagccatcgtacaacacgtagaaccgcctcaagtggaattgaacgcaccgttccaaatgcagatttcacaactggactacaacaactatgtgggcgtaatcggtattggtcgcattaaacgcggaacggtaaaaccgaatcagtccgtcactattatcgacagtttcggtaaaacccgtaacggcaaaataggtcaggtattgggtcatctgggtttacaacgttacgaagaagatctggcgcaagccggcgacatcgtggctattaccggattaggtgaattgaatatttccgataccgtttgcgatattaacgcggtggaagcattgcctgcgttaagcgtggacgaaccgacggttaccatgttcttctgcgtcaatacctcgccgttctgcggtcaggaagggaaattcgtcacttcacggcaaattctcgaacgtttaaataaagaattggttcacaacgtagccttacgggtagaagaaacaccgaatccggacgaattccgggtatccggtcgcggcgaattgcatttatcggtgttaatcgaaaatatgcgtcgcgaaggttacgaattagcggtgtcccgcccgaaagttatctataaagaagaaaacggtcacaaacaggaacccttcgaacaagtcaccattgatattgaagaacaacatcagggcgcggtaatggaagctttaggcatccgtaagggcgaagtgaaagacatgagcccggacggcaaaggccgtacccgtttggaatacgttatcccgagtcgcggcttaatcggtttccgtaacgagtttatgaccatgacatccggtaccggcttgctttattcaagcttcagccattacgatgatgtcaaaccgggcgaaatcggccagcgcaaaaacggcgtactgatttctaacgctaccggtaaagctctggcttatgctttatggggtttacaggaacgcggtaaattaatggcggaacacggtcaggaagtgtacgaaggtcagattatcggtattcacagccggactaacgacttaacggtaaactgcctgcaaggtaaaaaattaaccaatatgcgcgcctccggtaaagacgacgccattcagttgaccacgccaattaagttaactctggaacaggccattgaatttattgacgacgacgaattggtggaagtcaccccacaatccatccgtatccgtaaaaaactgttaacggaaatggatcgcaaacgtgccaaccgtaccaccaccagtaccagcacgcattaa

SEQ ID NO: 3674 - protein, 654 aa, Mannheimia succiniciproducens MBEL55E
MCGVPKIFFLSLKITDIANLFETSASPILFVKQLRTFQMAELDIHKLRNIAIIAHVDHGKTTLVDKLLQQSGTLETARNGDSDERVMDSNDLEKERGITILAKNTAINWNDYRINIVDTPGHADFGGEVERVLSMVDSVLLVVDAFDGPMPQTRFVTQKAFAHGLKPIVVINKVDRPGARPDWVVDQVFDLFVNLGATDEQLDFPIIYASALNGVAGLEHEELAEDMTPLFEAIVQHVEPPQVELNAPFQMQISQLDYNNYVGVIGIGRIKRGTVKPNQSVTIIDSFGKTRNGKIGQVLGHLGLQRYEEDLAQAGDIVAITGLGELNISDTVCDINAVEALPALSVDEPTVTMFFCVNTSPFCGQEGKFVTSRQILERLNKELVHNVALRVEETPNPDEFRVSGRGELHLSVLIENMRREGYELAVSRPKVIYKEENGHKQEPFEQVTIDIEEQHQGAVMEALGIRKGEVKDMSPDGKGRTRLEYVIPSRGLIGFRNEFMTMTSGTGLLYSSFSHYDDVKPGEIGQRKNGVLISNATGKALAYALWGLQERGKLMAEHGQEVYEGQIIGIHSRTNDLTVNCLQGKKLTNMRASGKDDAIQLTTPIKLTLEQAIEFIDDDELVEVTPQSIRIRKKLLTEMDRKRANRTTTSTSTH

SEQ ID NO: 3675 - DNA, 1839 bp, Bacillus licheniformis ATCC 14580
  CDS (1)..(1839): transl_table=11
gtgaaacttcgagaagatcttcgcaatatcgctattatcgcccacgttgaccatggaaaaacgacgctggtggatcagctcctccatcaggccggtacattccgtgcaaatgaaaacgtggctgagcgcgccatggattccaatgatttggaaagagagcgcggcattacgattttagcgaaaaatacggcgattaattataaagatacacgcattaatattttggatactccgggacacgcagatttcggcggggaagttgaacggatcatgaaaatggtcgacggcgttctgcttgttgtcgacgcttatgaaggctgcatgccgcaaacccgctttgtgctgaaaaaagcacttgagcaaaacttgacgccgatcgttgttgtcaataagatcgaccgcgattttgcccgtccagaagaggtcgttgacgaagtgctcgatttgtttatcgagctagatgcaaatgaagaacagcttgaattcccggttgtttacgcttctgcgatcaacggcaccgcgtcagcagatccgaagcagcaggatgaaaacatggaggctttattcgaagcgattgtcaaccatattccttgtcctgtcgataaccatgaggagcctttgcagttccaggtggctctgcttgactacaatgattatgtcggccgtatcggaatcggacgcgtgttcagaggaacgatgaaggtcggacagcaagttgctttaatgaagcttgacggttctgtcaagccgttccgcgtcacgaaaatcttcggtttccagggcttgaagagagtcgagattgaagaagcgaaagccggcgaccttgtcgctgtatcaggaatggaagacatcaatgtcggagaaaccgtctgcccgattgagcatcaagaggcgcttccggttcttcgcattgacgaaccgacgcttcaaatgacgtttgcggttaacaacagtccttttgccggtcgcgaaggaaaatatgtcacggccaggaagattgaagagcggcttgaacagcagctgcagacagatgtcagccttcgagtcgatccgacgccatctcctgacgcatggatcgtgtcaggacgcggtgagctgcatttgtcgattttaatcgaaaacatgcgccgcgaaggctttgaactgcaagtatcgaagccggaagtcatcattaaagaaatcgacggcgttcgctgtgagcctgttgaacgcgtacaaatcgatgtgcctgaagagcataccggatctgtaatggaatcaatgggtgcgcgcaaaggtgaaatgatcgacatgatcaataacggaaacgggcaagtccgcctgattttcaatgtcccttcacgcggattaatcggctactcaaccgaattcctttcccttacacgcggtttcgggattttaaatcatacgtttgacagctatcagccggttgagccggggcaagtcggcgggcgccgccaaggcgtgcttgtctcaatggataccgggaaagcttcagcctacggcattcaaggcgttgaagagcgcggcgtgatttttgtcgagccgggcacagaagtatatgaaggcatgatcgtcggcgagcacaaccgtgaaaacgaccttgtcgtcaacatcaacaaaatgaagcagcagacaaacgtgcgctcagcgacgaaagatcagacggtcagcatgaaaaaaccgcgtatcatgtcgcttgaagaatcgcttgaatacttgaacgaggatgagtactgcgaagtcacacctgaatccatcagattgagaaagaaaattctcgacaaaaacgaacgcgaaaaagcagcgaaaaagaaaaagctggcaggattgtcgtaa

SEQ ID NO: 3676 - protein, 612 aa, Bacillus licheniformis ATCC 14580
MKLREDLRNIAIIAHVDHGKTTLVDQLLHQAGTFRANENVAERAMDSNDLERERGITILAKNTAINYKDTRINILDTPGHADFGGEVERIMKMVDGVLLVVDAYEGCMPQTRFVLKKALEQNLTPIVVVNKIDRDFARPEEVVDEVLDLFIELDANEEQLEFPVVYASAINGTASADPKQQDENMEALFEAIVNHIPCPVDNHEEPLQFQVALLDYNDYVGRIGIGRVFRGTMKVGQQVALMKLDGSVKPFRVTKIFGFQGLKRVEIEEAKAGDLVAVSGMEDINVGETVCPIEHQEALPVLRIDEPTLQMTFAVNNSPFAGREGKYVTARKIEERLEQQLQTDVSLRVDPTPSPDAWIVSGRGELHLSILIENMRREGFELQVSKPEVIIKEIDGVRCEPVERVQIDVPEEHTGSVMESMGARKGEMIDMINNGNGQVRLIFNVPSRGLIGYSTEFLSLTRGFGILNHTFDSYQPVEPGQVGGRRQGVLVSMDTGKASAYGIQGVEERGVIFVEPGTEVYEGMIVGEHNRENDLVVNINKMKQQTNVRSATKDQTVSMKKPRIMSLEESLEYLNEDEYCEVTPESIRLRKKILDKNEREKAAKKKKLAGLS

SEQ ID NO: 3677 - DNA, 1827 bp, Legionella pneumophila subsp. pneumophila str. Philadelphia 1
  CDS (1)..(1827): transl_table=11
atgattgaaaaaattcgcaatattgccattattgcccacgttgaccatggcaaaactactcttgttgacaagctcttgcaacaaactggaacgctcaatgagagagctccaaaagttgaacgcgtgatggactccaatgcacttgaaaaggaacgtggaattactatcttagccaaaaacacttgcgtttattggaaaggttatcaaattaatattgtagataccccagggcatgcggattttggcggcgaagtggaacgtattctttctatggttgacagcgttttattgctggtcgatgcagttgacggccccatgccacaaacccgctttgtcacccagaaagcatttgcccgtggcttaaaccctatagtcgtgatcaataaaattgaccgtccaggagcaagacctgattgggtcatggatcaggtgttcgacttgttcgataacttaggcgccaatgacacccaactagacttccctgtagtttatacctccgctttaaatggctatgccaaacttaatttggaagacaatgcaacagatatgtctgccctactgcaaacaatcgtagataaagtcacaccaccttgtgtcgatgccaatggtccgtttcaaatgcaaatcagctctctcgattattcttcttatgttggcaccataggcattggccggattacacgcgggcaaattaaggcaaaatctcctgtaaagattattgataaagacggtaatatgcgcagcggacgactgctccagttactgggattcaaagggctggaacgcgttgaagtcgaggaagccagtgccggtgatattatcgcgataaccggaattgagagcctgaatatatccgacacgatttgcgaccccaacctggtggaggcattgccagcacttttagtagatgaacctacaatcagcatgacttttcaggttaatgactcgcctctggccggccaagaaggtaaatacgtcacatcaagaaaaattcgtgaacgcttaaatactgaattactgcataatgtggcgcttcgcgtagaggactgcgatgatcctgataaattcagagtttctggtcgcggcgaattacacttgtcgattcttatcgaaacgatgcgccgtgaaggctatgaattggcaataagcaaaccggaagtgattattcgcgaggtagaaggtgaacaacaggagccttatgaacacctgacagttgatgttgaggaaaaccatcaaggtaccattatggaaaaattgggtgaacgccgaggcgaaatgcaaaatatggtgcctgatggcaaaggcagagtacgtttggattacatcatcccgactcgcggattaatcggttttcacaatgaatttttatcctgcacttccggtaccggattaatgtatcatgtctttgatcactacggtccgttgattaaaggacgcatagggaagcgtctcaatggcgtcatgatagctaattgtcctggtactgcccgggcttttgccttgttcaatttacaagaacgtggaagattatttttagagcctcaatcagtctgctatgaaggaatgattgtaggtatccatgccagagataacgacctggttgttaatgtcaccaaagaaaagcaattaacaaacatcagggcatcaggttcggatgaaaatattatcctgactcctccggtcaaattatctcttgagcaagcgctggaatttatcgatgatgatgagttagttgaggttaccccgttatctattcgtttacgtaaaaaatttctcaaggaacacgatagaaaaaaagcctctcgtaccgccacaagtgaagaataa

SEQ ID NO: 3678 - protein, 608 aa, Legionella pneumophila subsp. pneumophila str. Philadelphia 1
MIEKIRNIAIIAHVDHGKTTLVDKLLQQTGTLNERAPKVERVMDSNALEKERGITILAKNTCVYWKGYQINIVDTPGHADFGGEVERILSMVDSVLLLVDAVDGPMPQTRFVTQKAFARGLNPIVVINKIDRPGARPDWVMDQVFDLFDNLGANDTQLDFPVVYTSALNGYAKLNLEDNATDMSALLQTIVDKVTPPCVDANGPFQMQISSLDYSSYVGTIGIGRITRGQIKAKSPVKIIDKDGNMRSGRLLQLLGFKGLERVEVEEASAGDIIAITGIESLNISDTICDPNLVEALPALLVDEPTISMTFQVNDSPLAGQEGKYVTSRKIRERLNTELLHNVALRVEDCDDPDKFRVSGRGELHLSILIETMRREGYELAISKPEVIIREVEGEQQEPYEHLTVDVEENHQGTIMEKLGERRGEMQNMVPDGKGRVRLDYIIPTRGLIGFHNEFLSCTSGTGLMYHVFDHYGPLIKGRIGKRLNGVMIANCPGTARAFALFNLQERGRLFLEPQSVCYEGMIVGIHARDNDLVVNVTKEKQLTNIRASGSDENIILTPPVKLSLEQALEFIDDDELVEVTPLSIRLRKKFLKEHDRKKASRTATSEE

SEQ ID NO: 3679 - DNA, 1821 bp, Methylococcus capsulatus str. Bath
  CDS (1)..(1821): transl_table=11
atggtagaaaaattacgcaacatagcgatcatcgcccacgtcgaccacggaaaaaccaccttggtagacaagctgctccagcaaagcggcactttcgccgctcacgagcgggtgggcgagcgcgtcatggactccaatgacctcgagaaggagcgcggcatcaccattctggcaaaaaataccgcgatcaagtggcgggattaccgtatcaatatcgtcgacacgcccggccacgccgatttcggaggtgaggtcgagcgcgtgctttccatggtcgactcggtgttgctgctggtcgacgccgtcgacggccccatgccacaaacccgcttcgtcacccagaaagccttcgccatggggctgcatcccatcgtgctgatcaacaagatcgaccggcccggcgcccgcgcggcctgggtgctcgatcagaccttcgatctgttcgaccgccttggcgccaccgaggcccagctcgatttcccggtgatctactgctcggccttgaacgggtatgcggggctcagcccggatatctcggaaggcacgcttgagccgctgttcgaggccatcgtgaatcatgtctcaccgcccgacgtggacaccgacggtccctttcagatgcaggtcagcagcctcgattacaattcgtatgtgggagtcattggcattggaagaatcacccgaggcaccgtcaagaggaatacccccgtcacactgatcaagcgcgatggcaggcagagcgccgcacgcattctccaggttctggcgttccacggtcttgagcgcatcgaaagggaagaggcgaacgccggcgatatcatcgctttcaccggtatcgaggggctcgagatttcggatacgctttgcgcggtcgggtttgccgaacagctccccccgctcaccgtggacgaacccacggtgagcatgacctttcaggtgaacaattcgcccttcgcgggaagggaaggcaagtttttgacgtccaggcagattcgggacaggctgaaccgcgaattgatccacaacgtcgcactgcgggtggaggatacggccgacccggacaaattcacggtttccggccgaggtgaactgcatctttcgattttgatcgaaaacatgcggcgagagggctatgaattggccgtttccagacctgaggtcatcattcgtgaaatcgacggcgaaccttgtgagccctatgaattcgtgacgatagaagtggaggaaacacatcagggcgccgtcatggaaaagctcggggagcgcaagggcgacctccgtaacatggtgccggatgggcaaggacgcgtgcgtctcgaatacctcatcccctcccgcggactcatcggatttcaaaccgaattcctcaccactacgtccggcaccggcctgctgtatcacgtgttcgatcactacggaccaatcaagaggggcgcgattgggcagaggaccaatggggcgctgatttccaacacaacgggtaaagcgctggcgttttccctgttcaacctacaggaacgcggacgcctgttcgtcgaacacggcgatgaagtctacgagggcatggtcgtgggcgtacatacgcggggaaacgatctggtggtcaaccccacgaaagcgaaacagctcaccaacatccgggcagcgggcagcgacgaaaacatccttttgacacccgcgatcaaattcactctcgagcaggcgatagaattcatcgacgacgatgaactcgtggaagtgacccctcagagcattcgcatccgcaagaagctcctgcaggaacacgagcgcaagaaggcttcgcgaaccgccgagggctga

SEQ ID NO: 3680 - protein, 606 aa, Methylococcus capsulatus str. Bath
MVEKLRNIAIIAHVDHGKTTLVDKLLQQSGTFAAHERVGERVMDSNDLEKERGITILAKNTAIKWRDYRINIVDTPGHADFGGEVERVLSMVDSVLLLVDAVDGPMPQTRFVTQKAFAMGLHPIVLINKIDRPGARAAWVLDQTFDLFDRLGATEAQLDFPVIYCSALNGYAGLSPDISEGTLEPLFEAIVNHVSPPDVDTDGPFQMQVSSLDYNSYVGVIGIGRITRGTVKRNTPVTLIKRDGRQSAARILQVLAFHGLERIEREEANAGDIIAFTGIEGLEISDTLCAVGFAEQLPPLTVDEPTVSMTFQVNNSPFAGREGKFLTSRQIRDRLNRELIHNVALRVEDTADPDKFTVSGRGELHLSILIENMRREGYELAVSRPEVIIREIDGEPCEPYEFVTIEVEETHQGAVMEKLGERKGDLRNMVPDGQGRVRLEYLIPSRGLIGFQTEFLTTTSGTGLLYHVFDHYGPIKRGAIGQRTNGALISNTTGKALAFSLFNLQERGRLFVEHGDEVYEGMVVGVHTRGNDLVVNPTKAKQLTNIRAAGSDENILLTPAIKFTLEQAIEFIDDDELVEVTPQSIRIRKKLLQEHERKKASRTAEG

SEQ ID NO: 3681 - DNA, 1860 bp, Anaplasma marginale str. St. Maries
  CDS (1)..(1860): transl_table=11
ttgtcccattgcgtcgcgggggggtctatgtctaacaattacgaatctgttcgtaatttggctattgttgcgcatgtagatcacgggaagactacgcttctagacagcatgctgaagcaaagcggtgccctcagggataaccaggaagttgttgagcgggtgatggacagcaatgacctggaacgggagcggggcattacgatcctggcgaagtgtaccgcgattacgtggggaagccataagattaatgtgatagacacaccaggccacgcagattttggtggcgaggtggaaagggtgctctcaatggcagacggggtgctcatgctcgttgatgcgtctgagggcccaatgccgcaaacgaagttcgtgctctcaaaagcgctgcaggccaatttgctgccaatagtggtggtaaataaggttgaccgtccagacagcagggtgagcgaagttttggacgaggtgtatgagctttttataaacctcaacgccacaagtgagcagcttgatttccccgtgctctatgcttccgggaggagcggttggtgcgtcaaggatttgtcggaggagcgcaaggatcttacacctctgtttggggcgattctggaatatatcaaaccctcgcaatatgaccataacgccccgttcagtatgctgttaaccctcttggagtcagacaagtttttgggcagggtgctgactgggaagatataccagggtagagcgaagatcaattcgcaggtgaaagtgctaaacttgagcggtgaggttgtagagagtggcaggctgaccaagctgctgtctttttccggtttgaagcgtgttccggttgatgaagccggtgccggagacataatagccgttgctgggctcgagaaagcctcggtttctgacagcattgtggacgttgctgtaagtgtgcctattccctctacccccgtagaccccccaaccatggccgtgactattggtgtgaatgattcacctctggctggtactgaaggcaccaagcttacgtctactgtgatcaaaaatagattgctgtccgaagctgaaaccaacgtagcaatcacggtgaaagagggggaacgcagtgattcttacgaggttggcggcagaggtgagctacagctcggtgtgttgattgaaacgatgcggcgggaaggttttgagctttctgtatcgcgcccgcgtgtcctatttaagaaggaagggtcagcccttctggagcccatggaagaggtggtgattgacgttgatgaagagtacagcggcataatcatggaaaagttaagcttccgcaagggcgatatgcaagatatgtcgccatcagggcagggcagggtgcgcatggtgtttctgattccttccagggggctgattggctaccatggcgagtttcttacagattccagaggcactggcataatgaatcgcctgttccacgggtacgcgccacacaagggtgatatccctggtagagtgaacggcgtgttgatttccactgggcagggtgaggcagttgcgtatgccatctttaaccttcaagacaggggtgcgatgtttatcaagccccaagataaggtatacatgggtatggtggtcgggctgcacaataggggcaatgacatcgaagtgaacgtcttgaagggcaagcagttgaccaacatccgggccgcgggctctgacgaggccgtcaggcttgttccgccgcagttaatgacactagaagaaatgatagggtttataaacgacgacgagctggtagagtgtacgccaaaatccgtaagattgcggaaaaggttcctagaccccaatgagcgcaagcgctttgcaagggcgaagagtgcaacttga

SEQ ID NO: 3682 - protein, 619 aa, Anaplasma marginale str. St. Maries
MSHCVAGGSMSNNYESVRNLAIVAHVDHGKTTLLDSMLKQSGALRDNQEVVERVMDSNDLERERGITILAKCTAITWGSHKINVIDTPGHADFGGEVERVLSMADGVLMLVDASEGPMPQTKFVLSKALQANLLPIVVVNKVDRPDSRVSEVLDEVYELFINLNATSEQLDFPVLYASGRSGWCVKDLSEERKDLTPLFGAILEYIKPSQYDHNAPFSMLLTLLESDKFLGRVLTGKIYQGRAKINSQVKVLNLSGEVVESGRLTKLLSFSGLKRVPVDEAGAGDIIAVAGLEKASVSDSIVDVAVSVPIPSTPVDPPTMAVTIGVNDSPLAGTEGTKLTSTVIKNRLLSEAETNVAITVKEGERSDSYEVGGRGELQLGVLIETMRREGFELSVSRPRVLFKKEGSALLEPMEEVVIDVDEEYSGIIMEKLSFRKGDMQDMSPSGQGRVRMVFLIPSRGLIGYHGEFLTDSRGTGIMNRLFHGYAPHKGDIPGRVNGVLISTGQGEAVAYAIFNLQDRGAMFIKPQDKVYMGMVVGLHNRGNDIEVNVLKGKQLTNIRAAGSDEAVRLVPPQLMTLEEMIGFINDDELVECTPKSVRLRKRFLDPNERKRFARAKSAT

SEQ ID NO: 3683 - DNA, 1818 bp, Azoarcus sp. EbN1
  CDS (1)..(1818): transl_table=11
atgtcccgctccatccgcaacatcgccatcattgcccacgtcgaccacggcaagaccacgctcgtcgaccagctcctgcgccaatccggcacctttcgcgagaaccagcaggtttccgaacgggtgatggactcgaacgatctggagaaggagcgcggcatcacgatcctgtcgaaaaactgcgcgatccagtatggcgatactcacatcaacatcgtcgacacgccgggacacgcggatttcggtggcgaagtcgagcgcgtattgtcgatggtcgacggcgtgctgctgctcgtcgacgcggtcgaaggcccgatgccgcagacgcgcttcgtcacgcgcaaggcgctcgcgctcggcctgaagccgatcgtcgtgatcaacaagatcgaccgtccgggcgcccgccccgactgggtcatcaaccacacgttcgaccttttcgacaagctcggcgcgaccgaagagcagctcgacttcccggtcgtgtatgcgtcgggcctgaacggcttcgcgatgctcgacctcgcgaagccgagcaccgacatgaagccgctgtacgaagcgatcctggagcatgtgccccagcctgaagtcgattccgacggcccactgcagctgcaggtctgctcgctcgactattcgacctacatcggccagctcggtatcggccgcatcaagcgcggccgcatccgtccgaaccaggaagtcgtcgtgatgtacggtgacgaaaatcgcggcaaggccaagatcggccaggtgctgaccttcgagggcctcgagcgcacgcagacggaatcggccgaagccggcgacatcgtgctggtgtcgggcgtcgatcaggtcaatatcggcgtcacgctgtgcgatcccgagaaactcgaaggcatggagccgatcgcggtcgatgaaccgacgctgacgatgaacttcatggtcaactcgtcgcccctggccgggcgtgaagggaagttcgtcacaagccgccagatccgcgagcggctcgaacgcgagctgctgaagaacgtcgcgctgcgcgtcgaatacaccaacgactcggacgtgttcctggtgtcgggccgcggcgaactgcatctgaccatcctgctcgagaacatgcgccgcgaaggcttcgaactcgcggtcggccgtccgcgcgtggtgttccgcgaggtcgatggcgtcaagtgcgagccgtacgagatgctgaccgtcgacgtcgaggaagagcatcaaggcggcgtcatggaagaactcggccgccgccgcggtgaactgcaggacatgcagtccgacagcaagggccgtgtgcgtctcgaataccgcatcccggcgcgcggtctgatcggcttccagggcgagttcctgacgctgacgcgcggtatcggcctcgcgagccacgtcttcgacggctacggcccgatggcggggccgatgggcgagcggcgcaacggcgtgctgatctcgcaggacaacggccacgcggtcgcctatgcgctgtggaagctgcaggatcgcggccggatgttcctcacgcacaacgatcccgtgtacgaaggcatcatcatcggcgtgcattcgcgcgacaacgatctcgtcgtcaatccgatcaagggcaagcagcttaccaacgtgcgctcgtcgggtaccgacgaagccgtgcggctgatcccgccgatccagttaacgctcgagtccgcgatcgaattcattgccgacgacgagctcgtcgagatcacgccgaagtcgattcggctgcgcaagcgttacctgaccgagaacgagcgcaaacgcgcggcaaaagctgaaaacgcctga

SEQ ID NO: 3684 - protein, 605 aa, Azoarcus sp. EbN1
MSRSIRNIAIIAHVDHGKTTLVDQLLRQSGTFRENQQVSERVMDSNDLEKERGITILSKNCAIQYGDTHINIVDTPGHADFGGEVERVLSMVDGVLLLVDAVEGPMPQTRFVTRKALALGLKPIVVINKIDRPGARPDWVINHTFDLFDKLGATEEQLDFPVVYASGLNGFAMLDLAKPSTDMKPLYEAILEHVPQPEVDSDGPLQLQVCSLDYSTYIGQLGIGRIKRGRIRPNQEVVVMYGDENRGKAKIGQVLTFEGLERTQTESAEAGDIVLVSGVDQVNIGVTLCDPEKLEGMEPIAVDEPTLTMNFMVNSSPLAGREGKFVTSRQIRERLERELLKNVALRVEYTNDSDVFLVSGRGELHLTILLENMRREGFELAVGRPRVVFREVDGVKCEPYEMLTVDVEEEHQGGVMEELGRRRGELQDMQSDSKGRVRLEYRIPARGLIGFQGEFLTLTRGIGLASHVFDGYGPMAGPMGERRNGVLISQDNGHAVAYALWKLQDRGRMFLTHNDPVYEGIIIGVHSRDNDLVVNPIKGKQLTNVRSSGTDEAVRLIPPIQLTLESAIEFIADDELVEITPKSIRLRKRYLTENERKRAAKAENA

SEQ ID NO: 3685 - DNA, 1821 bp, Silicibacter pomeroyi DSS-3
  CDS (1)..(1821): transl_table=11
atggacctgcgcaacattgcgatcatcgctcacgtggaccacggcaagacgacgctggtggatgaactgctgaaacaatccggcgcctttcgtgaaaaccaggccgtcgccgaacgtgccatggacagcaacgatctggaacgcgagcgggggatcaccatcctggccaaggcgacctcggtcgagtggcgcggcacccgtgtcaatatcgtcgacacccccggccacgccgatttcggcggcgaggtcgagcgcatcctgagcatggtcgatggcgtcgtgctgctggtcgatgccgccgagggtccgatgccccagaccaaattcgtgacctccaaggcgctggccctgggcctgcgccccatcgtagtactgaacaaggtcgacaagcccgatgcggaacccgaccgggcgctggacgaatgtttcgacctgttcgccaatctgggcgccaatgacgaacagctcgatttcccgcatctctacgcttcggggcgttcgggctgggctgataccgatctggacgggccgcgcaaggatctgacggcgctgtttgaactggtggtgcgccatgtgcccgccccggcacagatcgcgcgcaaggacgagccgttccggatgctggccaccacgctgggcagcgacccgttcatcggccgcatcctgaccggccgggtggaaagcggcacgctcaaggcgggcgagacgctcaaggcgctcagccgcgacggcacccagatcgaaagcttccgcgcctcgaagatcctcgccttccggggtctcggccagcagcccatcgacgtggccgaagcgggcgatatcgtcaccatcgccggcatgagcaaggcaaccgtggccgacagcctggtcaatccgcaggtgagcgaggccctgcccgcccagccgatcgacccgccgaccatcagcgttaccttcggcatcaacgacagcccgctggcgggccgcgacggcaagaaggtgcagagccgggtgatccgcgaccgcctgatgaaagaggcggaatcaaacgtggcgatccgcgttaccgacacgcccggcggcgaggccttcgaggtcgcgggccggggcgaattgcagatgggcgtgctgatcgagaacatgcgccgcgaagggttcgagctcagcatctcgcgcccgcaggtcctgttccgcgaagaagacggccagcgtctggaaccggtcgaggaagtcaccatcgacgtggatgacgaatataccggcgcggtgatcgaaaaggtgaccggcccccgccgtggcgagctggtcgagatgaaaccggccggcgccggcaagacgcggatcattgcccatgtcccctcgcgcgggctgatcggctatcacggcgagttcctgaccgatacccgcggcaccggcgtgctgaaccgggtgttccatggctggaccccgcacaagggcgccatcccgggccggcgcgcaggcgtgctgatctcgatggaaaacggccagtcggtcgcctatgcgctgtggaacctcgaagagcgcggccgcatgttcatcggcccgcagaccgatgtctacgagggcatgatcatcggcgaacacagccgcgacaacgacctggaagtgaacccgctcaagggcaagaaactgaccaacgtgcgcgcctcgggcaccgatgacgcggtgcgtctgaccccgcatatccagttcagcctggaagaggcgatcgcctatatcgacgatgacgaactggtcgaagtgaccccgaacacgatccgcctgcgtaaacgctatctcgacccgcacgagcgcaagcgcatggcccgggcggccagctga

SEQ ID NO: 3686 - protein, 606 aa, Silicibacter pomeroyi DSS-3
MDLRNIAIIAHVDHGKTTLVDELLKQSGAFRENQAVAERAMDSNDLERERGITILAKATSVEWRGTRVNIVDTPGHADFGGEVERILSMVDGVVLLVDAAEGPMPQTKFVTSKALALGLRPIVVLNKVDKPDAEPDRALDECFDLFANLGANDEQLDFPHLYASGRSGWADTDLDGPRKDLTALFELVVRHVPAPAQIARKDEPFRMLATTLGSDPFIGRILTGRVESGTLKAGETLKALSRDGTQIESFRASKILAFRGLGQQPIDVAEAGDIVTIAGMSKATVADSLVNPQVSEALPAQPIDPPTISVTFGINDSPLAGRDGKKVQSRVIRDRLMKEAESNVAIRVTDTPGGEAFEVAGRGELQMGVLIENMRREGFELSISRPQVLFREEDGQRLEPVEEVTIDVDDEYTGAVIEKVTGPRRGELVEMKPAGAGKTRIIAHVPSRGLIGYHGEFLTDTRGTGVLNRVFHGWTPHKGAIPGRRAGVLISMENGQSVAYALWNLEERGRMFIGPQTDVYEGMIIGEHSRDNDLEVNPLKGKKLTNVRASGTDDAVRLTPHIQFSLEEAIAYIDDDELVEVTPNTIRLRKRYLDPHERKRMARAAS

SEQ ID NO: 3687 - DNA, 1839 bp, Bacillus clausii KSM-K16
  CDS (1)..(1839): transl_table=11
atgactgtacgcgaagagttgcgtaatattgcgatcattgcccacgttgaccacggaaaaacgacattagtggatgaactcttaaaacaatctggcacatttttgcaacatgaaactgtgcaagaaagagcaatggattcgaatgcgattgaaaaagaacgaggcattaccattttagcaaaaaatacagcaattaattacaaaggaacacgtatcaacatcatggatacgccaggacacgccgactttggaggcgaagttgagcggattatgaaaatggttgacggtgttcttcttgtcgtcgatgcttacgaaggttgcatgccgcaaacgcgttttgttttgaaaaaagcacttgagcaaaagctggcaccgatcgtagtcgtgaataaaattgatcgtcctgcagcccggccgaatgaagtcgtggatgaagtcattgatttgtttatcgatttaggagcagatgaagaccagcttgattttccggttgtctacacttctgctataaatgggacggcatccttatcgccagaaaagcaagacgaaaacatggatgctcttttccaaacggttgtagagcaaatcccggccccagtagacaatagcgatgagccgttgcagctgcaaattacgttgcttgattacaacgattatgttggccgtattgggattggccgagtatttagaggcacgattaaagtgggccagcaagtggctctcatgaagcttgacggcacagtcaaacaatttcgcgtcacaaagctgttcggctttcttggcttaaaacgcgctgaaattagcgaagcaagagctggcgatttagtggctgtttcgggaatggaagaaatcaatgttggcgaaacggtttgtccgatagagcatcaagatgcgttgccaccgttacggatcgatgaaccgacacttaaaatgactttcctagtcaataattcaccttttgctggtcgtgaaggaaaatttgtaacaagccgtaaactagaagaacggcttaaagccgaattagaaaccgatgttagtttgcgtgtggaaaacacagactcccctgatatgtgggttgtctcagggcgtggcgagctgcacttgtccattttaattgaaaacatgcgccgtgaagggtacgaactacaagtatccaaaccggaagtcatcatccgcgaagtcgatggtatccggtgcgaaccggtagaacgtgtgcaaattgatgtgccagaggaataccaaggtgccgttatgcaatctcttggggagcgcaaaggcgaaatggtgaacatggccaacacaggaagtggacaagttcggcttgaatttctcgtacctgctcgtgggttgatcggttatacaactgagtttttaacgcaaacacgaggatacgggattttaaaccattcatttgattcctatcagccggttactgctggccaagttggcggtcgacgccaaggagtgcttgtttccattgaaacaggaaaagcgacccaatatgggattatcaatgtagaagaccgaggcaccatctttgtagaaccaggcacggaaatctacgaaggcatgattgtgggcgagcatacacgggaaaatgatttgactgtcaacattacgaaaatgaagcagcagacaaatgtccgttctgccacaaaagagcacacggtcacgatgaaacgaccacgcattttgacgctagaagaagcgcttgagtatttgaatgacgatgaatactgcgaaatgacgccacaatcgattcgcttgcgcaaaaaaatcttaaacaaatcagaacgggaacgggaagaaaaacggagaaaaatcgcttcaagtaagtga

SEQ ID NO: 3688 - protein, 612 aa, Bacillus clausii KSM-K16
MTVREELRNIAIIAHVDHGKTTLVDELLKQSGTFLQHETVQERAMDSNAIEKERGITILAKNTAINYKGTRINIMDTPGHADFGGEVERIMKMVDGVLLVVDAYEGCMPQTRFVLKKALEQKLAPIVVVNKIDRPAARPNEVVDEVIDLFIDLGADEDQLDFPVVYTSAINGTASLSPEKQDENMDALFQTVVEQIPAPVDNSDEPLQLQITLLDYNDYVGRIGIGRVFRGTIKVGQQVALMKLDGTVKQFRVTKLFGFLGLKRAEISEARAGDLVAVSGMEEINVGETVCPIEHQDALPPLRIDEPTLKMTFLVNNSPFAGREGKFVTSRKLEERLKAELETDVSLRVENTDSPDMWVVSGRGELHLSILIENMRREGYELQVSKPEVIIREVDGIRCEPVERVQIDVPEEYQGAVMQSLGERKGEMVNMANTGSGQVRLEFLVPARGLIGYTTEFLTQTRGYGILNHSFDSYQPVTAGQVGGRRQGVLVSIETGKATQYGIINVEDRGTIFVEPGTEIYEGMIVGEHTRENDLTVNITKMKQQTNVRSATKEHTVTMKRPRILTLEEALEYLNDDEYCEMTPQSIRLRKKILNKSEREREEKRRKIASSK

SEQ ID NO: 3689 - DNA, 1839 bp, Ehrlichia ruminantium str. Welgevonden
  CDS (1)..(1839): transl_table=11
atgtcgtcagaaggtgattatcagtcaatatgtaatttagctattattgcccatgttgatcatggaaaaacaactctgttggatgctatgttaaaacaaagtggtacttttagagagaatcaagatgtagctgaaagggttatggacaataatgacttagaacgtgagcgtggtattactattttagctaagtgtacatctattacctggcaaggtaagaagattaatataattgatactccaggacatgctgattttggtggagaagtagaacgtgtattatcaatggcagatggtgtgttgttattagttgatgcttcagaaggacctatgcctcaaactaaatttgtactgtcaaaggcgttaaaagctggattattacctatcgtaattataaataaagttgatagaccagatagtagaatagatgaagtacttgatgaagtatatgagttatttatgaatctagatgctactgatgaacaattggattttccaatcttatatgcatcaggaagaagtggatggtgtgttaaaagtttatctgataatagagaaaatttagtgccattatttgatgcagttattcaacatgttaagcctatatcttatgatattaatgcaccttttagtatgttattaacattattagaatcagataaatttttaggcagagtattaacgggaaaaatatatactggtacagctaagattaatgatagtgtaaaagttttaaatcttgctggtgaagttgttgaatatggtaaattaactaagttattatctttttcaggacttaaacgtgtaccagttaaagatgccagagctggagatattattgcagttgctggccttgagaaagcttcagtatctgacagtattgttgatagttctattactcatcctattgcatcaacaccagttgacccaccaactatggcagttactattagtgtaaatgattcaccttttgctgggacagaaggggttaagctaacatcaacggtaattaaggcacgcttgatagcagaagctgagacaaatgtggcaattacagtaaaagaaacagagcagggtgatgcttatgaagttggaggaagaggagaattacagcttggtgtattaatagagactatgagaagagaaggatttgagctttcagtatctcgccctcgtgttttgcttaaaaaagatgataatgggcaagttttagagcctatagaagaagtagttattgatgtagatgaagtgtatagtggcattataatggaaaaactaaatctacgtaaaggtgatatgcaagacttgcgtccatcaggaaagaatagagttaggatggtatttttagttccttcacgtggtcttataggttatcaaggagaatttttgactgattctcatggtacaggtattataaataggttgttctatagttatgctccacataaaggtaatattcctactaggaataatggtgtacttatttctaacgataaaggtgaagctgtagcttatgcgttatttaatttgcaagatcgaggtatgatgtttattaaacctcaagataaggtatattgtgggatgattgttggacttcatagtcgtgaaaatgatattgatgtcaatgttttaaaaggtaagcagttgactaatataagagctgctggttcagatgaagcagtaaggttagtaccaccaaaattaatgactttggaagaaatgatagcatttattaatgatgatgagttagttgaatgtactcctaaatctattcgtttaagaaagaaatatttagatcctaatgagcgtaagcgtgcttttagagctaataaaatataa

SEQ ID NO: 3690 - protein, 612 aa, Ehrlichia ruminantium str. Welgevonden
MSSEGDYQSICNLAIIAHVDHGKTTLLDAMLKQSGTFRENQDVAERVMDNNDLERERGITILAKCTSITWQGKKINIIDTPGHADFGGEVERVLSMADGVLLLVDASEGPMPQTKFVLSKALKAGLLPIVIINKVDRPDSRIDEVLDEVYELFMNLDATDEQLDFPILYASGRSGWCVKSLSDNRENLVPLFDAVIQHVKPISYDINAPFSMLLTLLESDKFLGRVLTGKIYTGTAKINDSVKVLNLAGEVVEYGKLTKLLSFSGLKRVPVKDARAGDIIAVAGLEKASVSDSIVDSSITHPIASTPVDPPTMAVTISVNDSPFAGTEGVKLTSTVIKARLIAEAETNVAITVKETEQGDAYEVGGRGELQLGVLIETMRREGFELSVSRPRVLLKKDDNGQVLEPIEEVVIDVDEVYSGIIMEKLNLRKGDMQDLRPSGKNRVRMVFLVPSRGLIGYQGEFLTDSHGTGIINRLFYSYAPHKGNIPTRNNGVLISNDKGEAVAYALFNLQDRGMMFIKPQDKVYCGMIVGLHSRENDIDVNVLKGKQLTNIRAAGSDEAVRLVPPKLMTLEEMIAFINDDELVECTPKSIRLRKKYLDPNERKRAFRANKI

SEQ ID NO: 3691 - DNA, 1830 bp, Dehalococcoides ethenogenes 195
  CDS (1)..(1830): transl_table=11
ttggaaaactaccagagaaccgatatccgtaatattgctattattgcccacgtagaccacggcaaaaccagcctggtagacgtgatgcttaaacaaagccgcattttccgtgaaaaccagcacgttggcgagcttattatggaccgaaacacccttgaacgggaaaaaggcattactattctggccaaaaacaccgccataacctaccgcggagtaaagataaacatcattgatactcccggacatgctgacttttcgggtgaggttgagcgggtactgaatatggcagacggctgtctcttggtgattgacagtatagacggccctatgccccaaacccgttttgtgcttaaggaagccatgcagaaaaagctgaagcctattgtagttataaacaagatagaccgcgaaaatgcccgccctgaaatagtgctggggctggtacaggacttgtttctggagctggctaccaccgaggaacagctggacttcccggtagtttatacctctgcccgcgaagggtatgccgtaaatacccccggtacaaaaagcactgaccttatccccctgtttgagtgcatactggataaaattcccccgcccagcatcgcccagggtgaattccaaatgcttatttccaacctggattatgatacccacaaagggcggatagctatcgggcgcattcagcggggtaaaatatgctcccatgaccgggtagttaatatagattcccaaaataaagctcacccttttgaagtgggtcaggtatttacctttatgggattgggcaaacaggaagtggagtgtgccgaagcaggtgagatagtagccattaccggtctggaaaacgcctcaataggtgataccgtcaccagccctctccagcctgaggccctgccccgcattgaaataggcgaacctactgtcagaatgactttcggggtcaatacctcacctttcggggggcgggaaggtaaattctgcacctcacgccagcttcgggaaaggcttttccgtgaactggagaccaatatagggctgagggttgaggaaactgattcgccggactcatttttgatttccgggcggggcgaactccacctgtccatcctggtagagaccatgcgccgcgaagggtatgaatttgaaatatccaaacccgaagccatcacgaaagatataaacggcaaagtctatgagccggtggaaactctgacgatagatgtccgcgaggattttgtgggagaggtcaccgaacttctgggtaaacgccaggcccgcatgactgatatgcacaatgacggcgaaggaaacgtaaggctggaatataacatacccacccgcggtcttatcggcttccgcaactcgttcctgacagctaccagaggcacaggcgtactgaacagccagtttctggattttcagccctggtgcggtgaaatagagcaaagccggaccggcgcattggtggcagccgaagcaggtttgtcctgcacttacgggcttaataactcacaggaacggggcatactgatgatagatgccaatgtacctgtgtacgagggcatgatagtcggcctgcatgccagaggtcttgacctggcagtaaatgtctgcaagcagaaaaagatgaccaatatccgttcgtctacttcggacattgccataaaactggtgccgcctatgaaactcagccttgagcaatctatggattttatcgccgaagatgagctggttgaggtcactcccaaaagtatccgcctgcggaagaagatactggataccgaaatgagacttagggctcgcaaacgcactgaaagtaattag

SEQ ID NO: 3692 - protein, 609 aa, Dehalococcoides ethenogenes 195
MENYQRTDIRNIAIIAHVDHGKTSLVDVMLKQSRIFRENQHVGELIMDRNTLEREKGITILAKNTAITYRGVKINIIDTPGHADFSGEVERVLNMADGCLLVIDSIDGPMPQTRFVLKEAMQKKLKPIVVINKIDRENARPEIVLGLVQDLFLELATTEEQLDFPVVYTSAREGYAVNTPGTKSTDLIPLFECILDKIPPPSIAQGEFQMLISNLDYDTHKGRIAIGRIQRGKICSHDRVVNIDSQNKAHPFEVGQVFTFMGLGKQEVECAEAGEIVAITGLENASIGDTVTSPLQPEALPRIEIGEPTVRMTFGVNTSPFGGREGKFCTSRQLRERLFRELETNIGLRVEETDSPDSFLISGRGELHLSILVETMRREGYEFEISKPEAITKDINGKVYEPVETLTIDVREDFVGEVTELLGKRQARMTDMHNDGEGNVRLEYNIPTRGLIGFRNSFLTATRGTGVLNSQFLDFQPWCGEIEQSRTGALVAAEAGLSCTYGLNNSQERGILMIDANVPVYEGMIVGLHARGLDLAVNVCKQKKMTNIRSSTSDIAIKLVPPMKLSLEQSMDFIAEDELVEVTPKSIRLRKKILDTEMRLRARKRTESN

SEQ ID NO: 3693 - DNA, 1848 bp, Staphylococcus aureus subsp. aureus COL
  CDS (1)..(1848): transl_table=11
atgactaataaaagagaagatgtccgcaatatagcaattattgctcacgttgaccatggtaaaacaactttagtagatgagttgttaaaacaatctggtatattcagagaaaatgaacatgtcgatgaacgtgcaatggactctaacgatatcgaaagagagcgtggaattacgattctagccaaaaatacggctgttgattataaaggtacacgtattaatattttggatacaccaggacatgcagactttggtggagaagtagaacgtattatgaaaatggttgatggggttgtcttagtagtagatgcgtatgaaggtacaatgcctcaaacacgttttgtacttaaaaaagcgctagaacaaaacctgaaacctgttgttgttgttaataaaattgataaaccatcagcacgtccagagggtgttgtagatgaagttttagatttatttattgaattagaagcaaacgatgaacaattagaattccctgttgtttatgcttcagcagtaaatggtacagctagcttagatcctgaaaagcaagatgataatttacaatcattatatgaaacaattattgattatgtaccagctccaattgataacagtgatgagccattacaattccaagtagcattgttggactacaatgattatgttggacgtattggtattggtcgtgtattcagaggtaaaatgcgtgtcggagataatgtatcactaattaaattagacggtacagtgaaaaacttccgtgtaactaaaatctttggttactttggattaaaacgtttagaaattgaagaagcacaagctggagatttaattgctgtttcaggtatggaagacattaatgttggtgaaactgtaacaccacatgaccatcaagaagcattgccagttctacgtattgatgagcctactcttgaaatgacatttaaagttaacaattctccatttgctggccgtgaaggtgactttgtaacagcacgtcaaattcaagaacgtttaaatcaacaattagaaacagatgtatctttgaaagtttctaacacagattctccagatacatgggtagttgctggtcgcggtgaattgcatttatcaatccttattgaaaatatgcgtcgtgaaggttatgaattacaagtttcaaaaccacaagtaattattaaagaaatagatggtgtaatgtgtgaaccatttgaacgtgtgcaatgtgaagtgccacaagaaaatgcaggtgctgttattgaatcattaggtgcacgtaaaggtgaaatggttgatatgactacaactgataatggacttacacgtttaatctttaatgtaccggctcgtggtatgattggttatacgactgaatttatgtcaatgacaagaggttacggtattattaaccatacatttgaagaatttagaccacgtattaaagcacaaattggcggtcgtcgtaatggtgcattaatttcaatggatcaaggttctgcaagtacttatgccattttgggacttgaagatagaggtgtaaacttcatggaacctggtactgaagtttatgaaggtatgattgttggtgaacataatcgtgaaaatgatttaactgttaacatcactaaaacaaaacatcaaactaacgtacgttctgcaacgaaagaccaaacacaaacaatgaatagaccgcgtattctaacattggaagaagcgttacaattcattaatgatgatgaacttgttgtggttacaccagaaagtatacgtttaagaaagaaaattttaaacaaaaatgttcgtgaaaaagaagcaaagcgtatcaaacaaatgatgcaagaaaacgaataa

SEQ ID NO: 3694 - protein, 615 aa, Staphylococcus aureus subsp. aureus COL
MTNKREDVRNIAIIAHVDHGKTTLVDELLKQSGIFRENEHVDERAMDSNDIERERGITILAKNTAVDYKGTRINILDTPGHADFGGEVERIMKMVDGVVLVVDAYEGTMPQTRFVLKKALEQNLKPVVVVNKIDKPSARPEGVVDEVLDLFIELEANDEQLEFPVVYASAVNGTASLDPEKQDDNLQSLYETIIDYVPAPIDNSDEPLQFQVALLDYNDYVGRIGIGRVFRGKMRVGDNVSLIKLDGTVKNFRVTKIFGYFGLKRLEIEEAQAGDLIAVSGMEDINVGETVTPHDHQEALPVLRIDEPTLEMTFKVNNSPFAGREGDFVTARQIQERLNQQLETDVSLKVSNTDSPDTWVVAGRGELHLSILIENMRREGYELQVSKPQVIIKEIDGVMCEPFERVQCEVPQENAGAVIESLGARKGEMVDMTTTDNGLTRLIFNVPARGMIGYTTEFMSMTRGYGIINHTFEEFRPRIKAQIGGRRNGALISMDQGSASTYAILGLEDRGVNFMEPGTEVYEGMIVGEHNRENDLTVNITKTKHQTNVRSATKDQTQTMNRPRILTLEEALQFINDDELVVVTPESIRLRKKILNKNVREKEAKRIKQMMQENE

SEQ ID NO: 3695 - DNA, 1848 bp, Staphylococcus epidermidis RP62A
  CDS (1)..(1848): transl_table=11
atgactaatttaagagaagatgttcgtaatatagcgattattgcgcatgtcgaccatggtaaaacaacattagtagaccagttgcttaaacaatcaggtatatttcgtgaaaacgaacatgtcgacgagcgtgcaatggactctaatgatttagaaagagaacgtggtattacgattcttgctaagaatacagcgatagattataaaggaacgcgtatcaatatattagacacacctggccacgccgattttggtggtgaagttgaacgtatcatgaaaatggttgacggtgtcgtactagtggttgacgcatatgaaggtacaatgcctcaaactcgttttgttcttaaaaaagctttagaacaaaacttaaaaccggttgtagttgtgaataaaattgataaaccagctgctagacctgagggagttgtagatgaagtattagacttattcattgaattggaagcgaatgatgagcaattagacttcccagttgtttatgcttcagctgtgaatggaacagcaagtttagactctgaaaagcaagacgaaaatatgcaatccctatacgagacgattattgactatgtaccggcaccagtagataattcagatgaaccattacaattccaaattgctttactagattataatgattatgtaggtcgtataggcgttggacgtgtgttcagaggtaaaatgcgtgtaggtgataatgtatcactaattaaattagatggtacagttaagaactttcgtgtgacgaaaatatttggttactttggtcttaaacgtgaagaaattgaagaagcacaagcaggagacttaatagctgtttcaggtatggaagatattaacgttggtgaaacagttacaccacatgatcatcgtgacccattaccggtgttacgtattgatgaaccaaccctagaaatgacttttaaagtaaataactctccgtttgctggacgtgaaggtgattatgtaacagctcgacaaattcaagaaagattagatcaacaacttgaaacagatgtttctttaaaagttacacctactgatcaaccagattcatgggttgttgctggtcgtggtgaactacacttgtctattcttattgaaaacatgagacgtgaaggctttgaattacaggtttctaaacctcaagttattttaagagaaatcgatggtgtgttaagtgaaccatttgagcgtgtacaatgtgaagtgccttctgaaaatgccggggcagtgattgagtcattaggtgcacgaaaaggtgaaatgttagatatgatgacgaccgacaatggtttgacgcgtttaatctttatggtacctgcacgcggtatgattggttatactactgaatttatgtctatgacacgaggttatggaattattaaccatacatttgaagaatttagacctcgcgttaaagctcaaatcggtggtagacgtaacggtgcattgatttctatggaccaaggtcaagcaacatcttatgcgattattaacttagaagatcgtggtgttaactttatggaaccaggtactgaagtatatgaaggtatgattgttggtgaacataaccgtgagaacgatttaacagtaaatattactaaagcaaagcatcaaacaaacgtacgttcagctactaaagatcaaacacaaacgatgaatcgtcctagaattttaacattagaagaagcgttacaatttatcaatgatgatgaattggtggaagtaactcctgaaagtattcgcttaagaaagaaaatacttaataaatctgcccgtgaaaaagaagcaaaaagagttaaacaattaatgcaagacgaacaataa

SEQ ID NO: 3696 - protein, 615 aa, Staphylococcus epidermidis RP62A
MTNLREDVRNIAIIAHVDHGKTTLVDQLLKQSGIFRENEHVDERAMDSNDLERERGITILAKNTAIDYKGTRINILDTPGHADFGGEVERIMKMVDGVVLVVDAYEGTMPQTRFVLKKALEQNLKPVVVVNKIDKPAARPEGVVDEVLDLFIELEANDEQLDFPVVYASAVNGTASLDSEKQDENMQSLYETIIDYVPAPVDNSDEPLQFQIALLDYNDYVGRIGVGRVFRGKMRVGDNVSLIKLDGTVKNFRVTKIFGYFGLKREEIEEAQAGDLIAVSGMEDINVGETVTPHDHRDPLPVLRIDEPTLEMTFKVNNSPFAGREGDYVTARQIQERLDQQLETDVSLKVTPTDQPDSWVVAGRGELHLSILIENMRREGFELQVSKPQVILREIDGVLSEPFERVQCEVPSENAGAVIESLGARKGEMLDMMTTDNGLTRLIFMVPARGMIGYTTEFMSMTRGYGIINHTFEEFRPRVKAQIGGRRNGALISMDQGQATSYAIINLEDRGVNFMEPGTEVYEGMIVGEHNRENDLTVNITKAKHQTNVRSATKDQTQTMNRPRILTLEEALQFINDDELVEVTPESIRLRKKILNKSAREKEAKRVKQLMQDEQ

SEQ ID NO: 3697 - DNA, 1812 bp, Neisseria gonorrhoeae FA 1090
  CDS (1)..(1812): transl_table=11
atgaaacaaatccgcaacatcgccatcatcgcacacgtcgaccacggcaaaaccacattggtcgaccaactgctgcgccaatccggcacattccgcgccaaccagcaggttgacgagcgcgtgatggacagcaacgaccttgaaaaagaacgcggcatcaccatcctcgccaaaaacaccgccatcgattacgaaggctgccacatcaatatcgtcgacacgccgggacacgccgacttcggcggcgaagtggagcgcgttttggggatggtggattgcgtcgtcttgttggtggacgcacaggaaggtccgatgccgcaaacccgtttcgtgaccaaaaaagccttggctttggggctgaaaccgattgtcgtcatcaacaaaatcgacaaaccgtccgcccgtccgagctgggttatcgaccagactttcgagttgttcgacaacttgggtgcgaccgacgagcagttggatttcccgattgtttacgcttcaggtttgagcggctttgccaagctggaagaaaccgacgagagcagcgatatgcgcccgctgttcgacaccatcctaaaatacacgcctgcaccgagcggcagcgcggacgagccgctgcaactgcaaatttcccaactcgactacgacaactacaccggccgcctcggtatcggtcgtatcttgaacggacgcatcaaacccggccaaaccgttgccgtgatgaaccacgagcagcaaatcgcccaaggccgcatcaaccagcttttgggtttcaaaggcttggaacgcgtgccgcttgaagaagccgaagccggcgacattgtgattatttccggtatcgaagacatcggcatcggcgtaaccatcaccgacaaagacaaccccaaaggcctgccgatgttgagcgtggacgaaccgacgctgacgatggactttatggtaaacaccagcccgctcgcaggtacagaaggcaaattcgtgaccagccgccaaatccgcgaccgcctgcaaaaagaattgctgaccaacgttgccctgcgcgtggaagacaccgccgatgccgacgtgttccgcgtatccgggcgcggcgaactgcacctgacgattttgctggaaaatatgcgccgcgaaggctacgaactcgccgtcggcaagccgcgcgtcgtgtaccgagacatcgacggtcaaaaatgcgaaccttatgaaaacctgactgtggacgtacccgacgacaaccaaggcgcggtaatggaagaactcggccgccgccgtggcgaactgaccaatatggaaagcgacggcaacggacgcacccgcctcgaataccatattccagcgcgcggcttgatcggtttccaaggcgaattcatgaccctgacgcgcggcgtcgggctgatgagccacgtgttcgacgactacgcgcccgtcaaacccgatatgcccggccgccacaacggcgtactggtgtcccaagagcagggcgaggcggttgcttacgccttgtggaatcttgaagaccgcggccgtatgttcgtatcgcccaacgacaaaatctacgaaggtatgattatcggcatccacagccgcgacaacgatttggtggtcaacccgctcaaaggcaaaaaactcaccaatatccgtgccagcggtaccgacgaagcggtgcgcctgaccacgccgatcaaactgacgctggaaggcgcggtcgagtttatcgacgatgacgagctggtggaaatcacgccgcaatccatccgcctgcgcaagcgttacctgagcgaattggaacgccgccgtcattttaaaaagctggattaa

SEQ ID NO: 3698 - protein, 603 aa, Neisseria gonorrhoeae FA 1090
MKQIRNIAIIAHVDHGKTTLVDQLLRQSGTFRANQQVDERVMDSNDLEKERGITILAKNTAIDYEGCHINIVDTPGHADFGGEVERVLGMVDCVVLLVDAQEGPMPQTRFVTKKALALGLKPIVVINKIDKPSARPSWVIDQTFELFDNLGATDEQLDFPIVYASGLSGFAKLEETDESSDMRPLFDTILKYTPAPSGSADEPLQLQISQLDYDNYTGRLGIGRILNGRIKPGQTVAVMNHEQQIAQGRINQLLGFKGLERVPLEEAEAGDIVIISGIEDIGIGVTITDKDNPKGLPMLSVDEPTLTMDFMVNTSPLAGTEGKFVTSRQIRDRLQKELLTNVALRVEDTADADVFRVSGRGELHLTILLENMRREGYELAVGKPRVVYRDIDGQKCEPYENLTVDVPDDNQGAVMEELGRRRGELTNMESDGNGRTRLEYHIPARGLIGFQGEFMTLTRGVGLMSHVFDDYAPVKPDMPGRHNGVLVSQEQGEAVAYALWNLEDRGRMFVSPNDKIYEGMIIGIHSRDNDLVVNPLKGKKLTNIRASGTDEAVRLTTPIKLTLEGAVEFIDDDELVEITPQSIRLRKRYLSELERRRHFKKLD

SEQ ID NO: 3699 - DNA, 1800 bp, Bacteroides fragilis NCTC 9343
  CDS (1)..(1800): transl_table=11
atgcaaaatattcgaaacattgcaattattgcccatgttgaccatgggaaaacgactctcgtcgataaaatgcttttagccggaaacttgtttcgcggcaaccaaacaagcggagaattaattctggataacaacgacttggagcgtgaacgagggataacgatcctctctaaaaacgtttctatcaattacaacggaactaagattaatattattgatactccgggacacagcgacttcggtggcgaagtagagcgtgtgctcaacatggccgacggatgcattctgttggttgatgcttttgaaggcccgatgccgcaaacgcgctttgtgctgcagaaagctttggaaatcggattgaaaccgattgttgttattaataaggtagacaaaccgaactgtcgtccggacgaagtacacgagatggtcttcgacctgatgttcagcctggatgctaccgaagagcaacttgattttccgacaatctatggttcggccaagaataactggatgagtacggactggaaagagcagacggacagtattgtgcctttgctggattgtattgtagagaacattcctgctccggagcaattggagggtactcctcagatgctgatcacttcacttgactattcttcatatacaggccgtattgctgtagggcgtgttcatcgtggtacactgaaagaaggcatgaacgtgtctttggctaagcgtgacggcagcattgtgaaatctaagattaaagaggttcatgtattcgaagggctgggtcgtgtgaagacgactgaggtctcttcgggagatatttgcgctttggtaggtattgacggattcgagatcggagatacgatctgtgattatgaaactccggaagcattgccacctattgctatcgatgaaccgactatgagtatgctgtttgccatcaacgactctccgttctatggtaaagatggtaaatttgtaacttcacgtcatatccatgatcgcctgaccaaggaattggataagaatctggctttgcgcgtacgtaagagcgaagaagacggtaaatgggttgtatcaggccgtggtgtgcttcacctttctgtcttgatcgaaaccatgcgtcgcgaaggttacgagttacaggtcggacagccgcaagtaatctataaagaaatagatggagtaaaatgtgaaccgattgaggagcttacgattaacgtacctgaagaatattcaagtaagatcatcgatatggtaacccgccgtaaaggtgagatgactatgatggagaataccggtgaacgcatcaaccttgaatttgatatgccttcgcgtggtatcatcggtcttcgtacgaatgttctgacggcttcggcaggtgaggctatcatggcacaccgctttaaggaatatcagccgttcaaaggagacatagaacgtcgtaccaatggttcgattatcgctatggagagtggtactgcatttgcttatgctatcgacaaattgcaggatcgtggtaaattctttattttccctcaggaagaggtgtatgcaggtcaggtagtgggtgagcatgctcacgaaaaagatttggttgtaaatgtgactaagtcgaagaagttgactaatatgcgtgcttccggttctgacgagaaagcccgtttgattcctcctgtacagttctctcttgaagaggccttggaatacattaaggaagacgaatatgtagaagttactccgaaagcaatgcgtatgcgtaaggttattctggatgaaactgaacgtaaacgcgccaataagagctaa

SEQ ID NO: 3700 - protein, 599 aa, Bacteroides fragilis NCTC 9343
MQNIRNIAIIAHVDHGKTTLVDKMLLAGNLFRGNQTSGELILDNNDLERERGITILSKNVSINYNGTKINIIDTPGHSDFGGEVERVLNMADGCILLVDAFEGPMPQTRFVLQKALEIGLKPIVVINKVDKPNCRPDEVHEMVFDLMFSLDATEEQLDFPTIYGSAKNNWMSTDWKEQTDSIVPLLDCIVENIPAPEQLEGTPQMLITSLDYSSYTGRIAVGRVHRGTLKEGMNVSLAKRDGSIVKSKIKEVHVFEGLGRVKTTEVSSGDICALVGIDGFEIGDTICDYETPEALPPIAIDEPTMSMLFAINDSPFYGKDGKFVTSRHIHDRLTKELDKNLALRVRKSEEDGKWVVSGRGVLHLSVLIETMRREGYELQVGQPQVIYKEIDGVKCEPIEELTINVPEEYSSKIIDMVTRRKGEMTMMENTGERINLEFDMPSRGIIGLRTNVLTASAGEAIMAHRFKEYQPFKGDIERRTNGSIIAMESGTAFAYAIDKLQDRGKFFIFPQEEVYAGQVVGEHAHEKDLVVNVTKSKKLTNMRASGSDEKARLIPPVQFSLEEALEYIKEDEYVEVTPKAMRMRKVILDETERKRANKS

SEQ ID NO: 3701 - DNA, 1923 bp, Corynebacterium glutamicum ATCC 13032
  CDS (1)..(1923): transl_table=11
atgcccccagtgacccacccagagtttcgtaacgtagcgattgtcgcgcacgttgaccacggaaagaccacactcgttaatgccatgcttgaacagtctggcgtattcagtgaccacggtgaagtagccgaccgtgtgatggactccggtgacctggaaaaggaaaagggcatcaccatccttgccaagaacaccgcgattcgtcgtaaaggcgctggcaaggacggcaatgacctgattatcaacgtcattgacaccccaggccacgctgacttcggtggcgaagttgagcgcgcactgtccatggttgacggcgttgtccttctggttgacgcatctgaaggcccactgcctcagacccgattcgtgcttggcaaggctcttgctgcgaagatgccagtcatcattgctgtgaacaagactgaccgccctgacgctcgtattgacgaggttgttgaagaggcacaggatctgcttcttgagctcgcatctgcacttgatgatgaagaagcagcacaggcagctgagcagcttcttgatctgccagttctgtacacctccggtcgtgagggcaaggcttccactgagaacccaggcaacggcaacgttcctaattccccagatctgatgcctttgtttgagaccctctacgaggttctcccagagccaaccgctgacattgatggccctctgcaggctcacgtcaccaaccttgactcttcctccttccttggtcgtatcggcctggttcgcgttcacgcaggtaccttgcgtaagggccagcaggttgcatggattcactacgatgaagaaggtaaccagcacaccaagaccgctaagatcgcagagcttctggctaccgttggcgttgcccgcgttcctgctaccgaagttgttgcaggtgacatcgctgctatctccggcatcgaagacatcatgattggcgataccctcgcggatcctgagaacccagttgcactgcctcgcatcaccgttgatgagccagcactgtccatgaccatcggtgtgaacacctcaccaatggctggtcgtggcggcggagacaagctgaccgcacgtgtggtcaaggctcgtcttgagaacgaactgatcggtaacgtgtccctgaaggtcaacccaactgagcgcccagatacctgggaagttcagggtcgtggcgaaatggctctgtccatcctcgttgagaccatgcgtcgcgaaggcttcgagctcaccgttggtaagccacaggttgttacccagaccatcgacggcaagctgcacgagccttacgagatcatcgtcatcgacgttccttccgagtaccagggcaacgtgacccagctgctggctacccgcaagggcctcatgcagtccatgtccaccaccccaggttccgactggatccgcatggaattccgtattcctgctcgtggcctgattggtttccgtacccagttcatgactgaaacccgtggtaccggtatcgctaactcctactctgacggcatggatgtttgggctggcgaaatcaagggccgcgcacacggttccttggttgctgaccgttccggccagatcaccgcttacgctctgacccagctggcagaccgtggtagcttcttcgttgagccaggcactgagacctacgaaggtgtcgttgttggtctgaacaaccgtgaagaagacatggacatcaacccaaccaaggaaaagaagctcaccaacatgcgtgcagcttccgcagacaccactgtcaccttggctaaggctcggtctctctccttggatgaggcactggagttctgtggcgtcgacgagtgcgtcgaggttacccctgatgttctgcgcatccgcaaggtcatcctgaacgctactgagcgtggccgtgcacgttcccgtgcgaagagcctgaacaagtaa

SEQ ID NO: 3702 - protein, 640 aa, Corynebacterium glutamicum ATCC 13032
MPPVTHPEFRNVAIVAHVDHGKTTLVNAMLEQSGVFSDHGEVADRVMDSGDLEKEKGITILAKNTAIRRKGAGKDGNDLIINVIDTPGHADFGGEVERALSMVDGVVLLVDASEGPLPQTRFVLGKALAAKMPVIIAVNKTDRPDARIDEVVEEAQDLLLELASALDDEEAAQAAEQLLDLPVLYTSGREGKASTENPGNGNVPNSPDLMPLFETLYEVLPEPTADIDGPLQAHVTNLDSSSFLGRIGLVRVHAGTLRKGQQVAWIHYDEEGNQHTKTAKIAELLATVGVARVPATEVVAGDIAAISGIEDIMIGDTLADPENPVALPRITVDEPALSMTIGVNTSPMAGRGGGDKLTARVVKARLENELIGNVSLKVNPTERPDTWEVQGRGEMALSILVETMRREGFELTVGKPQVVTQTIDGKLHEPYEIIVIDVPSEYQGNVTQLLATRKGLMQSMSTTPGSDWIRMEFRIPARGLIGFRTQFMTETRGTGIANSYSDGMDVWAGEIKGRAHGSLVADRSGQITAYALTQLADRGSFFVEPGTETYEGVVVGLNNREEDMDINPTKEKKLTNMRAASADTTVTLAKARSLSLDEALEFCGVDECVEVTPDVLRIRKVILNATERGRARSRAKSLNK

SEQ ID NO: 3703 - DNA, 1821 bp, Pseudomonas syringae pv. syringae B728a
  CDS (1)..(1821): transl_table=11
gtgatcgaaaatctacgtaacatcgccatcattgctcacgttgaccatggtaagaccaccctggtagacaaactcctgcgtcaatccggcactctggagcgcggcgagctcaacgacgaacgcgtgatggactccaacgaccaggagaaagagcgcggtattaccattctcgcgaagaacaccgcgatcaactggaatggctaccacatcaacatcgtggacaccccgggccacgccgacttcggtggtgaagtagagcgcgtgatgtcgatggtcgactccgtactgctgctggtcgatgcccaggacggccctatgccgcaaacccgtttcgtgaccaagaaggctttcgaagccggcctgcgtccgatcgtggtcatcaacaaggttgaccgtccaggcgcacgtccggactgggttctggaccagatcttcgacctgttcgacaacctgggtgccactgaagaacagctggacttcaaagtcgtctacgcctcggccctgaacggcattgccggtctggaacacaccgccatggctgaagacatgaccccgctgtaccaggcgatcgtcgatcacgtccctgcgccaaaggttgaccgtgacggtccgttccagatgcagatttccgcactggattacaacagcttcctgggcgtcatcggtgttggccgtatcgctcgtggtcgcgtcaagccgaacactccggtggttgccattgacgtcaacggcaagaagcgtaacggccgtatcctgaaactgatgggtcaccacggtctgcaccgcatcgacgttgaagaagcagctgccggcgacatcgtctgcatcagcggcttcgaccagctgttcatctccgacactctgtgcgacccactgaacgtcgaagcgatgaagccgctgaccgttgacgaacctaccgtttcgatgaccttccaggttaacgattcgccgttctgcggtaaggaaggcaagttcgtcaccagccgtaacatcaaggagcgtctggacaaggaactgctctacaacgttgctctgcgcgttgaagaaggcgacaccgccgacaagttcaaggtctccggccgtggtgagctgcacctctcagtactgatcgaaaccatgcgtcgcgaaggcttcgaaatgggtgttggtcgtcctgaagtgatcatccgcatggttgacggcgtcaagcacgaaccgtacgaaaacgtcaccatcgacctgcctgaagaagcgcagggcgcgatcatggagcaaatgggtaaccgtaaaggcgacctgaccaacatggttccggatggcaagggccgtgtgcgccttgagtacaacatcccggcacgtggcctgatcggtttccgtaacgagttcctgaccctgacttccggcgcaggcatcctgaccagcatcttcgaccgttacgacgtgatgaagtcgggcgacatgtccggccgtcagaacggcgttctggtttcggttgctaccggcaaggcgctgacctactccctggaaacactgcaagcccgtggcaagctgttcctgggtcatggcgaagacgtgtacgaaggtcagatcgtcggcatcaacagccgcgacaacgacctgggtgtcaacccaaccaaaggcaagaagctcgacaacatgcgtgcttccggtaaagacgaaaccatcgctctggttccgcctatccgtttcactctggaacaagcgctggaattcgtacaagaagacgaactctgcgaagtgacgccaaagtcgatccgcctgcgtaagaaaatccttggtgaaagcgagcgtactcgtgctgccaagaagtcgggcaactga

SEQ ID NO: 3704 - protein, 606 aa, Pseudomonas syringae pv. syringae B728a
MIENLRNIAIIAHVDHGKTTLVDKLLRQSGTLERGELNDERVMDSNDQEKERGITILAKNTAINWNGYHINIVDTPGHADFGGEVERVMSMVDSVLLLVDAQDGPMPQTRFVTKKAFEAGLRPIVVINKVDRPGARPDWVLDQIFDLFDNLGATEEQLDFKVVYASALNGIAGLEHTAMAEDMTPLYQAIVDHVPAPKVDRDGPFQMQISALDYNSFLGVIGVGRIARGRVKPNTPVVAIDVNGKKRNGRILKLMGHHGLHRIDVEEAAAGDIVCISGFDQLFISDTLCDPLNVEAMKPLTVDEPTVSMTFQVNDSPFCGKEGKFVTSRNIKERLDKELLYNVALRVEEGDTADKFKVSGRGELHLSVLIETMRREGFEMGVGRPEVIIRMVDGVKHEPYENVTIDLPEEAQGAIMEQMGNRKGDLTNMVPDGKGRVRLEYNIPARGLIGFRNEFLTLTSGAGILTSIFDRYDVMKSGDMSGRQNGVLVSVATGKALTYSLETLQARGKLFLGHGEDVYEGQIVGINSRDNDLGVNPTKGKKLDNMRASGKDETIALVPPIRFTLEQALEFVQEDELCEVTPKSIRLRKKILGESERTRAAKKSGN

SEQ ID NO: 3705 - DNA, 1878 bp, Pseudomonas fluorescens Pf-5
  CDS (1)..(1878): transl_table=11
ttgttaatcgctgccagcatttgtcagcacaccgaatcctctgatcgagatacacaagtgatcgaaaatctacgcaacatcgccatcattgcccacgttgaccatggtaagaccaccctggtagacaaactcctgcgtcaatccggcaccctggaacgcaacgagctcaacgacgagcgcgtgatggactccaacgaccaggaaaaagagcgcggcattaccatcctggcgaaaaacaccgccatcaactggaacggctaccacatcaacatcgtggacaccccgggccacgccgacttcggcggcgaagttgagcgcgtaatgtccatggtcgactccgtgctgctgctggtcgacgctcaagacggccctatgccgcaaacccgtttcgtgaccaagaaggctttcgaagccggcctgcgtccaatcgtggtgatcaacaaggtcgaccgtccgggcgcgcgtcctgactgggttctggaccagatcttcgacctgttcgacaacctgggcgccaccgaagaacagctggacttcaaagtcgtctacgcctcggccctgaacggcatcgccggtatggaccacaccgaaatggccgaagacatgaccccgctgtaccagtcgatcgtcgacaacgtgccagcgccaagcgttgaccgtgacggtccgttccagatgcagatctccgctctggactacaacagcttcctgggtgtgatcggcgttggccgtatcgctcgcggtcgcgtcaagcccaacaccccggtagtggccatcgacgtcgacggcaagcgccgcaacggtcgtatcctcaagctgatgggccaccacggtctgcaccgcgtagacgttgaagaagccgctgccggcgacatcgtctgcatcagcggtttcgacgagctgttcatctccgacaccctgtgcgacccgaccgctgttgaagcgatgaagccgctgaccgtcgacgagccaaccgtttccatgaccttccaggtcaacgactcgccattctgcggtaaagaaggcaagttcgtgacctcccgtaacatcaaggagcgtctggacaaggagctgctgtacaacgttgctctgcgtgtcgaagaaggcgactcggccgacaagttcaaggtttccggccgtggtgagctgcacctgtcggtactgatcgaaaccatgcgtcgcgaaggtttcgaaatgggcgttggccgtcctgaagtgatcatccgtgaagttgacggcgtgaagcaggaaccgttcgaaaacgtcaccatcgacatccctgaagattcccagggcaaggtcatggaagaaatgggcctgcgtaagggcgacctgagcaacatggttccggatggcaagggccgtgtacgcctggaatacaacattccagcccgtggtctgatcggtttccgtaaccagttcctgaccctgaccaacggtgcaggcatcctgacctcgatcttcgatcgctacgctccgatgaagtccggccacatgtccggccgtcagaacggcgtactggtatcggtagaaaccggcaaggccctgacctactccctggaaaccctgcaggcgcgcggcaagctgttcgtcgagcacggccaggaaatctacaacggtcagatcgttggtctgaacagccgtgacaacgacctgggtgtgaacccaaccaaaggcaagaagctcgacaacatgcgtgcttcgggcaaggacgaaaccatcgccctggttccaccggtccgtttcaccctggaacaggctctggaattcatccaggacgacgagctgtgtgaagtgacgcctaagtccatccgtcttcgcaagaagatcctggacgaaggcgagcgtactcgcgctgccaagaaagccaagaactga

SEQ ID NO: 3706 - protein, 625 aa, Pseudomonas fluorescens Pf-5
MLIAASICQHTESSDRDTQVIENLRNIAIIAHVDHGKTTLVDKLLRQSGTLERNELNDERVMDSNDQEKERGITILAKNTAINWNGYHINIVDTPGHADFGGEVERVMSMVDSVLLLVDAQDGPMPQTRFVTKKAFEAGLRPIVVINKVDRPGARPDWVLDQIFDLFDNLGATEEQLDFKVVYASALNGIAGMDHTEMAEDMTPLYQSIVDNVPAPSVDRDGPFQMQISALDYNSFLGVIGVGRIARGRVKPNTPVVAIDVDGKRRNGRILKLMGHHGLHRVDVEEAAAGDIVCISGFDELFISDTLCDPTAVEAMKPLTVDEPTVSMTFQVNDSPFCGKEGKFVTSRNIKERLDKELLYNVALRVEEGDSADKFKVSGRGELHLSVLIETMRREGFEMGVGRPEVIIREVDGVKQEPFENVTIDIPEDSQGKVMEEMGLRKGDLSNMVPDGKGRVRLEYNIPARGLIGFRNQFLTLTNGAGILTSIFDRYAPMKSGHMSGRQNGVLVSVETGKALTYSLETLQARGKLFVEHGQEIYNGQIVGLNSRDNDLGVNPTKGKKLDNMRASGKDETIALVPPVRFTLEQALEFIQDDELCEVTPKSIRLRKKILDEGERTRAAKKAKN

SEQ ID NO: 3707 - DNA, 1848 bp, Psychrobacter arcticus 273-4
  CDS (1)..(1848): transl_table=11
atggcgaacgatatcaaacacctgcgtaacattgcaattattgcccacgttgaccacggtaaaactactttggttgataagctattacatcagtctggtacttttggtgaccgtgccaacattgctgagcgtgcaatggattcaggtgatattgagcaagaacgtggtattactattctggctaaaaatacagccattcgttggacagataacactgacggtacagaataccgtatcaacattgttgataccccaggtcacgccgactttggtggtgaagttgaacgtgtaatgtctatggttgactgcgtacttctagtcgttgatgcggttgatggtccaatgcctcagacccgttttgtgactcaaaaagcgttcgagcaaggtctaaaacctatcgttgtcatcaataaaattgaccgtcctggctcacgtcctgattgggtaatggatcaaatctttgatttgtttgataaccttggtgcgactgatgagcagttagatttcccagtggtatatgcctcagcattgaatggtattgctggtctagaagctgataacttagctgatgacatgacgccacttttcaaaactattgttgatgtggttcagcctcctcaagtggatgctgaagcacctttccgtatgcaaatctcaagccttgattacaacagcttcgttggtgttatcggtattggtcgtattcagcgcggtaaagtaaaaaccaatacacaagtgactgtcattgataaaaatggcaatactcgtaatggccgtattttgaaaattatgggttatcatggtcttgatcgtattgatgtagaagatgcgcaagcaggcgatatcgtttgtattactggtattgatgcactaaatatctctgatacgatttgtgatcctagcactgtcgaagcattaaagcctttgacggttgatgaacctactgtttcaatgaacttccaagtaaataactcaccttttgctggtcgtgacggcaaatttgtgacctcgcgtaacattcgtgaacgtcttgagcgtgaattgattcataacgtcgcattacgtgtagaagatacagagtctcctgataaattcaaagtatcaggtcgcggtgagcttcatctatctgtacttatcgaaaacatgcgccgtgaaggttttgagatgggtgtttcaggcccagaagttattgttaaagaagttgatggtaagctacaagagccgtatgaaaacgtggtcttcgatattgaagatgagcatcaaggttctatcatggagcagattggcttgcgtaaaggcgagatgaccaatatggaacttgatggtaaaggtcgtatgcgtattgaagcgactatgcctgcccgtggtttgattggtttccgctctgagttcttaaccttgacttcaggttcagggatcatgacgtcaagcttctcacattacggtccacaaaagattggtgatgttggtggtcgctcgaatggtgtgttggtttctatggcgaagggtgtttgcctaggttttgctctatttaacctacaaaaacgcggtaaattattcgctgagccacagcttgaagtttacgaaggtatgatcgttggtcttaactcacgtaacgatgacatggccgttaacccgacgactgctaagcagttaaccaacgtccgtgctagtggtactgatgaagcgctaacactaacgccagcagtcaagtttacgcttgagcaagcactagaattcatccaagatgatgaattggtagaagtaacgccaaaagcgattcgtctacgtaagcgctatttgactgaaagtgaacgtaagcgttatggtcgtaagaaaggtgcttaa

SEQ ID NO: 3708 - protein, 615 aa, Psychrobacter arcticus 273-4
MANDIKHLRNIAIIAHVDHGKTTLVDKLLHQSGTFGDRANIAERAMDSGDIEQERGITILAKNTAIRWTDNTDGTEYRINIVDTPGHADFGGEVERVMSMVDCVLLVVDAVDGPMPQTRFVTQKAFEQGLKPIVVINKIDRPGSRPDWVMDQIFDLFDNLGATDEQLDFPVVYASALNGIAGLEADNLADDMTPLFKTIVDVVQPPQVDAEAPFRMQISSLDYNSFVGVIGIGRIQRGKVKTNTQVTVIDKNGNTRNGRILKIMGYHGLDRIDVEDAQAGDIVCITGIDALNISDTICDPSTVEALKPLTVDEPTVSMNFQVNNSPFAGRDGKFVTSRNIRERLERELIHNVALRVEDTESPDKFKVSGRGELHLSVLIENMRREGFEMGVSGPEVIVKEVDGKLQEPYENVVFDIEDEHQGSIMEQIGLRKGEMTNMELDGKGRMRIEATMPARGLIGFRSEFLTLTSGSGIMTSSFSHYGPQKIGDVGGRSNGVLVSMAKGVCLGFALFNLQKRGKLFAEPQLEVYEGMIVGLNSRNDDMAVNPTTAKQLTNVRASGTDEALTLTPAVKFTLEQALEFIQDDELVEVTPKAIRLRKRYLTESERKRYGRKKGA

SEQ ID NO: 3709 - DNA, 1818 bp, Colwellia psychrerythraea 34H
  CDS (1)..(1818): transl_table=11
gtgttagataaattaagaaatgtggcaattattgctcacgttgaccacggaaaaaccactttagttgataaattattagagcagtctggtaccctagatacgcgtggcggtctagaagaacgtacgatggattcgaatgatatcgaaaaagaacgtggtatcacaatcttagctaaaaatacggctgttaactggaatggctaccgtgtaaacatcgtagatactcctggccatgctgattttggtggtgaagttgagcgtgtaatgtcaatggtagattcagttttacttattgttgatgcacaagaaggccctatgccacaaacgcgtttcgtaacgaaaaaagcgtttgctcaaggtttaaaaccaattcttgttattaacaaagttgataagcctggttctcgtcctgattgggttatggaccaagtttttgaattgtttgataaccttggcgctacagatgaacagcttgactttaaagttgtttacgcttcagcaatcaatggttgggcttcgttagaagaaggcgttactggcactgacatgactcctttatttgatactattattaaagaagttccacagccaatcgctgatccagagggtgcatttcaaatgcaaatctctcaacttgattacaactcgtacttaggtgtaattggcgttggtcgtattactcgtggttctgttaagccgaaccaacaagtaactatacaattagcaaacggcggcgttcataacgctaaagtaggtaaagtatttggttatttaggactagagcgccttgatatcgctgaaggttttgccggtgatattattgcaattactggtttaggcgaattaaagatttctgatactgtttgttgtccaacagaagttgaaggtttacctgcattatctgttgatgaaccaactatcaacatgacgttccaagtaaacacttcaccattttgtggtaaagaaggtaagtacgttacttcacgtaacatcaaagatcgtttagacaaagaattgattcataacgtagctttacgtgttgagcaattagaagatgctgataaatttaaagtatcaggtcgtggtgaacttcacttaggcattttaattgaaaacatgcgtcgtgaaggttttgaattagctgtatcacgtccagaagttattattcgtgaaattgatggtcagttacaagaaccatatgaaacagtaacgattgatgttgaagaacaacatcaaggacctatcatggagaagatgggtgttcgtaaagctgaattaacagatatggcaccagatggtactggccgtattcgtatggatttcatcatgccaagtcgtggtttgattggtttccaaactgaattcatgacattaacgtcaggctctggtttgatttatcatacattctttgaatacggacctcacaagggtggcgaaatcggccaacgtaaaaatggtgtaatgatcggtaatgcaacaggtaaagcattaactaacgctatctttaacttacaatctcgtggtcgtatgttaatcggacacggtgttgatatttatgaaggtcaagttattggtattcatagccgcgataacgatttaacagtaaatgcccttaaaggtaagcagttaactaacgttcgttcatcaggtactgatgaagcacaaacattaacgccacctattgttatgtctttagagcaagcattagaatttatcgataacgatgaattggtagaagttacaccagaaagcattcgtatacgtaaaaaattcttgaaagagaatgatcgtaaacgtgaaggtcgcggtgttaaataa

SEQ ID NO: 3710 - protein, 605 aa, Colwellia psychrerythraea 34H
MLDKLRNVAIIAHVDHGKTTLVDKLLEQSGTLDTRGGLEERTMDSNDIEKERGITILAKNTAVNWNGYRVNIVDTPGHADFGGEVERVMSMVDSVLLIVDAQEGPMPQTRFVTKKAFAQGLKPILVINKVDKPGSRPDWVMDQVFELFDNLGATDEQLDFKVVYASAINGWASLEEGVTGTDMTPLFDTIIKEVPQPIADPEGAFQMQISQLDYNSYLGVIGVGRITRGSVKPNQQVTIQLANGGVHNAKVGKVFGYLGLERLDIAEGFAGDIIAITGLGELKISDTVCCPTEVEGLPALSVDEPTINMTFQVNTSPFCGKEGKYVTSRNIKDRLDKELIHNVALRVEQLEDADKFKVSGRGELHLGILIENMRREGFELAVSRPEVIIREIDGQLQEPYETVTIDVEEQHQGPIMEKMGVRKAELTDMAPDGTGRIRMDFIMPSRGLIGFQTEFMTLTSGSGLIYHTFFEYGPHKGGEIGQRKNGVMIGNATGKALTNAIFNLQSRGRMLIGHGVDIYEGQVIGIHSRDNDLTVNALKGKQLTNVRSSGTDEAQTLTPPIVMSLEQALEFIDNDELVEVTPESIRIRKKFLKENDRKREGRGVK

SEQ ID NO: 3711 - DNA, 1965 bp, Pseudomonas syringae pv. phaseolicola 1448A
  CDS (1)..(1965): transl_table=11
gtgcccggggctgtttgcctgtggcttgcgtcaccggccccccgacaccagtcgtcatgccgtaacggcttttgccgactcgaaatagttaatcgctgccttataaacagtcagcagaccgaatcctctgatcgagatacacaagtgatcgaaaatctacgcaacatcgccatcattgctcacgttgaccatggtaagaccaccctggtagacaaactcctgcgccagtccggcacccttgagcgcaacgagctcaacgacgagcgcgtgatggactccaacgaccaggaaaaagagcgcggtattaccattctcgcgaagaacaccgcgatcaactggaatggctaccacatcaacatcgtggacaccccgggccacgccgacttcggtggtgaagtagagcgcgtgatgtcgatggtcgactccgtactgctgctggttgatgcccaggacggccctatgccgcaaacccgttttgtgaccaagaaggctttcgaagctggcctgcgtccaatcgtggtcatcaacaaggttgaccgtccaggcgcgcgtccggactgggttctggaccagatcttcgacctgttcgacaacctcggtgctaccgaagaacagctggacttcaaagtcgtctacgcctcggccctgaacggtattgccggtctggaacacaccgacatggctgaagacatgactccgctgtatcagtcgatcgtcgaccacgttcctgcgccaaaagttgaccgtgacggcccgttccagatgcagatctcggctctggactacaacagcttcctgggcgtcatcggtgttggccgtatcgctcgcggtcgcgtcaagcctaacaccccggttgttgctatcgatgccgaaggtaagaagcgcaccggtcgtatcctgaagctgatgggtcaccacggtctgcaccgtgtggacgttgaagaagcagctgccggcgatatcgtctgcatcagcggcttcgaccagctgttcatctccgacaccctgtgcgatccgctgaatgttgaagcgatgaagccgctgaccgtcgacgagccaaccgtttcgatgaccttccaggttaacgattcgccgttctgcggtaaggaaggcaagttcgtcaccagccgtaacatcaaggaacgtctggacaaggaactgctttacaacgttgccctgcgcgttgaagaaggcgacaccgccgacaagttcaaggtctccggccgtggtgagctgcacctctcggtactgatcgaaaccatgcgtcgcgaaggcttcgaaatgggtgttggtcgtccggaagtgatcatccgtcgcgtaggtgacgttaagcacgaaccgtacgaaaacgtgaccatcgacctgccggaagaatcccagggcgcgatcatggagcaaatgggtctgcgtaaaggcgacctgaccaacatggttccggatggcaagggccgtgttcgccttgagtacaacatcccggcccgcggcctgatcggtttccgtaacgagttcctgaccctcacctccggtgctggcatcctgacctcgatcttcgaccgttacgacgtgatgaagtccggcgacatgtccggccgtcagaacggcgttctggtttcggttgaaaccggcaaggcgctgacctactcactggaaaccctgcaagcgcgcggcaagctgttcgtcgagcacggtcaggaaatctacggtggtcagatcgttggtctgaacagtcgcgacaacgacctgggtgtgaaccctaccaaaggcaagaagctcgacaacatgcgtgcttcgggcaaagacgaaaccatcgctctggttccacctgtcaagttcacccttgaacaggctctggaattcatccaggacgacgagctgtgcgaagtaacgccgaagtccatccgtcttcgtaagaagatcctggacgaaagcgagcgtacccgcgctgccaagaaagccaaggcttga

SEQ ID NO: 3712 - protein, 654 aa, Pseudomonas syringae pv. phaseolicola 1448A
MPGAVCLWLASPAPRHQSSCRNGFCRLEIVNRCLINSQQTESSDRDTQVIENLRNIAIIAHVDHGKTTLVDKLLRQSGTLERNELNDERVMDSNDQEKERGITILAKNTAINWNGYHINIVDTPGHADFGGEVERVMSMVDSVLLLVDAQDGPMPQTRFVTKKAFEAGLRPIVVINKVDRPGARPDWVLDQIFDLFDNLGATEEQLDFKVVYASALNGIAGLEHTDMAEDMTPLYQSIVDHVPAPKVDRDGPFQMQISALDYNSFLGVIGVGRIARGRVKPNTPVVAIDAEGKKRTGRILKLMGHHGLHRVDVEEAAAGDIVCISGFDQLFISDTLCDPLNVEAMKPLTVDEPTVSMTFQVNDSPFCGKEGKFVTSRNIKERLDKELLYNVALRVEEGDTADKFKVSGRGELHLSVLIETMRREGFEMGVGRPEVIIRRVGDVKHEPYENVTIDLPEESQGAIMEQMGLRKGDLTNMVPDGKGRVRLEYNIPARGLIGFRNEFLTLTSGAGILTSIFDRYDVMKSGDMSGRQNGVLVSVETGKALTYSLETLQARGKLFVEHGQEIYGGQIVGLNSRDNDLGVNPTKGKKLDNMRASGKDETIALVPPVKFTLEQALEFIQDDELCEVTPKSIRLRKKILDESERTRAAKKAKA

SEQ ID NO: 3713 - DNA, 1842 bp, Dechloromonas aromatica RCB
  CDS (1)..(1842): transl_table=11
atgtccgctcgtccgatccgtaacatcgccatcatcgcccacgttgaccacggtaaaaccaccctggtcgaccagctgctccgccagtccggtacttttgctgctcaccaacaattggttgagtgcgttatggactccaatgacctggaaaaagagcgtggcatcacgatcctttccaagaacactgcggtcgagtatcagggcgtccacatcaacatcgttgataccccgggacacgcggacttcggtggtgaagtcgagcgcgtgctgggtatggttgatggtgtggtcctgctggtcgatgctgccgaaggcccgatgccgcaaacccgtttcgtgaccaagaaggcgctggccctcggcctgcgcccgatcgttctggtcaacaaggttgaccgcgatggcgccgatcccgatcaggccgtcaatctgaccttcgacctgttcgacaagctgggcgcgaccgacgagcaactcgatttcccgatcgtttacgcatccggcctcaatggctgggctgccatggagctggatcagccgcgcgaaaacatgattccgctgttcgacacgattctgcgccacgtgcccgccccggataccgatatcgaagcaccgctgcaactgcagattactgcgcttgattactcttcctacgtcggtcgtatcggcgttggcaagatcaatcgcggcaaggtcaagaccggtcagaacgtgctggtcatgttcggtaccgaagaagaagcggccgaacacgagcgcaccccgatcaaggccaagattggccaggttttcggctacaagggcctgaacaaggttgagctggaagaaggtcatgctggcgacatcgtccagattaccggcatcgaagacctggtgctcggctgcaccgtaaccgatccggagcaaccggaatccctgccgctgctgaagatcgacgagccgacgttgtccatgcagttcatggtcaacaccagcccgctggctggtaccgaaggcaagttcgtgactagccgtcagatccgcgatcgtctgcacaaggaactgctgaccaatatggccctgcgcgttcatgacaccggtaatggcgacgtgttcgacgtttcaggtcgtggcgaactgcacctcggcatcctgctcgagaacatgcgtcgcgaaggctacgagctggccgtcggccgtccgcgcgtcgtcaagaagaccatcaatggtgtcgagtgcgagccgtatgagttgctgaccgttgacgtcgaagaagacacccagggcggtgtcatggaaagccttggccagcgcaagggcgacctgacggacatggtgccagacggccgcggtcgcgtccgtatcgaataccgcattccggcccgtggtctgatcggcttccagggcgagttcatgaacttgacccgtggtaacggcctgatgagccacgttttcgacgaatatgccccggtcaaggatggcagcgttgccgagcgtcgcaacggcgtactgatctcccaggacaatggcgaagctgttgcctatgcactgtggaagctgcaggatcgcggccgcatgttcgttgtgccgggcgacaagctgtacgaaggcatgatcatcggtatccacagccgtgaaaacgacctcgtggttaacccgatcaagggcaagcagctgaccaacgttcgcgcctccggtacggacgaagctgttcgcctggtgccggccgtccagcttagcctggaagccgctgtcgagtttatcgaggaagacgaactggtcgagctgacgccgaagtcgattcgtttgcgcaagcgttatctgaccgagattgagcgcaagcgcgcggttcgcggcctgtaa

SEQ ID NO: 3714 - protein, 613 aa, Dechloromonas aromatica RCB
MSARPIRNIAIIAHVDHGKTTLVDQLLRQSGTFAAHQQLVECVMDSNDLEKERGITILSKNTAVEYQGVHINIVDTPGHADFGGEVERVLGMVDGVVLLVDAAEGPMPQTRFVTKKALALGLRPIVLVNKVDRDGADPDQAVNLTFDLFDKLGATDEQLDFPIVYASGLNGWAAMELDQPRENMIPLFDTILRHVPAPDTDIEAPLQLQITALDYSSYVGRIGVGKINRGKVKTGQNVLVMFGTEEEAAEHERTPIKAKIGQVFGYKGLNKVELEEGHAGDIVQITGIEDLVLGCTVTDPEQPESLPLLKIDEPTLSMQFMVNTSPLAGTEGKFVTSRQIRDRLHKELLTNMALRVHDTGNGDVFDVSGRGELHLGILLENMRREGYELAVGRPRVVKKTINGVECEPYELLTVDVEEDTQGGVMESLGQRKGDLTDMVPDGRGRVRIEYRIPARGLIGFQGEFMNLTRGNGLMSHVFDEYAPVKDGSVAERRNGVLISQDNGEAVAYALWKLQDRGRMFVVPGDKLYEGMIIGIHSRENDLVVNPIKGKQLTNVRASGTDEAVRLVPAVQLSLEAAVEFIEEDELVELTPKSIRLRKRYLTEIERKRAVRGL

SEQ ID NO: 3715 - DNA, 1953 bp, Thermobifida fusca YX
  CDS (1)..(1953): transl_table=11
atggcgggaggccgcggaagtcgcggtgccccctctgttttcccacaacacgatcgagactttcgcatgcctaccgccaccaccgcccacaacacggcccgccgcaccgacctgcgcaacatcgccatcgtcgcgcacgtcgaccacggcaaaaccaccctcgtggacgccatgctctggcagtccggggcgttccgcgccaaccaggacgtcgacgagcgggtcatggactccggtgatctggaacgcgagaagggcatcaccatcctcgccaagaacaccgcggtccgctacaccacgcccgccggcgagaacatcgtcatcaacatcgtcgacacccctggccacgccgacttcggcggggaagtggagcgcgggctgtccatggtggacggtgtgctgctgcttgtcgacgccagcgaagggcctctcccgcagacgcggttcgtgctgcgcaaagccctggctgcccagctcccggtgatcctcgtcatcaacaaggtggaccgcccggacagccggatcgccgaggtggtggacgacacctacgagctcttcctcgacctggacgccaccgaggagcagatcgacttccccatcgtctacgcgtgcgcccgcgaaggccgggcctccctcacccgccccgccgacggcagcctccccgacagcgacactctggaaccgctgttcaccaccatcctcgacacgattcccgcccccgcctacaccccgggcgcacccctccaagcccacgtcacgaacctggacgcgtccccgttcctgggccggctcgccctgtgccgcgtccaccagggagagatccgcaaaggccagcaggtcgcctggatccgcaccgacggcagcatcgagcacgtcaaagtcaccgaactgttcctgaccgaggcgttggaccgcaagcccgcggagaaagccgggcctggcgacatcattgcgatcgccggtatccccgacatcatgatcggggagaccctggccgacccggcggatccccggccgctgccgccgatcaccgtggacgagccagcgatctccatgacgatcggcacgaacacgtcgccgctcgtgggccgggtcaaaggcgcgaaggtcaccgcccgcctcgtcaaagaacgtctcgaccgggaactcgtcggcaacgtcagcctgcgcgtcctgcccaccgaccggcctgacacgtgggaggtgcaggggcgcggggagctggcgctggccatcctcgtcgagcagatgcgccgtgaaggctacgagctgaccgtgggcaaaccgcaggtcgtcaccaaggtcatcgacggccaggtccacgagcctgtggagcgcctcaccgtggacatccccgaggagtacctgggcgccgtcacccagctcctcaacatccgcaagggccgcatggagaccatgaccaaccatggcaccggatgggtccgcatggactggacggtgccgtcgcgcggcctcatcggcttccgcaccgagttcctcaccgagacgcgcggcaccggtatcgcccaccacgtcttcgacggttatgcgccgtggttcggcgagctccgcacgcgcgccactggatcgctggtcgccgaccgcagcggcaaagccaccgcctatgccatgttcggcctgcaggagcgaggcacgcttttcgtggagccgggcaccgaggtctacgagggcatggtggtcggcgagaactcccgtgccgacgacatcgacgtcaacatcaccaaggagcgcaaggtcagcaacgtgcgctcctccaccgccgaggagctcgaacgcctctccccgccgcgcaagctctccttggaggaggcgttggagttctgccgcgaggacgaatgcgtggaggtcaccccggaggcggtccgcatccgcaaagtcatcctcgaccagaaggagcgggcccgcatcctggcccaccgcaagcgccgctga

SEQ ID NO: 3716 - protein, 650 aa, Thermobifida fusca YX
MAGGRGSRGAPSVFPQHDRDFRMPTATTAHNTARRTDLRNIAIVAHVDHGKTTLVDAMLWQSGAFRANQDVDERVMDSGDLEREKGITILAKNTAVRYTTPAGENIVINIVDTPGHADFGGEVERGLSMVDGVLLLVDASEGPLPQTRFVLRKALAAQLPVILVINKVDRPDSRIAEVVDDTYELFLDLDATEEQIDFPIVYACAREGRASLTRPADGSLPDSDTLEPLFTTILDTIPAPAYTPGAPLQAHVTNLDASPFLGRLALCRVHQGEIRKGQQVAWIRTDGSIEHVKVTELFLTEALDRKPAEKAGPGDIIAIAGIPDIMIGETLADPADPRPLPPITVDEPAISMTIGTNTSPLVGRVKGAKVTARLVKERLDRELVGNVSLRVLPTDRPDTWEVQGRGELALAILVEQMRREGYELTVGKPQVVTKVIDGQVHEPVERLTVDIPEEYLGAVTQLLNIRKGRMETMTNHGTGWVRMDWTVPSRGLIGFRTEFLTETRGTGIAHHVFDGYAPWFGELRTRATGSLVADRSGKATAYAMFGLQERGTLFVEPGTEVYEGMVVGENSRADDIDVNITKERKVSNVRSSTAEELERLSPPRKLSLEEALEFCREDECVEVTPEAVRIRKVILDQKERARILAHRKRR

SEQ ID NO: 3717 - DNA, 1797 bp, Prochlorococcus marinus str. NATL2A
  CDS (1)..(1797): transl_table=11
atgagttttgatatacaagctattaggaatatcgcaataattgctcacgttgatcatggtaagacaactttggttgatgctcttttaaatcaatctggcacttttcgagataacgaagaagtcccaacttgtgcgttggattcgaatgaattggaacgtgaaagaggtataacaattctttcgaaaaacacagctgttacttataacgatactcggataaacattgttgatacaccagggcacgctgattttggaggagaagttgagagggttttgggaatggtagatggctgtcttcttgttgttgatgctaacgagggaccaatgccacaaactcgatttgttctgaaaaaagctttagagcaaggcttaagacctattgtgtttgtgaataaaattgatcgtgcaagggtagaaccagaaaccgcggtagacaaagttttagatctgtttttggagttaggcgctgatgatgatcaatgtgattttccttatctatttgggagtggattaggggggtttgccaagactgaagtaaaaagtgaaaacgataatatgaaacctttatttgaagcaattattagacaagttcctcctccagttggcgacgtgaaaaagcctttacaattacaagtcaccaccctagattactcagatttcttaggaacaattattatcggtagagtacataatggtgtaattaaaaacggccaaaggacttgtttgataaaggaagatgggagtttgaaaaaaggaaggattaataaattattaggatttaagggattaaaaagaattgaaatagaagaagcaaatgctggagatatagtcgccttagctggttttgatgaggtttctattggtgaaactgtagcctgccctgatgagccgaaacctttacctctaatcaaggttgatgagccaaccttgcagatgacttttgttgttaatgattctccttttgcggggaaagagggcaagttcgtaactagccggcagttgaaggatcgtttaaataaagaacttctaacgaatgttgctttaagagttgaagacacagattctcctgaccgtttttctgttagtggaaggggagagttacatctaggaattcttatagagacaatgagaagagaggggtatgaatttcaagtttctcaaccacaagtaattttcaggacaatagatgaaattaaatgtgaacctgttgaaacacttgtccttgatgtccctgaagcttctattggtgcttgtattgagagccttggggtaagaaaaggtgaaatgcaaaatatggaaactggtactgatcatcgaactcagcttgagtttgttatcccctcaagaggcttgattggatttaggggtgaatttattcgtgcaacaagaggtgaagggattatgagccattcattttttgaatacaggccatctgtaggagattttgagcaaaggagaaatggagtccttatctcatttgaagaaggtgtcgctactttctattccttaaagaatgcagaagaccgtggacaattttttattactcctggagccaaggtttataaaggaatgattattggggagaataaacgcccacaagatcttgaattaaatatttgcagggctaaacaacttaccaatatgcgatcagctggtgcagatgagctagatcaattgcaatccccaattgaaatgacattagaaagagctcttgaatacattggaccaggagagatgttggaagttactcctgaatctataaggcttagaaaacttaaagcaaagaaaaatttgtaa

SEQ ID NO: 3718 - protein, 598 aa, Prochlorococcus marinus str. NATL2A
MSFDIQAIRNIAIIAHVDHGKTTLVDALLNQSGTFRDNEEVPTCALDSNELERERGITILSKNTAVTYNDTRINIVDTPGHADFGGEVERVLGMVDGCLLVVDANEGPMPQTRFVLKKALEQGLRPIVFVNKIDRARVEPETAVDKVLDLFLELGADDDQCDFPYLFGSGLGGFAKTEVKSENDNMKPLFEAIIRQVPPPVGDVKKPLQLQVTTLDYSDFLGTIIIGRVHNGVIKNGQRTCLIKEDGSLKKGRINKLLGFKGLKRIEIEEANAGDIVALAGFDEVSIGETVACPDEPKPLPLIKVDEPTLQMTFVVNDSPFAGKEGKFVTSRQLKDRLNKELLTNVALRVEDTDSPDRFSVSGRGELHLGILIETMRREGYEFQVSQPQVIFRTIDEIKCEPVETLVLDVPEASIGACIESLGVRKGEMQNMETGTDHRTQLEFVIPSRGLIGFRGEFIRATRGEGIMSHSFFEYRPSVGDFEQRRNGVLISFEEGVATFYSLKNAEDRGQFFITPGAKVYKGMIIGENKRPQDLELNICRAKQLTNMRSAGADELDQLQSPIEMTLERALEYIGPGEMLEVTPESIRLRKLKAKKNL

SEQ ID NO: 3719 - DNA, 1821 bp, Ralstonia eutropha JMP134
  CDS (1)..(1821): transl_table=11
atgacccgcgccatccgtaatatcgccatcatcgcccacgtcgatcatggcaagaccaccctggtcgaccaactcctgcgccaggcaggcaccttccgtgacaaccagcaggttgccgaacgggtgatggactcgaacgacctggaaaaggaacgcgggatcacgattctcgcgaaaaactgtgccgtcgagtacaacggcacccatatcaacatcgtcgacaccccgggccacgccgacttcggcggtgaagtggagcgcgtgctgtcgatggtcgacggcgtgctgctgctggtggacgccgtcgaaggcccgatgccgcagacccgcttcgtgacccgcaaggcactggcgctggggctgaagcccatcgtggtcgtcaacaagatcgaccgcccgggcgcgcgcccggactgggtgatcaaccagaccttcgacctgttcgacaagctgggcgccaccgacgagcaacttgacttcccggtcatctacgcctctggtctgaatggctttgccggcctgaccgaagacgtgcgcgacggcgacatgaagccgctgttcgaaaccgtgctggacaaggtgccggtgcgtgacgacgatcgcgacggtcccctgcaactgcagattatctccctggactactcgagctacgtcggcaagatcggcgtgggccgcatctcgcgtggccgcgcccggccgctgcaggacgtggtggtcaagttcggccccgaaggcaaccccatcaagggccgcatcaaccaggtgctgaagttccagggcctggagcgcgagattgtgtccgaagcggaagccggcgacatcgtgctgatcaacggtattgaagaactgggaatcggctgcacggtgtgcgcgccggacgcccaggacgcgctgccgatgctgaaggtggacgagccgacgctgaccatgaacttctgcgtcaacacctcgccgctggcgggccgtgaaggcaagttcgtgaccagccgccagctgcgcgagcgcctggaccgcgaactgaagtcgaacgtggcgctgcgcgtgaacgacaccggcgatgacacgatcttcgaagtgtcgggccgcggcgaactacacctgaccatcctgctggaaaacatgcgtcgcgaaggctacgaactggccgtatcgcgtccgcgcgtggtgttcaaggaaatcgacggcgtcaagaacgagccgtacgaactgctgaccgttgacgtcgaagacagccaccagggcggcgtgatggaagagctgggtcgccgcaagggcgaactgctcgacatggcatcggacggcaagggccgtacccgcctcgaataccgcatcccggcccgcggcctgatcggtttccagggcgagttcctgacgctgacgcgcggtaccggcctgatcagccatatcttcgacgactacgcaccggtgcgcgaaggcggcctgggtgagcgccacaacggcgtgctgatctcgcaggacgatggcgatgccgtggcctacgcgctgtggaagctgcaggatcgcggccgcatgttcgtgaagccgggcgatgcgctgtatgaaggcatgatcatcggcatccacagccgcgacaacgacctggtcgtgaacccgatcaagggcaagcagctgaccaacgtgcgtgcttcgggtaccgacgaagctgtgcgcctggtgccgccgatccagatgtcgctcgagtatgcggtggagttcattgccgacgacgaactggtcgagctcacgccgaagagcatccgcctgcgcaagcgccacctgaaggagcacgagcgcaagcgtgcctcccgcgaaggcgtgtaa

SEQ ID NO: 3720 - protein, 606 aa, Ralstonia eutropha JMP134
MTRAIRNIAIIAHVDHGKTTLVDQLLRQAGTFRDNQQVAERVMDSNDLEKERGITILAKNCAVEYNGTHINIVDTPGHADFGGEVERVLSMVDGVLLLVDAVEGPMPQTRFVTRKALALGLKPIVVVNKIDRPGARPDWVINQTFDLFDKLGATDEQLDFPVIYASGLNGFAGLTEDVRDGDMKPLFETVLDKVPVRDDDRDGPLQLQIISLDYSSYVGKIGVGRISRGRARPLQDVVVKFGPEGNPIKGRINQVLKFQGLEREIVSEAEAGDIVLINGIEELGIGCTVCAPDAQDALPMLKVDEPTLTMNFCVNTSPLAGREGKFVTSRQLRERLDRELKSNVALRVNDTGDDTIFEVSGRGELHLTILLENMRREGYELAVSRPRVVFKEIDGVKNEPYELLTVDVEDSHQGGVMEELGRRKGELLDMASDGKGRTRLEYRIPARGLIGFQGEFLTLTRGTGLISHIFDDYAPVREGGLGERHNGVLISQDDGDAVAYALWKLQDRGRMFVKPGDALYEGMIIGIHSRDNDLVVNPIKGKQLTNVRASGTDEAVRLVPPIQMSLEYAVEFIADDELVELTPKSIRLRKRHLKEHERKRASREGV

SEQ ID NO: 3721 - DNA, 1845 bp, Ehrlichia canis str. Jake
  CDS (1)..(1845): transl_table=11
atgttgtcacaaggtgattatcagtcgatatgtaatttagcaatcattgcacatgttgatcatggaaaaacgacgctattggatagtatgttgaagcagagtggtacgtttagagaaaatcaagatgtagctgaaagagtgatggataataatgatttagaacgtgaacgtggaattactattttagcaaaatgtacgtctgttatctggcagggtaagaaaattaatataattgatacaccaggtcatgcagattttggtggagaagtagaaagagtattatcgatggcagatggtgtgctgttgcttgttgatgcatcagaagggcctatgcctcaaacaaaatttgtactgtctaaagcattgaaggctgggttattaccaatagtaattataaataaagttgatagaccggatagtagaatagatgaagtattagatgaggtatatgaattatttattaatttggatgctactagtgagcagttagattttccaatattatatgcttcaggaagaaatggatggtgtattaaaaatttgtcagataatagagaaagtttagttcctttgtttgaggcaattgttcagtatgttaaacctgttgcttatgatgctaatgcgccatttagtatgttgcttactttattggaatcagataagtttttgggtagaatattaacagggaaaatatatactggtacagcacgtgttaatgatggtgttaaagttttaagcttatctggtgaagttgttgagtatggtaagcttactaaacttttggcattttcaggattaaagcgtgtacctgttaaggaagcaaaagctggtgatattattgctgtagcaggtcttgaaaaagcttcagtatctgatagtatacttgatagctccattaattttcctattgcgtcaacgcctgttgaccctccaactatggcagtaactattggtgtaaatgactcaccatttgctggaacagaaggtgtaaagttgacgtcgactgtcattaaagcaaggcttatagctgaagctgaaacaaatgttgctattacagttaaagaaacagggcaaggtgatgcgtatgaagttggaggaagaggagagcttcaacttggtgtattgatagaaacaatgagaagagaaggttttgaattatctgtgtctcgtcctcgtgttttgttacgaaaggatgataaaggacaggttttagaacctatagaagaagttgtaatagatgtagatgaagcatacagcggtgttattatggaaaaattgagtttccgtaaaggtgatatgcgagatttacgtccatctggcaaagatagagtaagaatggtattcttggttccatcacgtggtcttataggttatcaaggagaatttttaactgattctcatggtactggaattatgaatagattatttcatagctatgcacctcataaaggaaatatccctactagaaataatggtgtactcatttctactgataaaggtgatgcagtagcttatgcaatattcaatttgcaagatcgtggtgttatgtttataaagccacaagataaagtatattgtggtatgattgttgggcttcataatcgtgaaaatgacattgatgttaatgtattgaagggtaaacaattaactaatataagagctgcaggttcagatgaagcagtaagattggttccaccaaagataatgactttagaagaaatgatagcatttattaatgatgatgagttagttgaatgtacacctaaatctgttcgtttacgtaaaaaatatttagatcctaatgaacgtaagcgtgcttctcgtgctaataagaatatggtgtga

SEQ ID NO: 3722 - protein, 614 aa, Ehrlichia canis str. Jake
MLSQGDYQSICNLAIIAHVDHGKTTLLDSMLKQSGTFRENQDVAERVMDNNDLERERGITILAKCTSVIWQGKKINIIDTPGHADFGGEVERVLSMADGVLLLVDASEGPMPQTKFVLSKALKAGLLPIVIINKVDRPDSRIDEVLDEVYELFINLDATSEQLDFPILYASGRNGWCIKNLSDNRESLVPLFEAIVQYVKPVAYDANAPFSMLLTLLESDKFLGRILTGKIYTGTARVNDGVKVLSLSGEVVEYGKLTKLLAFSGLKRVPVKEAKAGDIIAVAGLEKASVSDSILDSSINFPIASTPVDPPTMAVTIGVNDSPFAGTEGVKLTSTVIKARLIAEAETNVAITVKETGQGDAYEVGGRGELQLGVLIETMRREGFELSVSRPRVLLRKDDKGQVLEPIEEVVIDVDEAYSGVIMEKLSFRKGDMRDLRPSGKDRVRMVFLVPSRGLIGYQGEFLTDSHGTGIMNRLFHSYAPHKGNIPTRNNGVLISTDKGDAVAYAIFNLQDRGVMFIKPQDKVYCGMIVGLHNRENDIDVNVLKGKQLTNIRAAGSDEAVRLVPPKIMTLEEMIAFINDDELVECTPKSVRLRKKYLDPNERKRASRANKNMV

SEQ ID NO: 3723 - DNA, 1830 bp, Dehalococcoides sp. CBDB1
  CDS (1)..(1830): transl_table=11
ttggaaaactaccagagaaccgacattcgtaatattgctattattgcccacgtagaccacggcaaaaccagcctggtagacgtgatgcttaaacaaagccgcattttccgtgagaaccagcatgtgggcgaactgattatggaccgcaacactctggaacgggaaaaaggcattactattctggctaaaaacacggctatcacctaccgcggagtaaaaataaatattatagatactcccggacatgctgacttttcgggtgaagttgagcgggtgctgaatatggctgacggctgtcttttggtgattgacagcattgacggccccatgccccaaacccgttttgtacttaaggaagccatgcagaaaaaactgaagcctatcgtagttataaacaagattgaccgcgaaaattcacgccccgaagtagtgcttggactggtacaggacttgtttctggaactggccactactgaagaacagctggatttcccggtggtttatacctctgcccgcgagggttatgccgttaacacccccggcaccaagaatactgatttggtacccctgtttgagtgcatactttccaaaatccccccgcccagcattgcccagggtgaattccagatgctgatttccaacctggattatgatacccataaaggcaggatagctatcggacgcattcaacggggcaaaatatgctcccgtgaccggatagttaatatagactcccaaaataaggctcattcttttgaagtaggtcaggtatttacctttatgggacttggcaagcaggaagttgaatgtgccgaggcgggtgaaattgtggccattaccggtctggaaaatgcatctataggtgataccgttaccagcccgctccagcctgaagccctgccccgtattgagataggtgaacccacagtcagaatgactttcggggtaaatacctcccctttcggcgggcgggacggcaaattctgtacttcacgccagcttcgggaaagactttaccgtgagcttgagactaatatcggactgagagtggaagaaaccgattccccggactcgtttttgatttccggacggggtgaactgcatctgtccatactggtagaaaccatgcgccgtgaaggatatgaatttgaaatatccaaaccggaggccattaccaagactattgacggcaaaatctatgaaccggtggaagctttgactatagatgtccgcgaggattttgtaggtgaggttaccgaacttctgggtaagcggcaggcacgcatgactgacatgcataatgacggcgaaggaaacgtaaggctggaatacaatatccccacccgcggtcttatcggcttccgcaactcgttcctgacggctaccagaggcacaggcgtacttaacagccagtttctggagtttcaaccctggtgcggcgaaatagaacaaagccgaaccggcgcacttgtagcggctgaagcaggattatcctgcacttacggcctgagcaattcgcaggaacggggtataataatgatagatgccaatatacccgtttatgaaggcatgattgtcggactgcatgccagaggccttgacttggctgtgaatgtctgcaagcagaagaaaatgaccaatatccgttcctcaacctcggatattgccatcaaactggtgccacccctcaaacttagccttgagcaatctatggatttcatcgctgatgacgaactggttgagataacccccaagggtatccgcctgcgcaagaagatactcaataccgacctgcggcttcgggcacgcaaacgcactgacaacaattaa

SEQ ID NO: 3724 - protein, 609 aa, Dehalococcoides sp. CBDB1
MENYQRTDIRNIAIIAHVDHGKTSLVDVMLKQSRIFRENQHVGELIMDRNTLEREKGITILAKNTAITYRGVKINIIDTPGHADFSGEVERVLNMADGCLLVIDSIDGPMPQTRFVLKEAMQKKLKPIVVINKIDRENSRPEVVLGLVQDLFLELATTEEQLDFPVVYTSAREGYAVNTPGTKNTDLVPLFECILSKIPPPSIAQGEFQMLISNLDYDTHKGRIAIGRIQRGKICSRDRIVNIDSQNKAHSFEVGQVFTFMGLGKQEVECAEAGEIVAITGLENASIGDTVTSPLQPEALPRIEIGEPTVRMTFGVNTSPFGGRDGKFCTSRQLRERLYRELETNIGLRVEETDSPDSFLISGRGELHLSILVETMRREGYEFEISKPEAITKTIDGKIYEPVEALTIDVREDFVGEVTELLGKRQARMTDMHNDGEGNVRLEYNIPTRGLIGFRNSFLTATRGTGVLNSQFLEFQPWCGEIEQSRTGALVAAEAGLSCTYGLSNSQERGIIMIDANIPVYEGMIVGLHARGLDLAVNVCKQKKMTNIRSSTSDIAIKLVPPLKLSLEQSMDFIADDELVEITPKGIRLRKKILNTDLRLRARKRTDNN

SEQ ID NO: 3725 - DNA, 1833 bp, Thiobacillus denitrificans ATCC 25259
  CDS (1)..(1833): transl_table=11
atgtcccgcaagcttcgcaacatcgcgatcatcgcgcacgtcgaccacggcaagaccacgctcgtcgaccagcttctcaagcaatccggcaccttccgcgacaaccaggccatcgacgaacgcgtcatggactcgaacgatctcgagaaggagcgcggcatcaccatcctcgcgaagaacaccgcgatcacctacggcgactaccacatcaacatcgtcgacacgccggggcacgccgacttcggcggcgaagtcgagcgcgtgctcggcatggtcgacggcgtcgtgctgctggtcgacgccgtcgagggcccgatgcctcagacgcgcttcgtcaccaagaaggcgctggcgctgggcctgcgtccaatcgtcgtgatcaacaaggtcgaccgccccggttcgcgcccggactgggtcgtcgaccagaccttcgacctgttcgacaagctcggcgccaccgacgaccagctcgacttcccgatcatctacgcctcgggcctgaacggctgggcctgcctcgacctcaaggacgcaccctcgcagggcggcagcgcggccgacatgaagccgctgttcgacaccgtgctcgcgcacgtccccaccccgcctggatcggccgacgccccgctgcagctgcagatcgccgcgctggattattcgacctataccggccgtctcggcgtcggccgcgtgctcaacggccgcatcaagcccggcatgtcggtggtggtgatgaaccacgaggaacaggtcgccaccggccgcatcaaccaggtgctcggcttcaagggcctcgaccgcgtgccggtggatgaagccgaagccggcgacatcatcatcatctccggcctcgacgacatcggcatcggcgtcaccatctgcgacaaggaaaaccccgttggcctgcccgtgctcggcgtggacgaaccgaccctgaccatggacttcatggtgaacacctcgccgctcgccggcacagagggaaagttcgttaccagccgccagatccgcgaccgcttgaacaaggaactgctgaccaacgtcgcgctgcgcgtcgacgacaccggcgacgccgacgtgttccgcgtttcgggccgcggcgaactgcacctgacgatcctgctcgagaacatgcgccgcgaaggcttcgagatggccgtcgccaagccgcgcgtggtgtacaaggaaatcaatggcgagaagtgcgagccctacgaaaacctgaccatcgacctggaagacgaacaccagggcggcgtgatggaagagatcggccgccgccgcggcgaactgaccaacatggaatccgacggccgcggccgcacccgcctggaataccacattcccgcacgcggcctgatcggcttccagtccgacttcatgaccatgacgcgcggcaccggcctgatgagccacgtgttcgacgactacggtccggtgaaagccgacctgccgggccgtcataacggcgtgctggtgagccaggacaacggcgaggccgtggcctacgcgctgtggaagctggaagaccgcggccgcatgttcgtctcgcccggtgacaaactgtacgaaggcatgatcatcggcatccacagccgcgacaacgatctggtggtcaacccgatcaaaggcaagcagttgaccaacgtgcgcgcctccggcaccgacgaagcggtgcgcctgaccacgccgatcaagctgacgctggaatccgccgtggaattcatcgatgacgacgaactggtggagatcacaccgaagtcgattcgcatccgcaagcgccacctgcaggaacacgagcgcaagcgcgccagccgcgcagcggcgtaa

SEQ ID NO: 3726 - protein, 610 aa, Thiobacillus denitrificans ATCC 25259
MSRKLRNIAIIAHVDHGKTTLVDQLLKQSGTFRDNQAIDERVMDSNDLEKERGITILAKNTAITYGDYHINIVDTPGHADFGGEVERVLGMVDGVVLLVDAVEGPMPQTRFVTKKALALGLRPIVVINKVDRPGSRPDWVVDQTFDLFDKLGATDDQLDFPIIYASGLNGWACLDLKDAPSQGGSAADMKPLFDTVLAHVPTPPGSADAPLQLQIAALDYSTYTGRLGVGRVLNGRIKPGMSVVVMNHEEQVATGRINQVLGFKGLDRVPVDEAEAGDIIIISGLDDIGIGVTICDKENPVGLPVLGVDEPTLTMDFMVNTSPLAGTEGKFVTSRQIRDRLNKELLTNVALRVDDTGDADVFRVSGRGELHLTILLENMRREGFEMAVAKPRVVYKEINGEKCEPYENLTIDLEDEHQGGVMEEIGRRRGELTNMESDGRGRTRLEYHIPARGLIGFQSDFMTMTRGTGLMSHVFDDYGPVKADLPGRHNGVLVSQDNGEAVAYALWKLEDRGRMFVSPGDKLYEGMIIGIHSRDNDLVVNPIKGKQLTNVRASGTDEAVRLTTPIKLTLESAVEFIDDDELVEITPKSIRIRKRHLQEHERKRASRAAA

SEQ ID NO: 3727 - DNA, 1791 bp, Anabaena variabilis ATCC 29413
  CDS (1)..(1791): transl_table=11
atgacgctcccaattcgtaacgtcgccattatcgcccacgttgaccacggcaaaacaaccctggttgatgctctcctcaaacaatccggcattttccgcgaaggcgaagacgttccggattgcgtcatggactctaacgccttggagcgagagcgggggattaccattttgtcgaaaaatacagccgttcgctacaaagaaacactaatcaatattgttgatactcccggacacgccgattttggtggtgaagtggaacgggtactcggcatggttgacggatgtctactgattgttgatgccaatgaaggccccatgcctcagacaaggtttgtgttgaaaaaagctttggaaaaaggcttgcgccccatcgttgttatcaacaaaattgaccgcgctaaggctgacccccacgttgcagtggataaggtgctggatctgttcttagaattaggtgcagacgaagaccagtgtgattttacctatctctttgcttctggtatgggcggttatgccaaagaaagcatggaagcagaggcggtagatatgcagcccttgtttaatgcgattctgcaacacgttccaccaccagtaggcgacatcaacaagcccctacaattgcaagtcacaaccctagattattctgaatacttgggacggattgtcattggcagaattcacaacggtactatccgcgctggtcagcaagcggctctagtcacagaaaatggctctattgtcaagggcaaaatcaccaagttgatgggatttgaagggctgaagcgggtagagatggaagaagcaaccgcaggctatattgttgcggtggctggtttcgctgatgcttacattggtgaaacaattactgatccaaccgaaccccaagctttaccactaattaaggtggatgagcctaccttacaaatgaccttctgggtaaacgattcaccctttgctggtcaagaaggtaagttggtgacatccagacaagtacgcgatcgcctattccgcgaactagaaaccaacgttgctttacgcgttgaagaaaccgactcccccgacaaattcctagtttccggtcgtggagaactgcacctgggtatcttaatcgaaaccatgcgccgagaaggttttgagttccaagtatctcagccacaagtaatttaccgcgaaatcaacggtcaaccttgcgaaccttatgaattgttggtgttagacgttcctgctgatgctgttggtagctgtatcgaacgtttgggacaacgcaaaggcgaaatgcaggatatgcagcctggaagtggcgatcgcacccagctagagtttgtcattcccgcccgtggtttgattggtttccgtggtgaattcatgcggatgacccgtggtgaaggtatcatgaatcacagcttcttagattaccgtcaactcagtggtgatattgaagcccgtaacaaaggcgttctcatctcctttgaagaaggcgtttctaccttctacgccatgaagaacgcagaagatagaggctcattcttcattactcctggtactaaagtttaccgaggtatgattgtcggcgaacacaaccgtcctcaagacttggaattgaatgtctgcaaaaccaagcagttaaccaaccaccgtgcggctggtggtgatgaattggttcagttgcaagcaccaatcgacatgagtttagagcgtgcgttggagtacatcggccccgatgagttggtggaagttacaccccaatctattcgtctacggaagatgtcgaagaaattggcaaaacggtaa

SEQ ID NO: 3728 - protein, 596 aa, Anabaena variabilis ATCC 29413
MTLPIRNVAIIAHVDHGKTTLVDALLKQSGIFREGEDVPDCVMDSNALERERGITILSKNTAVRYKETLINIVDTPGHADFGGEVERVLGMVDGCLLIVDANEGPMPQTRFVLKKALEKGLRPIVVINKIDRAKADPHVAVDKVLDLFLELGADEDQCDFTYLFASGMGGYAKESMEAEAVDMQPLFNAILQHVPPPVGDINKPLQLQVTTLDYSEYLGRIVIGRIHNGTIRAGQQAALVTENGSIVKGKITKLMGFEGLKRVEMEEATAGYIVAVAGFADAYIGETITDPTEPQALPLIKVDEPTLQMTFWVNDSPFAGQEGKLVTSRQVRDRLFRELETNVALRVEETDSPDKFLVSGRGELHLGILIETMRREGFEFQVSQPQVIYREINGQPCEPYELLVLDVPADAVGSCIERLGQRKGEMQDMQPGSGDRTQLEFVIPARGLIGFRGEFMRMTRGEGIMNHSFLDYRQLSGDIEARNKGVLISFEEGVSTFYAMKNAEDRGSFFITPGTKVYRGMIVGEHNRPQDLELNVCKTKQLTNHRAAGGDELVQLQAPIDMSLERALEYIGPDELVEVTPQSIRLRKMSKKLAKR

SEQ ID NO: 3729 - DNA, 1842 bp, Streptococcus agalactiae A909
  CDS (1)..(1842): transl_table=11
atgacaaatttaagaacagatatccgtaacgttgcgatcattgcccacgttgaccacggtaaaacaactctcgttgatgaattattaaaacaatcacatactcttgatgagcgtaaagagcttgaagaacgtgcaatggattcaaatgatatcgaaaaagaacgtggtatcaccattcttgcaaaaaatacagccgtagcatacaacgatgttcgtatcaatattatggacacacctggtcacgcggactttggtggtgaagttgagcgtattatgaaaatggttgatggtgttgttttagtcgttgatgcctacgaaggaacaatgccacaaacacgttttgttttgaagaaagctcttgaacaaaacttaattccaatcgttgttgtaaataaaattgataagccgtcagctcgtccatcagaggttgttgatgaagttcttgaactatttattgagctcggtgctgatgatgatcaactagatttccctgttgtttatgcttcagctatcaatggaacatcttcaatgtcagatgatccttcagatcaagaaaaaacaatggtaccgatttttgatactatcattgatcacattccagccccagttgacaactcggaagaaccacttcaattccaagtttctcttcttgattacaatgattttgtaggacgtattggtattggacgtgttttccgcgggactgtcaaagttggagatcaagttactctttcaaaacttgatggtacaactaaaaacttccgcgtaacaaaactttttggtttctttggacttgaacgtaaagaaatccaagaggctaaagcgggtgatttaatcgctgtttctggtatggaagatatcttcgttggtgagacagtaactccgacagatgctattgaaccactaccagttttacgtattgacgagccaacacttcaaatgactttcttggtgaataattcaccatttgcaggtcgcgaaggtaaatggattacgtcacgtaaggttgaagaacgtcttttagcagaattacaaacagacgtttctttacgtgttgacccaacagattcgccagataaatggacggtttcagggcgtggagaattacatttatctatccttattgaaacaatgcgtcgtgagggatatgaacttcaagtatcacgtccagaagttatcatcaaagaaattgatggtgttcaatgcgagccgtttgagcgtgttcaaattgatactccagaagaatatcagggtgctattatccaaagtttgtcagagcgtaaaggtgatatgcttgatatgcagatggttggtaatggtcaaacgcgtttgattttcttgattcctgcacgtggtttgattggttattcaacagagtttctttcaatgacacgtggatatggtatcatgaatcatacttttgaccagtatctaccggttgttcaaggagaaattggtggtcgtcatcgtggtgccttggtttctattgaaaatggtaaagcaactacatattcaattatgcgtattgaagaacgtgggactatctttgtaaatccaggtacagaagtttatgaaggaatgattgttggtgagaattctcgtgataatgacctcggagtcaatattacaactgctaaacaaatgacaaatgtccgttcagcaactaaagatcaaactgcagtcatcaagacgcctcgtatccttactttagaagagtcacttgaatttttagcagatgatgagtacatggaagtaactcctgagtctattcgtcttcgtaaacaaattttaaataaagcagcacgtgacaaagctaataaaaagaaaaaatcagctgaataa

SEQ ID NO: 3730 - protein, 613 aa, Streptococcus agalactiae A909
MTNLRTDIRNVAIIAHVDHGKTTLVDELLKQSHTLDERKELEERAMDSNDIEKERGITILAKNTAVAYNDVRINIMDTPGHADFGGEVERIMKMVDGVVLVVDAYEGTMPQTRFVLKKALEQNLIPIVVVNKIDKPSARPSEVVDEVLELFIELGADDDQLDFPVVYASAINGTSSMSDDPSDQEKTMVPIFDTIIDHIPAPVDNSEEPLQFQVSLLDYNDFVGRIGIGRVFRGTVKVGDQVTLSKLDGTTKNFRVTKLFGFFGLERKEIQEAKAGDLIAVSGMEDIFVGETVTPTDAIEPLPVLRIDEPTLQMTFLVNNSPFAGREGKWITSRKVEERLLAELQTDVSLRVDPTDSPDKWTVSGRGELHLSILIETMRREGYELQVSRPEVIIKEIDGVQCEPFERVQIDTPEEYQGAIIQSLSERKGDMLDMQMVGNGQTRLIFLIPARGLIGYSTEFLSMTRGYGIMNHTFDQYLPVVQGEIGGRHRGALVSIENGKATTYSIMRIEERGTIFVNPGTEVYEGMIVGENSRDNDLGVNITTAKQMTNVRSATKDQTAVIKTPRILTLEESLEFLADDEYMEVTPESIRLRKQILNKAARDKANKKKKSAE

SEQ ID NO: 3731 - DNA, 1821 bp, Pseudomonas fluorescens PfO-1
  CDS (1)..(1821): transl_table=11
gtgatcgaaaatctacgcaacatcgccatcattgcccacgttgaccatggtaagaccaccctggtagacaaactcctgcgtcaatccggcaccctggagcgcaacgagctcaacgacgagcgcgtgatggactccaacgaccaggaaaaagagcgcggcattaccattctggcgaaaaacaccgccatcaactggaacggctaccacatcaacatcgtggacaccccgggccacgccgacttcggcggcgaagtcgagcgcgtaatgtccatggttgactccgtgctgctgctggtcgacgctcaagacggccctatgccgcaaacccgtttcgtgaccaagaaggctttcgaagccggcctgcgtccaatcgtggtcatcaacaaggttgaccgtccgggcgcgcgtcctgactgggttctggaccagatcttcgatctgttcgacaacctgggcgctaccgaagaacaactggacttccaggttgtttacgcttcggccctgaacggcatcgccggtctggaccacaccgccatgggcgaagacatgaccgcgctgtaccaggcggtagtcgaccacgttccgcctccggctgttgaccgtgacggtccgttccagatgcagatctccgctctggactacaacagcttcctgggtgttatcggtgttggccgtatcgctcgtggtcgcgtcaagccgaacactccggttgtcgctatcagcgccgacggcaagcgccgcaacggtcgtatcctgaagctgatgggtcaccacggtctgcaccgcgttgacgttgaagaagcagcagccggcgacatcgtctgcatcagcggtttcgacgagctgttcatctccgacaccctgtgcgacatcaacaacgtcgaggcgatgaagccgctgaccgttgacgagccaaccgtttccatgaccttccaggtaaacgactcgccattctgcggtaaagaaggcaagttcgtgacctcccgtaacatcaaggatcgtctggacaaagagctgctgtacaacgttgcactgcgcgttgaagaaggcgactcggctgacaagttcaaggtttccggccgtggtgagctgcacctctcggtactgatcgaaaccatgcgtcgcgaaggcttcgagctggccctgggccgtcctgaagtgatcatccgtgaagttgacggcgtgaagcaggaaccgttcgaaaacgtgaccatcgacatccctgaagaatcccagggcaaggtcatggaagaaatgggtctgcgtaaaggcgacctgagcaacatggtgccggatggcaagggccgtgttcgtctggaatacaacatccctgctcgcggtctgatcggtttccgtaaccagttcctgaccctgaccaacggtgctggcatcctgacctcgatcttcgaccgttacgctccagtgaagtcgggccacatgtccggccgtcagaacggcgttctggtttcggttgaaaccggcaaggcactgacctactccctggaaaccctgcaggctcgtggcaagctgttcgtagaacacggccaggagatctacaacggtcagatcgttggtcagaactcccgcgacaacgacctgggtgtgaacccgactaaaggcaagaagctcgacaacatgcgtgcttcgggtaaagacgaaaccatcgctctggtcccacctgttcgcttcaccctggaacaggctctggaatacatccaggaagacgagctgtgcgaagtgactcctaagtccatccgtcttcgcaagaagatcctggacgaaagcgagcgtacccgcgctgccaagaaagccaaggcgtaa

SEQ ID NO: 3732 - protein, 606 aa, Pseudomonas fluorescens PfO-1
MIENLRNIAIIAHVDHGKTTLVDKLLRQSGTLERNELNDERVMDSNDQEKERGITILAKNTAINWNGYHINIVDTPGHADFGGEVERVMSMVDSVLLLVDAQDGPMPQTRFVTKKAFEAGLRPIVVINKVDRPGARPDWVLDQIFDLFDNLGATEEQLDFQVVYASALNGIAGLDHTAMGEDMTALYQAVVDHVPPPAVDRDGPFQMQISALDYNSFLGVIGVGRIARGRVKPNTPVVAISADGKRRNGRILKLMGHHGLHRVDVEEAAAGDIVCISGFDELFISDTLCDINNVEAMKPLTVDEPTVSMTFQVNDSPFCGKEGKFVTSRNIKDRLDKELLYNVALRVEEGDSADKFKVSGRGELHLSVLIETMRREGFELALGRPEVIIREVDGVKQEPFENVTIDIPEESQGKVMEEMGLRKGDLSNMVPDGKGRVRLEYNIPARGLIGFRNQFLTLTNGAGILTSIFDRYAPVKSGHMSGRQNGVLVSVETGKALTYSLETLQARGKLFVEHGQEIYNGQIVGQNSRDNDLGVNPTKGKKLDNMRASGKDETIALVPPVRFTLEQALEYIQEDELCEVTPKSIRLRKKILDESERTRAAKKAKA

SEQ ID NO: 3733 - DNA, 1827 bp, Burkholderia sp. 383
  CDS (1)..(1827): transl_table=11
atgacccgcgcccttcgcaatatcgccatcatcgcccacgtcgaccacggcaagactacgctcgtcgaccaactgcttcgccagtccggcaccttccgcgagaaccagcagattgcggaacgggtgatggactcgaacgacatcgaaaaagagcgcgggatcacgattctcgcgaagaactgtgcggtcgagtacgaaggcacgcacatcaacatcgtcgacacgccggggcacgcggacttcggtggcgaggtcgagcgcgtgctgtcgatggtcgactcggtgctgctgctcgtcgacgcggtcgagggcccgatgccgcagacgcgcttcgtcacgaagaaggcgctcgcgctcggcctgaagccgatcgtcatcgtcaacaagatcgaccgtccgggtgcgcggatcgactgggtcatcaaccagaccttcgacctgttcgacaagctcggcgcaaccgaagagcagctcgacttcccgatcgtctacgcatcgggcctgaacggctacgcgtcgctcgacccggctgcgcgcgaaggcgacatgcgcccgctgttcgaggcagtcctcgaacacgtgccggtccgtccggcggatccggaggcgccgctgcaactgcagatcacgtcgctcgactattcgacgtacgtcggccggatcggcgtcggccgcatcacgcgcggtcgcatcaagccgggccagccggtcgcgatgcgcttcggcccggaaggcgacgtgctgaaccgcaagatcaaccaggtgctgtcgttcacgggcctcgagcgcgtgcaggtcgaatcggccgaagcgggcgacatcgtgctgatcaacggtattgaagacgtcggcatcggcgcaacgatctgcgcggtggatacgccggaagcgctgccgatgatcaccgtcgacgagccgacgctgacgatgaacttcctcgtcaactcgtcgccgctcgccggccgcgaaggcaagttcgtcacgagccgccagatccgcgaccgcctgatgaaggaactgaaccacaacgttgcgctgcgcgtgaaggacacgggtgacgaaacggtgttcgaagtgtcgggccgcggcgagctgcacctgacgattctcgtcgagaacatgcgtcgtgaaggctacgagctggccgtgtcgcgtccgcgcgtcgtgatgcaggaaatcgacggcgttcgtcacgagccgtacgaactgctgaccgtcgacgttgaagacgagcatcagggcggcgtgatggaagagttgggtcgccgcaagggcgaaatgctcgacatggcgtcggacggccgcggccgcacgcgtctggagtacaagatctcggcacgtggcctgatcggcttccagagcgaattcctgacgctgacgcgcggcacgggcctgatgagccacatcttcgactcgtatgcaccggtcaaggacggttcggtcttcgagcgccgcaacggtgtgctgatctcgcaggacgacggcgctgccgtggcctacgcactgtggaagctgcaggatcgcggccgcatgttcgtgaagccgggtgacgcgctctatgagggcatgatcattggtatccacagccgtgacaacgacctcgtcgtgaacccgatcaagggcaagcagctgaccaacgtgcgtgcgtcgggtaccgacgaagccgtgcgcctcgtgccgccggtccagatgtcgctcgaatacgcggtcgaattcatcgacgacgacgagctcgtcgaagtgacgccgcaatcgatccgtctgcgcaagcgcttcctgaaggagcacgagcgtcgccgcgcgagccgcgaaggcgcggtcgactaa

SEQ ID NO: 3734 - protein, 608 aa, Burkholderia sp. 383
MTRALRNIAIIAHVDHGKTTLVDQLLRQSGTFRENQQIAERVMDSNDIEKERGITILAKNCAVEYEGTHINIVDTPGHADFGGEVERVLSMVDSVLLLVDAVEGPMPQTRFVTKKALALGLKPIVIVNKIDRPGARIDWVINQTFDLFDKLGATEEQLDFPIVYASGLNGYASLDPAAREGDMRPLFEAVLEHVPVRPADPEAPLQLQITSLDYSTYVGRIGVGRITRGRIKPGQPVAMRFGPEGDVLNRKINQVLSFTGLERVQVESAEAGDIVLINGIEDVGIGATICAVDTPEALPMITVDEPTLTMNFLVNSSPLAGREGKFVTSRQIRDRLMKELNHNVALRVKDTGDETVFEVSGRGELHLTILVENMRREGYELAVSRPRVVMQEIDGVRHEPYELLTVDVEDEHQGGVMEELGRRKGEMLDMASDGRGRTRLEYKISARGLIGFQSEFLTLTRGTGLMSHIFDSYAPVKDGSVFERRNGVLISQDDGAAVAYALWKLQDRGRMFVKPGDALYEGMIIGIHSRDNDLVVNPIKGKQLTNVRASGTDEAVRLVPPVQMSLEYAVEFIDDDELVEVTPQSIRLRKRFLKEHERRRASREGAVD

SEQ ID NO: 3735 - DNA, 1809 bp, Synechococcus sp. CC9605
  CDS (1)..(1809): transl_table=11
atgagcgccaacagcaaggcgatccgcaacatcgcgatcatcgcccacgttgaccacggcaagacgactctggtcgattcgctgttggcgcagtcaggaattttccgcgacaacgaggccgtccccacctgtgtgatggactccaacgacctggagcgtgagcggggcatcacgatcctgtccaagaacacggctgtcacctacaacgacacccggatcaacatcgttgacacgcctgggcacgccgatttcggtggtgaagtggagcgggtgctgggcatggtcgacggttgcctgctgatcgttgatgccaacgaggggccgatgccccaaacccgctttgtgttgaagaaagcccttgagcagggtctgcgtccgatcgtgttcgtcaacaagatcgaccgtgcccgggtggatcccgagaccgccgtcgacaaggtgctcgatctgttcatcgaactcggcgctgacgatgatcagtgcgatttcccctacctgttcggcagcggtctgggagggttcgccaagcccgacatgaagaccgacagcgacaacatgcgtccgctgttcgatgcaatcctgcgccacgttccgcccccggttggtgatccggaaaagccccttcagctgcaaatcaccacccttgattattccgacttcctgggtcggatcatcattggtcgcgttcacaacggaaaaatcaaacatggtcagaacgctgcactgatcaaggacgacggcagcattaagaagggtcgcatcagcaaacttcttggcttcgaaggtctgcagcgcgttgagatcgaagaggcttccgccggtgatctggtggccgttgctggttttgacgacgtcaacatcggtgaaaccatcgcctgcccggatgagcccaccgctctgccgctgatcaaggtggatgagcccaccctccagatgaccttcgtcgtcaacgattcacccttcgctggcaaggaaggcaagttcgtcacgagccgtcaggtgcgtgaccgccttcagcgtgagttgctcaccaacgtggccttgcgtgtggaagacaccgattcaccagaccgttttgcggtgagtggtcgcggtgagctgcacctcggcatcctgatcgagaccatgcgccgtgagggttatgagttccaggtgtcccaaccgcaggtgatctaccgcaccatcgatggcaccccttgtgagccggtggaaactctggtgatggatgtgcctgaacctgccgtgggcagctgcatcgaaaaactgggcacccgcaagggcgagatgcagaacatggaaaccagcgctgatggccgcacccagctggagttcatcgttccctcccgcggtctgatcggtttccgcggtgaattcatccgggccacccgcggcgaaggaatcatgagccattccttctatgagtaccggccgatgatgggtgaattcgacacccgccggaacggtgtgctgatcgccttcgaagagggaacggccacgtactatgccctcaagaacgccgaggatcgcggccagttcttcatcagcccgggcacgaaggtgtacaagggaatgatcatcggggaatacaaccggccgcaagaccttgaaatcaacgtctgcaagaccaagcagctcaccaacatgcgttcagctggcgctgaggaactggacacgctgcaagcaccggttcagatgacgctggagcgcgcattggaatacatcggccccgacgagatgctcgaagtcacgcccgagtcgatccgtctgcgcaaacttcccggcaagaagccggccaagtccaagcgctga

SEQ ID NO: 3736 - protein, 602 aa, Synechococcus sp. CC9605
MSANSKAIRNIAIIAHVDHGKTTLVDSLLAQSGIFRDNEAVPTCVMDSNDLERERGITILSKNTAVTYNDTRINIVDTPGHADFGGEVERVLGMVDGCLLIVDANEGPMPQTRFVLKKALEQGLRPIVFVNKIDRARVDPETAVDKVLDLFIELGADDDQCDFPYLFGSGLGGFAKPDMKTDSDNMRPLFDAILRHVPPPVGDPEKPLQLQITTLDYSDFLGRIIIGRVHNGKIKHGQNAALIKDDGSIKKGRISKLLGFEGLQRVEIEEASAGDLVAVAGFDDVNIGETIACPDEPTALPLIKVDEPTLQMTFVVNDSPFAGKEGKFVTSRQVRDRLQRELLTNVALRVEDTDSPDRFAVSGRGELHLGILIETMRREGYEFQVSQPQVIYRTIDGTPCEPVETLVMDVPEPAVGSCIEKLGTRKGEMQNMETSADGRTQLEFIVPSRGLIGFRGEFIRATRGEGIMSHSFYEYRPMMGEFDTRRNGVLIAFEEGTATYYALKNAEDRGQFFISPGTKVYKGMIIGEYNRPQDLEINVCKTKQLTNMRSAGAEELDTLQAPVQMTLERALEYIGPDEMLEVTPESIRLRKLPGKKPAKSKR

SEQ ID NO: 3737 - DNA, 1797 bp, Geobacter metallireducens GS-15
  CDS (1)..(1797): transl_table=11
atgcaagaacggatcaggaacatcgccatcatcgcccacgtcgaccacggcaaaaccacgctggtcgacgccatgctgaagcacgcgggggtcttccgcgagaatgaggccatcaccgagcgggtcatggactccaacgacctggagaaggagcgggggatcaccatcctcgccaagaacctctcggtgcaccatggccgctacaagatcaatatcatcgacacccctggccacgccgacttcggcggcgaggtggagcgggtgctcaagatggtggactcggtgctcctgctggtggatgccctggacggccccatgccccagacccgtttcgtgctcaagaaatccctcgatctgggcctgaagcccatcgtagtcatcaacaagatcgaccgccccggttcccgtcccgacgaagtcgtcgatatggtcttcgacctcttctgtgagctgaacgccaacgacgagcagctggatttccccatcgtctacaccagtgccaagctcggtttcgccaaactggacctcacctccgactcatccagcatggaacccctcttcgccgtggtggaatccaatgtccgccccccctccggcgatgccaaattaccgttccagttgctggtcaccaacattgattacaacgaatacatcggccgcatcgccacgggcaaggtcttcaacggcagcgtcaagagcggcgaaaccgtggcgctggtgcgccgcgacggcagcatcgtcaggagccgcatctcgaaactcctgggctacgaggggctcaagcaggtagaggttccggaagcgtgcaccggcgacatcgtcaccgtggccggctttgatgaggtgggtatcggcgaaaccctggcagccgccgacaatcccgtggccctcccctacgtctccatcgacgagccgaccatcgccatgaatttcatcgtcaactcctcccccttcgccggcaaggaggggaaattcgtcacctcccgcaacatccgtgaccgcctcgacaaggagttgcggaccaacgtgtcgctgcgcgtcgaggataccgggaacgccgacaccttcaaggtctcgggtcgcggcgagctccacctctccatcctcatcgagaacatgcggcgcgaagggttcgagatggcggtctccaagcccgaggtcatcatgcgggagttggacggcaagaagatggagcccatggagtacctggtggtggacgtcccctccgagttccaggggtccatcatcgagaagatgggaccccgcaagggtgagatgacctccatgcagcccatgggggagacggtgcgccttgagttcatcgtgccggcccggggactcatcggcctgcggggcgagctcctcaccgagacccggggcaccgcggtcatgacccacaccttccacgactacgccccctacaagggcgacatcccgggacgcaagaacggggtcctcatcgccatggagaacggcgagaccaccgcctactccctggacggcctccagccccggggcatcctcttcatcggggcaggagtcgaggtctacggtggcatgatcatcggccagcacgccaaggacaacgacctggacgtgaacccctgcaaggggaagaagctcaccaacgtccgggcctcgggctccgacgacgccatcaagctcaccccgccccgcatcctgaccctggagcaggccctggagttcatcgacgacgatgagctggtggaggtaaccccccagtcgatccggctccggaagaaggagctggacccgaaccggcgcaagcgcaagtaa

SEQ ID NO: 3738 - protein, 598 aa, Geobacter metallireducens GS-15
MQERIRNIAIIAHVDHGKTTLVDAMLKHAGVFRENEAITERVMDSNDLEKERGITILAKNLSVHHGRYKINIIDTPGHADFGGEVERVLKMVDSVLLLVDALDGPMPQTRFVLKKSLDLGLKPIVVINKIDRPGSRPDEVVDMVFDLFCELNANDEQLDFPIVYTSAKLGFAKLDLTSDSSSMEPLFAVVESNVRPPSGDAKLPFQLLVTNIDYNEYIGRIATGKVFNGSVKSGETVALVRRDGSIVRSRISKLLGYEGLKQVEVPEACTGDIVTVAGFDEVGIGETLAAADNPVALPYVSIDEPTIAMNFIVNSSPFAGKEGKFVTSRNIRDRLDKELRTNVSLRVEDTGNADTFKVSGRGELHLSILIENMRREGFEMAVSKPEVIMRELDGKKMEPMEYLVVDVPSEFQGSIIEKMGPRKGEMTSMQPMGETVRLEFIVPARGLIGLRGELLTETRGTAVMTHTFHDYAPYKGDIPGRKNGVLIAMENGETTAYSLDGLQPRGILFIGAGVEVYGGMIIGQHAKDNDLDVNPCKGKKLTNVRASGSDDAIKLTPPRILTLEQALEFIDDDELVEVTPQSIRLRKKELDPNRRKRK

SEQ ID NO: 3739 - DNA, 1845 bp, Desulfovibrio desulfuricans G20
  CDS (1)..(1845): transl_table=11
gtgaccacaatcgtaaacgaaaagctgcgtaacgtagctatcattgcccacgttgaccacggtaaaacaaccatggtcgacgccatgttccgtcaggccggactgttccgctccgatcaggaagttcaggatcgcataatggacagcatggatcttgaacgtgaacgcggcattaccattgcagccaaaaactgcgccgtgaactggaagggcacaaagatcaacataatcgacacccccggtcacgccgacttcggcggcgaggtggagcggtctctttccatggccacaggtgccatcctgctggtcgatgcttctgaaggccccctgccccagacccgctttgtgctcaaaaaaacgctggaggcgggactcaaggtcatcgtggtcattaacaagatcgaccgtaaagacgcccgcgtggaagaagtgctcaacgaagtgtacgacctgttcatcgatcttgacgccagcgaagagcagatagaatttccggtgctgtacgccatcggccgggacggcgtggccatgcgcgacccgcaggatccgcggcaggatctcaccccgctttttgaaaccatcctcgaggtcattcccggcccggcgcacaatcccgaagaacccttccagatgcttgtttccgaccttgcctactccgactatctgggcagactggctgtgggccgcatcatacacggaacggctcaggccaaagaagaaatgctctgcgtgggtgaaaaggaaaaccagaccctgcgtgccaccaagctgcaggtgtacgacgggctttcgctcagcgaagtgcagtctgccgaagccggcgacattctggtgctggccggtattgaagacgtgaccataggcgacaccatctgcaccaaagccgccccccgcaagctcaagcgtattcacgtggacgagccgacggtggccatgcgtttttccatcaacagctcgccccttgccggccgcgaaggaaaaattgtccagtcccgtaaaatcggcgagcggctcttcaaggaaatgctgcgcaacgtggccatccgcgtggaagaaaccgacgacaaggacagctaccttgtgaaaggccgcggcgaattccagatggccatactcatcgaaaccatgcgccgtgaaggatttgaactcaatgtgggccgtccggaagttatcttcaaaaaagacggcaacacactggtggaacccatcgaacgcctgtgggtggactgcgacgaaccctttatgggagttgtcactgaaaaactttccacccgtaaaggccgcatggtcaacctgatcaacaacggcaccggccgtgtgcgtatggaattcagcattccttcgcgcgggctcatcggctaccgtgatgaatttctcacggacaccaagggtaccggcatcatgaactcgtatcttgacggatacgaaccgcaccgcggcgattttcccacccgctataccggttccattgtggccgaccgtgcgggcaccactgttgcctacggtctgtacaacctggaaccgcgcggccgtctttttgtgggtgcgggcgaaccgtgctatgaaggcatggttgtgggtgaacacaaccgcgataacgacatcgatgtgaaccccaccaaagaaaagaaactgaccaacatgcgtgcttccggcaaagatgaaaacgtggtgcttactcccgtcaaacccatgacgctggaacaggcactgcactttgtgcgtgatgacgaactggtcgaagtcacccccgtatccatcagaatccgcaaggcggaactctcggcacaaaagcggcacgccgctcagggggccaagaaaaaagcctcgttgctgaaaaaataa

SEQ ID NO: 3740 - protein, 614 aa, Desulfovibrio desulfuricans G20
MTTIVNEKLRNVAIIAHVDHGKTTMVDAMFRQAGLFRSDQEVQDRIMDSMDLERERGITIAAKNCAVNWKGTKINIIDTPGHADFGGEVERSLSMATGAILLVDASEGPLPQTRFVLKKTLEAGLKVIVVINKIDRKDARVEEVLNEVYDLFIDLDASEEQIEFPVLYAIGRDGVAMRDPQDPRQDLTPLFETILEVIPGPAHNPEEPFQMLVSDLAYSDYLGRLAVGRIIHGTAQAKEEMLCVGEKENQTLRATKLQVYDGLSLSEVQSAEAGDILVLAGIEDVTIGDTICTKAAPRKLKRIHVDEPTVAMRFSINSSPLAGREGKIVQSRKIGERLFKEMLRNVAIRVEETDDKDSYLVKGRGEFQMAILIETMRREGFELNVGRPEVIFKKDGNTLVEPIERLWVDCDEPFMGVVTEKLSTRKGRMVNLINNGTGRVRMEFSIPSRGLIGYRDEFLTDTKGTGIMNSYLDGYEPHRGDFPTRYTGSIVADRAGTTVAYGLYNLEPRGRLFVGAGEPCYEGMVVGEHNRDNDIDVNPTKEKKLTNMRASGKDENVVLTPVKPMTLEQALHFVRDDELVEVTPVSIRIRKAELSAQKRHAAQGAKKKASLLKK

SEQ ID NO: 3741 - DNA, 1797 bp, Prochlorococcus marinus str. MIT 9312
  CDS (1)..(1797): transl_table=11
atgtcatcttcgataaaagaaattaggaatgttgcaattattgcccacgtagatcatggaaagacaactcttgtggatgcattattatctcaatcaggaatatttagagacaatgaagttattcctacatgtgtaatggattcgaatgatcttgaaagagaaagaggaataacaatactctcaaaaaatactgcagttaattataaagataccagaattaatattatagatactccgggacatgctgattttggaggagaagtcgagagggttttgggaatggttgatggttgtttgcttattgttgatgcaaatgagggaccgatgccacaaaccagatttgttttaaaaaaagcattagaaaaaggacttaggcctatagtttttgtaaataaaattgatagaccaagagtagtaccagaaatagcaattgataaggtccttgatttgtttttagaattaggagcagatgatgatcaatgtgattttccttatctttttggtagcggcctatctggttttgcaaaagaagagatggaatctaatagtgacaatatgatgcctctttttgaagctataatcagacatgttccacctccagtaggtgactcaaataagcctcttcaactacaaataactactttggattattctgatttcttaggcagaattgtaattggaaaaattcataatggaactataagaaatggtcaacaagctagcttaattaaagaaaatggaaaaactattaaaggcaaggttagtaaactactaggcttcgagggattacaaagaattgatataaatgaagcattcgcaggcgatattgttgctgtttctggtttcgatgacgtcaatattggtgagaccatagcatgtcccgattctcctcatcctcttccattaatcaaagttgatgaacctaccttaaatatgacttttgttgtcaatgattccccatttgcgggtaaggaagggaaatttgttactagtagacaattaaaaaatagattggagagggaacttctaacaaatgttgccctaagggtcgaagaaactgattcgcctgacaggttctcagtttcaggaagaggagaattacatttagggattttgattgaaactatgagaagagagggttttgagtttcaaatctcacaacctcaagtaatttttagagaaattgataatgttgaatgtgagcctatagagactttggttttagatgtgcctgaagtctctgttggttcatgtatagagaaacttggatctagaaaggcagagatgaaaaacatgcagacaagttcagatggaagaactcaattagaatttcttgtgccatcaagaggattaattggatttcgtggtgaatttgttcggatgacgagaggtgaaggtatcatgagtcactctttttatgaatataaacctaaaacaggagattttgaaactaggagaaatggagttcttatagcttttgaggaaggtgtggcaacattttatgctctaaagaatgcagaagataggggcgtttattttattaaaccaggagttaaagtttataagggaatgatcattggagagaataatcgacctcaggatcttgagttaaatatatgtaaaactaagcagttgactaatatgaggtctgcaggtgcagaagaacttgatactttgcagtcacctgttgatattactcttgaaagagcacttgaatatattggcccagatgaaatgctggaggtaacacccgaatcaataagaatgagaaaaataaataagaagaaaaaatattaa

SEQ ID NO: 3742 - protein, 598 aa, Prochlorococcus marinus str. MIT 9312
MSSSIKEIRNVAIIAHVDHGKTTLVDALLSQSGIFRDNEVIPTCVMDSNDLERERGITILSKNTAVNYKDTRINIIDTPGHADFGGEVERVLGMVDGCLLIVDANEGPMPQTRFVLKKALEKGLRPIVFVNKIDRPRVVPEIAIDKVLDLFLELGADDDQCDFPYLFGSGLSGFAKEEMESNSDNMMPLFEAIIRHVPPPVGDSNKPLQLQITTLDYSDFLGRIVIGKIHNGTIRNGQQASLIKENGKTIKGKVSKLLGFEGLQRIDINEAFAGDIVAVSGFDDVNIGETIACPDSPHPLPLIKVDEPTLNMTFVVNDSPFAGKEGKFVTSRQLKNRLERELLTNVALRVEETDSPDRFSVSGRGELHLGILIETMRREGFEFQISQPQVIFREIDNVECEPIETLVLDVPEVSVGSCIEKLGSRKAEMKNMQTSSDGRTQLEFLVPSRGLIGFRGEFVRMTRGEGIMSHSFYEYKPKTGDFETRRNGVLIAFEEGVATFYALKNAEDRGVYFIKPGVKVYKGMIIGENNRPQDLELNICKTKQLTNMRSAGAEELDTLQSPVDITLERALEYIGPDEMLEVTPESIRMRKINKKKKY

SEQ ID NO: 3743 - DNA, 1794 bp, Synechococcus elongatus PCC 7942
  CDS (1)..(1794): transl_table=11
atgtcgctccccattcgcaacgtcgcgatcattgcccacgttgaccacggcaaaacaaccttggttgacgccttgctcaaacaatctggcattttccgtgagggcgaagacgttccggattgcgtcatggactccaatgatttggagcgggaacggggcattaccattctttctaaaaatacagcggtcaaatacaaggacacgctgatcaatattgtcgatacgcccggtcacgcggacttcggtggtgaagtcgagcgggttctcggcatggtggatggctgcatcctgattgtggatgccaacgaaggcccgatgccccaaacgcgatttgtgctgaaaaaagcgttggaaaaagggctgcggccgatcgttgttgtgaacaaaatcgatcgccctcgcgctgagccgatggttgctgtcgataaggttctcgatctgttcctcgaactcggcgccgacgatgaccagtgcgaatttccctacctctttgcttcgggcttgagcggttttgcgaaagagtctttggaagatgaaagcaaggacatgcaaccgctgttcgatgcaattttgcgccatgttccacccccgattggggatgtgagcaagcccttgcagctgcaggtgacgaccctcgattattcagacttcttgggtcggattgtgatcggtaagatccacaacggcacgatcaacatgggtcagccgactgctctgctcaaggaagatggcagcgtggtgcggggtaaagtgaccaagctgctgggctttgagggcctgaagcggattgaaattgagcaagcgaccgccggcatgattgtggccgtcgcgggctttgctgatgccaacattggtgaaaccctggcttgtcccaacgaacctttggcgctgccgctgatcaaggttgacgagccaaccctgcagatgaccttctgcgtcaatgactcaccttttgctggcaaagaaggcaagtttgtcaccagccgccaagtccgcgatcgcctgttgcgtgagctggaaaccaacgtggccctgcgggtcgaagaaaccgattctcccgatcgcttcatggtctcggggcggggtgaactacacctcggcattctgatcgaaacgatgcgtcgcgaaggttatgagttccaagtgtcgcagccgcaggtgatcttccgggaagtcaatggtcagccgggcgaaccgtttgaaacgctcgtgatggatgtgcccgacgatgcggtcggcagcgtgatcgagcgcttgggcacccgcaaagcggaaatgcaaaacatggaagctgtcggtaatggccgtacgattctggagtttgtgattccggcgcgcggtctgattggcttccggggcgactttatccgcctcacccgtggcgaagggatcatgaaccactccttcttggagtaccgtcctttctgtggcgatctggaaatgcgccgcaacggtgtgctgattgcctttgaagaggggacagcgactttctacgccctcaagaacgccgaagatcgcggtgctttcttcattgaaccgggcaccaaggtctataagggcatgattgttggcgagcataaccggccccaagatttggagctgaacgtttgcaaaaccaaggcactgaccaaccaccgctcggctacaggcgatgaactggtacagctgcaaacgccaattcaaatgaccttggaacgggcgctggagtacatcggttccgatgaactgctggaagtgacgcccgagtcgatccgtctgcggaagctactggcgaagaaactcgctaagcgttag

SEQ ID NO: 3744 - protein, 597 aa, Synechococcus elongatus PCC 7942
MSLPIRNVAIIAHVDHGKTTLVDALLKQSGIFREGEDVPDCVMDSNDLERERGITILSKNTAVKYKDTLINIVDTPGHADFGGEVERVLGMVDGCILIVDANEGPMPQTRFVLKKALEKGLRPIVVVNKIDRPRAEPMVAVDKVLDLFLELGADDDQCEFPYLFASGLSGFAKESLEDESKDMQPLFDAILRHVPPPIGDVSKPLQLQVTTLDYSDFLGRIVIGKIHNGTINMGQPTALLKEDGSVVRGKVTKLLGFEGLKRIEIEQATAGMIVAVAGFADANIGETLACPNEPLALPLIKVDEPTLQMTFCVNDSPFAGKEGKFVTSRQVRDRLLRELETNVALRVEETDSPDRFMVSGRGELHLGILIETMRREGYEFQVSQPQVIFREVNGQPGEPFETLVMDVPDDAVGSVIERLGTRKAEMQNMEAVGNGRTILEFVIPARGLIGFRGDFIRLTRGEGIMNHSFLEYRPFCGDLEMRRNGVLIAFEEGTATFYALKNAEDRGAFFIEPGTKVYKGMIVGEHNRPQDLELNVCKTKALTNHRSATGDELVQLQTPIQMTLERALEYIGSDELLEVTPESIRLRKLLAKKLAKR

SEQ ID NO: 3745 - DNA, 1842 bp, Rhodospirillum rubrum ATCC 11170
  CDS (1)..(1842): transl_table=11
atgaccacccttcgcaacatcgccatcatcgcccacgtcgaccacggcaagaccacgctcgtcgacgccctgctcaagcagagcggcagcttccgggaaaaccagaaagtggacgagcgcgcgctcgattccaacgatctggaaagggaacgcggcatcaccatcctggccaaatgcacctcggtcgactggaagggcgttcgcgtcaatatcgtcgacaccccgggacacgccgatttcggcggtgaggtcgagcgcatcttgtcgatggtcgacggtgtcgtcctgcttgtcgatgccgccgaaggcccgctgccccagaccaaattcgtgctcggcaaggccctggcccttggcctgcgcccgatcgtcgtcatcaacaaggtcgatcgccccgacgcccgcgcccatgaggtccacgacgaggttttcgatctgttcgccaacctcggcgcctcggacaagcagcttgatttcccctgcctgttcgcctcgggccgcaacggctgggcggtgaacacgcttgaagagatcgacggcggcaccgaaggcctgaccctcgagccgctgttcaagttggtggtcgaccatgtgcccgcccccgagcgcgtgcttgacgcccccttcgccatgctggcgaccacccttgaatacgacccgtacctgggtcgcgtgctgaccggccgcatcctgtcgggtcgggccaagatcaacatgccgatcaaggcgctggcccgcgatggccgcatccttgaacagggccgcgcctccaagctgctggcctttcgcggcctgaaccgcgttccggtcgaagaggccgaggccggcgatatcatcgccatcgccggtatcgccaaggccaccgtggccgatacgctctgcgccctggaactcgatcagccgatctatgcggcgccgatcgacccgccgaccctggccatgaccttctcggtcaacgactcgcccttggccggcctggaaggcgacaagctgaccagccgcgtcatcgccgcccgtctggcccgcgaagccgagggcaatgtcgccattcacatccgcgaaaccgaagacaaggacgccttcgaggtcgccggccgtggcgaactgcagcttggcgtgctgatcgaaaccatgcgccgcgaaggcttcgagctgtcgatttcgcgcccgcgcgtgctctataagaccgacgagcagggcggcaatcgcgaagagccgatcgaagaggtggtgatcgacgtcgacgaggaattctccggcacggtcgttgacaagatgtcccagcgcaaggccgagcttcaggaaatgaagccctcgggcggcggcaagctgcgcttggtcttccacgccccgtcgcgcggactgatcggctatcacggcgaattcctgacagacacccggggcaccggcatcatgaaccgcctgttccacggttatgccccgttcaagggcacgatcgacggccggcgcgagggcgtgctgatctccaatggcgccggcgatgccgtggcctatgccatcttcaatcttcaggaccgtggcccgatgttcatcgagccgggcgtgaaggtctacgagggcatgatcgttggcgagcacaaccgcggcaacgacctggaaatcaacgtcctcaagggcaagcagctgaccaacatccgcgcttcgggcaaggacgaggccattcgcctgaccccgcccttgcgcaaaagcctggaagaggccctggcctatatccaggacgacgagttggtcgaggtgaccccgaagaccatccgtctgcgcaagcgttggcttgattccaacgagcgcaagaagcgttcgaagaaggtctccgaggcctga

SEQ ID NO: 3746 - protein, 613 aa, Rhodospirillum rubrum ATCC 11170
MTTLRNIAIIAHVDHGKTTLVDALLKQSGSFRENQKVDERALDSNDLERERGITILAKCTSVDWKGVRVNIVDTPGHADFGGEVERILSMVDGVVLLVDAAEGPLPQTKFVLGKALALGLRPIVVINKVDRPDARAHEVHDEVFDLFANLGASDKQLDFPCLFASGRNGWAVNTLEEIDGGTEGLTLEPLFKLVVDHVPAPERVLDAPFAMLATTLEYDPYLGRVLTGRILSGRAKINMPIKALARDGRILEQGRASKLLAFRGLNRVPVEEAEAGDIIAIAGIAKATVADTLCALELDQPIYAAPIDPPTLAMTFSVNDSPLAGLEGDKLTSRVIAARLAREAEGNVAIHIRETEDKDAFEVAGRGELQLGVLIETMRREGFELSISRPRVLYKTDEQGGNREEPIEEVVIDVDEEFSGTVVDKMSQRKAELQEMKPSGGGKLRLVFHAPSRGLIGYHGEFLTDTRGTGIMNRLFHGYAPFKGTIDGRREGVLISNGAGDAVAYAIFNLQDRGPMFIEPGVKVYEGMIVGEHNRGNDLEINVLKGKQLTNIRASGKDEAIRLTPPLRKSLEEALAYIQDDELVEVTPKTIRLRKRWLDSNERKKRSKKVSEA

SEQ ID NO: 3747 - DNA, 1779 bp, Moorella thermoacetica ATCC 39073
  CDS (1)..(1779): transl_table=11
atggaccagcaaaagatacgcaacctggcgataatcgcccacgtcgatcatggcaagacgaccctggtcgacggcatgctgaaacagagcggcattttccacgagaagcaggtggtccaggagcgtatcctggaccgcaacgatctggaacgggaacgcggcatcactatcatggccaagaataccgctgtcttttaccggggttacaagctgaacatcgtcgacacccccggccacgccgatttcggcggcgaagtggagcgcatcgtccagatggtggacggggccctcctactggtggacgccttcgagggccccatgccccagactcgttttgtcctgaaaaaggccctggcggtgggtctgaaacccattgtggtcatcaataaaatggaccggcccaacgcccggccgggggcggtggtcgacgaagtcctggaccttttcatcgacctgggagccaccgaggagcagctggatttcccggtggtctacacagtagcccgccagggaacggccagcctggacccggaccagcccgggaaagacctgcagcctctgtttgacataatcgtccagcatataccagcccccggcggggacccggaggcaaccctgcaggtaggagtcaacctcattgattatgacacttatgtcggccgccaggccatcggccgggtatataacggcaccatccgcgcccggcaggaagtggccgttgcccggcccgacggcagcctggtccgggggcatgtggctgccctgcatgtttttgaaggtctcaacaaggtgccggtggatgaagccgccgccggggagatcgtcgtcgtcagcggcctggaggacatcaacgtcgccaataccattacctcgccggaggacccccggcccctggactttgtccgtatcgacgagcccacggtggctatgactttcatggtcaataagagccccttcgccggccgggaaggggagtatgtaacttcccggaagctccgggagcgcctcctcagggaggcggaatcggatgtcagcctgcgggtggaggaaacggattcccctgacgccctgctggtttccggccggggcgagctgcacctcgccatcctcatcgaaaccatgcgccgggaggggtatgaattcgaagtctcccggccccaggcgattattaaagaaataaagggcgtcaagtgcgagcccgttgaagaactcattatagaggttccggaaacctatatgggcatcgtcatcgagcgcctgggtccccgcaaaagcgagatggtcaacctggaaaacaagggggacggccaggtgcgcctgacctttcatatccccacccgggggctcttcggcttccgttccgaattccttaccgatactaaaggtctgggcatcatgcaccacgcctttcaccattacgccccctatgccggggagattgctacccggacgcgtggttctctggtggcctttgaaaccggggaaacaaccagctatggcctggagaacgcccaggagcggggcgagctctttgtcggccctggggtaccagtctaccgggggatgattgtcggcgagcattcccggcccggcgacctgatgatcaacgtctgcaaaaaaaagcaactgaccaacgtccgcagttctaccgccgatattgctatcaaactggtcccgccccgggagatgaccctggagcagtgcctggaatttatcgctgccgacgaactcctggaagtgacgcccaggtccctcaggatgcgaaagagggatatataa

SEQ ID NO: 3748 - protein, 592 aa, Moorella thermoacetica ATCC 39073
MDQQKIRNLAIIAHVDHGKTTLVDGMLKQSGIFHEKQVVQERILDRNDLERERGITIMAKNTAVFYRGYKLNIVDTPGHADFGGEVERIVQMVDGALLLVDAFEGPMPQTRFVLKKALAVGLKPIVVINKMDRPNARPGAVVDEVLDLFIDLGATEEQLDFPVVYTVARQGTASLDPDQPGKDLQPLFDIIVQHIPAPGGDPEATLQVGVNLIDYDTYVGRQAIGRVYNGTIRARQEVAVARPDGSLVRGHVAALHVFEGLNKVPVDEAAAGEIVVVSGLEDINVANTITSPEDPRPLDFVRIDEPTVAMTFMVNKSPFAGREGEYVTSRKLRERLLREAESDVSLRVEETDSPDALLVSGRGELHLAILIETMRREGYEFEVSRPQAIIKEIKGVKCEPVEELIIEVPETYMGIVIERLGPRKSEMVNLENKGDGQVRLTFHIPTRGLFGFRSEFLTDTKGLGIMHHAFHHYAPYAGEIATRTRGSLVAFETGETTSYGLENAQERGELFVGPGVPVYRGMIVGEHSRPGDLMINVCKKKQLTNVRSSTADIAIKLVPPREMTLEQCLEFIAADELLEVTPRSLRMRKRDI

SEQ ID NO: 3749 - DNA, 1827 bp, Burkholderia thailandensis E264
  CDS (1)..(1827): transl_table=11
atgacccgcgcccttcgcaacatcgccatcatcgcccacgtcgaccacggcaagacgacgctcgtcgaccaactgctccgccagtccggcaccttccgcgagaaccagcagattgccgagcgggtgatggactcgaacgacatcgaaaaggagcgcgggatcacgattctcgcgaagaactgcgcggtcgaatacgagggcacgcacatcaacatcgtcgacacgccagggcacgcggacttcggcggcgaagtggagcgcgtgctgtcgatggtcgactcggtgctgctgctcgtcgatgcggtcgagggcccgatgccgcagacccgcttcgtgacgaagaaggcgctcgcgctcggcctgaagcccatcgtcgtgatcaacaagatcgaccgcccgggcgcgcgcatcgactgggtgatcaaccagaccttcgacctgttcgacaagctcggcgcgaccgaggagcagctcgacttcccgatcgtctacgcatcgggcctgaacggttacgcgtcgctcgatccggccgcgcgcgacggcgacatgcgcccgctcttcgaggcgattctcgagcacgtgccggtccgtccggccgatccggaggcgccgctgcagttgcagatcacgtcgctcgactattcgacgtacgtcgggcgcatcggcgtgggccgcatcacgcgcgggcgcatcaagccgggccagccggttgcgatgcgcttcggcccggagggcgaggtgctgaaccgcaagatcaaccaggtgctgtcgttcaaggggctcgagcgcgtgcaggtggagtcggccgaggcgggcgacatcgtgctgatcaacggcatcgaggatgtcggcatcggcgcgacgatctgcgcggtggacgtgcccgaggcgttgccgatgatcaccgtcgacgagccgacgctgacgatgaacttcctcgtcaactcgtcgccgctcgccggccgcgaaggcaagttcgtgacgagccgccagatccgcgaccgcctgatgaaggagctgaaccacaacgtcgcgctgcgcgtgaaggacacgggcgacgaaaccgtgttcgaggtgtcgggccgcggcgagctgcacctgacgatcctcgtcgagaacatgcgccgcgagggctacgagcttgcggtgtcgcgtccgcgcgtcgtgatgcaggagatcgacggcgtcaagcacgagccgtacgagctgctgacggtcgacctcgaggacgagcaccagggcggcgtgatggaggagctcggccgccgcaagggcgaaatgctcgacatggtgtccgacgggcgcggccgcacgcgtctcgaataccggattccggcgcgcggcctgatcggcttccagggcgaattcctgacgctcacgcgcggcacgggcctgatgagccacatcttcgattcgtacgcgcccgtcaaggaaggctcggtcggcgagcgccgcaacggcgtgctgatctcgcaggacgacggcgctgcggtggcgtacgcgctgtggaagctgcaggatcgcggccgcatgttcgtgaagccgggcgacgcgctttacgagggcatgatcatcggcattcacagccgcgacaacgacctcgtcgtgaatccgatcaagggcaagcaactgaccaacgtgcgcgcgtcgggcaccgacgaagcggtgcgtctcgtgccgccgatccagatgtcgctcgaatacgcggtcgagttcatcgatgacgacgagctcgtcgaggtgacgccgcagtcgatccgcctgcgcaagcgtcacctgaaggagcatgagcgtcgccgcgcgagccgcgaggccgaagccggctga

SEQ ID NO: 3750 - protein, 608 aa, Burkholderia thailandensis E264
MTRALRNIAIIAHVDHGKTTLVDQLLRQSGTFRENQQIAERVMDSNDIEKERGITILAKNCAVEYEGTHINIVDTPGHADFGGEVERVLSMVDSVLLLVDAVEGPMPQTRFVTKKALALGLKPIVVINKIDRPGARIDWVINQTFDLFDKLGATEEQLDFPIVYASGLNGYASLDPAARDGDMRPLFEAILEHVPVRPADPEAPLQLQITSLDYSTYVGRIGVGRITRGRIKPGQPVAMRFGPEGEVLNRKINQVLSFKGLERVQVESAEAGDIVLINGIEDVGIGATICAVDVPEALPMITVDEPTLTMNFLVNSSPLAGREGKFVTSRQIRDRLMKELNHNVALRVKDTGDETVFEVSGRGELHLTILVENMRREGYELAVSRPRVVMQEIDGVKHEPYELLTVDLEDEHQGGVMEELGRRKGEMLDMVSDGRGRTRLEYRIPARGLIGFQGEFLTLTRGTGLMSHIFDSYAPVKEGSVGERRNGVLISQDDGAAVAYALWKLQDRGRMFVKPGDALYEGMIIGIHSRDNDLVVNPIKGKQLTNVRASGTDEAVRLVPPIQMSLEYAVEFIDDDELVEVTPQSIRLRKRHLKEHERRRASREAEAG

SEQ ID NO: 3751 - DNA, 1809 bp, Syntrophus aciditrophicus SB
  CDS (1)..(1809): transl_table=11
atgaaaataagaaacgtagctatcatcgcccatgtcgaccacggcaagacaacgctggttgacaaactgctgatccagagcaagatcttccgtgaaaaccaggaagtgcgggactgctttcttgattccaacgatctggaacgcgaacggggaatcaccattctgtccaaaaacatctccatcaactataagggtcacaaaatcaacatcatcgacacccccggacattccgatttcggtggggaagtggaacgcgtccttaagatggctgacggcgccattcttcttgtggactcctttgaaggggcgatgccgcaaacgcgctttgtcctccagaaggccctgtccttcaatctgacccccattctggtcatcaacaagatggacaagccgaaccgcaggcccgccgaggtgcttgacgaagtctatgaccttttcatcgacctgggcgcagatgacgagcagatggaatttcccgtactctatgcatcaagccgtttcggctggtcttccctccttccggacgtggaaggaaaggatctgacctcactgctggatgccgtgatcgactccattcccgcacccaaagaggtggaaggacctctacaaatgcaggtcaccacggtggattactcagattatgtgggacgtatcgccatcgggcgcgtcttccggggaaagatcagagccggcatgccgatcgccgttctgaaacgtgacggatttacccagaaatcggcgatcaaggatgtttttctttttgagggactgcagcgcagcaaggcggaggaagttccctgcggggatatctgcgccattattggtccggaggacatcgatatcggggacaccattgccgacatcgagaatccggaagccctgcctatcatccccgtggatgaaccgaccatgagcatgacgttcatgcataacgattcgccctttttcggcaaggaaggccgttatgtcacaggccgtcatctgcgggatcgccttttccgcgagctgaagagcgatgtggcgctccagattgaagcagcctcaggtaccgacgcgttgaaggtttacgggcgaggcattctgcatctgtcgatcctgattgagacgatgcgtcgggaaggctacgaatttcaggttggacagcctcatgtgatctacaaggaaatcaacaaccggaaggcggagcccatcgagctgcttattgtcgatgcgcccgcggatctctcgggcagggtcatcgaagtggtcggcaggaagcgcggcgaactgaaaaaaattgattcaatcggcggccgctcgcgactggagttccacatcccgtcccgcggcatgatcggtttgcgcaaccgcctcctcaacgccacggctggagaagccgtcattaatcatcagttttaccaatacgaacccttcaaaggctccatccctcaccggcagaacggcgtactgatttccatgcaggcgggaccagccacggcctatgccctcgacgcacttcaggcccggggacgtttcttcatctcgccgggggaagtggtctatgagggacagatcatcggcgagcacaacaaagaggaagatatggtcgttaacgttcagagggcaaagaaactgacgaacatgcgcgcctccggaagtgacgaagccgtcaagctgtcgccgcccgttgtcttttctcttgaggaagcattggagtacatcactgaaggcgaaatcgtggagatcactcccaaatccatccggttgcgcaaaaaaatcctcggcgaatgggaacggcgcaaggccgaacgtctggaaagcgtgagttaa

SEQ ID NO: 3752 - protein, 602 aa, Syntrophus aciditrophicus SB
MKIRNVAIIAHVDHGKTTLVDKLLIQSKIFRENQEVRDCFLDSNDLERERGITILSKNISINYKGHKINIIDTPGHSDFGGEVERVLKMADGAILLVDSFEGAMPQTRFVLQKALSFNLTPILVINKMDKPNRRPAEVLDEVYDLFIDLGADDEQMEFPVLYASSRFGWSSLLPDVEGKDLTSLLDAVIDSIPAPKEVEGPLQMQVTTVDYSDYVGRIAIGRVFRGKIRAGMPIAVLKRDGFTQKSAIKDVFLFEGLQRSKAEEVPCGDICAIIGPEDIDIGDTIADIENPEALPIIPVDEPTMSMTFMHNDSPFFGKEGRYVTGRHLRDRLFRELKSDVALQIEAASGTDALKVYGRGILHLSILIETMRREGYEFQVGQPHVIYKEINNRKAEPIELLIVDAPADLSGRVIEVVGRKRGELKKIDSIGGRSRLEFHIPSRGMIGLRNRLLNATAGEAVINHQFYQYEPFKGSIPHRQNGVLISMQAGPATAYALDALQARGRFFISPGEVVYEGQIIGEHNKEEDMVVNVQRAKKLTNMRASGSDEAVKLSPPVVFSLEEALEYITEGEIVEITPKSIRLRKKILGEWERRKAERLESVS

SEQ ID NO: 3753 - DNA, 1863 bp, Frankia sp. CcI3
  CDS (1)..(1863): transl_table=11
atgtccgccccggagcgcatcaccgtgtctcttcgtgccgatcttcgaaacgtggcaatcatcgcccacgtcgaccacggcaagaccaccctcgtcgacgccatgctgcgccagtccggcgcgttcggcgagcatgccgagctcaccgaccgcgtgatggactcgatggacctggagcgtgagaagggcatcacgatcctcgcgaagaacaccgcggtccgttacggcgacatcacgatcaacatcgttgacacgcccggtcacgccgacttcggcggtgaggtcgagcgtggcctgtcgatggtcgacggcgtcctgctgctcgtggacgcgagcgagggcccgctgccccagacgcgcttcgtcctgcgcaaggcgctcgcggcgcggctgccggtggtgctcgtcatcaacaaggtggaccggtcggacgcccggatcgccgaggtggttgacgagacctacgagctcttcctcgacctcgacgccgacgaggaccagatcgacttcccgatcgtctactgcaacgcgaaggcgggtcgtgcctccaccacccgcccggccgacggggtgagcccggactcacccgatctcaagccgctgttcgaccttctgctggagaccgtgccggcgccgtcgtttgatcctgactcgccgctgcaagccctggtcaccaacctcgacgcgtccccgtacctcggccggctcgcgctgtgccgggtgcacaacggcacgatcaagcgtggtcagccggcgacgctgtgccgggccgacggcagccagcagcgcgtcaagatcagcgagatgctgatgacgcaggcgctcgagcgggtaccggcggagtcggccgggccgggcgacatcatcgccatcgccggcatccccgacatcacgatcggggagaccctcgccgacgccgatgatccccggccgctgccggttatcaccgttgacgaaccgtccatcagcatgacgatcggcatcaacacctccccgctcgccggccgttccggcaagaagctgacggcgcggctggtcaagaaccggctggacgccgagctcgtcggcaacgtgtcgatccgggtcctgcccaccgagcggccggacacctgggaggtgcagggccgcggggagctgcagctcgccgtgcttgtcgagctgatgcggcgcgaggacttcgagctgaccgtcggcaagccgcaggtcgtcacccgcactgtcgacggtaagatccacgagccggtggagcgcctcaccatcgacgcgcccgaggagttcctcggcacgctgacccagctgctcgcgctgcgcaagggccgggtcgagcagatggtcaaccacggcaccggctggatccggctggagtacctggtcccggcccgcgggctgatcgggttccggaccgagttcctcaccgagacccgcggtaccgggctgctgcaccacgtcttcgaccggtacgagccctggttcggggagctgcgcacccgggcgacaggctccatggtcgccgaccgcagcggggtggcgaccgcatacgccctgttcaacctccaggaacgcggcacgatgttcgtcgggccgacgaccgaggtctacgagggcatgatcgtgggtgagaactcccgggcggacgacatggacgtcaacccgaccaaggaaaagaagctcaccaacatgcgttcatccaccggcgacgagctggtccggctcaccccgcaccggatactcacccttgagcaggcgctggagttctgccgcgaggacgagtgcgtggaggtcaccccgggcttcgtgcgtctgcgcaaggtggcgctgaccgccgccgagcgcgagaagatccgctcccgccgccgagcctga

SEQ ID NO: 3754 - protein, 620 aa, Frankia sp. CcI3
MSAPERITVSLRADLRNVAIIAHVDHGKTTLVDAMLRQSGAFGEHAELTDRVMDSMDLEREKGITILAKNTAVRYGDITINIVDTPGHADFGGEVERGLSMVDGVLLLVDASEGPLPQTRFVLRKALAARLPVVLVINKVDRSDARIAEVVDETYELFLDLDADEDQIDFPIVYCNAKAGRASTTRPADGVSPDSPDLKPLFDLLLETVPAPSFDPDSPLQALVTNLDASPYLGRLALCRVHNGTIKRGQPATLCRADGSQQRVKISEMLMTQALERVPAESAGPGDIIAIAGIPDITIGETLADADDPRPLPVITVDEPSISMTIGINTSPLAGRSGKKLTARLVKNRLDAELVGNVSIRVLPTERPDTWEVQGRGELQLAVLVELMRREDFELTVGKPQVVTRTVDGKIHEPVERLTIDAPEEFLGTLTQLLALRKGRVEQMVNHGTGWIRLEYLVPARGLIGFRTEFLTETRGTGLLHHVFDRYEPWFGELRTRATGSMVADRSGVATAYALFNLQERGTMFVGPTTEVYEGMIVGENSRADDMDVNPTKEKKLTNMRSSTGDELVRLTPHRILTLEQALEFCREDECVEVTPGFVRLRKVALTAAEREKIRSRRRA

SEQ ID NO: 3755 - DNA, 1845 bp, Novosphingobium aromaticivorans DSM 12444
  CDS (1)..(1845): transl_table=11
atgtcgctgcccctgcgcaacatcgcgatcatcgcacacgtcgaccacggcaagaccacgctcgtggaccagctcttccgccagtccggcaccttccgcgacaaccagcgcgtcgaagagcgcgcgatggactccaacgacctcgagaaggaacgcgggatcaccattctcgcgaagtgcacctcggtcgaatggacctcgccgacctcgggcgagaccacccgcatcaacatcgtcgacacccccggccacgccgacttcggcggcgaggtcgagcgcatcctctcgatggtcgacggcgtgatcctgctggtcgacagctcggaaggcgcgatgccgcagaccaagttcgtcaccggcaaggcgctcgccctcggtctcaagccgatcgtggtggtcaacaagatcgaccgtcccgacggccgcgcgcaggaagtgctcgacgaggtgttcgacctcttcgtcagcctcgacgccaacgacgagcagctcgaattcccggtgctctacgcttcgggccgcaatggctacgcctcggacaacgaggaagctcgtgaaggcacgctcgagccgctgttcgagaagatcgtcagccacgtgccggcgccgaacctcgacgtcgacggtccgttcagcttcctcgccaccctgctcgaccgtgacaacttcatgggccgcgtgctgaccggtcgcgtccagtcgggcacgatcaaggtcaaccagccgatccacgcgctcgacgccgacggcaaggtgatcgaagtgggccgcgcctccaagctgatgagcttcaacggtcttgatcgcgtgcccgtcgaggaagccaaggcaggtgacatcatcgcgcttgccggcctcgaaaaggccaccgtcgccaacaccatcgccgacccctccgtgaccgagccgatcgcctcgcagccgatcgatccgccgaccctcgccatgcgcttcgccgtgaacgacagcccgttcgccggccgcgaaggcgacaaggtgaccagccgcatgatccgcgatcgcctgctgcgcgaggcggaaaccaacgtcgccatccgcgtgacggaatcggctgacaaggacagcttcgaagttgccggtcgcggcgaactccagctcggcgtgctgatcgagaccatgcgccgcgaaggcttcgagctgggcatcagccgcccccgcgtgctgttccagaccgacgagaacggccagcgcaccgaaccgtatgaaaccgttgttatcgacgtggacgacgagttctccgggacggtcgtcgagaagatgcagcgccgcaaggccgagcttaccgacatgcgcccgtcgggtgccggcaagacccgcatcctgttctcggcgccgtcgcgcggcctcatcggctaccacggcgagttcctttcggacacgcgcggcaccggcatcatgaaccgcctgttcgagaagtacggcccccacaagggcccgatcgaaggccgccagaacggcgtgctgatctcgaacggcaccggcgaggccgtgggctacgcgctcaacagcctcgaggatcgtggtatcctgttcgtgcgcccgcaggacaagatctacgaaggcatgatcatcggcgagaacgccaagccggaagaccttgaagtcaacccgatgaagtccaagcagctcacgaacttccgttcgacgggcaaggacgacgcgatccgcctgaccccgccgaagatcatgacgctggaacaggccatcgcctacatcgacgacgacgaaatggtcgaagtcacgcccaagaccatccgcctgcgcaaggcgatcctcgatccgaacgaacgcaagaaggcgtcgcggaagaaggaagcggcataa

SEQ ID NO: 3756 - protein, 614 aa, Novosphingobium aromaticivorans DSM 12444
MSLPLRNIAIIAHVDHGKTTLVDQLFRQSGTFRDNQRVEERAMDSNDLEKERGITILAKCTSVEWTSPTSGETTRINIVDTPGHADFGGEVERILSMVDGVILLVDSSEGAMPQTKFVTGKALALGLKPIVVVNKIDRPDGRAQEVLDEVFDLFVSLDANDEQLEFPVLYASGRNGYASDNEEAREGTLEPLFEKIVSHVPAPNLDVDGPFSFLATLLDRDNFMGRVLTGRVQSGTIKVNQPIHALDADGKVIEVGRASKLMSFNGLDRVPVEEAKAGDIIALAGLEKATVANTIADPSVTEPIASQPIDPPTLAMRFAVNDSPFAGREGDKVTSRMIRDRLLREAETNVAIRVTESADKDSFEVAGRGELQLGVLIETMRREGFELGISRPRVLFQTDENGQRTEPYETVVIDVDDEFSGTVVEKMQRRKAELTDMRPSGAGKTRILFSAPSRGLIGYHGEFLSDTRGTGIMNRLFEKYGPHKGPIEGRQNGVLISNGTGEAVGYALNSLEDRGILFVRPQDKIYEGMIIGENAKPEDLEVNPMKSKQLTNFRSTGKDDAIRLTPPKIMTLEQAIAYIDDDEMVEVTPKTIRLRKAILDPNERKKASRKKEAA

SEQ ID NO: 3757 - DNA, 1839 bp, Anaplasma phagocytophilum HZ
  CDS (1)..(1839): transl_table=11
atgtcgagtggctacgattccatacgtaatttagctattgtcgcgcacgtggatcatggaaagaccacgttgctggatagtatgctaaggcagagtggtgcttttagagataatcaagatgttgtggaccgtgttatggatagcaatgatcttgagagggagcgtggtattaccatcttggccaagtgtactgccattacttggaagaaccataagatcaatgttatcgatactcctggacatgctgacttcggtggtgaagtggagcgggtactgtctatggcagatggggtattgttgcttgtagatgcctctgagggccctatgcctcagacaaaatttgtgctctcaaaagcgctaaaggctaaattattgcccatagttgttgttaataaggtagatcgtccagatagtcgcgtaagtgaggttcttgatgaggtttatgaactttttatcaatctggatgctacgagtgagcagttagatttcccggttctctatgcttctggtagagaaggttggtgctctaagagtttgactgatgagaagaaggggttagagccgctgtttgagggaatattagagcatataaagccaaaacagtacgacttaaatgcgccgtttagtatgctattgacgttattggagtcagacaagtttttgggtagggtgctgactggtaaggtttatggcggtagggccaagataaactcacaggtgaaggtattgaacctcgctggtgaggttgtagagagtggtaggctcacgaagcttttgtctttttcggggctaaaaagggttcctgttgaagaggcagatgcgggtgacataatagctgttgcagggctggaaagggcttctgtatctgatagcattgtagatgtatctgtaactgtgcctatagagtctactcctgtagatcctccaactatggctgtgactattggtgtgaatgactcgccaattgcagggactgagggaacgaaattgacttctactgctataaagcagaggttgctttctgaagcggaaactaatgttgcgattactgtaaaagaaggtgctagaagtgaggcctatgaggtaggcggtagaggtgaattgcagcttggtgtcttgatagagacaatgaggcgtgaagggtttgagctttctgtatcgcgaccgcgtgtgatttttaaaaaggaaggttccacaatattagagcctatagaagaggtgataatagatgtagatgaagagtatagtggcgttataatggaaaagctgagcttccggaaaggtgacatgcaagatatgactccttctgggaagggcagggttagaatggtgtttttaatgccgtcacgtggtctaataggttaccatggggagtttttaacagactctagaggcaccggtataatgaacagattgttccatggatatgctccacataagggggaaatttctggaaggatgaacggtgtgcttatttctacagggcagggagaggccgttgcatatgccatttttaacttacaagatcggggtatgatgtttatcaagcctcaggataaagtttatatggggatgattgttgggcttcataatagaaataatgatattgaagtcaatgtgctgaagggtaagcagttgactaatgtgagggctgcaggatcggatgaagctgtgaggttagttccgccgaaaatgatgtctttggaggagatgatagggttcatcaatgacgatgagctggttgaatgtactccgaaatcaataaggttgaggaagagattccttgatccaaacgagcggaagcgctttgccagatctaagggaattatcgaaggttag

SEQ ID NO: 3758 - protein, 612 aa, Anaplasma phagocytophilum HZ
MSSGYDSIRNLAIVAHVDHGKTTLLDSMLRQSGAFRDNQDVVDRVMDSNDLERERGITILAKCTAITWKNHKINVIDTPGHADFGGEVERVLSMADGVLLLVDASEGPMPQTKFVLSKALKAKLLPIVVVNKVDRPDSRVSEVLDEVYELFINLDATSEQLDFPVLYASGREGWCSKSLTDEKKGLEPLFEGILEHIKPKQYDLNAPFSMLLTLLESDKFLGRVLTGKVYGGRAKINSQVKVLNLAGEVVESGRLTKLLSFSGLKRVPVEEADAGDIIAVAGLERASVSDSIVDVSVTVPIESTPVDPPTMAVTIGVNDSPIAGTEGTKLTSTAIKQRLLSEAETNVAITVKEGARSEAYEVGGRGELQLGVLIETMRREGFELSVSRPRVIFKKEGSTILEPIEEVIIDVDEEYSGVIMEKLSFRKGDMQDMTPSGKGRVRMVFLMPSRGLIGYHGEFLTDSRGTGIMNRLFHGYAPHKGEISGRMNGVLISTGQGEAVAYAIFNLQDRGMMFIKPQDKVYMGMIVGLHNRNNDIEVNVLKGKQLTNVRAAGSDEAVRLVPPKMMSLEEMIGFINDDELVECTPKSIRLRKRFLDPNERKRFARSKGIIEG

SEQ ID NO: 3759 - DNA, 1791 bp, Neorickettsia sennetsu str. Miyayama
  CDS (1)..(1791): transl_table=11
atgaataacaagactctaaacatagccgtaattgctcacgtggatcacggaaaaacaacgttaactaataatctgcttaggcaggccaatgttttggatgaggtcggcatggacagaaatccattggaacagaaacgtggtattacaatgttctcgaaggttgcttctgtatcttatgggaatgtgaaaatcaatcttatagatacaccaggacactcggattttggaggtgaggtagagcgcatcctgtcaatggtagactctgttatgttacttgttgatagtgcagaaggtgttatgccgcaaacaaaatttgtcctctcaaaggcgcttaaggtaggattgaggcctatagtgataataaacaaagttgatcgtccagataggagaattgaagaggtcatcaatgaaatatctgacctttttcttgctctggaagcgaatgatgagcaactagattttcctgttctgtatgcctccggtagagatggttggtgtgtccgtgatctcaatgatcagcgagaaagcctcgtaccactgttggaaacaataatagggtacactcctgtccggaaatatgatagagaagcacctttttcaatgctcgttacgatgctcgaaaatgacaatttccttggaagaattttaattggaaagatagagcagggttctatttcagtgaatgcacacgtaaaggcaataaatttaagtggggaattgttagagaattcccgcataactaagttgcaaatttttgacggtatggtgaagaaggttgttgagaatgcagaagcaggcgaaataattgctatcgctggtttagcagatacatcggtcactgatactgtatgcgatccatcggtgaatacaccaattgatgctattccaattgatcccgctactatctctatcaacatttccgttaatacttcccctttcactggtaaagaggggaataaactaacttctcgtatgattttggcgcgcctcctacaagaggtgaagacaaatgtttccataaaaatggaagaaagaggagaaggacaatttgaagtgatgggacgtggagaattacagctcggtgttctgatcgagaacatgagaaaagagggctttgaattatctgtttcacggccaaaggtagtgataaaaatcgacgagaatggtcaaaaaatggagccgatcgaagagcttacaatcgatatggatgaagaatacgcagggatagtaatggagaccctaaacacaaggaaagggatcatgcaatctatggaaaactacccgggaggaagggtaaggttggtatatcatattcctgcacgttcgttgattggatatcatgggaagttctactcagataccagaggaagtggtatactgaataaagtattttatggctacgcaccatactctgggaagatagatagtagatcgaatggtgttttggtatcgaatggacaaggggaagctgttgcttatgcactcttcaatttacaggatagaggcataatgtttgtaaagccacaggatccggtctactgtggaatgatagtaggtgaacacagcaggggtaatgaccttgatgtaaatgtcctcaagggtaagcagctcacaaatattcgtgctgctggtagtgatgaggcagtcaggcttagtccacccttgctaatgacgttagaagaaatgatggcttatattaatgatgatgaacttgttgaagtgacaccgttgtctttgaggttgcgtaaaaaggtattggattccaacatgaggaaaaaacagaacgtctaa

SEQ ID NO: 3760 - protein, 596 aa, Neorickettsia sennetsu str. Miyayama
MNNKTLNIAVIAHVDHGKTTLTNNLLRQANVLDEVGMDRNPLEQKRGITMFSKVASVSYGNVKINLIDTPGHSDFGGEVERILSMVDSVMLLVDSAEGVMPQTKFVLSKALKVGLRPIVIINKVDRPDRRIEEVINEISDLFLALEANDEQLDFPVLYASGRDGWCVRDLNDQRESLVPLLETIIGYTPVRKYDREAPFSMLVTMLENDNFLGRILIGKIEQGSISVNAHVKAINLSGELLENSRITKLQIFDGMVKKVVENAEAGEIIAIAGLADTSVTDTVCDPSVNTPIDAIPIDPATISINISVNTSPFTGKEGNKLTSRMILARLLQEVKTNVSIKMEERGEGQFEVMGRGELQLGVLIENMRKEGFELSVSRPKVVIKIDENGQKMEPIEELTIDMDEEYAGIVMETLNTRKGIMQSMENYPGGRVRLVYHIPARSLIGYHGKFYSDTRGSGILNKVFYGYAPYSGKIDSRSNGVLVSNGQGEAVAYALFNLQDRGIMFVKPQDPVYCGMIVGEHSRGNDLDVNVLKGKQLTNIRAAGSDEAVRLSPPLLMTLEEMMAYINDDELVEVTPLSLRLRKKVLDSNMRKKQNV

SEQ ID NO: 3761 - DNA, 1845 bp, Ehrlichia chaffeensis str. Arkansas
  CDS (1)..(1845): transl_table=11
atgttgtcacaaggtgattatcagtcgatatgtaatttagcaattattgctcatgttgatcatgggaaaacaacgctattagatggtatgttaaaacagagtggtacatttagagaaaatcaagatgtagctgaaagggtgatggataataatgatttggaacgtgaacgtggtattaccattttagcaaagtgtacatctgttatttggcaaggtaagaaaattaatataattgatactccaggacatgcggattttggtggagaggtagaaagagtattgtcaatggcagatggagtgttactgcttgttgatgcgtcagagggtcctatgcctcagactaagtttgtcttatcaaaagcattgaaagctggattattaccaatagtgattataaataaagttgataggccagatagtagagtagatgaagtactagatgaagtgtatgagttatttatcaatctggatgctactagtgagcaattggattttccaatattatatgcatcaggaagaaatggatggtgtgttaaaaatttgtctgataatagggaaagtttagtaccattatttgaagcgattgttgaatatgtaaagcctgtttcttatgatgctaatgcaccatttactatgttgttgactttattagagtcggacaaatttttaggtagaatattaacgggaaaaatatatacaggtacaatacgggttaatgacagtgttaaagtattgaatttatctggtgaagttgttgaatatggtaaacttacaaagcttttggcattttcaggggtaaagcgtatcccaattaaagaggcaaaagctggggatattattgctgttgcaggtcttgagaaggcttctgtatctgatagtattcttgatagttctattaattttcctattacatcaacacctgttgatcctccaactatggcagtaactattagtgtgaatgactcgccatttgctggtacggaaggagtaaaattgacatcgactgttattaaagcacgccttgtagctgaagctgaaacaaacgttgcaattacagttaaagagacagagcagggtgatgcatatgaggttggtggaagaggagaactacagcttggagtgttaattgagactatgagaagggaaggttttgaactatctgtatctagacctcgtgttttattacgtaaagatgatcaaggtcaagttttagaacctatagaagaagttgttatagatgtagatgaagcatacagcggtgtgattatggaaaaattaagtttccgtaaaggtgatatgcgagatttacgtccatctggaaaagatagagtgagaatgatatttttagttccttcacgtggtcttatagggtatcagggagaatttttaacagactctcatggtactggaattatgaaccggttattccatagttatgctccacataaaggtaatattcctactagaaataatggagttcttatttctactgataaaggtgatgcagtagcttatgcaatatttaatttgcaagatcggggtattatgtttgttaaacctcaagataaagtatattgtggaatgattgttgggcttcataatcgtgaaaatgatattgatgttaatgtattaaagggtaaacaattaactaatataagagcagcaggttcagatgaagcagttaggttagttccaccaaaagtaatgactttagaagaaatgatagcatttattaatgatgatgaattagttgaatgtacacctaaatctatccgtttgcgtaaaaaatatttagatcctaatgaacgtaaacgtgcttcccgtgctagtaagaatatggtctag

SEQ ID NO: 3762 - protein, 614 aa, Ehrlichia chaffeensis str. Arkansas
MLSQGDYQSICNLAIIAHVDHGKTTLLDGMLKQSGTFRENQDVAERVMDNNDLERERGITILAKCTSVIWQGKKINIIDTPGHADFGGEVERVLSMADGVLLLVDASEGPMPQTKFVLSKALKAGLLPIVIINKVDRPDSRVDEVLDEVYELFINLDATSEQLDFPILYASGRNGWCVKNLSDNRESLVPLFEAIVEYVKPVSYDANAPFTMLLTLLESDKFLGRILTGKIYTGTIRVNDSVKVLNLSGEVVEYGKLTKLLAFSGVKRIPIKEAKAGDIIAVAGLEKASVSDSILDSSINFPITSTPVDPPTMAVTISVNDSPFAGTEGVKLTSTVIKARLVAEAETNVAITVKETEQGDAYEVGGRGELQLGVLIETMRREGFELSVSRPRVLLRKDDQGQVLEPIEEVVIDVDEAYSGVIMEKLSFRKGDMRDLRPSGKDRVRMIFLVPSRGLIGYQGEFLTDSHGTGIMNRLFHSYAPHKGNIPTRNNGVLISTDKGDAVAYAIFNLQDRGIMFVKPQDKVYCGMIVGLHNRENDIDVNVLKGKQLTNIRAAGSDEAVRLVPPKVMTLEEMIAFINDDELVECTPKSIRLRKKYLDPNERKRASRASKNMV

SEQ ID NO: 3763 - DNA, 1851 bp, Desulfitobacterium hafniense Y51
  CDS (1)..(1851): transl_table=11
atgaaagggaaattcttaatgaaatcaatgaatattcgtaatatcgccatcatcgcccacgttgaccacggcaaaacaaccctagttgatgcaatgctcagacaaagcggaaccttccgcgccaatcaaaatgttatggagcgggttatggactccaatgacctggaacgggagagagggattaccattctctccaagaatacagcggtcaattggttggatacaaaaatcaatattgtggatacaccgggtcacgccgattttggcggtgaagtggaacgggtcttgaagatggtgaacggggtgctcctgattgtggattcctttgaagggcccatgccccaaacacgctttgtgttaagaaaagctttagagctgaagcttgttcccatcgtggtgattaataagattgaccgtcctgatgcccgtcctgctgaagtggtggacgaggtgctggatttatttatcgaattaggtgccgatgaagagcagctggatttccccgtagtctatgcttccgcccgggatgggatcgccggactggatcccgaccaactcaccgatagcctggagcctcttttcagtgtggtgctggagcatattcccgctcccagtgtggatgtggaagcccctctgcagctcctggttaccacccttgattatgacgactatgtaggcaagattgtgatcgggcgcattgtccggggcaaggtccgccaaggagagaatatcgccctgatcaaacgggatggtgttttggagcgggccaaaatcggcaaagtctatacctatgaagggttgaaacgtatcgatgtgcccgaggcagaggctggagaaatcgtggcccttaccggcttgaccactgccaatatcggggaaaccgtagccgatgccaataatccggaagcactgccggtgattgaagtggatgaacccactttgaatatgaattttattgttaacaacagcccttttgccggactggaaggggaatttgtgacctcccgcaaattaagggagcgcttattcaaagagatcgagaccaatgtgagccttcgtgtggaagaaacggactccgccgattccttcaaggtatccggccggggggagctccatttatccattctaattgagaatatgcgccgggaaggctatgagcttcaggtttccaagcccgaggtgatctataagatgattgacggggagaaatgtgaaccgattgagtatcttatctgtgatattccggaaaccgctatgggtacagtcattgaattgctggggaaacggaaagcggaaatgatcaatatggcccatatttcccagacccagatacgggtggaattcaaagttcccgcccgggggctgatcggctttcggggggatttcctgaccgaaacccggggcgaagggatcatgagccatgttttccacggttatgagccctataaaggcgaaataccgggcagaagccggggggttttgatcgcgtttgagaccggcgaggcgacaacctatgggctgcattccgctcaagaacggggcatcatctttattgaccccggtaccaagatttatgaaggcatgattgtgggggaaagcaaccgggaacaggacatcgaagtcaatgtggccagaaaaaaacatgtcaccaatatgcgtgccagcaactctgaggaagcccttcgtttggagaaagccaaagtctttaccttggagcaggccctggaatatattgatgatgatgagttggtggagatcacaccgaagagcgttcgcttgcggaaaaagcacctcgacaaaaatgcccgtgtccgctatgccaaatccctggcttccaacagcgcaaaatga

SEQ ID NO: 3764 - protein, 616 aa, Desulfitobacterium hafniense Y51
MKGKFLMKSMNIRNIAIIAHVDHGKTTLVDAMLRQSGTFRANQNVMERVMDSNDLERERGITILSKNTAVNWLDTKINIVDTPGHADFGGEVERVLKMVNGVLLIVDSFEGPMPQTRFVLRKALELKLVPIVVINKIDRPDARPAEVVDEVLDLFIELGADEEQLDFPVVYASARDGIAGLDPDQLTDSLEPLFSVVLEHIPAPSVDVEAPLQLLVTTLDYDDYVGKIVIGRIVRGKVRQGENIALIKRDGVLERAKIGKVYTYEGLKRIDVPEAEAGEIVALTGLTTANIGETVADANNPEALPVIEVDEPTLNMNFIVNNSPFAGLEGEFVTSRKLRERLFKEIETNVSLRVEETDSADSFKVSGRGELHLSILIENMRREGYELQVSKPEVIYKMIDGEKCEPIEYLICDIPETAMGTVIELLGKRKAEMINMAHISQTQIRVEFKVPARGLIGFRGDFLTETRGEGIMSHVFHGYEPYKGEIPGRSRGVLIAFETGEATTYGLHSAQERGIIFIDPGTKIYEGMIVGESNREQDIEVNVARKKHVTNMRASNSEEALRLEKAKVFTLEQALEYIDDDELVEITPKSVRLRKKHLDKNARVRYAKSLASNSAK

SEQ ID NO: 3765 - DNA, 1827 bp, Saccharophagus degradans 2-40
  CDS (1)..(1827): transl_table=11
gtgtcccttcccgatattactaaacttcgcaatgttgccatcattgctcacgttgaccatggcaaaaccacacttgttgataaattactgcagcaatctggcacgctcgatcgcaaagaccaaggtgccgagcgcatcatggattccaacgaccaagagaaagagcgtggaattactattttggcgaaaaacaccgccatccaatggaatgattaccgcattaacatcgtagataccccagggcacgccgacttcggcggcgaagtggagcgcgtattgtcgatggtagatagcgtatgtttgttggttgatgccgtagatggccctatgccacaaacccgctttgtaacctctaaggcctttgaaaaaggtttgcgccctattgttgttatcaacaaaattgaccgcccaggtgcgcgtccagattgggttatggaccaaatcttcgatttgttcgataacttaggcgcaaccgaagagcaactagacttcccagtggtatacacctctgcattaaacggtattgccggcaccgacccagagaagatgtcagaagacatgactcctctgtatcaaatgattgttgatgagtgcccagtacccgaagtagacccagctggctcgttccaaatgcaagtatctgcattggcttacgatagctacgtaggtgtaattggtgtgggccgcattacccgcggtacccttaagcctaatcagcaagtgattgttaagtctgccaacggcaaagagcgcaaaggtaaagtactaacggttaaaggttacttaggtttggagcaggttgaaacgcaattggccagcgccggtgaaattgtgtgtattaacggcatcgacggcttaagcatttctgatacattatgtgacccagaaaacgtagaagccctgccagcactatcggtagatgaaccaaccgtaagcatgaactttattgttaacgattcacctttcgccggtcgcgaaggtaagtttgtaacaacccgtaatattaaagaccgtttagatcaagaattgattcacaacgtggcactgcgcgtacagcagggcgatactccagataaatttatcgtatctggtcgcggtgaattgcatttgtcggtattaatcgaaaccatgcgtcgcgaaggtttcgaaatgggtgtatctcgtcctgaagttattcaaaaagttgtcgatggtgaagtgcaagagccgtacgaaaacgtcgttatcgacgttgaagagcagcaccaaggttccattatggaagagcttggtttgcgtaagggcgagttaactaacatggagccagacggtaaaggccgtgtgcgtttggagtttttgactccttcgcgcggtttgattggtttccgtggcgctttcctaaccatgacatctggttcaggtattatgaccagcatcttctctcactacggcccagttaaagtgggtgatgtagtaagccgtcaaaacggcgtactagtgagcatggttaaaggcaaaacagctgcatactcgctgtttaacctacaaagccgcggtcgcctattcttaggtcacgctgttgaggtttacgaaggccaagtaattggtattcactcgcgcgacaacgacttagcggttaacccaaccaaaggtaagcagctaaccaacgttcgtgcatcgggtaccgatgaagccctaacacttgtaccaccaatcaaacatacacttgagcaagcgctagagtttattgaagatgatgagttggtagaagtaactccagaaagcattcgtattcgcaaaaagttattaaccgaaaccgaacgcaagcgctctaaaaacagcaagtaa

SEQ ID NO: 3766 - protein, 608 aa, Saccharophagus degradans 2-40
MSLPDITKLRNVAIIAHVDHGKTTLVDKLLQQSGTLDRKDQGAERIMDSNDQEKERGITILAKNTAIQWNDYRINIVDTPGHADFGGEVERVLSMVDSVCLLVDAVDGPMPQTRFVTSKAFEKGLRPIVVINKIDRPGARPDWVMDQIFDLFDNLGATEEQLDFPVVYTSALNGIAGTDPEKMSEDMTPLYQMIVDECPVPEVDPAGSFQMQVSALAYDSYVGVIGVGRITRGTLKPNQQVIVKSANGKERKGKVLTVKGYLGLEQVETQLASAGEIVCINGIDGLSISDTLCDPENVEALPALSVDEPTVSMNFIVNDSPFAGREGKFVTTRNIKDRLDQELIHNVALRVQQGDTPDKFIVSGRGELHLSVLIETMRREGFEMGVSRPEVIQKVVDGEVQEPYENVVIDVEEQHQGSIMEELGLRKGELTNMEPDGKGRVRLEFLTPSRGLIGFRGAFLTMTSGSGIMTSIFSHYGPVKVGDVVSRQNGVLVSMVKGKTAAYSLFNLQSRGRLFLGHAVEVYEGQVIGIHSRDNDLAVNPTKGKQLTNVRASGTDEALTLVPPIKHTLEQALEFIEDDELVEVTPESIRIRKKLLTETERKRSKNSK

SEQ ID NO: 3767 - DNA, 1809 bp, Methylobacillus flagellatus KT
  CDS (1)..(1809): transl_table=11
atgtcgcgcgcccttcgtaatatcgccatcatcgcccacgtggaccatggcaagaccaccatggtggacaagctcctgcaacaggccggtacatttgccgcccaccagcaggtttcagaacgtgtcatggactccggtgatattgaaaaggaacgtggcatcacgattcttgccaagaatactgccgtcaattatgaaggcacgcatatcaatattgtcgatacgccaggacatgccgacttcggtggcgaagtcgagcgcgtactgggcatggtggatggtgtggtattgctggtcgactccgtggaaggcccgatgccgcagacccgcttcgtgaccaagaaagcgctggcgttgggattgcgtcccatcgtggtcatcaacaaggtggaccgcccgggcgcacgtcctgactgggtcatcaaccagacattcgacttgtttgccaacctgggggccacagacgagcaactggatttcccggttgtctatgcctctggcttgaatggtttcgcaacactggacctcaacaaaccgtcggatgacatgcgtcccctgttcgagaccattctcagccatgtccaaccgcccgctggcgacagcaatgctggcctgcagctacagatttctgcgctggactactctacttataccggccgtcttgggattggtcgtatccgcaatggccggatcaagccaggccagatagtggcggtcatgaagggcgatgagcaggtggcccagggccgcatcaaccaggtgctgggcttccgcggcctggagcgtgtacaggtggaagaagccgaagctggggatatcgtcatcatttccgggatcgaggaaatcggtatcggcgtcactgtggccgaccgtgataaccctgtcggcctgcctatcctggctgtggatgaaccgacgctgaccatggacttcatggtgaatacatcgccgctggctggcaccgagggcaagttcgtcaccagtcgccagatccgtgatcgcctgaacaaggaattgctgaccaatgtggcacttaaggtcgaggatactgaagatgcagacgtgttccgcgtttccggccggggcgaactccacttgactatcctgttggaaaacatgcgccgcgagggctatgaaattgctgttggcaagccgcgcgtggtgtacaaggaaatcaacggacagaagtgtgagccttatgaaatcctgacagtagacctggaagacgactgccagggcgccgtgatggaagagcttggtcgccgccgcggagagcttcagaacatggaatccgatggcaatggccgcacccgcctggaatacaagattccggcacgcgggctgatcggcttccagagcgagttcctcaccatgacgcgtggcactggcttaatggcacacattttcgatgagtatgccccggtcaaggccgacatgcccggccgccgcaatggtgtcctgatttcttccgagcagggcgaggccgtggcctatgccttgtggaaactgcaggaccgtggccgcatgttctcttcacccggtgacaagttgtatgaaggcatgatcatcggtatccacagccgcgagaacgacttggtggtgaacccgatcaagggtaagcagttgaccaacgtccgggcctctggcaccgatgaggctgtccggctggtaccacctgtgcagctgacgctggagtccgcagtcgagttcatcgacgatgacgagctggtggaaatcacgcccaagagcatccgtatccgcaagcgccacttgctggagcatgaacgcaagcgtgccgccaaggactaa

SEQ ID NO: 3768 - protein, 602 aa, Methylobacillus flagellatus KT
MSRALRNIAIIAHVDHGKTTMVDKLLQQAGTFAAHQQVSERVMDSGDIEKERGITILAKNTAVNYEGTHINIVDTPGHADFGGEVERVLGMVDGVVLLVDSVEGPMPQTRFVTKKALALGLRPIVVINKVDRPGARPDWVINQTFDLFANLGATDEQLDFPVVYASGLNGFATLDLNKPSDDMRPLFETILSHVQPPAGDSNAGLQLQISALDYSTYTGRLGIGRIRNGRIKPGQIVAVMKGDEQVAQGRINQVLGFRGLERVQVEEAEAGDIVIISGIEEIGIGVTVADRDNPVGLPILAVDEPTLTMDFMVNTSPLAGTEGKFVTSRQIRDRLNKELLTNVALKVEDTEDADVFRVSGRGELHLTILLENMRREGYEIAVGKPRVVYKEINGQKCEPYEILTVDLEDDCQGAVMEELGRRRGELQNMESDGNGRTRLEYKIPARGLIGFQSEFLTMTRGTGLMAHIFDEYAPVKADMPGRRNGVLISSEQGEAVAYALWKLQDRGRMFSSPGDKLYEGMIIGIHSRENDLVVNPIKGKQLTNVRASGTDEAVRLVPPVQLTLESAVEFIDDDELVEITPKSIRIRKRHLLEHERKRAAKD

SEQ ID NO: 3769 - DNA, 1827 bp, Burkholderia xenovorans LB400
  CDS (1)..(1827): transl_table=11
atgactcgcgccctacgcaacatcgccatcattgcccacgtcgaccacggcaagaccacgctcgtcgaccagcttctccgccagaccgccacgttccgcgacaaccagcagatcgccgagcgcgtgatggactcgaacgacatcgaaaaagaacgcggtatcacgattctgtcgaagaactgcgcggtcgaatatgaaggcacgcacatcaacatcgtcgacaccccgggccacgctgacttcggcggcgaagtggagcgcgtgctgtcgatggtcgactccgtgctgctgctggtcgacgccgtcgaaggcccgatgccgcaaacgcgcttcgtgaccaagaaggcactggcgctcggcctgaagccgatcgtcgtgatcaacaaggtggaccgtccgggcgcgcggatcgactgggtgatcaaccagacgttcgacctgttcgacaagctgggcgcaaccgacgaacaactcgattttccgatcgtctacgcatcgggtctgaacggctacgcaggcttgaccccggacgtgcgcgaaggcgacatgcgcccgctgttcgaagccgtgctgcaacacgtgccggttcgtccggccgatccggacgcaccgctgcaactgcagatcacgtctctggactattcgtcgtatgtcggccgtatcggcgtgggccgtatcacgcgcggccgcatcaagccgggcatggcggtcgccgtgcgttcgggccccgacggcgcgatcctgaaccgcaagatcaaccaggtgctgtcgttcaagggcctcgagcgcgtgcaggtcgactcggctgaagccggcgacatcgtgctgatcaacggcatcgaagaaatcggcattggcgtgaccatctgcgcgccggagcaaccggaagcgctgcccatgatcaccgtggacgaacccacgctgaccatgaacttcctcgtcaattcgtcgccgctggccggtcgcgaaggcaagttcgtcacgagccgtcagatccgtgaccgcctgatgaaggaactgaaccacaacgtcgcgctgcgcgtgaaagaaaccggcgacgaaaccacgttcgaagtggcgggccgcggtgaactgcacctgaccattctggtggaaaacatgcgccgcgaaggctacgagctggccgtgtcgcgtccgcgcgtggtgatgacggaagtggacggggtgaagcacgagccgtacgaaaacctgacggtcgacatggaagacgcccatcaaggcggcgtgatggaagagctgggccgccgcaagggtgaaatgctcgacatggcgtcggacggccgtggccgtacgcgtctggagtaccgtatttcggcgcgtggcctgatcggcttccagtcggaattcctcacgctcacgcgcggtacgggtctgatgagccacacgttcgactcgtatcagccggtcaaggaaggcgcggtcggcgagcgtcgcaacggcgtgctgatttcgcaggacgacggcgcggcagtcgcgtacgcattgtggaagctgcaggatcgcggccgcatgttcgtgtcgccgggcgagccgctgtatgagggcatgatcatcggcattcacagccgtgacaacgacctggtggtcaacccgatcaagggcaagcagttgaccaacgtgcgttcgtcgggtacggacgaagcggtgcgcctcgtgccgccgatccagatgtcgctggaatacgcggtcgaattcatcgacgacgacgaactggtcgaagtcacgccgcagtccatccgtctgcgcaagcgttatctgaaggaacatgagcgccgcagcgcgagccgtaagggcgcggtggactaa

SEQ ID NO: 3770 - protein, 608 aa, Burkholderia xenovorans LB400
MTRALRNIAIIAHVDHGKTTLVDQLLRQTATFRDNQQIAERVMDSNDIEKERGITILSKNCAVEYEGTHINIVDTPGHADFGGEVERVLSMVDSVLLLVDAVEGPMPQTRFVTKKALALGLKPIVVINKVDRPGARIDWVINQTFDLFDKLGATDEQLDFPIVYASGLNGYAGLTPDVREGDMRPLFEAVLQHVPVRPADPDAPLQLQITSLDYSSYVGRIGVGRITRGRIKPGMAVAVRSGPDGAILNRKINQVLSFKGLERVQVDSAEAGDIVLINGIEEIGIGVTICAPEQPEALPMITVDEPTLTMNFLVNSSPLAGREGKFVTSRQIRDRLMKELNHNVALRVKETGDETTFEVAGRGELHLTILVENMRREGYELAVSRPRVVMTEVDGVKHEPYENLTVDMEDAHQGGVMEELGRRKGEMLDMASDGRGRTRLEYRISARGLIGFQSEFLTLTRGTGLMSHTFDSYQPVKEGAVGERRNGVLISQDDGAAVAYALWKLQDRGRMFVSPGEPLYEGMIIGIHSRDNDLVVNPIKGKQLTNVRSSGTDEAVRLVPPIQMSLEYAVEFIDDDELVEVTPQSIRLRKRYLKEHERRSASRKGAVD

SEQ ID NO: 3771 - DNA, 1824 bp, Ralstonia metallidurans CH34
  CDS (1)..(1824): transl_table=11
atgacccgcgccatccgtaatatcgccatcatcgctcacgttgatcatggcaagaccaccctggtcgaccaactcctgcgccaggcaggcaccttccgcgagaaccagcaaatcgccgaacgggtgatggactcgaacgacctggaaaaggaacgcgggatcaccatcctcgcgaagaactgtgccgtcgagtacaacggcacgcacatcaatatcgtggacaccccgggccacgccgacttcggcggtgaagtggagcgcgtgctgtcgatggtcgacggcgtgctgctgctggtggatgccgtggaaggcccgatgccgcagacgcgtttcgtgacgcgcaaggcactggccctgggcctgaagccgatcgtcgtgatcaacaaggttgaccgtccgggcgcccgtcctgactgggtgatcaaccagaccttcgacctgttcgacaagctcggcgccaacgacgagcagctggacttcaccgtggtgtacgcctcgggcctgaacggctatgccggcctgaccgaagacgtgcgcgacggcgacatgaagccgctgttcgaaaccgtgctggacaaggtgccggtgcgtaacgatgacccgaatggtccgctgcagatgcaaatcatctcgctggactactcgagctacgtcggcaagatcggcgtcggccgtatctcgcgtggccgcgccaagccgctgcaggacgtggtggtcaagttcggtccggaaggtaacccgatcaagggccgtatcaaccaggtgctgaagttcagcggcctggagcgcgagattgtggccgaggcggaagccggcgacatcgtgctgatcaacggtatcgaggaactgggcattggctgcaccgtgtgcgcccccgaggctctggacgcgctgccgatgctgaaggtggacgagccgacgctgacgatgaacttctgcgtcaacacgtcgccgctggccggccgcgaaggcaagttcgtgaccagccgccagctgcgcgagcgtctggaccgcgagctgaagtcgaacgtggcgctgcgcgtggccgaaactggcgacgatacgatcttcgaagtctcgggtcgtggcgaactgcacctgaccatcctgctggaaaacatgcgccgtgaaggctacgagctggccgtgtcgcgcccgcgcgtggtgttcaaggaaatcgacggcgtcaagaacgagccgtacgaactgctgaccgtggacgtggaagacggccaccagggttcggtgatggaagagctgggccgccgcaagggtgaactgctcgatatggcatcggacggcaagggccgcacccgcctggaataccgcattccggcgcgtggcctgatcggcttccagggtgaattcctgacgctgacgcgtggtaccggcctgatcagccacatcttcgacgactacgcgccggtgcgcgaaggcggcctgggtgaacgccacaatggcgtgctgatctcgcaggacgatggcgacgccgtggcctacgcactatggaagctgcaggatcgcggccgcatgttcgtgaagccgggcgatgcgctgtacgaaggcatgatcatcggcatccacagccgtgacaacgacctcgtcgtgaacccgatcaagggcaagcagctgaccaacgtccgtgcttcgggtaccgacgaagccgtacgactggtaccgccgatccagatgtcgctcgagtacgcggtggaattcatcgccgacgacgaactggtggagatcacgccgaagagcatccgtctgcgcaagcgccacctgaaggagcacgagcgcaagcgcgcctcgcgcgaatcggtggcctga

SEQ ID NO: 3772 - protein, 607 aa, Ralstonia metallidurans CH34
MTRAIRNIAIIAHVDHGKTTLVDQLLRQAGTFRENQQIAERVMDSNDLEKERGITILAKNCAVEYNGTHINIVDTPGHADFGGEVERVLSMVDGVLLLVDAVEGPMPQTRFVTRKALALGLKPIVVINKVDRPGARPDWVINQTFDLFDKLGANDEQLDFTVVYASGLNGYAGLTEDVRDGDMKPLFETVLDKVPVRNDDPNGPLQMQIISLDYSSYVGKIGVGRISRGRAKPLQDVVVKFGPEGNPIKGRINQVLKFSGLEREIVAEAEAGDIVLINGIEELGIGCTVCAPEALDALPMLKVDEPTLTMNFCVNTSPLAGREGKFVTSRQLRERLDRELKSNVALRVAETGDDTIFEVSGRGELHLTILLENMRREGYELAVSRPRVVFKEIDGVKNEPYELLTVDVEDGHQGSVMEELGRRKGELLDMASDGKGRTRLEYRIPARGLIGFQGEFLTLTRGTGLISHIFDDYAPVREGGLGERHNGVLISQDDGDAVAYALWKLQDRGRMFVKPGDALYEGMIIGIHSRDNDLVVNPIKGKQLTNVRASGTDEAVRLVPPIQMSLEYAVEFIADDELVEITPKSIRLRKRHLKEHERKRASRESVA

SEQ ID NO: 3773 - DNA, 1818 bp, Acidobacteria bacterium Ellin345
  CDS (1)..(1818): transl_table=11
ttgagtaaggcacttcgcaacatcgccattattgcgcacgtcgatcacggcaaaaccacgctggtcgacgccatgttgaaacaatccggcaccttccgcgccaacgaacaggtcgccgaccgcgtaatggacagcaacgagctcgaacgcgagcgcggcatcaccatcctcgcgaaaaacaccgcggtcttttatcacgacatcaagatcaacatcgtggatacgcccggccacagtgacttcggcggtgaagtcgagcgcgccctcaaaatggtcgacggcgtcatgctcctcgtggacgcctccgaaggcccactgccgcaaacgcgttacgtgctcggcaaggcgctggaagcgaaccttccgcccatcgtcgtgatcaacaagattgaccgccccgacgcgcgcgcccaggaagtattgaacgagatctacgacctcttcatcgatctcgacgcaaaggaagagcagctcgaattcccggtcctctacaccaatgcgaagatcggcaccgcctccaccgatgcgaaagtcgcgggcgaagacctgcagccgctcttcgaagccatcgtcaaaaccattcctccgccgaagggcaaaaccgacgggcctctgcaagtcctcgtcgccaacctcgactacagcgattacctcggccgcatcgccatcgcccgcgtcttcaacggcaccctcttcacgggcgaagatgtcgtcatcgccaagctcgacggctcgttccacaaaacgaaaatcacgaaactgttctcattcagcggcctcaagcgcgtcgacatcaccgagaccgaactcggcgacatcgtggccgtcgccggcgtcgaaggcatcaccatcggcgagaccattaccgatgccgacaatcccaagccgctgccgcacatcgccatcgacgagccgaccatcgccatgcagttcatggtcaacacctcgcccttcgccggcaaagacggccagtacgtcacctcgcgcaatttgcgcgagcgcctcgcgaaagagctgctgacgaatgtgtcgctgcgcgtggaagattccgactcacctgacatctttaaggtcgcgggccgcggcgaactgcagctttcgatcctcatcgaaatgatgcgccgcgaaggttacgaactcatggtcggcaagcccgagatcgtcaccaagcacattgacggcaaactggtagagcccatcgagaagctcaccgtcgacatccccgagaccttcatcggcgtggtcattgagaagatcggcacccgcaagggacagatggaaaagatgaccaaccacggctacggccgtgtgcgcatggagttcaaagtgcccagccgcggactcatcggcctgcgcagcgaactcctcaccgacacccgtggcaccatcgtgatgaactcgctcttcgccggctacaccgagtggcagggcgacatcccgcaccgccccaccggcgcgctcgtcgccgaccgtaacggacttaccaccgcgtacgcgcttttcggattgcaggaacgcggagaacttttcctcggtccgggtgtcgacgtttacgagggcatggtcatcggcgagaactcacgcgataacgatctcgacgtaaattgcgtccgcgagaaaaagctcacgaacatgcgcgcgtcgacctccgacgatgccatccgcctcgtccccttcaagaacttaaatctcgagcaggcgatcgatttcatcgccgacgacgagctctgcgaggtcaccccgaagacgcttcgcctgcgcaagaagatcctccaggccaaccgtcgtccgcgccgctacgctacgccggaagactaa

SEQ ID NO: 3774 - protein, 605 aa, Acidobacteria bacterium Ellin345
MSKALRNIAIIAHVDHGKTTLVDAMLKQSGTFRANEQVADRVMDSNELERERGITILAKNTAVFYHDIKINIVDTPGHSDFGGEVERALKMVDGVMLLVDASEGPLPQTRYVLGKALEANLPPIVVINKIDRPDARAQEVLNEIYDLFIDLDAKEEQLEFPVLYTNAKIGTASTDAKVAGEDLQPLFEAIVKTIPPPKGKTDGPLQVLVANLDYSDYLGRIAIARVFNGTLFTGEDVVIAKLDGSFHKTKITKLFSFSGLKRVDITETELGDIVAVAGVEGITIGETITDADNPKPLPHIAIDEPTIAMQFMVNTSPFAGKDGQYVTSRNLRERLAKELLTNVSLRVEDSDSPDIFKVAGRGELQLSILIEMMRREGYELMVGKPEIVTKHIDGKLVEPIEKLTVDIPETFIGVVIEKIGTRKGQMEKMTNHGYGRVRMEFKVPSRGLIGLRSELLTDTRGTIVMNSLFAGYTEWQGDIPHRPTGALVADRNGLTTAYALFGLQERGELFLGPGVDVYEGMVIGENSRDNDLDVNCVREKKLTNMRASTSDDAIRLVPFKNLNLEQAIDFIADDELCEVTPKTLRLRKKILQANRRPRRYATPED

SEQ ID NO: 3775 - DNA, 1821 bp, Silicibacter sp. TM1040
  CDS (1)..(1821): transl_table=11
atggacctgcgcaatattgcgatcatcgcgcacgttgaccacggcaaaaccactctggttgacgagcttctgaaacaatccggcgcctttcgcgaaaaccaggccgtggctgaacgcgccatggactccaacgatctggaacgcgagcgcggcatcaccatcctggccaaagccacctcggtagaatggaacggcacgcggatcaacatcgtcgacacccccggccacgccgactttggtggcgaagtagaacgcatcctctccatggtggacggtgttgttctgcttgtggacgccgccgaaggcccgatgccgcagaccaaattcgtgacctcgaaagcgcttgcgctgggccttcgcccgatcgttgtgctgaacaaggtcgacaagcccgatgccgagcccgaccgcgcgctcgacgagtgttttgacttgtttgcaaacctcggtgcggacgacgatcagctcgacttcccctccatgtatgcgtccggccgctccggctgggccgatatggaactggatggtccgcgcaaggatctctcggcgctgtttgacctcatcgtaaagcacgtccccgcgcccaagcagatcgcgcagaaggatgaacccttccgcatgctcgcaaccacgctcggctccgaccctttcatgggccgcatcctgaccggacgtgtggaaagcggcacgctcaaggtgggcgacagcctaaaggcgctgactcgtgagggcgagttgatcgagaacttccgtgccaccaagatcctcgcgttccgtggtctggcccagcagccgatcgatctcgccgaagctggcgacatcgtgaccatcgccggcatggcaaaggccaccgttgcggattcgcttgtggacacctccgttaccgaagccctgcccgcccagccgatcgatccgccgacgatcaccgtgacctttggcatcaacgacagccctctggcgggtcgtgatggcaagaaagtccagtcgcgcgtgatccgggatcgcctcctgaaagaggccgagctcaatgtcgccatcgaggtcaccgacacccccggcggtgaggcctttgaggtcgcaggtcgtggcgaattgcagatgggcgttctcatcgagaacatgcgccgcgagggctttgaactctctatttcgcgcccgcaggttctgttcaaagaagagaacggtcagcgcatggagccggtcgaggaagccaccattgacgtggatgacgaatactccggcgtggtgatcgaaaagctcaccggcaaccgcaagggcgagctcgtagagatgaagcccgccggtgcaggcaagacccgcatcatcgcccatgtcccgtcacgtggcctcatcgggtatcacggtgaattcctcaccgacacccgcggcaccggtgttctgaaccgcgtgttccacggctggaccccgcacaagggcgccatcccgggccgtcgcgcgggcgtgctgatctcaatggagaacggtcaatccgtggcctatgcgctgtggaacctcgaagagcgtggcaagatgtttatcggcgcacaagccgacgtctacaccggcatgatcattggcgagcacagccgcgacaatgatctcgaggtgaacccgctcaagggaaagaagctcaccaacgtgcgggcctctggctctgatgacgccgtgcgcctgaccacgcccgtcacgctctcgctggaagaggcgattgcctatatcaacgacgacgagctggtcgaagtgacgccgaactccgtgcgtctgcgcaagcgctacctcgatccgcatgagcgcaagcggatggccaaggcgaacagctga

SEQ ID NO: 3776 - protein, 606 aa, Silicibacter sp. TM1040
MDLRNIAIIAHVDHGKTTLVDELLKQSGAFRENQAVAERAMDSNDLERERGITILAKATSVEWNGTRINIVDTPGHADFGGEVERILSMVDGVVLLVDAAEGPMPQTKFVTSKALALGLRPIVVLNKVDKPDAEPDRALDECFDLFANLGADDDQLDFPSMYASGRSGWADMELDGPRKDLSALFDLIVKHVPAPKQIAQKDEPFRMLATTLGSDPFMGRILTGRVESGTLKVGDSLKALTREGELIENFRATKILAFRGLAQQPIDLAEAGDIVTIAGMAKATVADSLVDTSVTEALPAQPIDPPTITVTFGINDSPLAGRDGKKVQSRVIRDRLLKEAELNVAIEVTDTPGGEAFEVAGRGELQMGVLIENMRREGFELSISRPQVLFKEENGQRMEPVEEATIDVDDEYSGVVIEKLTGNRKGELVEMKPAGAGKTRIIAHVPSRGLIGYHGEFLTDTRGTGVLNRVFHGWTPHKGAIPGRRAGVLISMENGQSVAYALWNLEERGKMFIGAQADVYTGMIIGEHSRDNDLEVNPLKGKKLTNVRASGSDDAVRLTTPVTLSLEEAIAYINDDELVEVTPNSVRLRKRYLDPHERKRMAKANS

SEQ ID NO: 3777 - DNA, 1848 bp, Myxococcus xanthus DK 1622
  CDS (1)..(1848): transl_table=11
atgattcctcgcgaaaatattcgtaacgtcgccattgtcgctcacgtcgaccatggcaagaccacgctcgtcgatcacctgcttcgccaggcgggcactttccgtagcaacgagcacgtcgccgaacgggtgatggactcgaacgacctcgagcgcgagaagggcatcaccattctcgcgaagaacaccgcggtcaattacaagggaatgcagatcaacatcatcgacaccccgggtcacgccgactttggtggtgaggtggagcgtggtctgcgcctcgttgagggcgtcatcctgctggtggacgccgccgaaggccccctgccccagacgcgcttcgtgctcagcaaggccctggccatgggcctgaagacggtgctggtcatcaacaagatcgaccgccaggacgcccgcgcgaaggacgtgctggacctggtgtactcgctctacatcgacctgggcgcggacgagcagcagttggagatgcccgtcctctacaccatcgcccgccagggtcaggcgtccacgcagctggaggtccccggcaagacgctggagcccctgtacgacgccatcatcaaccacatcccgcctccgccgaagtcggacgagccgtcgctgcagctgctggtcgccaacctggactacgacgactacgtcggccgtctggccgtgggccgcgtgcagtccggccgcatcaccgccaacatgcctgtctccgtctgccgcgagggcggcaaggtgcagccgggtaaaatcgtcaagctctacggcttctccggcctgaagcgcgtggagattccggacgcgggtccgggtgaaatcgtctccatcgccggcatcgaggagatctccatcggcgacaccatcgccgacgccgagaagccggtggccctgccccgcatcgccgtggacgagcccacgatgatgatggtcttcaaggtcaacgacgggccgctcgcgggcaaggaaggcaagttcgtcacctcccgcaacctgcgtgagcgcctctaccgcgaggcctaccgcaacgtgggcgtccgcgtggaggacaccgacacgccggacgcgttccgcgtggtgggccgtggcgagctcgccctggccgtcatcatcgagaacatgcgccgcgagggctacgagctgacggcctccaacccggagccgatcaccaaggagatcgacgggcaggtccacgagcccatggagctgctcttctgcgacgtgccggagaacagcgtgggcgtggtgacggagcgcctggggccccgcaagggccgcatggtggacatgggctccctgggctcgggccgtacccggctccagttccgcatccccgcgcgtggcctcatcggcttccgctcggagttcctcaccatcacccgtggcgagggcatcatgagcagccagttcgacggctacgagccgtggttcggctacatccccaagcgccagaatggcgccatcgtctccgaccgcctgggcgacaccgtgccctacgcgctcttcagcatccaggagcgtggctcgctcttcatcggcgccggcaccacggtgtacgagggcatgatcatcggcgagcactcgcacgcgtccgagctgaacgtgaactgctgccgtgagaagaagctcaccaacatccgcgccgccggccgcgacgagaacgtcatcctcaccactccgcgggaaatcagcctggagaaggcgctggagtggatcgccgacgacgagctggtcgaggtgacgcccaagtccatccgcatgcgcaagaaggcgctggcggtgggcgagcgctaccgcgccgagcgtgaccgcaagcgcgaggagcgcgcgtccgaaggcgagtag

SEQ ID NO: 3778 - protein, 615 aa, Myxococcus xanthus DK 1622
MIPRENIRNVAIVAHVDHGKTTLVDHLLRQAGTFRSNEHVAERVMDSNDLEREKGITILAKNTAVNYKGMQINIIDTPGHADFGGEVERGLRLVEGVILLVDAAEGPLPQTRFVLSKALAMGLKTVLVINKIDRQDARAKDVLDLVYSLYIDLGADEQQLEMPVLYTIARQGQASTQLEVPGKTLEPLYDAIINHIPPPPKSDEPSLQLLVANLDYDDYVGRLAVGRVQSGRITANMPVSVCREGGKVQPGKIVKLYGFSGLKRVEIPDAGPGEIVSIAGIEEISIGDTIADAEKPVALPRIAVDEPTMMMVFKVNDGPLAGKEGKFVTSRNLRERLYREAYRNVGVRVEDTDTPDAFRVVGRGELALAVIIENMRREGYELTASNPEPITKEIDGQVHEPMELLFCDVPENSVGVVTERLGPRKGRMVDMGSLGSGRTRLQFRIPARGLIGFRSEFLTITRGEGIMSSQFDGYEPWFGYIPKRQNGAIVSDRLGDTVPYALFSIQERGSLFIGAGTTVYEGMIIGEHSHASELNVNCCREKKLTNIRAAGRDENVILTTPREISLEKALEWIADDELVEVTPKSIRMRKKALAVGERYRAERDRKREERASEGE

SEQ ID NO: 3779 - DNA, 1824 bp, Mesorhizobium sp. BNC1
  CDS (1)..(1824): transl_table=11
atgaaaatccgcaatatcgcgatcattgcccacgtcgaccatgggaaaaccacccttgtagacgaactattgaaacagtccggctcgttccgcgagaaccagcgcgttgccgaacgcgtgatggactccaacgatttggaaaaagagcgcggcatcaccattctcgccaaggccacctcggtcgagtggaagggcgtgcgcatcaacatcgtcgatacgccggggcacgccgatttcggcggtgaggtcgagcgtatcctctccatggtggacggcgcgatcgttctagtagatgcatccgaagggccgatgccgcagaccaagttcgtagtcggcaaggcgctgaaggttggccttcgcccgatcgtcgcgatcaacaagatcgaccgtccggacggccgccaccaggaagtcatcaacgaggtcttcgaccttttcgccaatctcgacgccaccgacgagcagctcgattttccgatcctctacggctctggccgcgacggctggatgaacttcaatccggaaggcccgaaggaccagggcctcgcgccgctgctcgatctcgtcctcagccatgttccggagccgaccgtggaggaaggcccattccggatgatcggcacgattctggaggccaacccctttctcggccgcatcatcactggacgcatcgcttccggttcggtcaagcccaaccaggccgtcaaggttctcggccaggacggccggctcatcgagcaaggtcgtatttccaagatcctcgctttccggggcatcgagcgccagccgatcgaagaggcgcatgcgggtgacatcgtcgccatcgccggcctctccaaaggcaccgttgccgataccttctgcgacccggtcgtcacggaagccatgaaggcgcagccgatcgatccgccgaccgtcaccatgtccttcatcgtcaacgacagcccgcttgccggcaccgagggcgacaaggtgacgagccgcgtcatccgcgaccgtcttttcaaggaagccgagggcaatgtcgcgctgaagatcgaggaagccgagggcaaggattcgttctatgtttccggacgcggcgaattgcagcttgccgttctcatcgagacaatgcgtcgcgaaggcttcgaactcgcggtctcgcggccgcgcgtcgtcatgcacaaggacgagaacggcacgcttctcgagccgatcgaggaagtcgtcatcgacgtcgatgaggagtattccggcgtcgtcgtgcagaaaatgtccgagcgcaaggccgagatggtcgaactgcgtccgtcgggcggcaatcgtcttcgcctgcgtttttacgcgccgacccgcggcctgatcggctaccagtcggagcttttgacggatacgcgcggaaccgcggtcatgaaccgcctgttccacgattatcagccctacaagggcgcgatcggcggcaggattaacggcgtgcttctgtcgaacgccgcgggcgaggcggtcgcctatgccatgttcaacctcgaagatcgtggcccgatgatcatcgagccgggtgaaaaggtctaccagggcatgatcatcggcatccacagccgcgacaacgacctggaagtcaacgtgctgaagggcaagcagctcaccaacatccgcgccgccggcaaggacgaggcggtcaagctcaccccgccgatccgcatgactctcgaccgcgctctctcctggatccaggacgacgagctggtggaagtgacgccgaaatcgatccgcctgcgtaagatgtatctcgaccccaacgagcgcaagcgcttcgagaagcagaagctggcagtcgcctaa

SEQ ID NO: 3780 - protein, 607 aa, Mesorhizobium sp. BNC1
MKIRNIAIIAHVDHGKTTLVDELLKQSGSFRENQRVAERVMDSNDLEKERGITILAKATSVEWKGVRINIVDTPGHADFGGEVERILSMVDGAIVLVDASEGPMPQTKFVVGKALKVGLRPIVAINKIDRPDGRHQEVINEVFDLFANLDATDEQLDFPILYGSGRDGWMNFNPEGPKDQGLAPLLDLVLSHVPEPTVEEGPFRMIGTILEANPFLGRIITGRIASGSVKPNQAVKVLGQDGRLIEQGRISKILAFRGIERQPIEEAHAGDIVAIAGLSKGTVADTFCDPVVTEAMKAQPIDPPTVTMSFIVNDSPLAGTEGDKVTSRVIRDRLFKEAEGNVALKIEEAEGKDSFYVSGRGELQLAVLIETMRREGFELAVSRPRVVMHKDENGTLLEPIEEVVIDVDEEYSGVVVQKMSERKAEMVELRPSGGNRLRLRFYAPTRGLIGYQSELLTDTRGTAVMNRLFHDYQPYKGAIGGRINGVLLSNAAGEAVAYAMFNLEDRGPMIIEPGEKVYQGMIIGIHSRDNDLEVNVLKGKQLTNIRAAGKDEAVKLTPPIRMTLDRALSWIQDDELVEVTPKSIRLRKMYLDPNERKRFEKQKLAVA

SEQ ID NO: 3781 - DNA, 1809 bp, Cytophaga hutchinsonii ATCC 33406
  CDS (1)..(1809): transl_table=11
atgcagagtatcaggaatattgcgatcatcgcacacgtcgatcacggtaaaacaacattggttgataaaatcattcacgcgtctaaaatcttcagagagaaccaagtattcgaagacttgatcttggataacaacgatcaggaacgtgaacgaggcattacaattctagctaaaaacgtttctattcgttataaagaacataaaattaacattatcgatacaccaggtcacgccgatttcggtggtgaagtggagcgtgtattgaaaatggctgatggtgtagtgctattggtagatgcatttgaaggcgctatgcctcaaacgcgtttcgtattgagcaaggcattgggcttgggcttaaaaccgatcctgatcgtaaacaaagtagataaagaaaactgccgtccggacgaagtacacgaagaagtattcgacttaatgttcaacttaggtgcaaacgagcatcagcttgatttcgttacactttacggttctggccgtggtggctggatgagcacagactggaaaaagaaaacagaagatatcattcctttgctggatgcaatcgtggatcacattccacctgcaccggtgcatgaaggtattcctcaaatgcagatcacttcattggattactctacattcacaggccgtatcgcaatcggtcgtgtattcagaggcgaattaaaagaaggcggacagtattcattaactaaaatggatggttcgatcaaaaaagtaaaaatcaaagaacttcactcgttcgaaggtttaggcagagtacgtgttgaaagcgttttagctggtgatatctgtgccgtagttggtattgaagatttcgaaatcggtgatacaatcacagatcttgaaaaaccggaagcgttaccacgtatcgctgttgatgagcctaccatgagtatgcttttcacaatcaacaactctccgttcttcggtaaagaaggtaagtttgtaacttcccgtcacctgagagatcgtttgatgaaagagttagagaaaaaccttgctttacgtattcaaccaggtgagtctgaagataaattcttagtattcggccgtggtattcttcacttgtctgtattgatcgagacaatgagaagagaaggatatgaattacaagtgggtcagccgcaagtattgtataaagaaattgatggcaaacgttgcgaaccggtagaagtactggtagtggatgtacctcaggaaacttccggtaaagtaattgaattggctacgcagcgtaaaggtgagttgctgatcatggaaccaaaaggtgacttacaacacttagaatttaaaataccttcccgtggtatcatcggtttacgtacaaacgtgttgacggcaacattcggtgaagcaattatgacacaccgtttcgacggatacgagccttataaaggtgctatccctgaacgtgtgagtggttctatcatctctatggatagcggtgatgttactgcatacgcattggataaattacaggacagaggtaagttcttcatcgaaccgggtgatgttatttaccagggtatggttatcggtgagcacaaccgtcagaacgatatcacggtaaacgtacagcgcgaaaagaaattgaccaacatgcgtgcatccggtacagatgataacgctaagatcgctccgaagattaacttctcattagaagagatgatggaatacatccagaaggatgaatacatcgaggttacgcctaagtctttacgtatgcgtaagatccttcttgacgagaacgagcgtttgagaaacacgaaaaaagaagctgtttag

SEQ ID NO: 3782 - protein, 602 aa, Cytophaga hutchinsonii ATCC 33406
MQSIRNIAIIAHVDHGKTTLVDKIIHASKIFRENQVFEDLILDNNDQERERGITILAKNVSIRYKEHKINIIDTPGHADFGGEVERVLKMADGVVLLVDAFEGAMPQTRFVLSKALGLGLKPILIVNKVDKENCRPDEVHEEVFDLMFNLGANEHQLDFVTLYGSGRGGWMSTDWKKKTEDIIPLLDAIVDHIPPAPVHEGIPQMQITSLDYSTFTGRIAIGRVFRGELKEGGQYSLTKMDGSIKKVKIKELHSFEGLGRVRVESVLAGDICAVVGIEDFEIGDTITDLEKPEALPRIAVDEPTMSMLFTINNSPFFGKEGKFVTSRHLRDRLMKELEKNLALRIQPGESEDKFLVFGRGILHLSVLIETMRREGYELQVGQPQVLYKEIDGKRCEPVEVLVVDVPQETSGKVIELATQRKGELLIMEPKGDLQHLEFKIPSRGIIGLRTNVLTATFGEAIMTHRFDGYEPYKGAIPERVSGSIISMDSGDVTAYALDKLQDRGKFFIEPGDVIYQGMVIGEHNRQNDITVNVQREKKLTNMRASGTDDNAKIAPKINFSLEEMMEYIQKDEYIEVTPKSLRMRKILLDENERLRNTKKEAV

SEQ ID NO: 3783 - DNA, 1833 bp, Clostridium perfringens ATCC 13124
  CDS (1)..(1833): transl_table=11
atgagtaacgaatttacaagaaatgatattagaaatatagctataatcgctcacgttgaccatggtaaaacaactttagtggacgcattattaagacaaagtaacgtttttagaacaaacgaaaaagtagaagagagagtaatggactcaaatgacttagaaaaagaaagaggtattacaatactttcaaaaaatacagcagttcattataacggagttaaaataaatataatagatacaccaggacacgctgacttcggaggagaggttgaacgtgtacttaaaatggtagaaagtgttttacttgtagtagactcatatgaaggggctatgcctcaaacaaaattcgttttaagaaaagctcttgagttaggattaaaaccaatagttgttataaacaaaatagataaaccagatgctagaccagaagaagttattgatgaaatatttgaattattcttagagcttggtgcagatgatgagcaattagatttcccaatagtttatgcttcagctagagatggagtagctacaattaacatagatgagccaaaagataacatgaaagatttattcgatactataatcgaaaaagttgaatcaccaaagggatctatagaagacagtttacaaatgttagttacaactttagattcaagtgaatatgttggtaaaatagctataggtaaaataactagaggaatagctaagaaaaaccaacaagctgctgttgtaagacaagatggaacagtaactaaattcaaaatatcaagtctttatactcatgatggattaaagagaatagaggttgatgaagctcaattaggagatatagttgcaataagtggtatatctgacgtaaatattggagaaactataacagatgcacaaaatccagaaggattaccatttgttaaaatagacgagcctacattaaacatgaactttatggttaatgactcaccatttgctggtagagaaggggatttcgtaacttcaagacatttaagagatagattattaaaagaattagaaactaacgtaagtttaaaagttaaagaaataactccagattgtttcgaagtaagtggtagaggagagctacatctttcaatacttatagaaacaatgagaagagaaggatatgaattccaagtttctaagccaaacgttataacaaaaatagatgaaaatggtgttaaggttgaaccaatagagcacttaactatagacgttccagaagaatttatgggacctgttatggaaaaattaggacctagaaaagctgaaatggtaaatatgacttcagcggttaatggatactcaagattagagttcaaaatacctgcaagaggacttataggatttagaaatgaattcatgacagatacaaaaggtaacggaataatgaaccatgtatttgatggatttgaaaaatacaaaggagagatcccaggaagaagtagaggatcaatcgtagtatttgaatcaggagaagcagttacatatggattatttaatgctcaagaaagaggaactttattcatagagccaggtacagaggtttatgctggaatggtttgtggagaatgttcaagagcagatgacatagacgttaatatttgtaagaaaaaacaattaactaatacaagatcatctggagctgatgatgctttaaaattaactccagtaagacaaatgtcattagagcaatgtttagaattcataaacaatgatgaattagttgaagttactccagtaaatgtaagaatgagaaagagaatcttagacagtgctgagagaaagagagctataaatagaagtaaaaaataa

SEQ ID NO: 3784 - protein, 610 aa, Clostridium perfringens ATCC 13124
MSNEFTRNDIRNIAIIAHVDHGKTTLVDALLRQSNVFRTNEKVEERVMDSNDLEKERGITILSKNTAVHYNGVKINIIDTPGHADFGGEVERVLKMVESVLLVVDSYEGAMPQTKFVLRKALELGLKPIVVINKIDKPDARPEEVIDEIFELFLELGADDEQLDFPIVYASARDGVATINIDEPKDNMKDLFDTIIEKVESPKGSIEDSLQMLVTTLDSSEYVGKIAIGKITRGIAKKNQQAAVVRQDGTVTKFKISSLYTHDGLKRIEVDEAQLGDIVAISGISDVNIGETITDAQNPEGLPFVKIDEPTLNMNFMVNDSPFAGREGDFVTSRHLRDRLLKELETNVSLKVKEITPDCFEVSGRGELHLSILIETMRREGYEFQVSKPNVITKIDENGVKVEPIEHLTIDVPEEFMGPVMEKLGPRKAEMVNMTSAVNGYSRLEFKIPARGLIGFRNEFMTDTKGNGIMNHVFDGFEKYKGEIPGRSRGSIVVFESGEAVTYGLFNAQERGTLFIEPGTEVYAGMVCGECSRADDIDVNICKKKQLTNTRSSGADDALKLTPVRQMSLEQCLEFINNDELVEVTPVNVRMRKRILDSAERKRAINRSKK

SEQ ID NO: 3785 - DNA, 1908 bp, Rhodococcus sp. RHA1
  CDS (1)..(1908): transl_table=11
gtgaccatcaccagcttccgtaacgttgccatcgtcgcacacgtcgaccacggcaagaccactctcgtcgacgccatgttgcgtcagtcgggggcattcgaggagcgcgccgaactggtcgatcgcgtcatggactccggcgacctcgaacgcgagaagggcatcaccatcctcgcgaagaacaccgccgtccacaagcatcacgccgacggcagcgtcacggtcatcaacgtcatcgatacccccggtcacgccgacttcggtggcgaggtcgagcgcggcctgtccatggtcgacggtgtcgtcctgctcgtcgacgcgtccgagggcccgctgccgcagacccgcttcgtgctgcgcaaggcgctcgccgcgtcgctgcccgtcatcctcgtggtcaacaagaccgaccgtcctgacgcccgcatcgaagaggtcgtctccgagagccacgacctgctgctcgacctggcgtccgacctcgacgacgaggccgcggaagccgccgagctcgccctcgacctcccggtcctgtacgcctccggccgcgagggcaaggcgtccaaggttcagcccgagaacggtcacgcaccggacgccgagaacctcgacgccctgttcgaggtgctcctcaactacgtgcccgcacccaagggcaacgtcgacgcgccgctgcaggctcacgtcacgaacctcgacgcctccgcgttcctcggccgcctcgcgctggtccgtatccacaacggcgagctgaccaagggccagaccgtctcctggtgtcgcgaggtggacggcgagcccgtcgtcaccaaggccaagatcaccgaactgctcgccaccaagggcgtcgagcgtcagcccgccgagaaggccgtcgccggtgacatcgtcgccgtcgccggtttccccgacatcatgatcggcgacaccctcgccgacctggagaacccggtcccgctgccgcggatcaccgtcgaccagcccgccatctcggtgaccatcggcaccaacacctcgccgctcgtcggccgggtcagcggacacaagctgaccgcccgcatggtgaagtcgcgtctcgaccaggaactcgtcggcaacgtctcgctcaaggtcctcgacatcggtcgccccgacgcctgggaggttcagggccgtggtgagctcgcgctcgccatcctggtcgagcagatgcgccgcgagggcttcgagctgaccgtcggcaagccgcaggtggtcacccgtcaggtcgacggcaaggtgcacgagcccttcgaagagctcaccatcgacagccccgaggagtacctcggcgccatcacccagctcctcgccaaccgcaagggcaagatggtgcagatggccaaccacggcgcggggtgggtccggatggagttcatcgtcccgtcgcgcggcctgatcggcttccgtaccgacttcctcaccgagacccgcggcaccggcatcgcgaacgccgtgttccacggctacgcgccgtgggccggcgagatccgcgcccgccacaccggctcgctcgtctcggaccgcaccggttcggtcaccccgttcgcgatgatccagctcgccgatcgcggaacgttcttcgtcgagcccggcgccgacacctacgagggcatggtcgtgggcatcaacccgcgccaggaggacctcgacatcaacgtcacccgcgagaagaagctgaccaacatgcgtcagtcctccgccgacgtgatggagaccctcgccaagcccatcaagctcgagctcgaaggtgcgatggagttctgcgccggcgacgagtgcgtggaggtcaccccggaggtcgtgcgcgtgcgcaaggtgcacctgtcggccaccgaccgtgcccgtgagcgttcacgctccaaggcccgcgacaaggcggccctgtag

SEQ ID NO: 3786 - protein, 635 aa, Rhodococcus sp. RHA1
MTITSFRNVAIVAHVDHGKTTLVDAMLRQSGAFEERAELVDRVMDSGDLEREKGITILAKNTAVHKHHADGSVTVINVIDTPGHADFGGEVERGLSMVDGVVLLVDASEGPLPQTRFVLRKALAASLPVILVVNKTDRPDARIEEVVSESHDLLLDLASDLDDEAAEAAELALDLPVLYASGREGKASKVQPENGHAPDAENLDALFEVLLNYVPAPKGNVDAPLQAHVTNLDASAFLGRLALVRIHNGELTKGQTVSWCREVDGEPVVTKAKITELLATKGVERQPAEKAVAGDIVAVAGFPDIMIGDTLADLENPVPLPRITVDQPAISVTIGTNTSPLVGRVSGHKLTARMVKSRLDQELVGNVSLKVLDIGRPDAWEVQGRGELALAILVEQMRREGFELTVGKPQVVTRQVDGKVHEPFEELTIDSPEEYLGAITQLLANRKGKMVQMANHGAGWVRMEFIVPSRGLIGFRTDFLTETRGTGIANAVFHGYAPWAGEIRARHTGSLVSDRTGSVTPFAMIQLADRGTFFVEPGADTYEGMVVGINPRQEDLDINVTREKKLTNMRQSSADVMETLAKPIKLELEGAMEFCAGDECVEVTPEVVRVRKVHLSATDRARERSRSKARDKAAL

SEQ ID NO: 3787 - DNA, 1851 bp, Haemophilus somnus 129PT
  CDS (1)..(1851): transl_table=11
atgacagataaaattgatattcaaaaattacgcaatattgcaattattgcacacgttgaccatggtaaaacaaccctcgttgacaagcttcttaaactttcaggcacgttagacacttctcgtggtgatactgatgaacgtgtaatggattccaatgacttggaaaaagaacgtggaattactattcttgcgaaaaatactgcaattaattggaacggctatcgtattaatatcgtggatacaccaggacacgcagacttcggtggagaagtagagcgagtactttcaatggtagattccgtattgttggttgtcgatgcctttgacggtccaatgccacaaacccgcttcgtcacccaaaaagccttctcacatggtttaaaaccgattgttgtaatcaataaagtggatcgtcccggagcacgtcctgactgggtagtagatcaagtatttgatctctttgtaaatttgggtgccacagatgaacaacttgattttcctattatttatgcttctgcgttaaacggtgtagcaggtcttgaacatgaaaaattggcttctaatatggatccgctctttgaagcaattattgaacatgtttcaccgccggatgttgagttggatgcaccgttccaaatgcaaatctcccaattagattacagcaaatatttaggtgtcattgggattggacgcattaaacgtggtacagtaaaaccaaatcaacctgttacattaattgatcctgaagggaaaacccgtaacggtcgtatcggtcaggttttaggacacttaggtttacagcgttacgaagctcaagaagcttatgcaggtgatattatagccgttaccggtttaggtgagttaaatatttcagatactgtttgtgatattaacaatgtggaagcattgcctgcattaagcgttgatgaaccgacagtaactatgttcttttgtgtaaatacttcaccattctgtggaaaagaaggtaaatttgtcacttcccgccaaattttagagcgtttgaaaaaagagcttgtacataatgtggcattgcgtgtagaagaaacggatgattcggatattttcagtgtatccggccgtggggaattgcacttatccgtattaattgaaaatatgcgtcgtgaaggctatgagctggcggtttctcgtcctaaagtaatttttaaagaaattgatggtcgcaagcaagagcctttcgagcaagtgactattgatattgaagaacaacatcaaggttctgtcatggaagcactcggtattcgcaaaggtgaagtacgtgatatgataccggacggtaaaggtcgtactcgcttagaatacattattccaagtcgtggtctcattggtttccgtaatgaatttatgacaatgacttcagggacaggcttactttactcaagtttcagccattatgatgatgtaaaaccgggtgaaattggccagcgtattaacggcgtactgatttcaaacggtacgggtaaagccttggcttactcactttatgccctacaagatcgtggcaagctaatggttgatcatggtgcagaaatttatgaaggacaaataattggtattcatagtcgctctaatgatttaactgtcaacccgctggagggtaaaaaactcaccaatatgcgtgcttcaggtaaagatgatgcgttgactttaaccacaccattgaaactcacacttgaacaagcattagagtttattgatgatgatgagttagttgaagtaacgccaatttctgtacgtattcgtaaaaaacttttaactgaggtagagcgtaaacgtgcaaaccgtacgacaacgagtaccagtacccgttaa

SEQ ID NO: 3788 - protein, 616 aa, Haemophilus somnus 129PT
MTDKIDIQKLRNIAIIAHVDHGKTTLVDKLLKLSGTLDTSRGDTDERVMDSNDLEKERGITILAKNTAINWNGYRINIVDTPGHADFGGEVERVLSMVDSVLLVVDAFDGPMPQTRFVTQKAFSHGLKPIVVINKVDRPGARPDWVVDQVFDLFVNLGATDEQLDFPIIYASALNGVAGLEHEKLASNMDPLFEAIIEHVSPPDVELDAPFQMQISQLDYSKYLGVIGIGRIKRGTVKPNQPVTLIDPEGKTRNGRIGQVLGHLGLQRYEAQEAYAGDIIAVTGLGELNISDTVCDINNVEALPALSVDEPTVTMFFCVNTSPFCGKEGKFVTSRQILERLKKELVHNVALRVEETDDSDIFSVSGRGELHLSVLIENMRREGYELAVSRPKVIFKEIDGRKQEPFEQVTIDIEEQHQGSVMEALGIRKGEVRDMIPDGKGRTRLEYIIPSRGLIGFRNEFMTMTSGTGLLYSSFSHYDDVKPGEIGQRINGVLISNGTGKALAYSLYALQDRGKLMVDHGAEIYEGQIIGIHSRSNDLTVNPLEGKKLTNMRASGKDDALTLTTPLKLTLEQALEFIDDDELVEVTPISVRIRKKLLTEVERKRANRTTTSTSTR

SEQ ID NO: 3789 - DNA, 1791 bp, Trichodesmium erythraeum IMS101
  CDS (1)..(1791): transl_table=11
atgtctcttcctattcgcaacgtagccatcatcgcccacgttgaccacggcaaaactaccctagtagactcgctcctcaaacaatctggcatcttccgggaaggagaagaagttcctgattgtgtcatggactccaacgacctagaaagggaacgtgggattacaattctttctaaaaataccgcagttacatacaaagatactctcataaatatcgtcgatactcctggtcacgctgactttggaggagaagtagaacgagttctgggtatggtggatggttgtttactaattgtggatgccaatgaaggcccaatgccacaaactcgcttcgtgctcaaaaaagctctagaaaaaggtttacggcccattgttattgttaataaaatcgaccgtccccgagttaatccccacagggctgttgacaaagttcttgacctatttattgaactaggtgcagatgatgaccaatgtgactttccttatctatttgcctctggtttgggaggttacgcgaaaaaagacctggaaacggaatcacaggatatgcagtgtttattcgatgctattttagaccatgtgccccctccagtgggagaccctgaaaaatctctccagttacaggtgactactctggactattcagaatatttgggcagaatagtggtaggtcgtatccacaatggtgtgattaaatctgggcaactagctgctattgtcaaagaagatggtacaattgttaagtcaaaaatctcaaaattaatgggattccaaggtttggcacgcattgacgtacaagaagctgctgctggtagtattgtggcagttgctggttttagtgatgctaatattggtgaaactattacttgtcctaacgaacctcaagctctacctctgatcaaagtagatgaaccgactttacaaatgactttctctgtaaatgattctccatttgctggtaaggaaggaaaatttgtaacttctcggcaagtacgcgatcgcctgatgcgagagttagaaactaatgtggcattacgagtagaagaaactgactctccagagaagttctctgtttcaggtcgtggggaattgcacttgggtattttgattgaaactatgcgccgagaaggttatgagtttcaagtttctcaacctcaagttatttaccgggaaataaatggtcagccatgcgaaccatttgaactattagtgatggatgttcccgaagatgctgtcggtggttgcatcgaaagaataggtcagcgcaaaggggaaatgcagaatatgcaggtgagtacaaatggtcgaactcagttagatttttctgttcctgctcgtggtttgattggtttccggggtgagtttatgcgtcttacccgtggggaaggcattatgaatcacagttttttagattatcgtcctttaattggtgacattgaagctcgacgcaatggagtaattattgtatttgaggaaggtgtggcgactttttatgccttgaaaaatgctgaagaccgtggagtatttttcattacccctggtacaaaggtttataaaggtatgattgtgggagagcataaccgccctcaagatttggatttgaatgtttgtaaaactaagcagttgactaatcatcgttctgcaactggggatgagttagtgcagttacaagctcctgtggaaatgagcttggagcgggcgttggaatatattgggccggatgagttggttgagatcacaccagagtcaattcggttgcggaagatgagtaaaaaactggtcaaacgttaa

SEQ ID NO: 3790 - protein, 596 aa, Trichodesmium erythraeum IMS101
MSLPIRNVAIIAHVDHGKTTLVDSLLKQSGIFREGEEVPDCVMDSNDLERERGITILSKNTAVTYKDTLINIVDTPGHADFGGEVERVLGMVDGCLLIVDANEGPMPQTRFVLKKALEKGLRPIVIVNKIDRPRVNPHRAVDKVLDLFIELGADDDQCDFPYLFASGLGGYAKKDLETESQDMQCLFDAILDHVPPPVGDPEKSLQLQVTTLDYSEYLGRIVVGRIHNGVIKSGQLAAIVKEDGTIVKSKISKLMGFQGLARIDVQEAAAGSIVAVAGFSDANIGETITCPNEPQALPLIKVDEPTLQMTFSVNDSPFAGKEGKFVTSRQVRDRLMRELETNVALRVEETDSPEKFSVSGRGELHLGILIETMRREGYEFQVSQPQVIYREINGQPCEPFELLVMDVPEDAVGGCIERIGQRKGEMQNMQVSTNGRTQLDFSVPARGLIGFRGEFMRLTRGEGIMNHSFLDYRPLIGDIEARRNGVIIVFEEGVATFYALKNAEDRGVFFITPGTKVYKGMIVGEHNRPQDLDLNVCKTKQLTNHRSATGDELVQLQAPVEMSLERALEYIGPDELVEITPESIRLRKMSKKLVKR

SEQ ID NO: 3791 - DNA, 1803 bp, Synechococcus sp. CC9311
  CDS (1)..(1803): transl_table=11
atgagcgccccgaataaggcgattcgcaatattgcgatcatcgcccacgtggatcacggcaaaaccactcttgtggatgccctgctcaaccagtccgggatctttcgcgacaacgaggccgtcccaacatgcgttcttgactccaatgatttagagagagagcgcggaattaccattctttcgaagaatactgcggttacttataacgatacgagaatcaatattgttgatactcctggccacgccgatttcgggggtgaagttgagcgtgtgctcggcatggtggatggatgtttgctcatcgttgatgccaatgagggccccatgccccaaacccgttttgttctcaaaaaagccctggagcagggtttgagaccgattgtgtttgttaacaagattgaccgtgcgcgtgttgatccagaaacggctgttgataaggttcttgaccttttcctagagctaggtgctgacgatgatcagtgtgatttcccttatttgtttggcagtggattagggggctttgcaaagcccgacatgaaaacagagagcgacaacatgcgtcctctctttgatgccattttgcgtcatgtaccgcctccagttggtgatcctgaaaagcctctacaacttcaaattactaccctcgattattcagacttcctcggtcgaattattattggacgggtgcacaacggtgttataagacaggggcaaagagctacgcttattaaggatgacggaagtgtaaaaaaaggtcgtattagcaagcttttaggctttgaaggtttgcaaagagtggatattgcagaagcatctgccggtgaccttattgctgtcgctggtttcgacgatgtcaatatcggcgagacgattgcttgccctgatgaacccaaagcattacctcttatcaaggttgacgagccaactctgcaaatgaccttcgtggtcaatgattctccttttgcaggaaaagagggcaagtttgtcactagccgtcagcttcgagatcgtttgcagcgcgaactgcttacgaatgttgctctacgcgttgaagacaccgattctcctgatcgtttctctgtttgtggtcgcggtgaacttcatctcggtatcttgatcgaaacgatgcgccgcgaggggtttgaatttcaggtttctcaaccccaggtgattttccgcactatcgacggcacaccttgtgagcctgtggagacattggtgatggatgttcctgaagctgcagttggtagctgcattgaaaagcttggaactcgaaaaggtgaaatgcaaaatatggaaaccggagcagacaatcgcacgcaacttgaatttgtggttccttcccgggggttaattggtttccggggtgaattcattcgtgccactcgcggagaaggaattatgagccattcgttttttgaatatcgtccgatggtgggcgattttgagactcggaggaatggcgtgttgattgcatttgaggaaggtacagctactttctatgctctaaagggagcagaggatcgtggacaattctttatcactccgggcactaaagtctataaaggaatgattattggtgaaaatactcgtcaacaagacatggaaatcaatatctgtaaagcgaagcaggtcaccaacattcgttctgctggcgcagacgttttggatacgcttcagtcaccaattcagatgacattggagcgtgctttggaatatataggacctgatgaaatgcttgaagtcacacctgaatccatgcgtttaagaaaattacctgctaaaaaaatggctaagcgttga

SEQ ID NO: 3792 - protein, 600 aa, Synechococcus sp. CC9311
MSAPNKAIRNIAIIAHVDHGKTTLVDALLNQSGIFRDNEAVPTCVLDSNDLERERGITILSKNTAVTYNDTRINIVDTPGHADFGGEVERVLGMVDGCLLIVDANEGPMPQTRFVLKKALEQGLRPIVFVNKIDRARVDPETAVDKVLDLFLELGADDDQCDFPYLFGSGLGGFAKPDMKTESDNMRPLFDAILRHVPPPVGDPEKPLQLQITTLDYSDFLGRIIIGRVHNGVIRQGQRATLIKDDGSVKKGRISKLLGFEGLQRVDIAEASAGDLIAVAGFDDVNIGETIACPDEPKALPLIKVDEPTLQMTFVVNDSPFAGKEGKFVTSRQLRDRLQRELLTNVALRVEDTDSPDRFSVCGRGELHLGILIETMRREGFEFQVSQPQVIFRTIDGTPCEPVETLVMDVPEAAVGSCIEKLGTRKGEMQNMETGADNRTQLEFVVPSRGLIGFRGEFIRATRGEGIMSHSFFEYRPMVGDFETRRNGVLIAFEEGTATFYALKGAEDRGQFFITPGTKVYKGMIIGENTRQQDMEINICKAKQVTNIRSAGADVLDTLQSPIQMTLERALEYIGPDEMLEVTPESMRLRKLPAKKMAKR

SEQ ID NO: 3793 - DNA, 1812 bp, Shewanella sp. MR-4
  CDS (1)..(1812): transl_table=11
gtgctagagaatttacgtaacatcgccattattgcgcacgttgaccatggcaaaacgaccctggttgacaagctgctgtcgcaatcaggaacccttgcaacccggggagaagctactgagcgggtgatggactccaacgatcttgaaaaggagcgtgggatcacgattctggcaaagaatactgccatcaagtggaatgactaccgcattaacatcgtagacaccccaggccacgccgacttcggtggtgaggttgagcgcgtgttgtctatggtggactcagtattactgctggttgacgccgttgacggtccaatgccacagactcgcttcgtaaccaagaaagcgttcgctcaaggtttaaagccaatcgttgtgatcaacaagattgaccgtcctggtgctcgccctgattgggttatcgaccaagtattcgacctgttcgacaacttaggcgcgaccgatgagcaattagatttcccaatcgtttatgcctcggcattaaacggttttgcaactttagatccggatgaagtgagcgcagatatgacgccactgttccaaactatcgttgaaaaagtttctccacctgcagctgacgctgaaggtccattccagatgcaaatttctcagctcgattacaactcttatgtgggtgttatcggcgtgggtcgcatcaagcgtggtagtatcaaagcaaaccaacaggtgagcgtgatcggcgccgacggtaaagtgcgtaacggcaaaatgggccaagtattaggttacatgggcttagatcgtaccgaagttgacgtagctaacgctggcgacatcgttgctattaccggtttaggcgagctgaaaatctctgatactgtgtgtgctgccggtagcgttgaagcactgcctgcactgtcagttgatgagccaacgctgaccatgactttccaagtcaacacttcacctttcgcaggtaaagaaggtaagtacgtgacttcacgtaacattcttgagcgtctgcaacaggaattagtgcacaacgtggcactgcgtgttgaagaaaccgacagcccagaccgtttcgcggtatctggccgtggtgaattacacttatctatcctgatcgaaaacatgcgtcgtgaaggttacgaattagcggtttctcgcccagaagttatcttaaaaaccatcgatggcgaactgtgtgagccatatgaaactctgactgttgacgttgaagaagaacatcaaggtacagtgattgagaaactgggtatccgtaaagccgaaatgaaagacatgcagcttgacggtaaaggtcgcgttcgcgttgactttatcatcccaagccgtggcttaatcggtttccaaactgagttcttaactgcaacttctggtactggtctgatttaccactcattcgatcactacggtccacacaaaggtggcgatatcggtcaacgcgctaacggcgtactgatctctaacgcgaccggtaaggcgctgacattcgcactgttcggtctgcaggatcgcggtcgtctgtttatcggccacgctgccgaagtttacgaaggtcaagttgtgggtatccactcacgttcaaacgacctgacagttaactgtctgaaaggtaagcagctgaccaacatgcgtgcttctggtactgacgaagctcaagtactgactacgccaatcaccttaactcttgagcaagcacttgagtttatcgatgatgacgaattagtagaagtaacgcctaagagcatccgtgttcgtaagaaacatttaactgaaaatgaccgtaaacgcgctagccgtggttaa

SEQ ID NO: 3794 - protein, 603 aa, Shewanella sp. MR-4
MLENLRNIAIIAHVDHGKTTLVDKLLSQSGTLATRGEATERVMDSNDLEKERGITILAKNTAIKWNDYRINIVDTPGHADFGGEVERVLSMVDSVLLLVDAVDGPMPQTRFVTKKAFAQGLKPIVVINKIDRPGARPDWVIDQVFDLFDNLGATDEQLDFPIVYASALNGFATLDPDEVSADMTPLFQTIVEKVSPPAADAEGPFQMQISQLDYNSYVGVIGVGRIKRGSIKANQQVSVIGADGKVRNGKMGQVLGYMGLDRTEVDVANAGDIVAITGLGELKISDTVCAAGSVEALPALSVDEPTLTMTFQVNTSPFAGKEGKYVTSRNILERLQQELVHNVALRVEETDSPDRFAVSGRGELHLSILIENMRREGYELAVSRPEVILKTIDGELCEPYETLTVDVEEEHQGTVIEKLGIRKAEMKDMQLDGKGRVRVDFIIPSRGLIGFQTEFLTATSGTGLIYHSFDHYGPHKGGDIGQRANGVLISNATGKALTFALFGLQDRGRLFIGHAAEVYEGQVVGIHSRSNDLTVNCLKGKQLTNMRASGTDEAQVLTTPITLTLEQALEFIDDDELVEVTPKSIRVRKKHLTENDRKRASRG

SEQ ID NO: 3795 - DNA, 1809 bp, Alkalilimnicola ehrlichei MLHE-1
  CDS (1)..(1809): transl_table=11
atgaccgaacgcctgcgcaacatcgccatcatcgcccacgtcgaccacggcaagaccaccctcgtcgacaaactcctgcaacaatccggcaccctggaaacccgcggtgaggccgtcgagcgggtcatggattcgaacgacctggagaaggaacgcggcatcaccatcctctccaagaacaccgccatccagtggaacgactggcgcatcaacatcgtcgacacccccggccacgccgatttcggcggcgaagtggagcgggtgctctccatggtcgactcggtgctgctgctggtggatgccgtcgacggccccatgccgcagacccggttcgtcacccagaaggccctggccctggggctgcgccccatcgtggtggtaaacaagatcgaccggcccagcgcccgccccgactgggtggtggaccagaccttcgacctgttcgaccggctgggcgccagcgacgaacaactggacttccccatcgtcttcgcctccgcgctgcagggctatgccagcgaggacagcgaggcccggggcggcgacatgaccccgctgttcgagaccattacccgacatgtcccggcccccgaggtggacgcggacggcccgttccagatgcaggtcagctcgctggactacaacagctacgtgggcgtgatcggcatcggccggatcacccgcgggcgggtgcgcaccaactccccgatcagcatcatcggccgcgacggtcgcaagcgtaacggccgcatcctgcaggtgctcggcttccacggcctggaccgggtggaggtgcccgaggcccgggccggcgacatcatcgcctttaccggctgcgaggggctcaacatctccgataccctcaccgacccggcccacccggatgcgctgcccccgctcaccgtggatgagcccaccgtgagcatgacgtttcaggtcaacacctccccctttgccggtcgcgacggcaagtacgtcacctcgcggcagatccgcgagcgcctggagcgggaactgatccacaacgtggccctgcgggtggagcccaccgacgacccggaccgcttccgcgtctccgggcgcggcgagctgcacctgtccgtgctcatcgagaacatgcgccgcgagggctacgagctgggtgtcagccgccccgaggtgatcgtgcgcgagatcgacggcgttcagcaggagccctgggagcagctgaccgtggacgtggaggagcagcaccagggcgcggtcatggagaagctgggcgagcgcggcggcgagctgcaggacatgatccccgacggcaggggccgggtacggctggatttcatcatccctgcccgcgggctgatcggctttcgcaccgagttcatgacggccacctccggcaccggcctgatgtaccacgtctttgaccactacggcccggtgaagcagggcgactttggcagccgacacaatggggtgatggtgagcatggcgaaaggcaaggcgctggcctacgccctgttcaacctgcaggagcggggcaagctgttcatcggtcacggggcggaggtttacgaggggatgatcgtgggcatccacgcccgcgacaacgacctggtggtcaacccgctcaaggccaagcagctcaccaacgttcgcgccgccggctcggacgagaacctcatcctgaccccggccatcgacctgaccctggagcaggcgctggagttcatcaacgacgatgagctggtggaggtgaccccggaggccatccgcctgcgcaagaagctgctcaaggaacacgagcgcaaacgcgccgcgcgctga

SEQ ID NO: 3796 - protein, 602 aa, Alkalilimnicola ehrlichei MLHE-1
MTERLRNIAIIAHVDHGKTTLVDKLLQQSGTLETRGEAVERVMDSNDLEKERGITILSKNTAIQWNDWRINIVDTPGHADFGGEVERVLSMVDSVLLLVDAVDGPMPQTRFVTQKALALGLRPIVVVNKIDRPSARPDWVVDQTFDLFDRLGASDEQLDFPIVFASALQGYASEDSEARGGDMTPLFETITRHVPAPEVDADGPFQMQVSSLDYNSYVGVIGIGRITRGRVRTNSPISIIGRDGRKRNGRILQVLGFHGLDRVEVPEARAGDIIAFTGCEGLNISDTLTDPAHPDALPPLTVDEPTVSMTFQVNTSPFAGRDGKYVTSRQIRERLERELIHNVALRVEPTDDPDRFRVSGRGELHLSVLIENMRREGYELGVSRPEVIVREIDGVQQEPWEQLTVDVEEQHQGAVMEKLGERGGELQDMIPDGRGRVRLDFIIPARGLIGFRTEFMTATSGTGLMYHVFDHYGPVKQGDFGSRHNGVMVSMAKGKALAYALFNLQERGKLFIGHGAEVYEGMIVGIHARDNDLVVNPLKAKQLTNVRAAGSDENLILTPAIDLTLEQALEFINDDELVEVTPEAIRLRKKLLKEHERKRAAR

SEQ ID NO: 3797 - DNA, 1833 bp, Hyphomonas neptunium ATCC 15444
  CDS (1)..(1833): transl_table=11
atgaccacgcacctcgaaaagatgcgcaacattgccatcatcgcccacgttgaccatggcaagaccacgctcgttgacgaactcctgaaacaatccggaaccttccgcgccaacgaaaagacggccgagcggatgatggactccaacgatctggagaaagaacgcggcatcaccatcctcgccaagacaacctcggtcgagtggaatggctaccgcatcaacatcgtcgacacccccggccacgccgacttcggcggtgaggtggagcgtattctcgacatggtggacggcgtgatcgtcctcgtcgactcggccgaaggccccatgccgcagaccaaattcgtggtctccaaggccctgaagctcggcctgcgccccatcgtggccatcaacaagatcgacaaggccgagcgccgcgtggacgaagtgctcaacgaagtcttcgatcttttcgcaaatctcgacgccaccgatgagcagctcgatttccccgtcctctacggctcgggcaagatgggctggatgtcgacccagtatgaagaagttcgccccaacatggacgaactcttccagctggtcgtggaccatgtgccgaccccaaaagtggcagagggcccgttccggttcctcgccaccaccatttcggcagaccctttcctcggccgcatcctcaccggccggatcctctctggctcgatcaagccgaaccagtcgatcaaggtcctcgcgcgcgatggccagctcgtcgagcagggccgcatctccaaagtcctcgccttccgcggccttgagcgcgtgccggtcgatgaggcctccgccggcgacatcgtctccctggccggcatgaccaaggccaacgtcgccgacaccttctgcgatccgtcggtcaccgagccgctcgccgcccagccgatcgacccgcctaccatctcgatgaccttccgcgtcaacgacagcccgctggccggcaccgaaggcaccaaagtcacctcgcgcctcatctgggaccgtctcctgaaagaagccgaaggcaacgtcgccctgaaggtagaccgtgccaccgacgccgaagctttcaccgtttccggccggggcgagcttcagctctccgtccttatcgagacgatgcgccgcgaaggcttcgaactgggcgtcgcccgcccgcaggtcctgatgcaggaaggcccgaacggcgaaaagctggagccgatcgaggaagtcatcatcgatgtcgatgacgaccattccggcatcgtcgttcagaaaatgaacgagcgcaaagccgagatgctcgacatgcgcccttccggcgttggccgcacgcgccttgtcttccacgcgcccacgcgcggcctgatcggctatcagggcgagctgctgtcggatacccgcggcaccgccatcatgaaccgcatcttccacgaatacctgccccacaaaggcaagatccagggccgccacaccggcgttctgatcgccatggagcagggagaggccgttgccttcgcgctctggaacctcgaagaccgtggcccgatgatgatccatcccggcgacaaggtgtatggcggcatgatcgtgggcgaacacaaccgcgacaacgatctggaagtgaacgtcctcaagggcaagaagctcaccaacatgcgcgcgtcgggtacggatgaagccgtccgcctcaccccgccgctgatgatgacgctggaaaaatccctggcttacatcgccgatgacgaactcgtggaagtcacgcccaagaatatccgcctgcggaaaatctggctcgaccccaatgaccgcaaacgccgctccaaacaaaccgccgacgcttaa

SEQ ID NO: 3798 - protein, 610 aa, Hyphomonas neptunium ATCC 15444
MTTHLEKMRNIAIIAHVDHGKTTLVDELLKQSGTFRANEKTAERMMDSNDLEKERGITILAKTTSVEWNGYRINIVDTPGHADFGGEVERILDMVDGVIVLVDSAEGPMPQTKFVVSKALKLGLRPIVAINKIDKAERRVDEVLNEVFDLFANLDATDEQLDFPVLYGSGKMGWMSTQYEEVRPNMDELFQLVVDHVPTPKVAEGPFRFLATTISADPFLGRILTGRILSGSIKPNQSIKVLARDGQLVEQGRISKVLAFRGLERVPVDEASAGDIVSLAGMTKANVADTFCDPSVTEPLAAQPIDPPTISMTFRVNDSPLAGTEGTKVTSRLIWDRLLKEAEGNVALKVDRATDAEAFTVSGRGELQLSVLIETMRREGFELGVARPQVLMQEGPNGEKLEPIEEVIIDVDDDHSGIVVQKMNERKAEMLDMRPSGVGRTRLVFHAPTRGLIGYQGELLSDTRGTAIMNRIFHEYLPHKGKIQGRHTGVLIAMEQGEAVAFALWNLEDRGPMMIHPGDKVYGGMIVGEHNRDNDLEVNVLKGKKLTNMRASGTDEAVRLTPPLMMTLEKSLAYIADDELVEVTPKNIRLRKIWLDPNDRKRRSKQTADA

SEQ ID NO: 3799 - DNA, 1821 bp, Rhizobium leguminosarum bv. viciae 3841
  CDS (1)..(1821): transl_table=11
atggcacttcgcaatatcgcgatcatcgcgcacgttgaccatggcaaaacgaccctggtggatgagcttctcaagcagtccggctcgttccgcgaaaatcagcgtgtcgctgaacgcgtgatggactcgaacgatctcgaaaaggaacgcggcatcaccattctcgccaaggcgacctcggtggaatggaagggtgtccgcatcaacatcgtcgacacccccggccacgccgacttcggcggtgaagtcgagcgcattctctcgatggtggatggcgcgatcgttctcgtcgactcctccgaaggcccgatgccgcagacgaagttcgttgtctccaaggcgttgaaggttggccttcgcccgatcgtcgcgatcaacaagatcgaccgtccggatggccgccacgaagaagtcatcaacgaagtcttcgacctctttgcaaacctcgacgcgaccgacgagcagctcgacttcccgatcctctacggttcgggccgcgacggctggatgaacgtcaatccggaaggtccgaaggatcagggtcttacgccgcttctcgacctggtgctcaagcatgttccggagccgaccgtccacgaaggtccgttcacgatgatcggcacgatccttgaagccaaccccttcctcggtcgcatcatcaccggccgtatcaattccggttccatcaagccgaaccaggccgtgaaggttctccacgccgacggcaagacgatcgaaaccggccgtatttccaagatcctcgccttccgcggcatcgagcgcacggcaatcgacgaagcgcatcagggcgatattatcgcgattgccggcctttccaagggcacggtcgccgacaccttctgcgatccttcgatcacaataccgctgccggcgcagccgatcgatccgccgaccgtcaccatgtccttcatcgtcaacgatagcccgctggccggcaccgaaggcgacaaggtgacgagccgcgtcatccgcgaccgtctcttcaaggaagcggaaggcaacgtcgccctgaagatcgaagaagccgaaggcaaggattcgttctacgtgtccggccgcggcgaacttcagctcgccgttctcatcgaaaccatgcgtcgcgaaggcttcgagcttgccgtgtcgcgtccgcgcgtcgtgatgcacaaggacgaaagcggccagcttctggagccggtcgaggaggtcgtcatcgacgtcgacgaagaacattccggtgtcgtcgtgcagaagatgtccgagcgcaaggccgaaatggtcgagctgcgtccgtcgggcggtaaccgtctccgcctgcgtttctacgcaccgacccgtggcctgatcggctaccagtcggagctgctgacggatacgcgcggcacggcgatcatgaaccgcctgttccacgactaccagccctacaagggtgtgatcggtggccgcgtcaacggcgtgctgctcgccaacgcccccggcgaagccgtcgcctatgcgatgttcaacttggaagatcgcggcccgatgatcatcgagccgggcgaaaaggtctatgccggcatgatcatcggcatccattcgcgcgacaacgaccttgaagtcaacgtcctgaagggcaagcagctcaccaacatccgcgccgccggcaaggacgaagcggtgaagctgacaccgccgatccgcatgacgcttgatcgcgcgctctcctggatccaggatgacgagctgatggaagtgacaccgaagaatattcgtctgcgcaagatgtatctcgacgcaaacgatcgcaagcgtttcgaaaagacgaaggcggctctctga

SEQ ID NO: 3800 - protein, 606 aa, Rhizobium leguminosarum bv. viciae 3841
MALRNIAIIAHVDHGKTTLVDELLKQSGSFRENQRVAERVMDSNDLEKERGITILAKATSVEWKGVRINIVDTPGHADFGGEVERILSMVDGAIVLVDSSEGPMPQTKFVVSKALKVGLRPIVAINKIDRPDGRHEEVINEVFDLFANLDATDEQLDFPILYGSGRDGWMNVNPEGPKDQGLTPLLDLVLKHVPEPTVHEGPFTMIGTILEANPFLGRIITGRINSGSIKPNQAVKVLHADGKTIETGRISKILAFRGIERTAIDEAHQGDIIAIAGLSKGTVADTFCDPSITIPLPAQPIDPPTVTMSFIVNDSPLAGTEGDKVTSRVIRDRLFKEAEGNVALKIEEAEGKDSFYVSGRGELQLAVLIETMRREGFELAVSRPRVVMHKDESGQLLEPVEEVVIDVDEEHSGVVVQKMSERKAEMVELRPSGGNRLRLRFYAPTRGLIGYQSELLTDTRGTAIMNRLFHDYQPYKGVIGGRVNGVLLANAPGEAVAYAMFNLEDRGPMIIEPGEKVYAGMIIGIHSRDNDLEVNVLKGKQLTNIRAAGKDEAVKLTPPIRMTLDRALSWIQDDELMEVTPKNIRLRKMYLDANDRKRFEKTKAAL

SEQ ID NO: 3801 - DNA, 1845 bp, Pediococcus pentosaceus ATCC 25745
  CDS (1)..(1845): transl_table=11
ttgaatttaagagacgatattagaaatattgcaatcattgcccacgttgaccacggaaagactaccttggttaatgaattattgaaacaatcagatacattagacgaacacgttcaaattgaagaccgtgctttggactcaaatgcgattgaacgtgaacgtggaatcacaattctttcaaaaaacactgctgtacgttatgcagataaacaaattaacattttagatactccaggacatgctgacttcggtggtgaagttgaacgtatcatgcgcatggttgatggtgttttgcttgttgttgatgcttttgaaggaacaatgccccaaacacgctttgttttgaaaaaagctttggaacaacatttaacaccaatcgtggttgttaacaagattgaccgcccaggcgcacgtccagaagaagttgttgacgaagttcttgatctattcattgaacttggtgctgatgaagaccaacttgagttcccagttgtatatgcttcagctatcaatggaacttctagtttttcttcagacccagctgaccaagaacacacaatgaaaccaatttttgatacaattgtagatacaattccagctcctgaagattcttcagctgaaccacttcaattccaagttgctttacttgattacaacgacttcgttggacggattggtattggacgtgtattccgcggtcggatcaaggttggagacaacgtttccgtgcttaaacttgatggttcaaagaaaaacttccgagttactaagttgtttggttactttggtttgaaacgtttggaaatcaacgaagccaaagcaggggacttgattgctatctcaggtatggaagacattttcgttggtgaaacagttgccgatgcagaacatccagaagcattaccagtgttacgaattgacgaacctacactacaaatgacatttagaacaaatgattcaccatttgctggtcgcgaaggtaagttcgttacatcacgtcagttggaacaacgtttgaagactgaacttcatactgatgtttcacttcgagttgatgatactgatgatcctggtgcatggattgtttcaggtcgtggtgaacttcatctttcaattttaattgaaacacttcgtcgcgaaggttacgaacttcaagcatcacgtccagaagttatcatcaaggaaatcgatggcaagctatgtgaaccttatgaaatggttcaaattgatacacctgatgaatatactggttctgtaattgattcactttcacaacgtaagggtgaaatgaagaatatggaaactactgataatggtcaaactcgtttgactttcttggctccttcacgtggattgattggttactctacagaattcctatcaatgactcgtggatatggtattatgaaccatactttccaagaatacttaccacaaattaagaactggaatccaggtcgtcgtaatggtactttagtatcaattaattctggtaaagttaccacttacgctatcatggctgttcaagatcgtggagttatctttacagatgctggtactgaagtatatgaaggtatgattgttggtcaaaacagtcgtgaaaatgatatttcagttaacattactcgtggacgtaaccaaactaacgtgcgtgctgctggttctgaagatatcgctaaggttaaaacaccagttcatatgtcactcgaagaatcacttgaatttttgaatgaagatgaatactgtgaaattacacctgatcacattcgtttgcgtaagcaaatcttgaatacaaatgaacgtgaaaaagctgctaagaaacgtaaaatggctgctaaaaaataa

SEQ ID NO: 3802 - protein, 614 aa, Pediococcus pentosaceus ATCC 25745
MNLRDDIRNIAIIAHVDHGKTTLVNELLKQSDTLDEHVQIEDRALDSNAIERERGITILSKNTAVRYADKQINILDTPGHADFGGEVERIMRMVDGVLLVVDAFEGTMPQTRFVLKKALEQHLTPIVVVNKIDRPGARPEEVVDEVLDLFIELGADEDQLEFPVVYASAINGTSSFSSDPADQEHTMKPIFDTIVDTIPAPEDSSAEPLQFQVALLDYNDFVGRIGIGRVFRGRIKVGDNVSVLKLDGSKKNFRVTKLFGYFGLKRLEINEAKAGDLIAISGMEDIFVGETVADAEHPEALPVLRIDEPTLQMTFRTNDSPFAGREGKFVTSRQLEQRLKTELHTDVSLRVDDTDDPGAWIVSGRGELHLSILIETLRREGYELQASRPEVIIKEIDGKLCEPYEMVQIDTPDEYTGSVIDSLSQRKGEMKNMETTDNGQTRLTFLAPSRGLIGYSTEFLSMTRGYGIMNHTFQEYLPQIKNWNPGRRNGTLVSINSGKVTTYAIMAVQDRGVIFTDAGTEVYEGMIVGQNSRENDISVNITRGRNQTNVRAAGSEDIAKVKTPVHMSLEESLEFLNEDEYCEITPDHIRLRKQILNTNEREKAAKKRKMAAKK

SEQ ID NO: 3803 - DNA, 1836 bp, Oenococcus oeni PSU-1
  CDS (1)..(1836): transl_table=11
atggcaaaaacgagagaagatattagaaatattgcgattatcgcccatgttgatcatggtaagactactttggttaacgaaatgctgaaacaatcagatacttttgattcacatacgcaaattgctgatcgagcaatggatacgaatccaattgaaaaagaacgtggaattaccattctttcaaaaacgacagcaatcagagttggcaataaacagattaacatcgtcgatacaccgggccatgccgattttggcggtgaagttgaacgtatcatgacgatggttgacggtgttttgcttgtcgttgatgcttttgaaggaacgatgccacaaacacgctttgttttaaaaaaagcttttgaacaacatttgactccaattgtaatcattaataaagttgatcgtcccggtgctcgtccacaagaagtggtcgatgaggttttggatttgtttattgaattgggtgctgacgatgagatgcttgatttcccagttatctatgcatccgcaatgaatgggacaagcagctactcggctgatataagcaaacaagaacatacaatgaagcctatttttgatacggtctttaaaacaatcccggctccaatcgataattctgacgaaccaatgcagttccaagttgctatgcttgattacaatgactttgttggtcgtatcggaattggccgtgttgttcgcggaacaatcaaagtcggcgataatgttactgttctaaaacttgatggttcacataaagattttcgtgtgacgaaattaatgggttttttgggcttgaaacgaattgatataaatcaggccgaagcaggagatttgattgctgtttccggaatggaagaaattaatgtcggtgaaacagttgctgcttccagccaccctgacgctctgcctccgctgagaatcgatccaccaactttgcagatgatttttagaaccaatgattcgccctttgccggtcgggaaggaaaattcgtaaccgcccgtcaattggaagatcggttgaagcaggagcttcatacagacgtttcactacgagtagaagatacgaaaacacctggtgtctggactgtttccggtcgtggagaactacacctttcaattttgatcgatacattgcgccgagaaggatttgagttgcaggctggtcgtccaaaggttatttatcgtgagatcgacggaacgcgttgcgaaccgtttgaagatgtacaaatcgatacgcctgaagaatatactggttcaattattcaatctttgtcggaacgcaaaggagagttattgaatatggaaccacagggtaacggtcagacgcgtttacactttgttgccccttcacgcggcctgattggttattctagcgagtttttgagttctactcgtggatatggtatctataaccatacattcttggattatcgcccggttattaccggatggaacccgggtcgtcgtaatggtactttggttgcaattggtcagggaacggttacgacttatgcaatcatgcaggttgaggatcgcggtactatttttgttgatcccggcaccgaggtttacgagggtatgattgttggtgaaaattcccgtgaaaatgatatctcagttaacattacccgtatgaaagcgcaaagtaacgtccgttcttcaaataaagaccaaacggctattatcaagacgccaactcatttgactcttgaagagtcgatcgagttcttgaatgatgacgaattagtcgaggttacccctgaaaatacccgtcttcgcaagataattctgaagaccaatgaacgtgaaaaagtagctcgtcatcgaaataattaa

SEQ ID NO: 3804 - protein, 611 aa, Oenococcus oeni PSU-1
MAKTREDIRNIAIIAHVDHGKTTLVNEMLKQSDTFDSHTQIADRAMDTNPIEKERGITILSKTTAIRVGNKQINIVDTPGHADFGGEVERIMTMVDGVLLVVDAFEGTMPQTRFVLKKAFEQHLTPIVIINKVDRPGARPQEVVDEVLDLFIELGADDEMLDFPVIYASAMNGTSSYSADISKQEHTMKPIFDTVFKTIPAPIDNSDEPMQFQVAMLDYNDFVGRIGIGRVVRGTIKVGDNVTVLKLDGSHKDFRVTKLMGFLGLKRIDINQAEAGDLIAVSGMEEINVGETVAASSHPDALPPLRIDPPTLQMIFRTNDSPFAGREGKFVTARQLEDRLKQELHTDVSLRVEDTKTPGVWTVSGRGELHLSILIDTLRREGFELQAGRPKVIYREIDGTRCEPFEDVQIDTPEEYTGSIIQSLSERKGELLNMEPQGNGQTRLHFVAPSRGLIGYSSEFLSSTRGYGIYNHTFLDYRPVITGWNPGRRNGTLVAIGQGTVTTYAIMQVEDRGTIFVDPGTEVYEGMIVGENSRENDISVNITRMKAQSNVRSSNKDQTAIIKTPTHLTLEESIEFLNDDELVEVTPENTRLRKIILKTNEREKVARHRNN

SEQ ID NO: 3805 - DNA, 1842 bp, Leuconostoc mesenteroides subsp. mesenteroides ATCC 8293
  CDS (1)..(1842): transl_table=11
ttggcaaatcgcgaagacattcgtaacatcgctatcattgcccacgtcgatcacgggaagacgacgctggttaacgaacttttgaagcaatcagacacattggattcacgcaaggaattgggtgatcgtgcaatggatactaacgatattgaaaaagaacgtggtatcactatcttgtcaaaaaacacagccgttaaggttggggacaagcaaattaacattttggatacacctggacacgcggacttcggtggtgaagttgaacgtatcatgggtatggttgatggcgtgttgttggtcgttgatgcttttgaaggtacaatgccacaaactcgttttgtgttgaaaaaagctttcgaacaacatttgacaccaatcgttatcgttaacaaagtggaccgtcctggtgcacgtcctgaagaagttgttgacgaagtattggatttgtttattgaattaggtgccgatgaagaagatttggacttcccagttatctttgcttcagcgatgaacggtacatcttctttgtcaccaaatgttgacgatcaagaacatacgatgaagccaatttttgatgctgtctttaatacaattccttcaccagttgacaactcagatgaaccattacaattccaagtggcaatgttggactacaatgatttcgttggtcgtatcggtattggccgtgttaagcgcggaacaattaaaattggtgacaacgttgaagttttgaagttggatggttcaacacaaagtttccgtgtaactaagcttgctggtttcatcgggttagaccaagtagatatccaagaagctaaagctggtgatttgattgctgtctctggtatggaagatatctctgttggtgaaacagttgcagatcctgctcatccagatgcattaccaattttacgtatcgacgaacctactttgcaaatgacattccgtcaaaatgacagtccgtttgcaggtaaagaaggtaagtttgttactgcacgtcaaattgaagatcgtttgcgtcgtgaattgcatactgatgtgtcattgcgcgttgaagatattggacaagctggtgcttggtcagtgtctggtcgtggtgaattacacttgtcaattttgattgaaacgatgcgtcgtgaaggctttgagttacaagcttctcgtccacaggttatttaccgtgaaattgatggtgttcaatcagaaccatatgaatcagttcaaatcgatacacctgatgaatattcatcaacagttattgattcattgaaccaacgtaagggtgagatggtcaacatggagtctgttggtaacggacaaacacgtttgacttatatggcaccttcacgtggcttaattggttattcaactgaatttatgtcagctacacgtggatatggtatttttaaccatacgtatgctgaatatcgtccagttgttcgtaactgggaaccaggacgtcgtaatggtgctttggtttctattaaccaaggaacaactacaaactatgcgattatgggtgttgaagatcgtggacaaatgtttgttggcgctggtattgaagtttatgaaggaatgattgttggaatgaatgcgcgtgacaatgacatctcagtcaacgttacaaaattgaagccacaatcaaacgttcgttcatcaaacaaagaccaaacatcttcaattaagacaccacgcatcatgaatttggaagcttctttggaattcttgaatgatgatgaatatgttgaagtaactcctgaaaacgtacgtatccgtaaagctatcttgaacacagctgagcgtgaaaagtctgctaagcgtcgtaaggcatcaacaaactaa

SEQ ID NO: 3806 - protein, 613 aa, Leuconostoc mesenteroides subsp. mesenteroides ATCC 8293
MANREDIRNIAIIAHVDHGKTTLVNELLKQSDTLDSRKELGDRAMDTNDIEKERGITILSKNTAVKVGDKQINILDTPGHADFGGEVERIMGMVDGVLLVVDAFEGTMPQTRFVLKKAFEQHLTPIVIVNKVDRPGARPEEVVDEVLDLFIELGADEEDLDFPVIFASAMNGTSSLSPNVDDQEHTMKPIFDAVFNTIPSPVDNSDEPLQFQVAMLDYNDFVGRIGIGRVKRGTIKIGDNVEVLKLDGSTQSFRVTKLAGFIGLDQVDIQEAKAGDLIAVSGMEDISVGETVADPAHPDALPILRIDEPTLQMTFRQNDSPFAGKEGKFVTARQIEDRLRRELHTDVSLRVEDIGQAGAWSVSGRGELHLSILIETMRREGFELQASRPQVIYREIDGVQSEPYESVQIDTPDEYSSTVIDSLNQRKGEMVNMESVGNGQTRLTYMAPSRGLIGYSTEFMSATRGYGIFNHTYAEYRPVVRNWEPGRRNGALVSINQGTTTNYAIMGVEDRGQMFVGAGIEVYEGMIVGMNARDNDISVNVTKLKPQSNVRSSNKDQTSSIKTPRIMNLEASLEFLNDDEYVEVTPENVRIRKAILNTAEREKSAKRRKASTN

SEQ ID NO: 3807 - DNA, 1797 bp, Solibacter usitatus Ellin6076
  CDS (1)..(1797): transl_table=11
atgaaaagcagcaatccaaagattcgcaacatcgccatcatcgcccacgtcgatcacggcaagaccactctcgtcgatgccatgctcaatcagagcggtatcttcggctcccacgaggagcacgttgaccgcgtcatggattccaacgacctggaacgcgaacgcggcatcaccatcctggccaagatcaccggcgtgcgttatcacggcgtgaagatcaacatcgtcgatacccccggccacgcggatttcggcggcgaagtcgagcgcgccctcaaaatcgtcgatggcgtcatgctcctcgtcgatgccagcgaaggccctctcccccagacccgctacgtcctcagcaaggcgctcgaagccaagctcacccccatcgtcgtcatcaacaagatcgatcgccccgacgcccgcgtcgcggaagttctcaacgaaatctacgatctcttcatcgatctcgacgcccacgaagaccagctcgatttccccgtcctctatgccatcgccaaaaatggcatcgccaaggccacgatggaagatgagtccaccgacctgcgcccgctcttcgatgccatcgtcaaaaccatcccgccgcccgtcggcgaccccgagggcaccctccagatgctcatcgccaatctggattacagcgattacctcggccgcctcggtatcggccgcgtcgtcaacggcaccctccggtacggcgacatggtcagcatcgccaaactcgatggctcgatgcacaccaccaaaatcaccaagatgtattccttcgaaggcctgaagcgcatcgatgaaacggtcggcgcccagggcgacatcctcgccatcgccggcgtcgaaggcatcaccatcggcgagaccgtcaccagcgccgagaaccccgacccgctcccgcccatccagatcgatgagcctaccatcgcgatggccttctcgatcaacacctcgcccttcgccggccgcgaaggtcagtgggtcacctcgcgcaacctgcgcgaccgcctcgataaggaactgctcaccaacgtctccatcaaagtcgaagagatcggccacgacaccttcaaagtcatgggccgcggcgaattgcagctcgctatcctcatcgagatgatgcgccgcgaaggcttcgagctcgccgtcggcaaacccgaaattctcacccgcaccatcgatcatcagctccaggagcccgtcgagcacctgattgtcgattgccccgagaacttcctcggcgtcgtcatcgaaaagcttggcgtccgcaagggcaagatgaccaagatgatcaaccacggctccggccgcgtgcgactcgagttccacgttccctcgcgcggcctgatcgggctgcgcagcgaaatcctcaccgatacccgcggcaccgccatcatgaactcgctcttccacggctacatcccgtggcagggcgacatcccctcccgtcccaccggttcgctggtcgccgaccgcgccggcaaaaccaccggctacgccatcttcaacctccaggaacgcggcgagatcttcgtcagtcccggcaccgaagtctacgagggcatgatcgtcggcgaaaacgcccgcgatgccgatctcgacgtcaacatcgtcaaggaaaagaagctcactaacatgcgcgcctccacctccgacgaaggcatccgcctcgtccccccgcgcattctgaacctcgaacaggccatcgaattcatccgcgacgacgaattcgtcgaggtcaccccggtcagcatccgcctccgcaaaaaggtcctgaagtccaaccagcgctaa

SEQ ID NO: 3808 - protein, 598 aa, Solibacter usitatus Ellin6076
MKSSNPKIRNIAIIAHVDHGKTTLVDAMLNQSGIFGSHEEHVDRVMDSNDLERERGITILAKITGVRYHGVKINIVDTPGHADFGGEVERALKIVDGVMLLVDASEGPLPQTRYVLSKALEAKLTPIVVINKIDRPDARVAEVLNEIYDLFIDLDAHEDQLDFPVLYAIAKNGIAKATMEDESTDLRPLFDAIVKTIPPPVGDPEGTLQMLIANLDYSDYLGRLGIGRVVNGTLRYGDMVSIAKLDGSMHTTKITKMYSFEGLKRIDETVGAQGDILAIAGVEGITIGETVTSAENPDPLPPIQIDEPTIAMAFSINTSPFAGREGQWVTSRNLRDRLDKELLTNVSIKVEEIGHDTFKVMGRGELQLAILIEMMRREGFELAVGKPEILTRTIDHQLQEPVEHLIVDCPENFLGVVIEKLGVRKGKMTKMINHGSGRVRLEFHVPSRGLIGLRSEILTDTRGTAIMNSLFHGYIPWQGDIPSRPTGSLVADRAGKTTGYAIFNLQERGEIFVSPGTEVYEGMIVGENARDADLDVNIVKEKKLTNMRASTSDEGIRLVPPRILNLEQAIEFIRDDEFVEVTPVSIRLRKKVLKSNQR

SEQ ID NO: 3809 - DNA, 1836 bp, Magnetococcus sp. MC-1
  CDS (1)..(1836): transl_table=11
atgtctcaggacgtttaccccatcgaaaaactgcgtaatattgccattattgcccacgtggaccatggcaaaaccaccttggtggataagctgttgcagcagtctggcaccctcaaacagcgcggagaggcgacagaacgggtgatggactccaatgacctggaaaaagagcgcggcatcaccattttagcaaaaaatacggccatttattggaacggctatcgtattaacattgtggacacccccggacacgccgattttggcggtgaggttgagcgggtactctccatggtggattcggtgctgctgttggtggatgcggtagaaggccccatgcctcaaacccggtttgtcacgcaaaaggcgtttgctcaagggttgcgccccattgtggtggtcaacaaaatcgaccgtgatggggcccgccccgattgggtgcaagatcaaacctttgatctgtttgataaactggatgccaccgacgaacagttggattttccgattatctacacctcggccctgcgcggctttgccaccctggaccacacccaagtgaccaccaacatggatgccctgtttgagaccattatcaagcatgtctctccaccggatgtggaccaagaaggccccttccgtatgcaggttacagcgctggattataacagctacgtgggcatcattgggattggtcgtattgcccgtggtcgcattaagagcaatagcccggtggtgctcgttgacgccgacggcagccaacgtaatggccgcatgttgcaactgttcggctttttggggctggataaggtggaagtgcccgatgccaaagctggcgatattatcgccttcaccggcattgaaaagttgcgtatctccgagaccatctgccaccccgatgcggtggagcctctgcccctattgtcggtggacgagcccacggttagcatgacctttcaggtcaacgattcacccttggctggccgtgagggtaaatttgttaccagccgccaactgcgggaccgtttgatgcgcgagttggagaccaacgtagccctacgggtcgaagagttggatgatcccgataaatttcgggtctcgggccgtggtgaactgcacttgggaattctcattgagaacatgcgtcgcgaaggttacgagttaggggtctcccgtcctgaggtcatcgtcaaagagattgatggtgaaagacgcgaaccctatgaacagctgaccgtcgatattgacgaaaccagccagggcaaggtgatggaagcccttggtgagcgtaagggtgagttggtcaacatggtgcccgatggccgtggccgcgtgcgcttggactatatgatccccgcgcggggtttaatcggttttctgacggaattccgcaccatgacctctggtactggtttgatgtaccacgtgtttgaccattttggcccctatatcaaggagcctattgggcagcgcatcaacggtgtgttgattgccaaagacctaggggagaccgtagcctttgctctgttcaacttacaggagcgtggccgtctgttctcctcaccgggggataaatgctatgaaggcatgctgatcggcattcacagccgtggccaggatctggtggtgaaccccatgcgggctaagcaactgaccaacattcgcgccgctggttgtgacgaaaacatcaatctggtgccgcccattcgctttaacctggaagaggcgttggaattcattgatgacgacgagttggttgaagtaacgcccaaaagcatccgtctacgtaagcggtttttaaaagagcatgagcgtaagcgctcgtctaaaaaggctcaataa

SEQ ID NO: 3810 - protein, 611 aa, Magnetococcus sp. MC-1
MSQDVYPIEKLRNIAIIAHVDHGKTTLVDKLLQQSGTLKQRGEATERVMDSNDLEKERGITILAKNTAIYWNGYRINIVDTPGHADFGGEVERVLSMVDSVLLLVDAVEGPMPQTRFVTQKAFAQGLRPIVVVNKIDRDGARPDWVQDQTFDLFDKLDATDEQLDFPIIYTSALRGFATLDHTQVTTNMDALFETIIKHVSPPDVDQEGPFRMQVTALDYNSYVGIIGIGRIARGRIKSNSPVVLVDADGSQRNGRMLQLFGFLGLDKVEVPDAKAGDIIAFTGIEKLRISETICHPDAVEPLPLLSVDEPTVSMTFQVNDSPLAGREGKFVTSRQLRDRLMRELETNVALRVEELDDPDKFRVSGRGELHLGILIENMRREGYELGVSRPEVIVKEIDGERREPYEQLTVDIDETSQGKVMEALGERKGELVNMVPDGRGRVRLDYMIPARGLIGFLTEFRTMTSGTGLMYHVFDHFGPYIKEPIGQRINGVLIAKDLGETVAFALFNLQERGRLFSSPGDKCYEGMLIGIHSRGQDLVVNPMRAKQLTNIRAAGCDENINLVPPIRFNLEEALEFIDDDELVEVTPKSIRLRKRFLKEHERKRSSKKAQ

SEQ ID NO: 3811 - DNA, 1812 bp, Shewanella sp. ANA-3
  CDS (1)..(1812): transl_table=11
gtgctagagaatttacgtaacatcgccattattgcgcacgttgaccatggcaaaacgaccctggttgacaagctgctgtcgcaatcaggaacccttgcaacccggggagaagctactgagcgggtgatggactccaacgatcttgaaaaggaacgtgggatcacgattctggcaaagaatactgccatcaagtggaacgactaccgcattaacatcgtagacaccccaggccacgccgacttcggtggtgaggttgagcgcgtgctgtctatggtggactcagtattactgctggttgacgccgttgacggtccaatgccacagactcgcttcgtaaccaagaaagcgttcgcccaaggcttaaagccaatcgttgttatcaacaagattgaccgtcctggtgctcgccctgattgggttatcgaccaagtattcgacctgttcgacaacttaggtgcgactgacgagcaattagatttcccagtggtttacgcttctgcgttaaacggctttgcaaccttagatccggacgaagttggcaccgacatgacgccactgttccaaactatcgttgaaaaagtatcttcacctgcagctgacgctgaaggtccattccagatgcaaatttctcagctcgattacaactcatacgtgggggttatcggtgttggccgcatcaagcgtggtagcatcaagactaaccaacaagtgaccgtgatcggcgccgatggtaagactcgtaacggtaaaatgggccaagtattaggttacatgggcttagagcgtaccgaagttgacgtagcaaacgctggcgacatcgtagcgattactggtttaggtgagctgaagatttctgacactgtgtgtgccgcaggtaatgttgaagcgctgccacccctgtctgttgacgaaccaacactgaccatgactttccaagtcaacacttcacctttcgcaggtaaagaaggtaagtacgtgacttcacgtaacattcttgagcgtctgcaacaagaattagtgcacaacgtggcactgcgtgttgaagaaaccgacagcccagaccgtttcgcggtatctggccgtggtgaattacacttatctatcctgatcgaaaacatgcgtcgtgaaggttacgaattagcggtttctcgcccagaagttatcttaaaaaccatcgatggcgaactgtgtgagccatacgagacgctgaccgttgacgttgaagaagaacatcaaggtacagtcatcgagaagctgggtgtacgtaaggctgagatgaaagacatgcagcttgacggtaaaggccgcgtgcgcgttgactttatcatcccaagccgtggcttaatcggtttccaaactgagttcttaacggcaacttctggtactggtctgatttaccactcattcgatcactacggtccgcacaaaggtggcgacattggtcaacgtgcgaacggcgtattgatctctaacgcgaccggtaaggcgctaacattcgcactgttcggtctgcaggaccgcggtcgtctgtttatcggccacgctgccgaagtttacgaaggtcaagttgtgggtatccactcacgttctaacgacctgacagttaactgtctgaaaggtaagcagctgactaacatgcgtgcttctggtactgacgaagctcaagtactgactacgccaatcaccttaactcttgagcaagcacttgagtttatcgatgatgacgaattagttgaagtaacacctaagagcatccgtgttcgtaagaaacacttaactgaaaacgaccgtaagcgcgctagccgcggctaa

SEQ ID NO: 3812 - protein, 603 aa, Shewanella sp. ANA-3
MLENLRNIAIIAHVDHGKTTLVDKLLSQSGTLATRGEATERVMDSNDLEKERGITILAKNTAIKWNDYRINIVDTPGHADFGGEVERVLSMVDSVLLLVDAVDGPMPQTRFVTKKAFAQGLKPIVVINKIDRPGARPDWVIDQVFDLFDNLGATDEQLDFPVVYASALNGFATLDPDEVGTDMTPLFQTIVEKVSSPAADAEGPFQMQISQLDYNSYVGVIGVGRIKRGSIKTNQQVTVIGADGKTRNGKMGQVLGYMGLERTEVDVANAGDIVAITGLGELKISDTVCAAGNVEALPPLSVDEPTLTMTFQVNTSPFAGKEGKYVTSRNILERLQQELVHNVALRVEETDSPDRFAVSGRGELHLSILIENMRREGYELAVSRPEVILKTIDGELCEPYETLTVDVEEEHQGTVIEKLGVRKAEMKDMQLDGKGRVRVDFIIPSRGLIGFQTEFLTATSGTGLIYHSFDHYGPHKGGDIGQRANGVLISNATGKALTFALFGLQDRGRLFIGHAAEVYEGQVVGIHSRSNDLTVNCLKGKQLTNMRASGTDEAQVLTTPITLTLEQALEFIDDDELVEVTPKSIRVRKKHLTENDRKRASRG

SEQ ID NO: 3813 - DNA, 1890 bp, Mycobacterium avium 104
  CDS (1)..(1890): transl_table=11
gtgccatttcgcaacgtcgccatcgtcgcccacgtcgaccacggcaagaccaccctggtggacgcgatgctgcggcagtccggggcgctgcaccaccgcggcgacgacacccaggagcgcatcctggacagcggtgacctggagaaggaaaagggcatcaccatcctggccaagaacaccgccgtgcaccgccaccaccccgacggcagcgtcacggtcatcaacgtcatcgacacccccgggcacgccgacttcggcggcgaggtggagcgcgggctgtccatggtggacggggtgctgctgctggtcgacgcctcggaggggccgctgccgcagacccggttcgtgctgcgcaaggcgctggccgcgcacctgccggtgatcctggtggtcaacaagaccgaccggccggacgcccggatcgccgaggtggtggaggccagccacgacctgctgctcgacgtcgcctccgacctggacgacgaggccgccaaggccgccgagcacgcgctgggcctgccgacgctgtacgcctccggccgcgccggcgttgcgagcaccgagcaaccggccgacggcgaggtgcccgccggggagaacctcgacccgctgttcgacgtgctgctcgagcacatcccggcgccgtcgggcgacccggaggcgccgctgcaggcgctggtgaccaacctcgacgcgtcgaccttcctgggccggctcgccctgatccgcatctacaacggcaaactgtgcaagggccaacaggtggcctggatgcgcgaggtcgacgggctgccggtgatcaccagcgccaagatcaccgaactgctggccaccgagggcgtcgagcgcagccccaccgacgaggcgatcgccggcgacatcgtcgcggtggccgggctgcccgagatcatgatcggcgacaccctggccgaccccgaccacgcccacgcgctgccccggatcaccgtcgacgagccggcgatctcggtgaccatcggcaccaacacctcgccgctggccggcaaggtgcccggccacaaactgaccgcccggctggtccgcaaccggctggaccaggagctggtcggcaacgtgagcatccgggtcgtcgacatcggccggcccgacgcctgggaggtgcagggccgcggcgagctcgccctggccgtgctggtcgaacagatgcgccgggagggcttcgagctcaccgtcggcaagccgcaggtggtgacccgcaccatcgacggccagctgcacgagccgttcgaggcgatgacgatcgactgccccgaggagttcgtcggcgccatcacccagctgatggccgcccgcaagggccgcatggaggagatgaccaaccacgcggcgggctgggtccgcatggacttcatcgtgcccagccgcgggctgatcggcttccgcaccgacttcctcaccatcacccgcggcaccggcatcgccaacgccgtgttcgacggctaccggccgtgggcgggggagatccgggcccgccacaccgggtcgctggtctccgaccgcgccggcaccatcacgccgttcgccatgatccagctcgccgaccgcggccagttcttcgtcgaacccggccaggacacctacgagggcatggtcgtcggaatcaacccgcgcgcagaggatctcgacatcaacgtcacccgggagaagaagctgaccaacatgcggtcctcgaccgccgatgtcatcgagacgctggccaagccgctcgagctggacctggagcaggccatggaattctgcgcggccgacgaatgcgtcgaggtgactccggagatcgtgcgggtgcgcaaggtcgagctggacgccacctcgcgggcgcgcagccgggcccgcgccaaggcccggggctga

SEQ ID NO: 3814 - protein, 629 aa, Mycobacterium avium 104
MPFRNVAIVAHVDHGKTTLVDAMLRQSGALHHRGDDTQERILDSGDLEKEKGITILAKNTAVHRHHPDGSVTVINVIDTPGHADFGGEVERGLSMVDGVLLLVDASEGPLPQTRFVLRKALAAHLPVILVVNKTDRPDARIAEVVEASHDLLLDVASDLDDEAAKAAEHALGLPTLYASGRAGVASTEQPADGEVPAGENLDPLFDVLLEHIPAPSGDPEAPLQALVTNLDASTFLGRLALIRIYNGKLCKGQQVAWMREVDGLPVITSAKITELLATEGVERSPTDEAIAGDIVAVAGLPEIMIGDTLADPDHAHALPRITVDEPAISVTIGTNTSPLAGKVPGHKLTARLVRNRLDQELVGNVSIRVVDIGRPDAWEVQGRGELALAVLVEQMRREGFELTVGKPQVVTRTIDGQLHEPFEAMTIDCPEEFVGAITQLMAARKGRMEEMTNHAAGWVRMDFIVPSRGLIGFRTDFLTITRGTGIANAVFDGYRPWAGEIRARHTGSLVSDRAGTITPFAMIQLADRGQFFVEPGQDTYEGMVVGINPRAEDLDINVTREKKLTNMRSSTADVIETLAKPLELDLEQAMEFCAADECVEVTPEIVRVRKVELDATSRARSRARAKARG

SEQ ID NO: 3815 - DNA, 1902 bp, Mycobacterium smegmatis str. MC2 155
  CDS (1)..(1902): transl_table=11
gtgagttcgcacccagattttcgcaacgtcgccattgtggcccacgttgaccacggcaagaccactctggtcgacgcaatgctgcggcagtccggcgcgttgacccaccgaggtgacgactccaccgagcgcatcatggactccggtgacctggagcgggaaaagggcatcacgatcctggccaagaacaccgcggtgcaccggcacaacgccgacggcaccgtgacggtcatcaacgtgatcgacacccccggccacgccgacttcggcggtgaggtggaacgcggtctgtccatggtcgacggcgtgctgctgctcgtcgacgcctccgagggcccgctgccgcagacgcgcttcgtgctgcgcaaggcgctcgccgcgcacctgccggtgatcctcgtggtcaacaagaccgaccgccccgacgcccgcatcgccgaggtcgtgtcggacagccacgacctgctgctcgatgtcgcctcggatctcgacgaggacgcccaggccgcggccgagaaggcgctcgacctgccgacgctgtacgcgtcgggccgcgccggtgtggccagcacggtccagcccgccgacggcgaggtgcccgagggcgacaacctcgatccgctgttcgacgtcctgatgaagcacatcccgccgccatcgggtgatcccgaggcgccgctgcaggcgctcgtcaccaacctcgacgcgtcggcgttcctgggacgcctcgcactggtccgtatttacaacggcaagctcaagaaggggcagcaggtcgcgtggatgcgtgaggtcgacggcgcccccgtcgtcacgagcgccaagatcaccgaactgctcgtcaccgagggcgtggagcgcacggccacggccgaggccgtggcgggcgacatcgtcgccgtcgcgggcatccccgagatcatgatcggtgacacgctggccgatccggaccatgcgcacgcgctgccgcgcatcacggtcgacgaacccgcgatctcggtgaccatcggcaccaacacctcgcccctggccggcaaggtctccggccacaagctcaccgctcgaatggtcaagaaccgcttggattccgagctcatcggcaacgtgtccatccgcgtcgtcgacatcggcaagcccgacgcctgggaggtgcagggccgtggtgaactcgcgctggccgtgctcgtcgagcagatgcgacgtgaaggcttcgagctcaccgtcggcaagcctcaggtggtcaccaagaacatcgacggcaagctgcacgagccgttcgaggcgatgaccatcgactgccccgaggagttcgtcggcgccatcacccagctcatggccgcccgcaagggccgcatggaggagatgaccaaccacgccgccgggtgggtccggatggacttcatcgtgcccagccgcggtctgatcggcttccgcaccgacttcctgacgctgacgcgcggcaccggtatcgccaacgccgtgttcgacggctaccggccgtgggccggcgagatccgcgcgcgccacaccggttcactggtgagcgaccgtgcgggcaccatcacgccgttcgcgatgatccaactggccgaccgtgggcagttcttcgtcgagccgggccaggagacctacgagggaatggtcgtcgggatcaacccgcgcgcagaggatctcgacatcaacgtgacgcgcgagaagaagctcaccaacatgcggtcctcgacggccgacgtgatggagaccctcgcccgtccgctggaactcgacctcgagaaggccatggagttctgcgcagaggacgagtgcgtcgaggtcacccccgaggtggtccgggtgcgcaaggtggagctgaccgcgagcctgcgggcgcgtgccaaggcccgcgcgaaggcacggggctag

SEQ ID NO: 3816 - protein, 633 aa, Mycobacterium smegmatis str. MC2 155
MSSHPDFRNVAIVAHVDHGKTTLVDAMLRQSGALTHRGDDSTERIMDSGDLEREKGITILAKNTAVHRHNADGTVTVINVIDTPGHADFGGEVERGLSMVDGVLLLVDASEGPLPQTRFVLRKALAAHLPVILVVNKTDRPDARIAEVVSDSHDLLLDVASDLDEDAQAAAEKALDLPTLYASGRAGVASTVQPADGEVPEGDNLDPLFDVLMKHIPPPSGDPEAPLQALVTNLDASAFLGRLALVRIYNGKLKKGQQVAWMREVDGAPVVTSAKITELLVTEGVERTATAEAVAGDIVAVAGIPEIMIGDTLADPDHAHALPRITVDEPAISVTIGTNTSPLAGKVSGHKLTARMVKNRLDSELIGNVSIRVVDIGKPDAWEVQGRGELALAVLVEQMRREGFELTVGKPQVVTKNIDGKLHEPFEAMTIDCPEEFVGAITQLMAARKGRMEEMTNHAAGWVRMDFIVPSRGLIGFRTDFLTLTRGTGIANAVFDGYRPWAGEIRARHTGSLVSDRAGTITPFAMIQLADRGQFFVEPGQETYEGMVVGINPRAEDLDINVTREKKLTNMRSSTADVMETLARPLELDLEKAMEFCAEDECVEVTPEVVRVRKVELTASLRARAKARAKARG

SEQ ID NO: 3817 - DNA, 1896 bp, Nocardioides sp. JS614
  CDS (1)..(1896): transl_table=11
gtgcctactaccgcccgcaccgacctccgcaacgtggcgatcgtcgcccacgtcgaccacggcaagacgacgctcgtcgatgcgatgctgcgccagggcggcgcgttcaccgagcaccaggccgagggcgtcgccgagcgggtgatggactccggtgacctcgagcgcgagaagggcatcacgatcctcgcgaagaacaccgcgatccactacgcgggcgccgccgccgagggccggccgatgacgatcaacatcatcgacaccccgggccacgcggacttcggcggcgaggtcgagcgcggcctgtcgatggtggacgggatcgtgctgctcgtcgacgcgtccgagggcccgctgccgcagacccggttcgtgctgcgcaaggcgctcaacgccgacatgccggtcgtgctcgtggtcaacaaggtcgaccgcggcgacgcgcggatcgaggaggtcgtcgacgagacctacgagctgttcatggacctgctcgacgagcaccacagccaggacgccctggacttccccgtcgtctacgcgtccgcgaagtccggccgggcctcactggagatgccggagaacggcggccttccggactcccccgacctcgagccgctgttcaagacgatcctcgagacgatccccgcgccgacgtacaccgagggcgcgccgctgcaggcgcacgtcaccaacctggacgcctcgccgttcctcggccggctcgcgctggtgcgcgtccacgagggcaccctgcgcaagggccagcaggtggcctggatgaagcgcgacggctcgacgaagagcgtgaagatcaccgagctgctggtcaccgagggcctcgagcgcaagccgggcgagtccgcgggcccgggcgacatcgtcgcggtcgcggggatcccggagatcacgatcggtgagacgctggccgacgccgagaacccggtcgcgctgccgctgatccacgtcgacgagcccgcgatctcgatgacgatcggcaccaacacctcaccgctggtcggcaagggcggcaagggtcacaaggtcacggcccggctggtcaaggaccggctcgacgcggagctggtcggcaacgtgtcgctcaacgtgctgcccaccgagcgtcccgacgcgtgggaggtgcagggccgtggtgagctggcgctggcgatcctggtcgagcagatgcgccgcgagggctacgagctgaccgtcggcaagccgcaggtggtcaccaaggagatcgacggcaagctccacgagcccgtcgagcggctgaccatcgacgcgccggaggagtacctcggcacgatcaccgagatgctcgcgacccgcaagggccggatggagcagatgaccaaccacggcaccggctgggtgcggatggagttcctggtgccggcccgtgggctgatcgggttccggaccgagttcctcaccgcgacccgcggcaccggcatcgcccaccacatctccgagggctacgagccgtgggccggcgagatccgctcgcgcgcgtccggctcgctggtcgccgaccggtcgggcgcggcgacggcgtacgccatgacgtcgctgcaggagcgcggcgtgctgttcgtcgacccgaccaccgaggtctacgagggcatgatcgtcggcgagaactcgcgcgccgacgacatggacgtgaacatcaccaaggagaagcagcagacgaacatccgctcctccacgtccgacaacttcgagaagctggtgccgccgcgcaagctctcgctcgagcagtgcttggagttctgccgcgaggacgagtgcgtcgaggtcaccccggagacggtgcggatccgcaaggtcgtcctcgaccagaacgcccgggcgaagtcggcgagccgggcgcgcaaggcgagcagctag

SEQ ID NO: 3818 - protein, 631 aa, Nocardioides sp. JS614
MPTTARTDLRNVAIVAHVDHGKTTLVDAMLRQGGAFTEHQAEGVAERVMDSGDLEREKGITILAKNTAIHYAGAAAEGRPMTINIIDTPGHADFGGEVERGLSMVDGIVLLVDASEGPLPQTRFVLRKALNADMPVVLVVNKVDRGDARIEEVVDETYELFMDLLDEHHSQDALDFPVVYASAKSGRASLEMPENGGLPDSPDLEPLFKTILETIPAPTYTEGAPLQAHVTNLDASPFLGRLALVRVHEGTLRKGQQVAWMKRDGSTKSVKITELLVTEGLERKPGESAGPGDIVAVAGIPEITIGETLADAENPVALPLIHVDEPAISMTIGTNTSPLVGKGGKGHKVTARLVKDRLDAELVGNVSLNVLPTERPDAWEVQGRGELALAILVEQMRREGYELTVGKPQVVTKEIDGKLHEPVERLTIDAPEEYLGTITEMLATRKGRMEQMTNHGTGWVRMEFLVPARGLIGFRTEFLTATRGTGIAHHISEGYEPWAGEIRSRASGSLVADRSGAATAYAMTSLQERGVLFVDPTTEVYEGMIVGENSRADDMDVNITKEKQQTNIRSSTSDNFEKLVPPRKLSLEQCLEFCREDECVEVTPETVRIRKVVLDQNARAKSASRARKASS

SEQ ID NO: 3819 - DNA, 1818 bp, Azoarcus sp. BH72
  CDS (1)..(1818): transl_table=11
atgtcccgcgccattcgcaacatcgccatcatcgctcacgtcgaccatggcaagaccaccctggtggaccagctcctgcgccagtccggcaccttccgcgataaccagcaagttgccgagcgggtcatggactcgaacgatatcgagaaggaacgcggcatcaccatcctctcgaagaactgtgccatccagtacggtgaaacccacatcaacatcgtcgacaccccggggcacgccgacttcggcggcgaagtcgagcgcgtgctgtcgatggtcgacagcgtgctgctgctggtcgatgcggtcgaaggcccgatgccgcagacccgcttcgtcacccgcaaggcgctggcgctcggcctcaagcccatcgtcgtgatcaacaagatcgaccgcccgggcgcgcgtccggactgggtgatcaaccacaccttcgacctcttcgacaagctcggcgctaccgaagagcagctcgacttcccggtgatctacgcctccggcctcaacggcttcgcggtcgaaaacatcgatgacgagcgcaaggacatgcgtccgctgttcgaagcgatcctcaagcacgtgccgccgccggaagtcgacgccgatggcccgctgcagctgcaggtctgttcgctcgactactccacctacatgggccagctcggcatcggccgcatcaagcgcggccgcatcaagcccaaccaggaactggtggtgatgtatggcgacgagaaccgcggcaagggcaaggtcagccagatcctcaccttcaagggcctggagcgctcgcccgccgaatccgccgaggccggcgacatcgtgctcgtggcgggtatccagcaggtcaatatcggcgtgacgctgtgcgaccccgactgcctcgagggcctgaccccgatcgcggtggacgagccgaccctgaccatgaacttcatggtcaacagctcaccgctcgccggccgcgaaggcaagttcgtcaccagccgccagatccgcgagcgcctggaaaaggaactgctgaagaacgtggcgctgcgggtgaactacaccggcgactccgacgtgttcgaagtctccggccgtggcgaactgcacctcaccatcctgctggaaaacatgcgccgcgaaggctatgagctggcggtgggccgtccgcgcgtggtgtacaaggaaatcgacggcgtgaagtgcgagccgtacgaaatgctgacggtggacgtggaagaagaccaccagggcggcgtgatggaagaactcggccgccgccgcggcgagctgcaggacatgcagccggacggcaaggggcgcgtgcgtctggaataccgcatcccggcccgcggcctgatcggcttccagggcgaattcctcaccatgacgcgcggcaccggcctcgcctcccacgtgttcgacgactacagcccgatggccggctcgatggccgagcgccgcaacggcgtgctgatctcgcagaacgatggcgaagccgtggcctacgcgctgtggaacctgcaggaccgcggccgcatgttcgtgagcccgggtgaagcgctgtacgaaggcatgatcatcggcatccacacccgcgacaacgacctcgtcgtgaacccgatcaagggcaagcagctcaccaacgtccgcgcctcgggtaccgacgaagcggtgcgcctgatcccgccgatcgcgctgacgctggaatccgcgatcgagttcatcgccgacgacgagctggtcgagatcacgccgaagaacatccgcctgcgcaagcgtcacctgaaggaaaccgaccgcaagcgcgcggccaaggccgacgccgcgtaa

SEQ ID NO: 3820 - protein, 605 aa, Azoarcus sp. BH72
MSRAIRNIAIIAHVDHGKTTLVDQLLRQSGTFRDNQQVAERVMDSNDIEKERGITILSKNCAIQYGETHINIVDTPGHADFGGEVERVLSMVDSVLLLVDAVEGPMPQTRFVTRKALALGLKPIVVINKIDRPGARPDWVINHTFDLFDKLGATEEQLDFPVIYASGLNGFAVENIDDERKDMRPLFEAILKHVPPPEVDADGPLQLQVCSLDYSTYMGQLGIGRIKRGRIKPNQELVVMYGDENRGKGKVSQILTFKGLERSPAESAEAGDIVLVAGIQQVNIGVTLCDPDCLEGLTPIAVDEPTLTMNFMVNSSPLAGREGKFVTSRQIRERLEKELLKNVALRVNYTGDSDVFEVSGRGELHLTILLENMRREGYELAVGRPRVVYKEIDGVKCEPYEMLTVDVEEDHQGGVMEELGRRRGELQDMQPDGKGRVRLEYRIPARGLIGFQGEFLTMTRGTGLASHVFDDYSPMAGSMAERRNGVLISQNDGEAVAYALWNLQDRGRMFVSPGEALYEGMIIGIHTRDNDLVVNPIKGKQLTNVRASGTDEAVRLIPPIALTLESAIEFIADDELVEITPKNIRLRKRHLKETDRKRAAKADAA

SEQ ID NO: 3821 - DNA, 1902 bp, Mycobacterium sp. KMS
  CDS (1)..(1902): transl_table=11
gtggatttacccaatgacttccgcaatgtcgccatcgtcgcccacgtcgaccacggcaagacgacgctggtcgatgcgatgctgcggcagtccggtgcgctgagtcaccgcggcgacgatgccgtcgaacgcctgatggactccggggatctggagaaggaaaaaggcatcaccatcctcgccaagaacacggcggtgcaccgtcatcaccccgacggcacgatgaccgtcatcaacgtgatcgacaccccgggccacgccgacttcggcggcgaggtcgagcgcgggctgtccatggtcgacggcgtgctgctgctggtcgacgcctccgaggggccgttgccgcagacccgcttcgtgctgcgcaaggcactggccgcgcacctgcccgtcatcctcgtggtgaacaagaccgaccgccccgacgcccggatcgcggaggtggtctccgagagccacgatctgctgctcgacgtcgcctccgacctcgacgacgaggcgcagaaggccgccgaggaggcgctcggtctgccggtcctctacgcctccggccgcgcgggtatcgcgagcaccaccgaacccgcgaacggtgagaaccccgacggcgagaacctcgacccgctcttcgacgtcctgctcgagcacatcccgccgccgcagggcgatccggaggcgccgctgcaggcgttggtgaccaacctcgacgcgtcggccttcctcggccgtctcgcgctgatccgtatctacaaggggcgcatccgcaagggtcagcaggtggcctggatgcgtgaggtcgacggccacccggtcgtgaccaacgccaagatcaccgaactgctcgtcaccgtgggcgtcgagcgcaccgccaccgacgaagccgtcgccggggacatcgtggccgtcgccgggatccccgagatcatgatcggcgacacgctggccgatccggaccatgcgcacgcactgccgcgcatcaccgtcgacgagcccgccatctcggtcaccatcggcaccaacacctcaccgctggcaggcaaggtgtccggtcacaagctcaccgcacgaatggtgaagtcgcggttggactccgaactggtcggcaacgtgtcgctgaaggtcgtcgacatcggccggcccgacgcctgggaggtgcagggccgcggcgagctggcgctcgcggtgctcgtcgagcagatgcgccgcgagggcttcgagctcaccgtcggcaaaccgcaggtggtcacccgcacgatcgacggcaagctgcacgagccgttcgaggccctgacgatcgactgcccagaggagttcgtcggcgcgatcacccagctgatggccgcccgcaagggccgcatggaggagatgaccaaccacgccgcgggctgggtgcggatggacttcatcgtcccgagccgtggcctgatcggtttccgcaccgacttcctgacgttgacccgcggcaccggcatcgccaacgcggtgttcgacggctaccgcccgtgggcgggggagatccgcgcccgccacaccggctcgctggtgtcggaccgcagcggctcggtgacgccgttcgcgatgattcagctctccgaccgtggccagttcttcgtcgagccgggcgacgacacctacgagggacaggtcgtcgggatcaacccgcgtgccgaggacctcgacgtcaacgtcacccgcgagaagaagctgaccaacatgcgcagttccaccgccgacgtgatggagacgctggcccgtccgctcgagctcggcctcgaacaggccatggagttctgcgccgaggacgaatgcgtcgaggtcacccccgaggtggtgcgggtgcgcaaggtcgagctcgacgccaccctgcgggcccgcgcgcgctcgcgggcgaaggcgcggaactga

SEQ ID NO: 3822 - protein, 633 aa, Mycobacterium sp. KMS
MDLPNDFRNVAIVAHVDHGKTTLVDAMLRQSGALSHRGDDAVERLMDSGDLEKEKGITILAKNTAVHRHHPDGTMTVINVIDTPGHADFGGEVERGLSMVDGVLLLVDASEGPLPQTRFVLRKALAAHLPVILVVNKTDRPDARIAEVVSESHDLLLDVASDLDDEAQKAAEEALGLPVLYASGRAGIASTTEPANGENPDGENLDPLFDVLLEHIPPPQGDPEAPLQALVTNLDASAFLGRLALIRIYKGRIRKGQQVAWMREVDGHPVVTNAKITELLVTVGVERTATDEAVAGDIVAVAGIPEIMIGDTLADPDHAHALPRITVDEPAISVTIGTNTSPLAGKVSGHKLTARMVKSRLDSELVGNVSLKVVDIGRPDAWEVQGRGELALAVLVEQMRREGFELTVGKPQVVTRTIDGKLHEPFEALTIDCPEEFVGAITQLMAARKGRMEEMTNHAAGWVRMDFIVPSRGLIGFRTDFLTLTRGTGIANAVFDGYRPWAGEIRARHTGSLVSDRSGSVTPFAMIQLSDRGQFFVEPGDDTYEGQVVGINPRAEDLDVNVTREKKLTNMRSSTADVMETLARPLELGLEQAMEFCAEDECVEVTPEVVRVRKVELDATLRARARSRAKARN

SEQ ID NO: 3823 - DNA, 1812 bp, Neisseria meningitidis FAM18
  CDS (1)..(1812): transl_table=11
atgaaacaaatccgcaacatcgccatcatcgcccacgtcgaccacggcaaaaccacattggtcgaccaactgctgcgccaatccggcacattccgcgccaaccagcaggttgacgagcgcgtgatggacagcaacgacctcgaaaaagaacgcggcatcaccatcctcgccaaaaacaccgccatcgattacgaaggctaccacatcaatatcgtcgatacgccgggacacgccgacttcggcggcgaagtagagcgcgttttggggatggtggactgcgtcgtcttgttggtggacgcgcaggaaggcccgatgccgcaaacccgtttcgtgaccaaaaaagccttggctttggggctgaaaccgattgtcgtcatcaataaaatcgacaagccgtctgcacgtccgagctgggttatcgaccaaactttcgagctgttcgacaacttgggcgcgaccgacgagcagttggatttcccgattgtttacgcttcaggtttgagcggctttgccaagctggaagaaaccgacgagagcagcgatatgcgcccgctgttcgacaccatcttaaaacacacgcccgcaccgagcggcagcgcggacgagccgctgcaactgcaaatttcccaactcgactacgacaactacaccggccgcctcggcatcggtcgtatcttgaacggacgcatcaaacccggccaaaccgttgccgtcatgaaccacgagcagcaaatcgcccaaggccgcatcaaccagcttttgggtttcaaaggcttggaacgcgtaccgcttgaagaagccgaagccggcgacatcgtgattatttccggtatcgaagacatcggcatcggcgtaaccatcaccgacaaagacaaccccaaaggcctgccgatgttgagcgtggacgaaccgacgctgacgatggactttatggtcaacaccagcccgctggcgggtacggaaggcaaattcgtaaccagccgccaaatccgcgaccgcctgcaaaaagaattgctgaccaacgtcgccctgcgcgtggaagacaccgccgatgccgacgtgttccgcgtatccggacgcggcgagctgcacctgaccattttgttggaaaatatgcgccgcgaaggctacgaactcgccgtcggcaaaccgcgcgtcgtgtaccgcgacatcgacggtcaaaaatgcgaaccttatgaaaacctgaccgtggacgtacccgacgacaaccaaggcgcggtaatggaagaactcggccgccgccgtggcgaactgactaatatggaaagcgacggcaacggacgcacccgcctcgaataccatattccagcgcgcggcttgatcggtttccaaggcgaatttatgaccctgacgcgcggggtcgggctgatgagccacgtgttcgacgattacgcgcccgtcaaacccgatatgcccggccgccacaacggcgtgctggtgtcccaagagcagggcgaggcagtcgcttacgccttgtggaatctggaagaccgcggccgtatgttcgtatcgcccaacgacaaaatctacgaaggtatgattatcggcatccacagtcgcgacaacgatttggtggtcaacccgctcaaaggcaaaaaacttaccaacatccgtgccagcggtaccgacgaagccgttcgcctgaccacgccgattaagctgacgctggaaggtgcggtcgagtttatcgacgatgatgagctggtagaaatcacgccgcaatccatccgcctgcgcaagcgttacctgagcgaattggaacgccgccgccatttcaaaaagctagattga

SEQ ID NO: 3824 - protein, 603 aa, Neisseria meningitidis FAM18
MKQIRNIAIIAHVDHGKTTLVDQLLRQSGTFRANQQVDERVMDSNDLEKERGITILAKNTAIDYEGYHINIVDTPGHADFGGEVERVLGMVDCVVLLVDAQEGPMPQTRFVTKKALALGLKPIVVINKIDKPSARPSWVIDQTFELFDNLGATDEQLDFPIVYASGLSGFAKLEETDESSDMRPLFDTILKHTPAPSGSADEPLQLQISQLDYDNYTGRLGIGRILNGRIKPGQTVAVMNHEQQIAQGRINQLLGFKGLERVPLEEAEAGDIVIISGIEDIGIGVTITDKDNPKGLPMLSVDEPTLTMDFMVNTSPLAGTEGKFVTSRQIRDRLQKELLTNVALRVEDTADADVFRVSGRGELHLTILLENMRREGYELAVGKPRVVYRDIDGQKCEPYENLTVDVPDDNQGAVMEELGRRRGELTNMESDGNGRTRLEYHIPARGLIGFQGEFMTLTRGVGLMSHVFDDYAPVKPDMPGRHNGVLVSQEQGEAVAYALWNLEDRGRMFVSPNDKIYEGMIIGIHSRDNDLVVNPLKGKKLTNIRASGTDEAVRLTTPIKLTLEGAVEFIDDDELVEITPQSIRLRKRYLSELERRRHFKKLD

SEQ ID NO: 3825 - DNA, 1830 bp, Acidovorax sp. JS42
  CDS (1)..(1830): transl_table=11
atgagcaaacaaatccgcaacatcgccatcatcgcccacgtcgaccatggcaagaccacgatggtggaccaactgctgcgccagtccggcaccttcgccgagcacgagaaggtcgtggacaccgtgatggacagcaacgccatcgagcgcgagcgcggcatcaccatcctggcgaagaactgcgccgtgagctggaacggcacgcacatcaacatcctggacacgcccggccacgcggacttcggcggcgaggtggagcgtgcactgtcgatggtggacggcgtggtgctgctgatcgacgcgcaggaaggccccatgccccagacgcgcttcgtgaccaagaaggcgttggcgctgggcctcaagcccatcgtggtggtcaacaaggtggacaagcccggcgcgcgccccgactacgtggtgaacgccgctttcgatctgttcgacaagctgggcgccaccgacgagcaactggactttcccgtggtctacgcctcgggcatcaacggctggagctccctggagcagggcaaccccggcgagcaatggggccccgacatgtcggcgctgttcgagaccatcctcaagcatgtgccgtccgtgaagggtgacgccacggcacccctgcagatgcaggtatcggcgctggactattccaccttcgtgggccgcattggcgtgggtcgcatcacccagggtacgctcaaggccgggcaggacgtgctggtcatggctggccccgatggcgccagctacaagggccgcgtgaaccagatccaccagttccagggcctggaccgcgtgcaggtgagcgaagccggccccagcgagatcgtgctcatcaacggcatcgagaacgtgggtatcggcgagaccctcaccgaccccgccaacccccagccgctgcccatgctgaagatcgacgagcccacgctgacgatgaacttctgcgtgaacacctcgccgctggcgggccgtgaaggcaagttcgtgaccagccgccagatctgggaccgtctgcagaaggagctgcgttccaacgtggccctgcgcgtcaaggaaaccgacgaggacggcatcttcgaggtgtccggccgcggcgaactgcacctgaccatcctgctggaagaaatgcgccgtgaaggctacgagctggccgtttccaagccgcgcgtggtgtaccgcgacatcgacggcgagcgctgcgagcctatcgaactggtgactgctgatatcgaggaaggccaccaaggcggtgtgatgcaggccctcggcgagcgcaagggtgaactggtgaacatggagcctgacggccgtggccgcgtgcgcctggagtaccgcatcccggcccgtggcctgatcggtttcaccaacgaattcctgaacctgacgcgcggctcgggcctcatcagcaacattttcgacagctatgagccgcataagggcgacattggtggccgcaagaacggcgttctgatttccatggacgatggtgaaattttcacctacgccctgggcaagctcgacgaccgtggccgcatgttcgtgaaggcaggcgacccggtgtacgaaggcatgatcgtcggcgtgcacaaccgcgacaacgacctggtggtgaacgccacgcgtaccaagcagctcaccaacttccgcgtgagcggcaaggaagacgcgatcaagatcacgcccccgatcgacctcacgctggagtacggtgtggagttcatcgaggacgatgaactggtggagatcacgcccaagagcattcgcctgcgcaagcgccacctcaaggagcacgagcgcaagcgcgccagccgcgaaggcgcgtga

SEQ ID NO: 3826 - protein, 609 aa, Acidovorax sp. JS42
MSKQIRNIAIIAHVDHGKTTMVDQLLRQSGTFAEHEKVVDTVMDSNAIERERGITILAKNCAVSWNGTHINILDTPGHADFGGEVERALSMVDGVVLLIDAQEGPMPQTRFVTKKALALGLKPIVVVNKVDKPGARPDYVVNAAFDLFDKLGATDEQLDFPVVYASGINGWSSLEQGNPGEQWGPDMSALFETILKHVPSVKGDATAPLQMQVSALDYSTFVGRIGVGRITQGTLKAGQDVLVMAGPDGASYKGRVNQIHQFQGLDRVQVSEAGPSEIVLINGIENVGIGETLTDPANPQPLPMLKIDEPTLTMNFCVNTSPLAGREGKFVTSRQIWDRLQKELRSNVALRVKETDEDGIFEVSGRGELHLTILLEEMRREGYELAVSKPRVVYRDIDGERCEPIELVTADIEEGHQGGVMQALGERKGELVNMEPDGRGRVRLEYRIPARGLIGFTNEFLNLTRGSGLISNIFDSYEPHKGDIGGRKNGVLISMDDGEIFTYALGKLDDRGRMFVKAGDPVYEGMIVGVHNRDNDLVVNATRTKQLTNFRVSGKEDAIKITPPIDLTLEYGVEFIEDDELVEITPKSIRLRKRHLKEHERKRASREGA

SEQ ID NO: 3827 - DNA, 1821 bp, Magnetospirillum magnetotacticum MS-1
  CDS (1)..(1821): transl_table=11
atggaactgcgcaacatcgctattatcgcccacgtcgaccacggcaagaccactttggtggatgccatgctgcggcaatccggaaccttccgcgaaaatcagcaggtggctgaacgcgtgatggattccaacgatctggaaaaagaacgcggcatcaccattctggccaagtgcacctcggtcgagtggaagggcgtgcgcatcaatatcgtcgacacccccggccacgccgatttcggcggcgaggtggagcgcatcttgtccatggtggacggcgtcgtggttctggtggacgcggccgagggccccatgccccagaccaagttcgtcaccggcaaggcgctgggcctgggtctgcgccccatcgtggtggtcaacaaggtggatcgcggcgacgcgcggccccatgaagtgcacgacgaatgcttcgacctgttcgccgccctggatgccgatgacgatcagctggacttccccactctgttcgccgtgggccgtgacggctgggccgacgattcgttggagggtccgcgcaaggatctggccgcgctgttcgacctgatcgtcgcccatgtgccgccgcccaagcgcgacctggacgctccgttctccatgctggccaccacgctggaagccgatccctatctgggccgcgttctgacgggccgcatctattccggtaccgccaagctgaacatgcaggtcaagggcctgtcccatgacggcaaggtgctggaacagttccgcctgtccaagctgctggccttccgtggcatcgagcgcattccggtggaaagcgccgaggcgggcgacatcatcgccatcgctggcatgaccaagcccaccgtggccgacaccatctgcgtgcccgaggtcaccgagcccttgaaggccaatcccatcgatccgccgacgctggccatgaccttctcggtcaatgacagcccgctggcgggccaggaaggcgacaaggtcacgtcgcgcatgatcggtgcccgtctggcccgtgaagccgagtccaacgtcgccatccatatccgcgagaccgctggcaaggacgctttcgaggtgtcgggccgtggcgagcttcagttgggcgtgctcatcgagcagatgcgccgcgagggctttgaactctccatctcgcgtccccgcgttttgttccagaccgacgaacacggcaagcgcctcgagcccatcgaggaagtgttcatcgacgtggacgacgaatattccggcgtcgtggtcgagaagatgagcctcaggaaggctgaactcaccggcatgcgtccctcgggcggcggcaagacccgcgtcaccttcctggcgcccgcccgcggcctgatcggctatcacggcgaattcctcaccgatacgcgcggcaccggcctgatgaaccgtatgttccatggctatgccccctacaagggcgccatcgagggccgccgcaacggcgttctgatctccaatggtcagggcgatgcggtcacctatgccctgtggaacctggaagatcgcggctccatgttcatcaccggcaacgtcaagatctacgagggcatgatcatcggcgaacacaaccgccccaatgatctcgaggtcaatgccctcaaggccaagcagctcaccaatatccgcgccgctggcaaggacgaggcggtcaagctgaccccgccgcgcaagatgagcctggaacaggccatcgcctatatcgaggacgatgaactggtggaagtgacgcccaagtccatccgcttgcgcaagcgcctgctcgatcccaacgagcgcaagaaggccgaccgcgccgccaagaacgactaa

SEQ ID NO: 3828 - protein, 606 aa, Magnetospirillum magnetotacticum MS-1
MELRNIAIIAHVDHGKTTLVDAMLRQSGTFRENQQVAERVMDSNDLEKERGITILAKCTSVEWKGVRINIVDTPGHADFGGEVERILSMVDGVVVLVDAAEGPMPQTKFVTGKALGLGLRPIVVVNKVDRGDARPHEVHDECFDLFAALDADDDQLDFPTLFAVGRDGWADDSLEGPRKDLAALFDLIVAHVPPPKRDLDAPFSMLATTLEADPYLGRVLTGRIYSGTAKLNMQVKGLSHDGKVLEQFRLSKLLAFRGIERIPVESAEAGDIIAIAGMTKPTVADTICVPEVTEPLKANPIDPPTLAMTFSVNDSPLAGQEGDKVTSRMIGARLAREAESNVAIHIRETAGKDAFEVSGRGELQLGVLIEQMRREGFELSISRPRVLFQTDEHGKRLEPIEEVFIDVDDEYSGVVVEKMSLRKAELTGMRPSGGGKTRVTFLAPARGLIGYHGEFLTDTRGTGLMNRMFHGYAPYKGAIEGRRNGVLISNGQGDAVTYALWNLEDRGSMFITGNVKIYEGMIIGEHNRPNDLEVNALKAKQLTNIRAAGKDEAVKLTPPRKMSLEQAIAYIEDDELVEVTPKSIRLRKRLLDPNERKKADRAAKND

SEQ ID NO: 3829 - DNA, 1791 bp, Nostoc punctiforme PCC 73102
  CDS (1)..(1791): transl_table=11
atgacgctcccaattcgcaacgtcgccattatcgcccacgttgaccacggcaaaactacgctggttgacgcactcctcaaacaatccggcattttccgcgaaggcgaagacgttccggattgcgttatggactccaacgccctagaacgggaacggggtattactatcctgtccaaaaatacggcagttcgctacaaagaaacactaatcaatattgttgatactcctggacacgctgactttggtggcgaagttgaacgcgtactcggcatggttgacggatgtcttctgattgtcgatgccaatgaaggccccatgccccaaacacgctttgttctcaaaaaagctttagaaaaagggctgcgccccattgttattatcaacaaaatcgaccgtggtaaaactgaccctcacgttgctgtcgataaagttttggatctgttcttggaattaggggcagacgaagaccagtgtgattttacctatctgtttgcctccggtatggcaggtttcgccaaggaaagcttggaagcagaatcggtagatatgcaacccctgtttaacgcgattctgcaacacgttccaccaccagtaggcgacagcaataagcctctgcaattgcaagttacaaccctagattattctgaatatctgggacggattgtcattggcagaattcacaacggtactatccgctcaggacagcaagcggctttagttacagaagatggcaccattgtcaagggtaaaattaccaagttgatgggctttgatggactgaagcgcgtagagatggaagaagcaaccgcaggttatattgtcgcggtggctggtttcgcggatgcttatattggggaaacaattactgaccccaatgaaccgcaagctttaccactcattaaagtagatgaaccaaccttgcaaatggccttctgggtaaatgattcgccctttgctggtcaagaaggtaagttggtaacatcaagacaaatacgcgatcgcctattccgcgaactcgaaaccaacgttgctttgcgtgtcgaagaaaccgattctcccgataaattccttgtttccggtcggggagaactccacttgggtatcttaattgaaaccatgcgtcgggaaggcttcgaatttcaggtatctcagccacaggtaatttaccgcgaaatcaacggtcaaccttgcgaaccttacgaactcctggtgttagacattcctgctgatagtgtgggtagctgtattgaacgcctgggacaacgcaaaggcgaaatgcaagatatgcaaccaggtagtggcgatcgcacccagttagagtttgtcattcctgctcgtggattgattggtttccggggtgaattcatgcggatgacccgtggtgaaggcatcatgaaccacagtttcctagactaccgtcaactcagtggtgatattgaagcccgtaacaaaggcgttttaatctcctttgaagaaggcgtttctaccttctacgccatgagaaatgccgaagatagaggagcattctttattactcccggcacaaaggtttacagaggcatgatcgtgggagaacacactcgttctcaagatttggaactaaatatctgtaagaccaagcagttgaccaaccaccgggctgctggtggcgatgaattggtgcaactgcaagcaccgatagatatgagcctagagcgtgctttggaatacatcgccgccgatgaattggtggaagttacaccccaatcgattcgtttgcggaagatgtcgaagaagttggcgaaacggtaa

SEQ ID NO: 3830 - protein, 596 aa, Nostoc punctiforme PCC 73102
MTLPIRNVAIIAHVDHGKTTLVDALLKQSGIFREGEDVPDCVMDSNALERERGITILSKNTAVRYKETLINIVDTPGHADFGGEVERVLGMVDGCLLIVDANEGPMPQTRFVLKKALEKGLRPIVIINKIDRGKTDPHVAVDKVLDLFLELGADEDQCDFTYLFASGMAGFAKESLEAESVDMQPLFNAILQHVPPPVGDSNKPLQLQVTTLDYSEYLGRIVIGRIHNGTIRSGQQAALVTEDGTIVKGKITKLMGFDGLKRVEMEEATAGYIVAVAGFADAYIGETITDPNEPQALPLIKVDEPTLQMAFWVNDSPFAGQEGKLVTSRQIRDRLFRELETNVALRVEETDSPDKFLVSGRGELHLGILIETMRREGFEFQVSQPQVIYREINGQPCEPYELLVLDIPADSVGSCIERLGQRKGEMQDMQPGSGDRTQLEFVIPARGLIGFRGEFMRMTRGEGIMNHSFLDYRQLSGDIEARNKGVLISFEEGVSTFYAMRNAEDRGAFFITPGTKVYRGMIVGEHTRSQDLELNICKTKQLTNHRAAGGDELVQLQAPIDMSLERALEYIAADELVEVTPQSIRLRKMSKKLAKR

SEQ ID NO: 3831 - DNA, 1851 bp, Haemophilus somnus 2336
  CDS (1)..(1851): transl_table=11
atgacagataaaattgatattcaaaaattacgcaatattgcaattattgcacacgttgaccatggtaaaacaaccctcgttgacaagcttcttaaactttcaggcacattagacacttctcgtggtgatactgatgaacgtgtaatggattccaatgacttggaaaaagaacgtggaattactattcttgcgaaaaataccgcaattaattggaacggctatcgtattaatatcgtggatacaccaggacacgcagacttcggtggagaagtagagcgagtactttcaatggtagattccgtattgttggttgtcgatgcctttgacggtccaatgccacaaacccgcttcgtcacccaaaaagccttctcacatggtttaaaaccgattgttgtaatcaataaagtggatcgtcccggagcacgtcctgactgggtagtagatcaagtatttgatctctttgtaaatttgggtgccacagatgaacaacttgattttcctattatttatgcttctgcgttaaacggtgtagccggtcttgaacatgaaaaattggcttctaatatggatccgctctttgaagcaattattgaacatgtttcaccgccggatgttgagttggatgcaccgttccaaatgcaaatctcccaattagattacagcaaatatttaggtgtcattgggattggacgcattaaacgtggtacagtaaaaccaaatcaacctgttacattaattgatcctgaagggaaaacccgtaacggtcgtatcggtcaggttttaggacacttaggtttacagcgttacgaagctcaagaagcttatgcaggtgatattatagccattaccggtttaggtgagttaaatatttcagatactgtttgtgatattaacaatgtggaagcattgcctgcattaagcgttgatgaaccgacagtaactatgttcttttgtgtaaatacttcaccattctgtggaaaagaaggtaaatttgtcacttcccgccaaattttagagcgtttgaaaaaagagcttgtacataatgtggcattgcgtgtagaagaaacggatgattcggatattttcagtgtatccggccgtggggaattgcacttatccgtattaattgaaaatatgcgtcgtgaaggctatgagctggcggtttctcgtcctaaagtaatttttaaagaaattgatggtcgcaagcaagagcctttcgagcaagtgactattgatattgaagaacaacatcaaggttctgtcatggaagcactcggtattcgcaaaggtgaagtacgtgatatgataccggacggtaaaggtcgtactcgcttagaatacattattccaagtcgtggtctcattggtttccgtaatgaatttatgacaatgacttcagggacaggcttactttactcaagtttcagccattatgatgatgtaaaaccgggtgaaattggccagcgtattaacggcgtactgatttcaaacggtacaggtaaagccttggcttattcactttatgccctacaagatcgtggcaagctaatggttgatcatggtgcagaaatttatgaaggacaaataattggtattcatagtcgctctaatgatttaactgtcaacccgctggagggtaaaaaactcaccaatatgcgtgcttcaggtaaagatgatgctttgactttaaccacaccattgaaactcacacttgaacaagcattagagtttattgatgatgatgagttagttgaagtaacgccaatttctgtacgtattcgtaaaaaacttttaactgaggtagagcgtaaacgtgcaaaccgtacgacaacgagtaccagtacccgttaa

SEQ ID NO: 3832 - protein, 616 aa, Haemophilus somnus 2336
MTDKIDIQKLRNIAIIAHVDHGKTTLVDKLLKLSGTLDTSRGDTDERVMDSNDLEKERGITILAKNTAINWNGYRINIVDTPGHADFGGEVERVLSMVDSVLLVVDAFDGPMPQTRFVTQKAFSHGLKPIVVINKVDRPGARPDWVVDQVFDLFVNLGATDEQLDFPIIYASALNGVAGLEHEKLASNMDPLFEAIIEHVSPPDVELDAPFQMQISQLDYSKYLGVIGIGRIKRGTVKPNQPVTLIDPEGKTRNGRIGQVLGHLGLQRYEAQEAYAGDIIAITGLGELNISDTVCDINNVEALPALSVDEPTVTMFFCVNTSPFCGKEGKFVTSRQILERLKKELVHNVALRVEETDDSDIFSVSGRGELHLSVLIENMRREGYELAVSRPKVIFKEIDGRKQEPFEQVTIDIEEQHQGSVMEALGIRKGEVRDMIPDGKGRTRLEYIIPSRGLIGFRNEFMTMTSGTGLLYSSFSHYDDVKPGEIGQRINGVLISNGTGKALAYSLYALQDRGKLMVDHGAEIYEGQIIGIHSRSNDLTVNPLEGKKLTNMRASGKDDALTLTTPLKLTLEQALEFIDDDELVEVTPISVRIRKKLLTEVERKRANRTTTSTSTR

SEQ ID NO: 3833 - DNA, 1848 bp, Actinobacillus pleuropneumoniae serovar 1 str. 4074
  CDS (1)..(1848): transl_table=11
atgcaaaatttagatattaataaattgcgtaatatcgcaattatcgcgcacgttgaccacggtaaaacaacgcttgtagataaacttttacaacaatcaggcacattaggcgaaactcgtggtgacgcggacgagcgtgtcatggactcaaacgatcttgaaaaagaacgtggtattaccattcttgcaaaaaatacagcgattaactggaacgattatcgtatcaacatcgtagatacaccgggacatgcggacttcggcggtgaagtagaacgtgtgctttcaatggttgattctgtgttattagtggtagatgcgtttgacggcccaatgccgcaaacacgtttcgtaacgcaaaaagcatttgcacacggtttaaaaccgatcgtagttatcaataaagtggaccgtccgggcgcacgtcccgactgggttgtggatcaagtattcgatttattcgtaaacttaggtgcaactgacgagcaattagatttcccaattatttatgcatcggcattaatgggtgttgccggtttagaacacgaagatcttgcggaagatatgaccccgttattccaagcgatcgttgatcatgttgaaccgccgaaagtggaattaaacgcaccgttccaaatgcaaatttcgcaattagattacaacaactatgtaggtgtaatcggtatcggtcgtatcaaacgcggttcaatcaaaccgaaccaaacggtaacggtgatcgactccgaaggtaaaacccgtaacggtaaaatcggtcaggtgttaggtcacttaggtttacaacgttatgaagcaagcgaagcatttgccggcgacatcattgcaatcaccggtttaggcgaattaaatatctcggatacgatttgtgatattaacaacgtagaagcgttaccggcattaagtgttgatgaaccgaccgtaagtatgttcttctgcgtaaatacttctccgttctgcggtcaagaaggtaagtatgtgacttctcgtcaaatccttgagcgtttaaacaaagaattagtccacaacgtagcattacgtgtagaagagacaccaaacccggatgaattccgtgtatcaggccgtggtgagttacatttatcggtattaatcgaaaatatgcgccgtgaaggttacgaattagcggtatcgcgtccgaaagtaatctacaaagaagaaaacggtaaaaaacaagaaccgttcgagcaagttaccatcgatatcgaagagcaacaccaaggtgcggtaatggaagcattaggtatccgtaaaggtgaagtgaaagatatgattccggacggtaaaggtcgtacacgtttagaatacgtgatcccaagccgcggtttaatcggttttcgtaacgaatttatgacgatgacttctggtacaggtttactttactcaagcttcagtcattatgatgacgtaaaaccgggtgaaatcggtcagcgtaaaaacggcgtgttaatttctaacgcaaccggtaaagcgcttgcttatgcattattcggtttacaagaacgcggtaaattaatgatcgatcacggtgtggatgtttacgaaggtcaaattatcggtattcacagccgtggtaacgacttaaccgtaaactgcttacaaggtaaaaaattaaccaatatgcgtgcatcgggtaaagatgatgcaatcgtattaacaactccggttcgtttgagtttagaacaagcgttagagtttatcgatgatgacgagttagtagaagtaacgccgcaatcaattcgtgtacgtaaacgtttattaaccgaaaatgatcgtaaacgtgcaggtcgtacaaccacaagtaccagcacgaaataa

SEQ ID NO: 3834 - protein, 615 aa, Actinobacillus pleuropneumoniae serovar 1 str. 4074
MQNLDINKLRNIAIIAHVDHGKTTLVDKLLQQSGTLGETRGDADERVMDSNDLEKERGITILAKNTAINWNDYRINIVDTPGHADFGGEVERVLSMVDSVLLVVDAFDGPMPQTRFVTQKAFAHGLKPIVVINKVDRPGARPDWVVDQVFDLFVNLGATDEQLDFPIIYASALMGVAGLEHEDLAEDMTPLFQAIVDHVEPPKVELNAPFQMQISQLDYNNYVGVIGIGRIKRGSIKPNQTVTVIDSEGKTRNGKIGQVLGHLGLQRYEASEAFAGDIIAITGLGELNISDTICDINNVEALPALSVDEPTVSMFFCVNTSPFCGQEGKYVTSRQILERLNKELVHNVALRVEETPNPDEFRVSGRGELHLSVLIENMRREGYELAVSRPKVIYKEENGKKQEPFEQVTIDIEEQHQGAVMEALGIRKGEVKDMIPDGKGRTRLEYVIPSRGLIGFRNEFMTMTSGTGLLYSSFSHYDDVKPGEIGQRKNGVLISNATGKALAYALFGLQERGKLMIDHGVDVYEGQIIGIHSRGNDLTVNCLQGKKLTNMRASGKDDAIVLTTPVRLSLEQALEFIDDDELVEVTPQSIRVRKRLLTENDRKRAGRTTTSTSTK

SEQ ID NO: 3835 - DNA, 1830 bp, Rickettsia sibirica 246
  CDS (1)..(1830): transl_table=11
atgacatctattcgtaatatagcaattattgcccacgttgatcatggaaaaactacgcttgttgatcacatgcttaaacaaagcggaacatttagagctaaccaagcagttgctgagcgtgctatggactctaacgatcttgagcgtgagcgtggaatcacgatacttgccaaatgcactgctcttatgtggaacgatatccgtatcaatatagttgatacgccaggacacgccgattttggcggtgaagtagaacgcatccttagcatggttgacggtgtagtgctacttgtcgatgcatcggaaggaccaatgccgcaaacaaaattcgtgctttctaaagcgttaaatctcggcttaaaacctattgtcgttattaataaaatcgatagagatgaccaaagaattaaagaagttatcgatgaagtatttgagctatttgtggcacttgaagcaaacaacgatcagcttgacttccctatagtttatgcatcaggtagagcaggtagagcatctttaacctttgatgataaaattaatcctttagacaatttagcagatgatttagcaccgcttttcgaccttatagtacagcatgtaccaaaacccttagccgatgacaaagcaccgttttctatgcttgttactactagagaatataactctttcttcggtagggttttaacaggtcgtgtacaaagcggcactgtcaaaattaaccaaaacgtaaaagtattaaatcgtgagaataaagtacttgaaaccggacgtatcactaaaatattagcctttagaggcttagagcgaatcgctataaatgatgctacagccggcgatattattgccgtagcaggcgttgaaaacgccaacgttgccgatactatctgctcccctgaagtaaccgaggccgtaccgtctctacctatcgatccgccgactttatccatgacttttagcgtcaatgactcaccgcttgcaggaagcgaagggacaaaagttacgtcgagcttaattggagctaggttaatgcgtgagcttgaaagtaacgttgccttaaaagttactgaagctgccgagaaaaatgctttccaagttgcagggcgtggtgagttacaacttggtatcttaattgaaactatgcgtcgtgaaggatttgagctatctattagcagacccgaagtattattccaaactgatgagaaaggtaataagcaagaaccgatggaagaaatccaagttgacgttgatgatgattatgttggagtagtcgtaaaatctttagcactgagaaaagccgaaatgactgatatgaggccgtcaggcggcggtaaaagccgtgttacgtttatcggaccgtctagagggttaatcggctatcacagccagtttttaaccgaaacacgaggcacagggattatgaatcgtattttccatggatatgctgattataaaggaaatatcgagggaagacgtaacggtgtgcttatctctaacggtgacggggcagcagtcgcatatgctctatggaatctagaagaaaggggaaaaatgtttataaaccctagtgacaaagtatatagaggcatgattatcggcgaacataatcgtgataatgatttagaggtaaacccactaaaagcgaaacaactgagcaacgttagagcaacaggtaaagacgaagccataaggctaaccccgccaatgcttttaacgttagagcaggcaatcagctatatacaagatgatgagcgagttgaagtcacaccgaaatctattcgtttacgtaaagctctacttgaccctaacgaccgcaaaagagctgcaaagtag

SEQ ID NO: 3836 - protein, 609 aa, Rickettsia sibirica 246
MTSIRNIAIIAHVDHGKTTLVDHMLKQSGTFRANQAVAERAMDSNDLERERGITILAKCTALMWNDIRINIVDTPGHADFGGEVERILSMVDGVVLLVDASEGPMPQTKFVLSKALNLGLKPIVVINKIDRDDQRIKEVIDEVFELFVALEANNDQLDFPIVYASGRAGRASLTFDDKINPLDNLADDLAPLFDLIVQHVPKPLADDKAPFSMLVTTREYNSFFGRVLTGRVQSGTVKINQNVKVLNRENKVLETGRITKILAFRGLERIAINDATAGDIIAVAGVENANVADTICSPEVTEAVPSLPIDPPTLSMTFSVNDSPLAGSEGTKVTSSLIGARLMRELESNVALKVTEAAEKNAFQVAGRGELQLGILIETMRREGFELSISRPEVLFQTDEKGNKQEPMEEIQVDVDDDYVGVVVKSLALRKAEMTDMRPSGGGKSRVTFIGPSRGLIGYHSQFLTETRGTGIMNRIFHGYADYKGNIEGRRNGVLISNGDGAAVAYALWNLEERGKMFINPSDKVYRGMIIGEHNRDNDLEVNPLKAKQLSNVRATGKDEAIRLTPPMLLTLEQAISYIQDDERVEVTPKSIRLRKALLDPNDRKRAAK

SEQ ID NO: 3837 - DNA, 1818 bp, Fusobacterium nucleatum subsp. vincentii ATCC 49256
  CDS (1)..(1818): transl_table=11
atgaagattaaaaacatagcaattattgcccatgttgaccatggtaaaacaacacttgtagattgtctgttaagacaaggaggagtttttaaaactcatgaacttgaaaaagttgaagaaagagttatggactcagatgatattgaaagagaaagaggaattacaattttctctaaaaatgcttctgttagatataaagactataagattaacatagttgatacaccaggacatgctgattttggtggagaagtacaaagaattatgaaaatggttgattctgtacttttacttgtagatgcttttgaaggacctatgcctcaaacaaaatatgttttaaagaaagctttggaacaagggcatagaccaatagttgtagtaaacaaggttgataaacctaatgctagaccagaagatgtactatatatggtttatgatttatttatagagttgaatgctaatgaatatcaacttgaatttccagttatttatgcatcaggaaaatcaggttttgctagaaaagaattgactgatgaaaatatggatatgcaaccattatttgaaacaatattagaacatgtccaagaccctgatggagatgttacaaaaccaactcaatttttaataacaaatattgcttatgataactatgttggaaaattagcagttggaagaatacataatggaactttaaaaagaaatcaagatgtaatgttaataaaaagagatggaaaacaagtcagaggtaaagtttctgttctatatggctatgagggattaaaaagagttgaaattgaagaagcagaagcaggagatatagtttgtgttgctggtattgatgatatagatataggagaaacattagctgatataaatgagcctgttgctctacccttgattgatattgatgagcctactcttgctatgacatttatggtaaatgattctccatttgttggaaaagaaggaaaatttgtaacttcaagacatatttgggatagattacaaaaagaaattcaaactaatgttagtatgagagtagaggcaactgattcgcctgattcatttatagtaaaaggtagaggagaacttcaactttcaatattacttgaaaatatgagaagagaaagttttgaagtacaagtttctaaaccaagagttttatttaaagaaaaagatgggaaaaaattagagcctatcgaacttgctttaattgatgtagatgatagctatactggtgttgtaattgaaaaaatgggagttagaaaagcagaaatggtttctatggttcctgggcaagatggttatacaagacttgaatttaaagttcctgcaagggggcttattggttttagaaatgaatttttaactgatactaagggaactggaattttaaatcattcattctttgactatgaagaatataagggagatatccctacaagaaataaaggagttttaattgctactgagccaggagttactgttccttatgctttaaataacttacaagatagagggactttattcttagatccaggtgttcctgtgtatgaaggaatgatagttggagaacataacagagaaaatgatttagttgtaaatgtttgtaagactaaaaaattaacaaatatgagagctgctggttcagatgatgctgttaaactcgcaactccaagaaaatttacattggagcaagcacttgactatattgcggaagatgaacttgtagaagttacacctacaaatatcagacttagaaagaaaattttaaaagaaggagacagaagaaaaaactggtctgctactaataaatag

SEQ ID NO: 3838 - protein, 605 aa, Fusobacterium nucleatum subsp. vincentii ATCC 49256
MKIKNIAIIAHVDHGKTTLVDCLLRQGGVFKTHELEKVEERVMDSDDIERERGITIFSKNASVRYKDYKINIVDTPGHADFGGEVQRIMKMVDSVLLLVDAFEGPMPQTKYVLKKALEQGHRPIVVVNKVDKPNARPEDVLYMVYDLFIELNANEYQLEFPVIYASGKSGFARKELTDENMDMQPLFETILEHVQDPDGDVTKPTQFLITNIAYDNYVGKLAVGRIHNGTLKRNQDVMLIKRDGKQVRGKVSVLYGYEGLKRVEIEEAEAGDIVCVAGIDDIDIGETLADINEPVALPLIDIDEPTLAMTFMVNDSPFVGKEGKFVTSRHIWDRLQKEIQTNVSMRVEATDSPDSFIVKGRGELQLSILLENMRRESFEVQVSKPRVLFKEKDGKKLEPIELALIDVDDSYTGVVIEKMGVRKAEMVSMVPGQDGYTRLEFKVPARGLIGFRNEFLTDTKGTGILNHSFFDYEEYKGDIPTRNKGVLIATEPGVTVPYALNNLQDRGTLFLDPGVPVYEGMIVGEHNRENDLVVNVCKTKKLTNMRAAGSDDAVKLATPRKFTLEQALDYIAEDELVEVTPTNIRLRKKILKEGDRRKNWSATNK

SEQ ID NO: 3839 - DNA, 1830 bp, Rickettsia rickettsii
  CDS (1)..(1830): transl_table=11
atgacatctattcgtaatatagcaattattgcccacgttgatcatggaaaaactacgcttgttgataacatgcttaaacaaagcggaacatttagagctaaccaagcagttgctgagcgtgctatggactctaacgatcttgagcgtgagcgtggaatcacgatacttgccaaatgcactgctcttatgtggaacgatatccgtatcaatatagtggatacgccaggacacgccgattttggcggtgaagtagaacgcatccttagcatggttgacggtgtagtgctacttgtcgatgcatcggaaggaccaatgccgcaaacaaaattcgtgctttctaaagcgttaaatctcggcttaaaacctattgtcgttattaataaaatcgatagagatgaccaaagaattaaagaagttatcgatgaagtatttgagctatttgtggcacttgaagcaaacaacgatcagcttgacttccctatagtttatgcatcaggtagagcaggtagagcatctttaacatttgatgataaaattaatcctttagacaatttagcagatgatttaacaccgcttttcgaccttatagtacagcatgtaccaaaacccttagccaatgacaaagcaccgttttctatgcttgttactactagagaatataactctttcttcggtagggttttaacaggtcgtgtacaaagcggcactgttaaaattaaccaaaacgtaaaagtattaaatcgtgagaataaagtacttgaaaccggacgtatcactaaaatattagcctttagaggcttagagcgaatcgctataaatgatgctacagccggcgatattattgccgtagcaggcgttgaaaacgccaacgttgccgatactatctgctcccctgatgtaaccgaggccgtaccgtctctacctatcgatccgccgactttatccatgacttttagcgttaatgactcaccgcttgcaggaagcgaagggacaaaagttacgtcgagcttaattggagctaggttaatgcgtgagcttgaaagtaacgtggccttaaaagttactgaagctgcggagaaaaatgctttccaagttgcagggcgtggtgagttacaacttgggatcttaattgaaactatgcgtcgtgaaggatttgagctatctattagcagacccgaagtattattccaaactgatgagaaaggtaataagcaagaaccgatggaagaaatccaagttgacgttgatgatgattatgttggagtagtcgtaaaatctttagcactgagaaaagccgaaatgactgatatgaggccgtcaggcggcggtaaaagccgtgttacgtttatcggaccgtctagagggttaatcggctatcacagccagtttttaaccgaaacacgaggcacagggattatgaatcgtattttccatggatatgctgattataaaggaaatatcgagggaagacgtaacggtgtgcttatctctaacggtgacggggcagcagtcgcatatgctctatggaatctagaagaaagggggaaaatgtttataaaccctagtgacaaagtatatagaggcatgattatcggcgaacataatcgtgataatgatttagaggtaaacccactaaaagcgaaacaactgagcaacgttagagcaacaggtaaagacgaagccataaggctaactccgccaatgcttttaacgttagagcaggcaatcagctatatacaagatgacgagcgagttgaagtcacaccgaaatctattcgtttacgtaaagctctacttgaccctaacgaccgtaaaagagctgcaaagtag

SEQ ID NO: 3840 - protein, 609 aa, Rickettsia rickettsii
MTSIRNIAIIAHVDHGKTTLVDNMLKQSGTFRANQAVAERAMDSNDLERERGITILAKCTALMWNDIRINIVDTPGHADFGGEVERILSMVDGVVLLVDASEGPMPQTKFVLSKALNLGLKPIVVINKIDRDDQRIKEVIDEVFELFVALEANNDQLDFPIVYASGRAGRASLTFDDKINPLDNLADDLTPLFDLIVQHVPKPLANDKAPFSMLVTTREYNSFFGRVLTGRVQSGTVKINQNVKVLNRENKVLETGRITKILAFRGLERIAINDATAGDIIAVAGVENANVADTICSPDVTEAVPSLPIDPPTLSMTFSVNDSPLAGSEGTKVTSSLIGARLMRELESNVALKVTEAAEKNAFQVAGRGELQLGILIETMRREGFELSISRPEVLFQTDEKGNKQEPMEEIQVDVDDDYVGVVVKSLALRKAEMTDMRPSGGGKSRVTFIGPSRGLIGYHSQFLTETRGTGIMNRIFHGYADYKGNIEGRRNGVLISNGDGAAVAYALWNLEERGKMFINPSDKVYRGMIIGEHNRDNDLEVNPLKAKQLSNVRATGKDEAIRLTPPMLLTLEQAISYIQDDERVEVTPKSIRLRKALLDPNDRKRAAK

SEQ ID NO: 3841 - DNA, 1851 bp, Haemophilus influenzae R2866
  CDS (1)..(1851): transl_table=11
atgaaaaacgaaattgatattaaaaaactccgtaacatcgccattattgcgcacgtagaccatggtaaaaccacccttgtagataaacttcttcaacaatctggtacttttgaatctgcacgtggtgatattgatgagcgagttatggactcaaacgatcttgaaaaagaacgtggcattaccattcttgcaaaaaatactgcgattaactggaatgactaccgcattaacatcgtggatactccagggcacgcagacttcggtggagaagttgaacgtgtactttctatggtggattctgttctattagttgttgatgcgtttgatggcccaatgccacaaacgcgtttcgtgacacaaaaagcattcgctcacagcttaaaaccaatcgtcgtaattaataaagttgatcgccctggtgcacgtccagactgggttgtggatcaagtgtttgacttatttgtcaatcttggtgcaagcgatgaacaattagacttccctattatctatgcttcagcattaaatggtgttgctggtcttgaacacgaagatttagcggaagatatgaccccattatttgaagccattgtgaaacatgtagaaccgccaaaagtagaacttgatgcgccattccaaatgcaaatttcacaattagactacaacaactatgtaggcgttattggtattggtcgtattaagcgcggttcgattaaaccaaaccaaccagttactatcatcaatagtgaaggaaaaactcgtcaaggtcgtatcggtcaagtacttggacatcttggtttacaacgttatgaagaagacgttgcttatgctggcgatattgttgctatcactggtttaggagaattaaatatttctgatacgatttgtgatatcaacacagttgaagcactgccatcattaacggttgatgaaccaaccgtaaccatgttcttctgtgtaaacacctctccatttgcagggcaagaaggaaaatacgtcacatctcgtcaaattcttgaacgtttaaataaagaattggttcacaacgtggcattacgtgtagaagaaaccccaaacccagatgaattccgtgtatctggtcgtggcgaattacatctttccgtattaattgaaaatatgcgtcgtgaaggttatgaacttgccgtttctcgccctaaagtaatctatcgtgatattgacggtaaaaaacaagaaccatacgaacaagtaactatcgatgtggaagaacaacaccaaggttctgtaatggaagcattaggtatccgtaaaggtgaagttcgtgatatgttgcctgacggtaaaggccgtgttcgcttagaatacatcattcctagccgtggattaattggcttccgtggtgaatttatgactatgacttcaggtaccggtttactttactccagcttcagccactacgatgaaatcaaaggcggcgaaattggtcagcgcaaaaatggtgtgttgatttctaatgcaacaggtaaagcacttggctatgcattatttggcttacaagaacgtggtaagttaatgattgatgcaaacgtagaagtttatgaagggcaaattatcggtattcatagtcgctcaaacgacttaaccgtaaactgcttgcaaggtaaaaaactaactaatatgcgtgcgtcaggtaaagacgatgcgattgtgctaactacacctgtaaaattcagtcttgaacaagcgattgaatttatcgatgatgatgaactagtggaagtaacacctgagtcgattcgtatccgtaaaaaacttttaacggaaaacgatcgtaaacgtgcaaatcgtacaacgacaagtactagcacgcattaa

SEQ ID NO: 3842 - protein, 616 aa, Haemophilus influenzae R2866
MKNEIDIKKLRNIAIIAHVDHGKTTLVDKLLQQSGTFESARGDIDERVMDSNDLEKERGITILAKNTAINWNDYRINIVDTPGHADFGGEVERVLSMVDSVLLVVDAFDGPMPQTRFVTQKAFAHSLKPIVVINKVDRPGARPDWVVDQVFDLFVNLGASDEQLDFPIIYASALNGVAGLEHEDLAEDMTPLFEAIVKHVEPPKVELDAPFQMQISQLDYNNYVGVIGIGRIKRGSIKPNQPVTIINSEGKTRQGRIGQVLGHLGLQRYEEDVAYAGDIVAITGLGELNISDTICDINTVEALPSLTVDEPTVTMFFCVNTSPFAGQEGKYVTSRQILERLNKELVHNVALRVEETPNPDEFRVSGRGELHLSVLIENMRREGYELAVSRPKVIYRDIDGKKQEPYEQVTIDVEEQHQGSVMEALGIRKGEVRDMLPDGKGRVRLEYIIPSRGLIGFRGEFMTMTSGTGLLYSSFSHYDEIKGGEIGQRKNGVLISNATGKALGYALFGLQERGKLMIDANVEVYEGQIIGIHSRSNDLTVNCLQGKKLTNMRASGKDDAIVLTTPVKFSLEQAIEFIDDDELVEVTPESIRIRKKLLTENDRKRANRTTTSTSTH

SEQ ID NO: 3843 - DNA, 1830 bp, Rickettsia akari str. Hartford
  CDS (1)..(1830): transl_table=11
atgacacctattcgtaatatagcaattattgcccacgttgatcatgggaaaactacccttgttgataatatgcttaaacaaagcgggacatttagggctaaccaagcagtagccgagcgtgctatggactctaatgatcttgagcgtgagcgtggaataacaatactagccaaatgcactgctcttatgtggaacgatatccgtattaatatcgttgatacacctgggcatgctgattttggcggtgaagtagaacgcatattaagtatggttgacggtgtcgtgctacttgtcgacgcttctgaaggaccaatgccgcaaacaaaattcgtgctttctaaagctttaaagctcaacttaaaacctatcgttgttattaataaaatcgatagagacgaccaaagaattaaagaagttatcgaagaagtattcgagctatttgttgcactcgaggcaaataacgaccagcttgatttccctatagtctatgcatcaggtagagcaggcagagcatctttaaactttgatgataaaataaatcctttagataatttagcagatgatttagctccgcttttcgacctaatagtaacacatgtacctacgcctgcagccgatgataaagcaccgttttctatgcttattactactagagaatataattctttctttgggagagttctaacagggcgtgtacaaaacggcactgtcaaaatcaaccaaaacataaaagtattaaatcgtgagaataaagtacttgaaaccggacgtatcactaaaatattagcctttagaggcttagagagaatcgctatagatgaggctatagctggtgatattattgccgtagcaggggtggaaaacgccaatgttgccgatactatctgctcacctgaagtaaccgaagctgtaccatctctacctattgaccccccaactttatccatgacttttagcgttaatgactcaccgcttgcaggaagtgaagggacaaaagttacatcaagcttgattggagcgaggttaatgcgtgagattgagagtaacgtggcactaaaagttaccgaagcagctgaaaaaaatgctttccaagttgcgggacgaggagaattacagcttggtatcttaatcgaaactatgcgtcgcgaagggtttgagttatctataagtagacccgaagtattattccaaaccgatgggaaaggtaacaagcaagaacctatggaagaaatccaggttgacgttgatgacgattatgttggagtggtcgtaaaatctttagcacttagaaaagctgacatgactgatatgagaccatcaggcggcggtaaaagccgtgttacgtttatcggaccgtctagagggttaatcggttatcacagccaatttttaaccgaaacacgaggcacgggaattatgaaccgtattttccacggatacgctaattataaaggagctatcgcgggaagacgtaacggcgtgctaatctctaacggtgacggggcggcggtagcatatgctctatggaatctagaagaaagggggaaaatgtttataaaccctagcgataaagtatatagaggtatgattatcggagaacataaccgtgagaatgatttagaggtaaacccactaaaagcaagacaactaagcaacgttagagcttccggaaaagacgaagccataagactaacgccgccaatgcttttaactctagagcaggcaattagctatatacaagatgatgaaagggttgaagtaacaccaaaatctattcgtttacgtaaagctctacttgaccctaacgaccgtaaaagagctgcgaagtag

SEQ ID NO: 3844 - protein, 609 aa, Rickettsia akari str. Hartford
MTPIRNIAIIAHVDHGKTTLVDNMLKQSGTFRANQAVAERAMDSNDLERERGITILAKCTALMWNDIRINIVDTPGHADFGGEVERILSMVDGVVLLVDASEGPMPQTKFVLSKALKLNLKPIVVINKIDRDDQRIKEVIEEVFELFVALEANNDQLDFPIVYASGRAGRASLNFDDKINPLDNLADDLAPLFDLIVTHVPTPAADDKAPFSMLITTREYNSFFGRVLTGRVQNGTVKINQNIKVLNRENKVLETGRITKILAFRGLERIAIDEAIAGDIIAVAGVENANVADTICSPEVTEAVPSLPIDPPTLSMTFSVNDSPLAGSEGTKVTSSLIGARLMREIESNVALKVTEAAEKNAFQVAGRGELQLGILIETMRREGFELSISRPEVLFQTDGKGNKQEPMEEIQVDVDDDYVGVVVKSLALRKADMTDMRPSGGGKSRVTFIGPSRGLIGYHSQFLTETRGTGIMNRIFHGYANYKGAIAGRRNGVLISNGDGAAVAYALWNLEERGKMFINPSDKVYRGMIIGEHNRENDLEVNPLKARQLSNVRASGKDEAIRLTPPMLLTLEQAISYIQDDERVEVTPKSIRLRKALLDPNDRKRAAK

SEQ ID NO: 3845 - DNA, 1794 bp, Crocosphaera watsonii WH 8501
  CDS (1)..(1794): transl_table=11
atgtctcttcccattcgtaacgttgctattatcgcccacgtcgatcacggtaaaaccaccctggtggactcccttctcaaacagtctggtatctttcgtgaaggggaagagatccctgactgtgtgatggactccaataccctcgaacgagaacggggtattactatcctctccaaaaatacagcagttcgctacaatgacaccctaattaacatcgttgatacccctggacacgcggactttgggggagaagtagaacgagtgttagggatggtagatggttgcatcttgattgtagatgctaacgaaggtcccatgccacaaactcgttttgttctcaaaaaagctttagaaaaagggttacgtcccattgtagttgttaacaagatcgatcgccctcaagctgaaccggatcaagcagtggataaggtttttgacctcttcatagaactaggggccgatgacgatcagtgcgactttaccaccttatatgcgtcgggtttatcggggtttgcaaaagataacctagaggatgagtcagaagacatgaaacctctatttgaagcaattttacaccatgttcccccaccagcaggggacgtaagcaaacccctacaactacaagtaactaccttagattattccgaatatttaggccgtattatgattggtcgtatccataacggaactctcaaagcaggacaacaagcagctttgatgaaagaagatggtacaattgttcgaggtaaaattagtaaactgttagggtttgaaggactgcaacgggtagaattagaagagtctaacgcagggaatatcgttgctgtggccgggtttgctgatgctaacatcggggagactttaacttgtcccgatgaaccccaagcgttacctttaattaaggtagatgaaccaactttacagatgactttctcggtaaatgactctccttttgccggtcaagaaggtaagtttgtcacctcccgacaaatacgcgatcgcctcatgcgtgagttagaaaccaacgtagcgttaagggttgaaccaggagactctccggaccagttttccgtttccggtaggggtgaactccatttaggtattttaatcgaaaccatgcgtcgggaaggatacgagtttcaggtggcccaaccccaagttatttatcgtgaggttaatggccaaccctatgaaccctttgaatatttagtgttagacgttcccgaagaagcagtaggatcttgcatcgaacgtttaggccaacgaaaaggggaaatgcaggatatgcaaaccggggtcaatggacggactcagttagagtttgttgtcccggccaggggtttactgggtttccgtggtgactttatccgcattacacggggtgaagggatcatgaaccatagtttcttggaatatcgtcctttatctggtgagttggaaacccgttacaatggggtgattattgcctttgaggaagggacatctactttctacgctatgaaaaacgcagaagatcgcggtgtcttctttattattcccggaaccaaagtttataaagggatgattattggtgaaaataaccgtccccaagacttagaattaaatgtgtgtaagacgaaacagttaaccaaccatcgtgcagctagtggagaggaattagttcaactccaggccccccaggaaatgagtttagaaagggccttagaatatattggttccgatgagttagtagaagttacaccagagtctattcggttacggaagatgaagacgaaaaaattagccaaacgttaa

SEQ ID NO: 3846 - protein, 597 aa, Crocosphaera watsonii WH 8501
MSLPIRNVAIIAHVDHGKTTLVDSLLKQSGIFREGEEIPDCVMDSNTLERERGITILSKNTAVRYNDTLINIVDTPGHADFGGEVERVLGMVDGCILIVDANEGPMPQTRFVLKKALEKGLRPIVVVNKIDRPQAEPDQAVDKVFDLFIELGADDDQCDFTTLYASGLSGFAKDNLEDESEDMKPLFEAILHHVPPPAGDVSKPLQLQVTTLDYSEYLGRIMIGRIHNGTLKAGQQAALMKEDGTIVRGKISKLLGFEGLQRVELEESNAGNIVAVAGFADANIGETLTCPDEPQALPLIKVDEPTLQMTFSVNDSPFAGQEGKFVTSRQIRDRLMRELETNVALRVEPGDSPDQFSVSGRGELHLGILIETMRREGYEFQVAQPQVIYREVNGQPYEPFEYLVLDVPEEAVGSCIERLGQRKGEMQDMQTGVNGRTQLEFVVPARGLLGFRGDFIRITRGEGIMNHSFLEYRPLSGELETRYNGVIIAFEEGTSTFYAMKNAEDRGVFFIIPGTKVYKGMIIGENNRPQDLELNVCKTKQLTNHRAASGEELVQLQAPQEMSLERALEYIGSDELVEVTPESIRLRKMKTKKLAKR

SEQ ID NO: 3847 - DNA, 1848 bp, Exiguobacterium sibiricum 255-15
  CDS (1)..(1848): transl_table=11
atgacaacattagtaagaaacgatttacgcaacgtcgcgatcatcgcccacgttgaccatggtaaaacgacactcgtcgatgagcttttaaaacaatctggaacattccgtgcgaatgaactagtcgaagaacgcgcaatggactcaaatgatatcgagcgtgagcgcggaatcacgatccttgctaaaaataccgcaattgattacaaaaatacacgtatcaacatcgttgatacaccaggtcacgccgatttcggtggtgaagtagaacgtatcatgcgtatggttgacggcgttatcctcgttgtcgatgcacgtgaaggctgtatgccacaaacacgtttcgtattgaaaaaagcacttgaacaaggtcttcaaccaatcgtcgtcgtcaataaaattgacaaaccgatggtccgtccactcgaagttgttgacgaagtcgtcgacctcttgatcgatcttggagcagatgaagatcaactcgaattcccagtcgtttatgcatcggcagtcaacggctcaagttcatttgaccctgaacttgaaaatcaagaagatacaattacaaacgttcttgatttgattcttgaacacacaccggctcctgttgacaacagcatggacccgttacaattccaagttacaatgctcgactacgataactatcttggtcgtatcggagtaggacgcgttttccgtggagaaatcaaagttggagacagcgtttcgctttctaaacttgatggatcaatcaaaaacttccgtgttacaaaattattcggatactttggtctgaaacgtgttgaaattgaagctgcaaaagctggagatttgattgcaatcgcaggtatggaagatatcaacgtcggtgaaacggtttgcccgacttcacacgtcgatccactcccattacttcgtattgatgagccgactcttcaaatgacgttcatcgttaacaactcgccattcgctggtcgtgaaggtgacctcgtcacttcgcgtaaaatcgaagagcgtcttgaaaaagaacttgaaacagacgtttcgctccgtatcgaaaacacagattcgccggaccgctggatcgtatctggccgtggtgagcttcacctcgggattttgattgaaaacatgcgtcgtgaaggatacgaaattcaagtatctaaaccgcaggtaatcatcaaagttgaagacggcgttaaagttgagccgtttgagcgcgttgtcattgatacacctgaagagtacacaggtggtgtcatggaatcgatcggtctccgtaaaggtgaactgacgaacatgcagacaatggataacggacaaacaaaaatggaattcatcgttccttcacgtggattgatcggataccggaatgaattcttatctgcaacacgtggatacggaatcatgaaccacacgttcgaagaataccgtccgttcatcaatgcagacatcggtggacgccgcagtggagttatggtctcaatcgagacgggtaaagcgactgcttatgcaatctctgcactcgaagaccgcggaacaatcttcatcgagccaggtcttgaagtttacgaaggaatgatcatcggtgaatgtaaccgtgacgtcgacctcgctgttaacgttgttaaagcgaaacaattgacgaacatgcgtgcatctgcgaaagatacaacaaacgttcttaaacgtccacgtgtcttctcacttgaagaatcattaacattcctgaatgaagatgagtactgtgaaatcacaccgcaatcagttcgtcttcgtaaacaagtattaaacaaaaacgaacgtgaaaaacaagacaagcgccgtcgtcttggtaaagactga

SEQ ID NO: 3848 - protein, 615 aa, Exiguobacterium sibiricum 255-15
MTTLVRNDLRNVAIIAHVDHGKTTLVDELLKQSGTFRANELVEERAMDSNDIERERGITILAKNTAIDYKNTRINIVDTPGHADFGGEVERIMRMVDGVILVVDAREGCMPQTRFVLKKALEQGLQPIVVVNKIDKPMVRPLEVVDEVVDLLIDLGADEDQLEFPVVYASAVNGSSSFDPELENQEDTITNVLDLILEHTPAPVDNSMDPLQFQVTMLDYDNYLGRIGVGRVFRGEIKVGDSVSLSKLDGSIKNFRVTKLFGYFGLKRVEIEAAKAGDLIAIAGMEDINVGETVCPTSHVDPLPLLRIDEPTLQMTFIVNNSPFAGREGDLVTSRKIEERLEKELETDVSLRIENTDSPDRWIVSGRGELHLGILIENMRREGYEIQVSKPQVIIKVEDGVKVEPFERVVIDTPEEYTGGVMESIGLRKGELTNMQTMDNGQTKMEFIVPSRGLIGYRNEFLSATRGYGIMNHTFEEYRPFINADIGGRRSGVMVSIETGKATAYAISALEDRGTIFIEPGLEVYEGMIIGECNRDVDLAVNVVKAKQLTNMRASAKDTTNVLKRPRVFSLEESLTFLNEDEYCEITPQSVRLRKQVLNKNEREKQDKRRRLGKD

SEQ ID NO: 3849 - DNA, 1827 bp, Prosthecochloris aestuarii DSM 271
  CDS (1)..(1827): transl_table=11
atgagtacgaaacagaatattcgaaatattgcgatcattgcccacgttgatcatggtaagacgacacttgttgatgcaatttttaatcatacgggtgttttcagggataaccagcaggttgatgcccgtgtgcttgattcaaacccccaggagagggagagaggaatcacgatcttttcaaaaaatgcggcagctttttacaaagggcataaaattaatattgtcgatactcccggccacgccgattttggcggtgaggtagagcgtatcctcaagatggttgacggcgtcctgcttcttgtcgatgcgttcgaaggaccgatgcctcagactaaatttgttttgcgcaaggcgcttgaactcaatctgaagcctgttgtcgttatcaacaagatcgaccgtccgcaggccgatcctgtgaaggttcacgaccaggtgcttgatctgtttatcgctcttggtgctgatgaagaccagcttgaatttccctatatgttcacctctgccaagatgggtatcgcaaaagcaagcatggaagatgaagatcatgatatgagccttctgcttgacatgattatcgaagagatgccttcaccggaaagcagcgatgaagatggcttccagatgctcgttaccacgttggactatagcgattatcttggtaaaattgccattggacgagttcagagaggacgcgtcagaacaggcgatgcgcttgttgtcgttaccgatgagggcgttgtggcaaaaggaacggcagccaaggtgttcacctttgatcagaccaggcgcgtcgaggtcaaggaggctggagcaggcgatattattgccatttccggtattgcaggggccaatgtcggtcagacactggctgcggctgataaacccgatgcattgacgtcattcgagatcagcaaaccgaccctgtcgatgcttttttcggtcaacgactcgccctttgccggcctggaaggcaaggaggttaccagtcgcaagatcagggatcgactgatgaaggaagtgatgaccaatgtcgctctcgacatcgaggaaaccgacagtgcagataccttcagggtgtcaggccgcggtgaactgcacctttcggtcctgatcgagagtatgcgtcgcgaaggattcgagctatccatctcgagaccccaggttattacccgtacggcagaggatggaacagtactcgaaccggtcgaacatgtgaccattgatgttcccgatgagtacaacggcgttgtcatcgagaaaatgggccgccgtaaagctgaaatgaaacatatggaaaccctcaaaggcggtatggtccgtctcgagttcgagattcctacccgtggtcttatcggctacagtcaggagtttacaaccgataccaagggagaaggtattctttctcacgtttttcatgactatcagcctttcaaaggcaaacttcctgcgcgtgaaaccggtgcccttgtttcaggtgataatggtcagtctgttgcgtatgcgctttccgcacttgaagacagaggcaccttctttatcgggccgaacgtcaaggtttatgaaggtatggttgtcggagaatcgacaagggagttcgatatttctctgaacgtgtgcaaaaccaaaaagctcaccaatatgcgttcttcgggtgctgacgactccgtgcgtctgaccccgccgaaggtgctgacgcttgagcaggcacttgaatttatcaatgatgatgaactcgttgaggtaactcctcagagtatcaggctcaggaagagaattcttgattcaaaccttcgtgcgaaagccgccaagaaagccaaaggatga

SEQ ID NO: 3850 - protein, 608 aa, Prosthecochloris aestuarii DSM 271
MSTKQNIRNIAIIAHVDHGKTTLVDAIFNHTGVFRDNQQVDARVLDSNPQERERGITIFSKNAAAFYKGHKINIVDTPGHADFGGEVERILKMVDGVLLLVDAFEGPMPQTKFVLRKALELNLKPVVVINKIDRPQADPVKVHDQVLDLFIALGADEDQLEFPYMFTSAKMGIAKASMEDEDHDMSLLLDMIIEEMPSPESSDEDGFQMLVTTLDYSDYLGKIAIGRVQRGRVRTGDALVVVTDEGVVAKGTAAKVFTFDQTRRVEVKEAGAGDIIAISGIAGANVGQTLAAADKPDALTSFEISKPTLSMLFSVNDSPFAGLEGKEVTSRKIRDRLMKEVMTNVALDIEETDSADTFRVSGRGELHLSVLIESMRREGFELSISRPQVITRTAEDGTVLEPVEHVTIDVPDEYNGVVIEKMGRRKAEMKHMETLKGGMVRLEFEIPTRGLIGYSQEFTTDTKGEGILSHVFHDYQPFKGKLPARETGALVSGDNGQSVAYALSALEDRGTFFIGPNVKVYEGMVVGESTREFDISLNVCKTKKLTNMRSSGADDSVRLTPPKVLTLEQALEFINDDELVEVTPQSIRLRKRILDSNLRAKAAKKAKG

SEQ ID NO: 3851 - DNA, 1830 bp, Xylella fastidiosa Ann-1
  CDS (1)..(1830): transl_table=11
atgtccatagaaaatctccgtaatatcgccatcgttgctcacgttgaccatggtaagaccactcttgttgatcagttgcttaagcaatctgggactttcagcgaacgtgcccaggtgggtgagcgcgtgatggacagcaatgaccaggaaaaggaacgcggtatcacaattcttgctaaaaatacggcaatcaaatggaatggtaaccgcatcaacattgttgatactcctgggcatgctgattttggaggggaggttgaacgcgtattgtcgatggttgattcagtcctactgttggtggatgcaatggatgggccaatgccgcagacgcgcttcgtgactcagaaggcttttgcaatggggtttaagccgattgtggtggtcaacaagattgatcgtcctggtgctcgtccggattgggttgttgagcaggtttgggacttattcgactgtctcggtgctacgccagagcagatggactttccgattgtctatgcctcggcactaaatggctatgccagcttggagtcaagtgcgcgggcgggggatatgaatccgctgtacgaagcgatcatgcagcacgttcaaccgccgcaagttgacctgcatggcccatttcagatgcgtatcagtcaattggactacaacagttacgttggtctcattggtattggtcggattcaacgtggcaaggtgtctactaacatgccggtgacggtcattgatcgcataggtaataaacataatggtaaagttctccaggtactaggtttccttggtctggagcgtcatgaagttgaggaagcccaggcaggcgatatcgttgctatttcaggtattgagtcactcagtatttccgatacccttactgacccaacggccccagatgcgctgccagcattgagcgtcgatgaaccgacaatcagtatgacctttcaagtcaataattcgccatttgctgggcagaaggaatattcgggtgggaagttcctgacaagccgtcagatccgtgaacgcttggctcgcgaaactttacataatgttgccttgcgtgttgaggatactgaggatcctgacagatttaaggtttccggccgaggtgagctgcacttgtctgtcttgattgagactatgcggcgtgagggctatgaattgggtgtatcgcgcccggaagtcatcatcaaggaaatcgatggaatactccaagagccttacgagcagttagtcgtggacgtggaggaggagcatcaaggtggtgtgatagagcgcttgggcacgcgtaaagctcagttgtcaaatatggagttggatggtaaagggcgtgtacgtttggattacattatccctgcgcgtggtttgattggtttccagactgagtttaaaaccatcacttctgggagcggccttctgttccacatctttgatcactatggtccgaaagctgatggtccgattgccaagcgtatcaacggtgtcatgatctctaatggtcatggcaaagcacctgggtatgctttgatgggcttgcaagaacgtgggcgtttgctgattgatgctggtgaggatatttacgaaggcatgttagttggcatccattccaaggataatgacttgaccgtcaatgcacttcgagagaaacaattgacaaatattcgtgcttctgggaaggacgacgcgatctcattgaccccgcccattaagatgtccttggagcaggcgttagagtttatcgaagatgacgagttggttgaggtcacgccgaaggcaatccggttacggaaaaaataccttagtgaaaatgatcgcaagcgtgccagtcgtactggctga

SEQ ID NO: 3852 - protein, 609 aa, Xylella fastidiosa Ann-1
MSIENLRNIAIVAHVDHGKTTLVDQLLKQSGTFSERAQVGERVMDSNDQEKERGITILAKNTAIKWNGNRINIVDTPGHADFGGEVERVLSMVDSVLLLVDAMDGPMPQTRFVTQKAFAMGFKPIVVVNKIDRPGARPDWVVEQVWDLFDCLGATPEQMDFPIVYASALNGYASLESSARAGDMNPLYEAIMQHVQPPQVDLHGPFQMRISQLDYNSYVGLIGIGRIQRGKVSTNMPVTVIDRIGNKHNGKVLQVLGFLGLERHEVEEAQAGDIVAISGIESLSISDTLTDPTAPDALPALSVDEPTISMTFQVNNSPFAGQKEYSGGKFLTSRQIRERLARETLHNVALRVEDTEDPDRFKVSGRGELHLSVLIETMRREGYELGVSRPEVIIKEIDGILQEPYEQLVVDVEEEHQGGVIERLGTRKAQLSNMELDGKGRVRLDYIIPARGLIGFQTEFKTITSGSGLLFHIFDHYGPKADGPIAKRINGVMISNGHGKAPGYALMGLQERGRLLIDAGEDIYEGMLVGIHSKDNDLTVNALREKQLTNIRASGKDDAISLTPPIKMSLEQALEFIEDDELVEVTPKAIRLRKKYLSENDRKRASRTG

SEQ ID NO: 3853 - DNA, 1848 bp, Streptococcus suis 89/1591
  CDS (1)..(1848): transl_table=11
atgacaaaacttagagaagacatccgtaacgttgccattattgcccacgttgaccacggaaaaacaaccctcgttgatgaattattgaaacaatcccaaacacttgatgaacgtacgcaattggatgagcgtgccatggactcaaacgacatcgaaaaagagcgtggaatcactatcctggctaaaaacactgccgtagcttacaacggtactcgtatcaacatcatggacacaccgggacacgcggacttcggtggtgaggttgagcgtatcatgaaaatggttgacggtgttgtgcttgtcgtagatgcctacgaagggactatgccacagactcgtttcgtattgaaaaaagcacttgaacaaaacttgacaccaatcgtggttgtcaacaagattgataagccttctgctcgtccagaggaagtagtggatgaagtgcttgaactcttcatcgaactcggtgcagacgatgaccaattggaattcccagtagtttatgcatcagctatcaacggtacttcttcattgtctgacaatccagcggaccaagaagaaacaatggcaccaattttcgataccatcatcgagcatatccctgcaccagtcgataactcagatgagcctttgcagttccaagtatcccttttggactacaacgacttcgtaggtcgtatcggtatcggtcgtgtcttccgtggtactgttaaagttggtgaccaggttaccctttctaaactagatggtacaacgaaaaacttccgcgttacaaaactctttggtttcttcggtcttgagcgtaaagaaatccaagaagcaaaagctggtgatttgattgccgtttctggtatggaagacatcttcgttggtgaaactgtaacaccaactgatgcggttgagccacttccagttcttcgtatcgatgagccaactcttcaaatgactttcttggtgaacaactcaccgtttgcaggtcgtgaaggtaaatgggtgacatcacgtaaaatcgaagagcgccttttggccgagttgcaaacagacgtttctctccgtgttgaccctactgactctccagataaatggactgtttcaggtcgtggtgaattgcacttgtctatcttgattgaaaccatgcgtcgtgagggctatgagcttcaagtatcacgtccagaagttatcatcaaggaaatcgacggcgtgaagatggagccatttgagcgcgtgcaaatcgatacaccagaagaataccaaggttctgttatccaatccctctctgagcgtaagggtgatatgttggatatggttgcgacaggaaatggtcaaactcgtcttgtattccttgttcctgcgcgtggtttgattggttattcaacagaattcctttcaatgactcgtggttacggtatcatgaaccatactttcgaccaatacttgcctgttgttcaaggtgagatcggtggtcgtcaccgtggtgcccttgtctctatcgaccaaggtaaggcaacgacatactctatcatgcgtattgaagagcgtggtaccatctttgtcaacccaggtactgaagtgtacgaaggaatgattatcggtgaaaactcgcgtgaaaatgacttgacagttaacatcacaactgcaaaacaaatgaccaacgttcgttcagcaaccaaagaccaaacgtctgtaattaagacaccacgtatcttaactcttgaagaatcactagaattcttgaacgatgatgaatacatggaagtaacgccagaatctatccgtcttcgtaagcaaatcttgaacaaggcagagcgtgataaggctgcgaagaagaaaaaattagcgactgaggaataa

SEQ ID NO: 3854 - protein, 615 aa, Streptococcus suis 89/1591
MTKLREDIRNVAIIAHVDHGKTTLVDELLKQSQTLDERTQLDERAMDSNDIEKERGITILAKNTAVAYNGTRINIMDTPGHADFGGEVERIMKMVDGVVLVVDAYEGTMPQTRFVLKKALEQNLTPIVVVNKIDKPSARPEEVVDEVLELFIELGADDDQLEFPVVYASAINGTSSLSDNPADQEETMAPIFDTIIEHIPAPVDNSDEPLQFQVSLLDYNDFVGRIGIGRVFRGTVKVGDQVTLSKLDGTTKNFRVTKLFGFFGLERKEIQEAKAGDLIAVSGMEDIFVGETVTPTDAVEPLPVLRIDEPTLQMTFLVNNSPFAGREGKWVTSRKIEERLLAELQTDVSLRVDPTDSPDKWTVSGRGELHLSILIETMRREGYELQVSRPEVIIKEIDGVKMEPFERVQIDTPEEYQGSVIQSLSERKGDMLDMVATGNGQTRLVFLVPARGLIGYSTEFLSMTRGYGIMNHTFDQYLPVVQGEIGGRHRGALVSIDQGKATTYSIMRIEERGTIFVNPGTEVYEGMIIGENSRENDLTVNITTAKQMTNVRSATKDQTSVIKTPRILTLEESLEFLNDDEYMEVTPESIRLRKQILNKAERDKAAKKKKLATEE

SEQ ID NO: 3855 - DNA, 1797 bp, Croceibacter atlanticus HTCC2559
  CDS (1)..(1797): transl_table=11
atggaaatcaaaaatatagcaattattgctcacgttgaccacggtaaaacaaccttggttgataaaattatgtatcactgtcagttattcagagaaaatgaaaacactggtgatcttatattggacaacaacgatcttgaacgcgaacgtggtattacaattacatctaaaaacgtttctgtaaactacaaagacattaagattaatattattgatacacctggtcacgccgattttggtggagaagtagagcgtgtacttaacatggcagatggcgttttattgttagtagatgcttttgaaggcccaatgcctcaaactcgttttgtactacaaaaagctatagacttaggccttaagccttgtgtagttataaataaggtagataaagaaaactgtactccagacttggtgcacgaaaaagtattcgacttaatgtttgagcttggtgcagaagagtggcaattagacttcccaactgtttacggttctgccaaacaaggttggatgagtgatgattaccaaaaaccaacagagaatatcgagccattattagaaatggtttatgatcatattcccgcgccaaaaattgaagaaggaacaacacagatgttaattacatctttagatttctcttcttacacaggtcgtatagcaataggtcgtttacaaagaggacatcttaaagaaaatatgcaaatctctcttgtaaaaagagatggtagcatacaaaaagctagaattaaagaactacatacttttgaaggccttggccgtaaaaaagtagaagaagtaaaagctggagatatctgcgcaatcgtaggattagaaagctttgatattggagatactgtagcagattttgaaaatccagaagggttaaaaactattgctatagatgagccaacaatgagtatgttatttacaattaacgattcgcctttctttggtaaagacggaaagtttgtaacatctcgccacgtaaaagaccgtttaactaaagaacttgagaaaaacttagcactacgtgttgaagaaacagacagtgcagacaagtttatggtatttggtcgtggtgtacttcacttatctgtattaattgaaacaatgcgtcgtgaaggttatgaattacaaattgggcagccacaagtaatcattaaggaaattgatggtgttaaatgtgagccttttgaagaattaactattgatcttccagaagaagtttctggtagagcagtggagtttgtatcgcttcgtaaaggagagatgacaagtatggaagctaaaggcgaccgtatggtttgtgagtttattattccttctagaggtattataggattacgtaaccaattacttactgcaacagctggtgaggcaattatggcacaccgttttaaggaatatgcaccacttaaaggtgatattccacaacgtcaaaacggttctttagtatctatggaaaatggttctgctattccttattctatcgataagttacaggatagaggtcgtttctttgtagatccaggtgaggatatttacgaaggtcaagtaattggcgaaaactctcgtggtgatgatatggttgttaacgtaactaagactaagaaactgtctaacgtacgttcttctggagcagatgataaagcgaagattacaccagcaattaagttttctttagaagaggctttagaatatattcagaaagatgagtatgttgaagtaacgccaaaccacttaagattacgtaaaatctacttaaaagaagttgatagaaaacgttacaagattgtataa

SEQ ID NO: 3856 - protein, 598 aa, Croceibacter atlanticus HTCC2559
MEIKNIAIIAHVDHGKTTLVDKIMYHCQLFRENENTGDLILDNNDLERERGITITSKNVSVNYKDIKINIIDTPGHADFGGEVERVLNMADGVLLLVDAFEGPMPQTRFVLQKAIDLGLKPCVVINKVDKENCTPDLVHEKVFDLMFELGAEEWQLDFPTVYGSAKQGWMSDDYQKPTENIEPLLEMVYDHIPAPKIEEGTTQMLITSLDFSSYTGRIAIGRLQRGHLKENMQISLVKRDGSIQKARIKELHTFEGLGRKKVEEVKAGDICAIVGLESFDIGDTVADFENPEGLKTIAIDEPTMSMLFTINDSPFFGKDGKFVTSRHVKDRLTKELEKNLALRVEETDSADKFMVFGRGVLHLSVLIETMRREGYELQIGQPQVIIKEIDGVKCEPFEELTIDLPEEVSGRAVEFVSLRKGEMTSMEAKGDRMVCEFIIPSRGIIGLRNQLLTATAGEAIMAHRFKEYAPLKGDIPQRQNGSLVSMENGSAIPYSIDKLQDRGRFFVDPGEDIYEGQVIGENSRGDDMVVNVTKTKKLSNVRSSGADDKAKITPAIKFSLEEALEYIQKDEYVEVTPNHLRLRKIYLKEVDRKRYKIV

SEQ ID NO: 3857 - DNA, 1818 bp, Sulfitobacter sp. EE-36
  CDS (1)..(1818): transl_table=11
atggacatgcgtaacatcgcaatcatcgctcacgttgaccacggcaaaacgacgctggttgacgagcttctgaaacaatccggcacctaccgcgaaaaccaggccacaaccgaacgcgcgatggacagcaacgatctggagcgcgagcgcggcatcacgatctttgccaagccgacctctgtcgtctggaacaacacacgcatcaacatcgtcgacacgcccggccacgccgactttggcggcgaggtggaacgcatcctgtcgatggtcgacggtgttgtcctgctggtcgacgcggctgaaggcccgatgccacaaaccaaattcgtgacctccaaggcgctgaaactgggccttcgcccgatcgttgtgctgaacaaggtcgacaaggccgacgcggagcctgaccgcgcactggacgaatgtttcgaccttttcgccagccttgacgcgacagacgaacagcttgaattcccgcatatgtacgcttccggccgctccggctgggccgatgcagagctggacggcccgcgcaaagacctcagcgcgctgttcgagcttgtgctcaagcatgtgcctgcgcccaagcagatcgaaaacgccgacaagcccttcaccatgctggcaaccacattgggcggtgacccctttctgggccgtctgctgaccggtcgcgtggaaacaggcacgctgaaagccggccaaagcatcaaggcgatgtcgcgcgacggcaaattgattgaaaacttccgctgcaccaagatcctcgccttccgcgggctagagcagacagccatcgacgtggccgaagcaggtgacatcgtttccattgccggtatgtccaaggcaaccgtggccgacacgctggccgatacatcagtgaacgaagccatccctgcccagccgatcgatccgcccaccatcaccgtgactttcggcatcaacgacagcccgctggccggtcgtgacggcaagaaagtccagtcccgcgtgatccgcgagcgcctgatgaaggaagccgaatccaacgtcgcgatcaaaatctccgacacccccggcggcgacgccttcgaggttgccggtcgtggcgaattgcaaatgggcgttctgatcgagaacatgcgccgcgaagggttcgagctttcgatctcgcgcccgcaggttctgttccaggagatcgacggtgtgcgtcacgagcccatcgaagaagccaccatcgacgtggatgacgaatactccggcgcggtcatcgaaaagatcactggcacccgtaagggcgagttggttgaaatgaaacctgccggcgccggcaaaacccgcatcatcgcccatgtcccgtcgcgcgggctgatcggctaccacggtgaattcctgaccgacacacgcggcacaggcgtcattaaccgcgtgttccattcctgggcaccgcacaaaggcacgattcccggccgtcgcgcgggcgtcctgatctcgatggagaacggcacctcggtggccttcgccctgtggaaccttgaagaacgcggcaagatgatgatcggcgcacaggctgacgtctataccggcatgatcatcggcgaacacagccgtgagaacgatcttgaggtgaacccgctgaagggcaaaaagctgaccaacgtccgcgcctcgggcaccgacgaggccgtacgtctgaccacgcccatgacactgagcctggaagaagccatcgcctatatcgatgatgacgaactggttgaagtgacgccaaacgcgatccgtctgcgcaagcgctatctggacccgcacgagcggaaacggatggcaaagtcggcgtaa

SEQ ID NO: 3858 - protein, 605 aa, Sulfitobacter sp. EE-36
MDMRNIAIIAHVDHGKTTLVDELLKQSGTYRENQATTERAMDSNDLERERGITIFAKPTSVVWNNTRINIVDTPGHADFGGEVERILSMVDGVVLLVDAAEGPMPQTKFVTSKALKLGLRPIVVLNKVDKADAEPDRALDECFDLFASLDATDEQLEFPHMYASGRSGWADAELDGPRKDLSALFELVLKHVPAPKQIENADKPFTMLATTLGGDPFLGRLLTGRVETGTLKAGQSIKAMSRDGKLIENFRCTKILAFRGLEQTAIDVAEAGDIVSIAGMSKATVADTLADTSVNEAIPAQPIDPPTITVTFGINDSPLAGRDGKKVQSRVIRERLMKEAESNVAIKISDTPGGDAFEVAGRGELQMGVLIENMRREGFELSISRPQVLFQEIDGVRHEPIEEATIDVDDEYSGAVIEKITGTRKGELVEMKPAGAGKTRIIAHVPSRGLIGYHGEFLTDTRGTGVINRVFHSWAPHKGTIPGRRAGVLISMENGTSVAFALWNLEERGKMMIGAQADVYTGMIIGEHSRENDLEVNPLKGKKLTNVRASGTDEAVRLTTPMTLSLEEAIAYIDDDELVEVTPNAIRLRKRYLDPHERKRMAKSA

SEQ ID NO: 3859 - DNA, 1818 bp, Roseovarius nubinhibens ISM
  CDS (1)..(1818): transl_table=11
atggacctgcgcaatattgcgatcatcgcccacgtcgaccatggcaagaccacccttgtcgacgagctgctgaaacaatccggtgccttccgtgccaaccaggccgtcgacgaacgcgccatggacagcaacgacctcgaacgcgaacgtggcatcaccatctttgccaaacccacctcggtggaatggaagggcaagcgcgtcaacatcgtcgacacccccggccacgccgatttcggcggtgaagtcgaacggatcctgagcatggtcgacggcgttgttctgctggtcgatgccgccgaaggcccgatgccgcagacgaaattcgtgacctccaaggcgctcgccctcgggctgcgccccatcgtggtcctcaacaaggtcgacaagcccgacgccgagccggatcgtgcgctggacgaatgtttcgatctcttcgcaagcctcggcgccgatgatgatcagctcgacttcccgcatatgtatgcctcgggccgcaacggctgggccgatcacgagctcgacggcccacgcaaggacctgaccgcgctgtttgatctcatcgtcaaccacgtccccgccccgcgccaggtggcgcgtgccggcgaagatttccgcatgctggcgaccacgctcggctctgacactttcgtcggccgtcagctcaccggccgcgtcgaaagcggccgcctcaaggtcggcgccaccgtgcaggcgctgagccgcgtcggccagaaaatcgaacagttccgcgtgaccaagatccaagccttccgcggtctgcaaacccaggacatcgaagaggccgtcgcaggcgatatcgtgaccatcgcgggcatggccaaggccaccgtggccgacacgatctgcgcgctggcggtcgacgagccgctcgaagcacagcccatcgatccgcccaccatcaccgtgaccttcggcatcaacgacagcccgctggccggtcgtgacggcaaaaaggtccaaagccgggtgatccgcgaacgcctccacaaagaggccgagagcaacgtcgcgatcaagatcgccgacacccccggcggcgaggccttcgaagtgtctggccgtggcgaattgcagatgggcgttctcatcgaaaacatgcgccgcgaagggttcgaactgtcgatctcgcgcccgcaggtgatcatgaaggacgtcgacggcaagcggatggaaccggtcgaagaggccaccatcgacgtcgatgacgaatattccggcgcggtgatcgaaaagctcacaggcgcgcgcaagggcgagctggtcgagatgaaaccggcgggcgcgggcaagacgcggatcatcgcacatgtgccgtcgcgcgggctcatcggctatcatggcgaattcctcaccgacacgcgtggcaccggggttctcaaccgcgtgttccacggctggaccgagcacaaaggttcgatccccggccgtcgtgcaggcgtgctgatctcgatggaaaacggcgaggcggtggcctatgcgctgtggaacctcgaagatcgcggcaagatgttcatcggcgcgcaggccaaggtctacaccggcatgatcatcggcgagcacagccgtgagaacgatctcgaagtgaacccgctcaagggcaagaagctcaccaacgtgcgggcctcgggcaccgacgaagcggtgcgcctgaccacgccgatcacgctcagcctcgaagaggccatcgcctatatcaatgatgacgagctggtcgaagtgacgcccaatgcgatccgtctgcgcaagcgctatctcgacccccacgagcgcaagcggatggccaaaacggcctaa

SEQ ID NO: 3860 - protein, 605 aa, Roseovarius nubinhibens ISM
MDLRNIAIIAHVDHGKTTLVDELLKQSGAFRANQAVDERAMDSNDLERERGITIFAKPTSVEWKGKRVNIVDTPGHADFGGEVERILSMVDGVVLLVDAAEGPMPQTKFVTSKALALGLRPIVVLNKVDKPDAEPDRALDECFDLFASLGADDDQLDFPHMYASGRNGWADHELDGPRKDLTALFDLIVNHVPAPRQVARAGEDFRMLATTLGSDTFVGRQLTGRVESGRLKVGATVQALSRVGQKIEQFRVTKIQAFRGLQTQDIEEAVAGDIVTIAGMAKATVADTICALAVDEPLEAQPIDPPTITVTFGINDSPLAGRDGKKVQSRVIRERLHKEAESNVAIKIADTPGGEAFEVSGRGELQMGVLIENMRREGFELSISRPQVIMKDVDGKRMEPVEEATIDVDDEYSGAVIEKLTGARKGELVEMKPAGAGKTRIIAHVPSRGLIGYHGEFLTDTRGTGVLNRVFHGWTEHKGSIPGRRAGVLISMENGEAVAYALWNLEDRGKMFIGAQAKVYTGMIIGEHSRENDLEVNPLKGKKLTNVRASGTDEAVRLTTPITLSLEEAIAYINDDELVEVTPNAIRLRKRYLDPHERKRMAKTA

SEQ ID NO: 3861 - DNA, 1818 bp, Oceanicola batsensis HTCC2597
  CDS (1)..(1818): transl_table=11
atggatctgcgaaacatcgccatcatcgcccacgtcgaccacggcaagacaacgctcgtggacgaactgctcaagcaatcgggcgtgttccgcgagaaccaggccgtggccgaacgggcgatggattcgaacgatctcgagcgcgagcgcgggatcaccatcctcgccaaggccaccagcgtcgagtggaagggcacgcggatcaacatcgtcgacacccccggccacgcggatttcggcggcgaggtcgagcgcatcctgtcgatggtggacggcgtggtgctgctggtcgacgccgccgaggggccgatgccgcagacgaagttcgtgacctcgaaggcgctggcgctcggcctgcgtccgatcgtggtgctgaacaaggtggacaagcccgacgccgaaccggaccgcgcgctggacgagtgcttcgatctcttcgcctcgctcgatgccgacgaggaccagctggatttcccgcatctctacgcctcgggccggtccggctgggcggatgccgaacttgacgggccgcgcaagaacctggacgcgctcttcaacctggtcgtcaaccacgtgcccgcgcctcggcagatcaagcggcaggacgaggatttccggatgctggccacgacgctcggctcggacccgttcgtgggccggatgctgaccgggcgggtcgagagcggcaagctgaaggtcggggcgacggtgcaggcgatcagccgcatcgggcagaagatcgaacagttccgcgtcaccaagatccaggcgttccgcgggctctcgcttcaggatatcgacgaagcccaggccggcgacatcgtctcgctcgccgggatgggcaaggcgaccgtggccgacacgatctgcgccctggcggtggacgagccgctggatgcgcagccgatcgacccgccgacgatcaccgtcaccttcgggatcaacgacagccccctggcaggccgcgacggcaagaaggtacagagccgcgtgatccgcgaccgcctgatgaaggaggccgaatccaacgtcgccatcaaggtcgcagacacgccgggcggcgaggctttcgaggtctcgggccggggcgagcttcagatgggcgtgctgatcgagaacatgcgccgcgaggggttcgaactctcgatctcgcgcccgcaggtgatcatgcgcgaactggacggtcagcgggtcgagccgatcgaagaggtcaccatcgacgtcgacgacgaatattccggcgccgtgatcgagaaggtgaccggcgcgcgcaagggcgagttggtcgagatgcgccaggccggggcaggtaagacgcggatcatcgcgcatgtcccctcgcgcgggctgatcggctatcacggcgaattcctcaccgatacgcgcggaacgggcgttctgaaccgcgtattccacagctgggcccccttcaagggcgcgatcccgggccgccgtgccggcgttctgatctcgatggaggccggcgaggcggtggcctatgcgctgtggaacctcgaagagcgcggccggatgttcctcggcccgcaggccaaggtctatcaggggatgatcatcggcgagcattcgcgcgacaatgatctcgaggtgaacccgctcaagggcaagaagctgacgaacgtccgcgcctcgggctcggatgacgcggtccggctgacacctcatgtccagttttcgctggaagaggccatcgcctacatcaacgacgacgagcttgtcgaggtgacgccgaacgccatccggctgcgcaagcggtacctcgacccgcatgaacgcaagcgcatggccaaggcgggctga

SEQ ID NO: 3862 - protein, 605 aa, Oceanicola batsensis HTCC2597
MDLRNIAIIAHVDHGKTTLVDELLKQSGVFRENQAVAERAMDSNDLERERGITILAKATSVEWKGTRINIVDTPGHADFGGEVERILSMVDGVVLLVDAAEGPMPQTKFVTSKALALGLRPIVVLNKVDKPDAEPDRALDECFDLFASLDADEDQLDFPHLYASGRSGWADAELDGPRKNLDALFNLVVNHVPAPRQIKRQDEDFRMLATTLGSDPFVGRMLTGRVESGKLKVGATVQAISRIGQKIEQFRVTKIQAFRGLSLQDIDEAQAGDIVSLAGMGKATVADTICALAVDEPLDAQPIDPPTITVTFGINDSPLAGRDGKKVQSRVIRDRLMKEAESNVAIKVADTPGGEAFEVSGRGELQMGVLIENMRREGFELSISRPQVIMRELDGQRVEPIEEVTIDVDDEYSGAVIEKVTGARKGELVEMRQAGAGKTRIIAHVPSRGLIGYHGEFLTDTRGTGVLNRVFHSWAPFKGAIPGRRAGVLISMEAGEAVAYALWNLEERGRMFLGPQAKVYQGMIIGEHSRDNDLEVNPLKGKKLTNVRASGSDDAVRLTPHVQFSLEEAIAYINDDELVEVTPNAIRLRKRYLDPHERKRMAKAG

SEQ ID NO: 3863 - DNA, 1800 bp, Prochlorococcus marinus str. MIT 9211
  CDS (1)..(1800): transl_table=11
atgaattcaaaaagtcaatcgattcgcaatattgcaattattgcccacgtagatcatggtaagacaactcttgtcgacgcactcctatctcaatcggggatttttcgcgacaacgaggctgtaccgacctgtgtaatggattcaaatgatttagaacgtgaacggggaataaccatactttccaaaaatactgcaattacatttaaggacacccgaataaatattgtcgacacaccaggtcatgctgattttggaggagaagttgaaagggttcttggaatggtagatggttgcttattgattgttgacgccaatgaaggacctatgccgcaaacgcgatttgttctcaaaaaagcactcgaaaaaggattgagaccaattgtgtttgttaataagattgatcgcccaagagttgatcctgagatagctgttgataaagttttagaccttttcattgaattaggggctgatgatgaccagtgtgatttcccttatctctttggaagtggtttgggaggatttgcaaagccggatatgcaaactaaaagtgacaatatgattcctctgtttgattcaataattagacatgtccccccccctgtgggagataaagacaaaccacttcagcttcaaataactactcttgactattcagattttttaggacgaattattattggaagagttcataatggctatataagaagtggtcaaaaagcaagcttaattaaggaggatggatctataaaacatggcagaatatctaaattacttggatttgagggcttacaacgaattgagaaagaagaggctattgcaggagatattgttgcaattgcaggatttccagatgtaaatattggggaaacgatagcttgccctgacgagcccaaagccctccctttaatcaaggttgatgagcctacattgcagatgactttcgttgttaatgattctccattcgcagggaaagaaggtaagtttgtaacaagtagacaattaagagaaagactttacaaagaactacttacaaatgttgcactcagagttgaggatacagataccccagatagctttgcagtatgtggtagaggtgagttgcatttaggtattttaatagaaacaatgaggagagaaggttacgagtttcaggtctctcagccacaggttattttcagagatattgatgaattaacttgtgaaccttttgagactcttgtgttagatgtaccagaggaatctgttggtatttgcatagaaaggctgggcgaacgaaaaggggagatgcaaaatatgttcaatagtaatgatggaagaactcagttggagtttgtagttccttctagaggcttaattggtttcagaggagaatttataagagcaacaagaggagaaggaattatgagccattcattctatgaatatcgaccaatgataggtgaatttgaatctagaagaaatggagtcttgatttcttttgaagaaggtgtttctactttctatgctttaaagaatgccgaagatcgaggtcaatactttatttcacctggaacaaaagtgtataaaggaatgataattggagagaataatagacctcaggatctagagattaatatttgtaagactaagcaattgacaaacatgcggtcagcaggagccgatgaacttgatactcttcaatcacctattgatatgaatttagaaagagccttggagtacattggaccagaagaaatgcttgaagtaacaccagactctatacgacttaggaaaaaagtaatgaaaagaagaagtaagtaa

SEQ ID NO: 3864 - protein, 599 aa, Prochlorococcus marinus str. MIT 9211
MNSKSQSIRNIAIIAHVDHGKTTLVDALLSQSGIFRDNEAVPTCVMDSNDLERERGITILSKNTAITFKDTRINIVDTPGHADFGGEVERVLGMVDGCLLIVDANEGPMPQTRFVLKKALEKGLRPIVFVNKIDRPRVDPEIAVDKVLDLFIELGADDDQCDFPYLFGSGLGGFAKPDMQTKSDNMIPLFDSIIRHVPPPVGDKDKPLQLQITTLDYSDFLGRIIIGRVHNGYIRSGQKASLIKEDGSIKHGRISKLLGFEGLQRIEKEEAIAGDIVAIAGFPDVNIGETIACPDEPKALPLIKVDEPTLQMTFVVNDSPFAGKEGKFVTSRQLRERLYKELLTNVALRVEDTDTPDSFAVCGRGELHLGILIETMRREGYEFQVSQPQVIFRDIDELTCEPFETLVLDVPEESVGICIERLGERKGEMQNMFNSNDGRTQLEFVVPSRGLIGFRGEFIRATRGEGIMSHSFYEYRPMIGEFESRRNGVLISFEEGVSTFYALKNAEDRGQYFISPGTKVYKGMIIGENNRPQDLEINICKTKQLTNMRSAGADELDTLQSPIDMNLERALEYIGPEEMLEVTPDSIRLRKKVMKRRSK

SEQ ID NO: 3865 - DNA, 1845 bp, Erythrobacter sp. NAP1
  CDS (1)..(1845): transl_table=11
atgtccaaggccccctcctcgctccgaaatgtcgcaattattgcgcacgttgaccacggcaagaccactctggtcgaccaattgttccgccaatcgggaactttccgcgagaatcagcgggttgaagaacgcgccatggattcgggcgatctcgaaaaagaacgcggcatcaccatccttgccaagtgcaccagcgtcgaatgggaagcccccgacggcgaggtcacccgcatcaacatcgtcgacactccgggccacgccgatttcggcgccgaagtggagcgaattctgagcatggtcgacggggtcatcctgctggtcgacagcgccgaaggcgcaatgccgcagaccaaattcgtcaccggcaaggcgctggcgctcggcctcaagccgatcgtggtcgtcaacaagatcgaccgtcccgatggccgcccgcaggaagtgctcgacgaagtgttcgatctgttcgcatcgctcgacgcgaacgacgaacaactcgacttcccttcgctctgggcttcgggccgcgatggctatgcgtcgaatgacgagaccgcgcgcgaaggcgaccttcagccgctgttccagctgatcgtcgaccacgtgcccgagcccggccttgaggaagacgcgccgttcagcttccttgccacgctgctcgaccgcgacaatttcatgggccgcgtgattacgggccgcgtccagtccggcacgctcaagatcaacgaccccatccacgcaatcgacatcgccggtaacgtcgtcgagacgggccgcgcgacaaagctgctttcattccgcggccttgagcgtgtcccggtcgagagcgcgaaggcgggcgacatcatcgccctcgcaggcctcgaaaaggcgactgttgcgaacacgatttgcgacccgtcggtcaccgaaccgatcgcagcgcaggaaatcgacccaccgacactcgccatgcagttctcggtcaacgattcgcccctcgcaggccgcgaaggcgacaaggtgacgagccgcatgatccgcgaccgcctgctgcgcgaagcggaaaccaacgtggccatccgcgtcaccgagagcgaccagaaggacgcctttgaggtcgcagggcgcggtgaacttcagctgggcgtgctgatcgagacaatgcgccgcgaagggttcgagctgggcatcagccgtcccaaagtgctgttccgcgaagaagacggccagcgcaccgaaccgtatgaaacggtcgttatcgacgtcgatgacgagcattcgggcaccgttgtcgagaagatgcagaagcgcaaagccgaccttaccgaaatgcgcccctcgggcatcggcaagacccgcatcactttctcggccccctcgcgcggcctgatcggctatcacggtgaattcctgtccgacacgcgcggcaccggcataatgaaccgcctgttcgaaaagtacggcccgtacaaaggccagatcgacggcaggaacaacggcgttctcatctcgaatggcgatggcgagtccaatgcctatgcgctcaacatgctcgaagagcgcggcgagttgttcgtcgctccgcagatgaagctctacgagggcatgatcatcggcgagaatgcgaagcccgacgacctagaagtcaacccgatgaaggccaagcagctcaccaacatccgttcgtcgggcaaggatgattccatccgcctcaccccaccgcgccggatgacgctcgaacagtcgattgcatatatcgacgacgatgaaatggtcgaagtaacgcccaagtcgatccgtctgcgcaagacgttgctgtgcccgcacgagcgcaaaaaggccaagcgttcgaaggctgggtaa

SEQ ID NO: 3866 - protein, 614 aa, Erythrobacter sp. NAP1
MSKAPSSLRNVAIIAHVDHGKTTLVDQLFRQSGTFRENQRVEERAMDSGDLEKERGITILAKCTSVEWEAPDGEVTRINIVDTPGHADFGAEVERILSMVDGVILLVDSAEGAMPQTKFVTGKALALGLKPIVVVNKIDRPDGRPQEVLDEVFDLFASLDANDEQLDFPSLWASGRDGYASNDETAREGDLQPLFQLIVDHVPEPGLEEDAPFSFLATLLDRDNFMGRVITGRVQSGTLKINDPIHAIDIAGNVVETGRATKLLSFRGLERVPVESAKAGDIIALAGLEKATVANTICDPSVTEPIAAQEIDPPTLAMQFSVNDSPLAGREGDKVTSRMIRDRLLREAETNVAIRVTESDQKDAFEVAGRGELQLGVLIETMRREGFELGISRPKVLFREEDGQRTEPYETVVIDVDDEHSGTVVEKMQKRKADLTEMRPSGIGKTRITFSAPSRGLIGYHGEFLSDTRGTGIMNRLFEKYGPYKGQIDGRNNGVLISNGDGESNAYALNMLEERGELFVAPQMKLYEGMIIGENAKPDDLEVNPMKAKQLTNIRSSGKDDSIRLTPPRRMTLEQSIAYIDDDEMVEVTPKSIRLRKTLLCPHERKKAKRSKAG

SEQ ID NO: 3867 - DNA, 1803 bp, Synechococcus sp. RS9917
  CDS (1)..(1803): transl_table=11
atgagcgccccgaacaaggcgattcgcaatatcgcgatcatcgcccacgttgaccacggcaaaacaaccctggtcgacgccctgctcaaccagtccggcatcttccgcgacaacgaagcggtgcccacctgcgtgatggactccaacgatctggagcgggagcgcggcatcaccattctctccaaaaacacggcggtcacctacaacgacacccgcatcaacatcgtcgacacccccggccacgccgatttcggtggcgaagtggagcgggtgctcggcatggtggatggctgcctgctgatcgtggatgccaatgaggggccgatgccccagacccgcttcgtgttgaagaaagcgctggagcaggggctccgtccgattgtgtttgtgaacaagatcgaccgggcgcgcgtcgatcccgagacggctgtcgacaaggtgctggatctgttcatcgagctgggcgccgatgacgatcagtgcgatttcccttacctgttcggcagtggtctgggtgggttcgccaagcccgacatgaagaccgacagcgagacgatgcaaccgctgttcgatgcgatcctccgccatgttccgccgccggtcggcgatcccgagaagccgctgcagcttcagatcaccaccctcgactactccgatttccttggtcggatcatcatcggccgcgttcacaacggcgtgatcaaacaggggcagagtgcggcgttgatcaaggacgacggcagcgtcaagaaggggcggatcagcaagctgctcggcttcgagggcctgcagcgtgtggagatcgagcatgcctcggccggtgatctggtggccgtggccggtttcgacgatgtgaacatcggcgaaaccatcgcctgcccggatgaacccaaagctttgccgctgatcaaggtggacgagcccaccctgcagatgaccttcgtggtcaacgactcccccttcgccggcaaggagggcaaattcgtgaccagtcgccaggtgcgcgaccgcctgcagcgcgaactgctcaccaatgtcgcgctgcgcgtggaagacaccgactccccggatcgctttgccgtgagcggtcgcggtgaactccacctgggcatcctgattgaaaccatgcggcgcgagggctacgagttccaggtgtcccagccgcaggtgatcttccgcacgattgacggcactccctgcgagcctgtggagactctggtgatggatgtgcccgaggaagctgttggggcctgcattgagaagctcggcacccgcaaaggcgagatgcagaacatggaaaccggccaggatggtcgcacccagctcgaattcatcgttccctcacgcggcctgatcggtttccgtggtgaattcatccgcgccacccgcggtgaagggatcatgagccattccttctttgaataccggccgatgctgggtgatttcgatacccgccgtaatggtgtgttgatcgcctttgaggagggaaccgccaccttctatgccctcaagaacgccgaagatcggggccagttcttcatctcacccggcaccaaggtgtacaagggcatgatcatcggtgagaacaatcgtcctcaggatctggagatcaacatctgtaaggcgaagcagctcaccaacatgcggtcagcaggtgccgatgaactcgataccctgcaggcccctgtgcagatgaccctggagcgggcgctggagtacatcggccccgacgagatgctcgaagtcacccctgagtcgatccgtctgcgcaagctgcccgccaagaagatggccaagcgttga

SEQ ID NO: 3868 - protein, 600 aa, Synechococcus sp. RS9917
MSAPNKAIRNIAIIAHVDHGKTTLVDALLNQSGIFRDNEAVPTCVMDSNDLERERGITILSKNTAVTYNDTRINIVDTPGHADFGGEVERVLGMVDGCLLIVDANEGPMPQTRFVLKKALEQGLRPIVFVNKIDRARVDPETAVDKVLDLFIELGADDDQCDFPYLFGSGLGGFAKPDMKTDSETMQPLFDAILRHVPPPVGDPEKPLQLQITTLDYSDFLGRIIIGRVHNGVIKQGQSAALIKDDGSVKKGRISKLLGFEGLQRVEIEHASAGDLVAVAGFDDVNIGETIACPDEPKALPLIKVDEPTLQMTFVVNDSPFAGKEGKFVTSRQVRDRLQRELLTNVALRVEDTDSPDRFAVSGRGELHLGILIETMRREGYEFQVSQPQVIFRTIDGTPCEPVETLVMDVPEEAVGACIEKLGTRKGEMQNMETGQDGRTQLEFIVPSRGLIGFRGEFIRATRGEGIMSHSFFEYRPMLGDFDTRRNGVLIAFEEGTATFYALKNAEDRGQFFISPGTKVYKGMIIGENNRPQDLEINICKAKQLTNMRSAGADELDTLQAPVQMTLERALEYIGPDEMLEVTPESIRLRKLPAKKMAKR

SEQ ID NO: 3869 - DNA, 1806 bp, Synechococcus sp. WH 5701
  CDS (1)..(1806): transl_table=11
atgagcgccaatcagagcgcaccgatccgcaacatcgcgatcattgcccacgtggaccacggcaagaccaccctggtggatgccctgcttcagcaatcgggcatctttcgcgaaggggaggccgtgcccacctgcgtcatggactccaacgacctggagcgcgagcgcggcatcacgattctctccaagaacacggcggtcacctacgccggcacccgcatcaacatcgtcgacaccccaggccacgccgatttcggcggtgaagtggagcgggtgctgggcatggtcgatggggcgctgctgatcgtcgacgccaacgaggggccgatgccccagacgcgcttcgtgctcaagaaggctctggagcagggattgcggccgatcgtgttcgtcaacaagatcgaccgggcccgggtggaccccgagcaggccgtcgacaaggtcctcgatctcttccttgaactgggcgccgacgacgaccagtgcgacttcccctacctcttcggcagcggcatgggcggttacgccaagcccgacatggccaccgagagcgacaccatgaagccgctcttcgacgccatcctgcgccacgtcccacctccggtgggagatcccaccaaacccctgcagctgcaggtcaccacgctcgattactccgattttctcggacggatcatgatcggccgggtgcacaacggcacgatcaaggcggggcagccggccgcactcattcgcgacgacggcagcatcaagcgcagccgcatcagcaagctgctgggcttcgaaggactggcccgggtggagatcgccgaggcccgcgccggagatctggtggccgtggccggtttcgatgaggtgaacatcggcgagaccatcgcctgccctgatcaccccgaagcgctgccgctgatccgggtggatgaacccaccctgcagatgaccttcgtggtcaatgattccccctttgccggcaaggagggcaagttcgtcaccagccgccagctgcgtgaccgcctgcagaaggagctgctcaccaacgtggccctgcgggtcgaggacaccgattccccggatcgcttcgccgtcagcggccgtggtgaactccacctcggcatcctgatcgagacgatgcgccgggaaggcttcgaattccaggtgtcgcagccccaggtgatcttccgcaccatcgatggcaccccctgcgaaccggtggaaaccctggtgatggatgtccccgaagatgccgtcggcagctgcatcgagaagctggggatgcgcaagggcgagatgcagaacatggaaaccggcagtgatggacgcacccagctggagttcgtcgttccggctcggggcctgatcggcttccgcggagagttcgtgcgggccacccggggtgaggggatcatgagccattccttcttcgagtaccgcccgatgcagggcgatttcgatgcgcgccgcaatggcgttttgattgcctacgaggaaggcaccgccaccttctatgccctgaagggtgccgaagatcggggccagttcttcatcacaccgggcaccaaggtgtacaagggcatgatcgtcggcgagcacaaccgaccgcccgaccttgagctcaacgtctgcaaggccaaacaggtcaccaacatccgctcggccggtgctgaggtgctcgacaccctgcagtcgccgatccagatgaccctggagcgggcactggaatacatcggccccgacgagatgctggaggtgacccctgaatcgatccggttgcgcaagctgccggcgaagaagcccgccaagcgttga

SEQ ID NO: 3870 - protein, 601 aa, Synechococcus sp. WH 5701
MSANQSAPIRNIAIIAHVDHGKTTLVDALLQQSGIFREGEAVPTCVMDSNDLERERGITILSKNTAVTYAGTRINIVDTPGHADFGGEVERVLGMVDGALLIVDANEGPMPQTRFVLKKALEQGLRPIVFVNKIDRARVDPEQAVDKVLDLFLELGADDDQCDFPYLFGSGMGGYAKPDMATESDTMKPLFDAILRHVPPPVGDPTKPLQLQVTTLDYSDFLGRIMIGRVHNGTIKAGQPAALIRDDGSIKRSRISKLLGFEGLARVEIAEARAGDLVAVAGFDEVNIGETIACPDHPEALPLIRVDEPTLQMTFVVNDSPFAGKEGKFVTSRQLRDRLQKELLTNVALRVEDTDSPDRFAVSGRGELHLGILIETMRREGFEFQVSQPQVIFRTIDGTPCEPVETLVMDVPEDAVGSCIEKLGMRKGEMQNMETGSDGRTQLEFVVPARGLIGFRGEFVRATRGEGIMSHSFFEYRPMQGDFDARRNGVLIAYEEGTATFYALKGAEDRGQFFITPGTKVYKGMIVGEHNRPPDLELNVCKAKQVTNIRSAGAEVLDTLQSPIQMTLERALEYIGPDEMLEVTPESIRLRKLPAKKPAKR

SEQ ID NO: 3871 - DNA, 1803 bp, Synechococcus sp. WH 7805
  CDS (1)..(1803): transl_table=11
atgagtgcccagcaaaaggcgattcgcaatatcgcgatcatcgcccacgttgaccatggcaagacgaccttggtcgactctctgctggcccaatcgggcatcttccgcgacaacgaagccgtgcccacctgcgtgatggactccaatgatctggagcgtgagcgcggcatcaccattctctccaagaacactgcggtcacttacaacgaaacgcgcatcaacattgttgatacccctggccacgccgacttcggtggtgaggtcgagcgtgtcctcggcatggtggacggctgtctgctgatcgttgatgccaacgagggacccatgccccagacccgtttcgtgctcaagaaggcgctcgaacagggactgcggccgattgttttcgtcaacaagatcgaccgggcccgcgtggatcccgagacggctgttgacaaggtgctggatctgtttatcgagctgggtgctgacgatgatcagtgcgactttccttatttgttcggaagtggtttgggaggatttgccaaacccgatatgaaaaccgacagcgagaacatgcgtccgctgttcgatgcgatcctgcgtcatgtcccgcccccggtcggtgatccagagaagcctcttcagctccagatcacgacccttgattattccgatttcctggggagaatcattatcggtcgcgttcacaacggcgtgatcaagcaggggcaaagcgcttcactcatcaaagacgatggcagtgtcaagaagggacgcatcagcaagcttctcggttttgaaggtctgcaacgggttgaaattgagaacgccgctgccggcgatctcgttgccgttgccggtttcgatgatgtgaacatcggggaaaccattgcctgccccgatgagccgacggcactcccactgatcaaggtggatgagcccacccttcagatgactttcgttgtcaacgactctcccttcgcggggaaggaaggcaagttcgtcacgagtcgtcaggtgcgggaccgtctgcaacgtgaacttctcaccaacgtggccctgcgggtggaggacaccgactctccagatcgctttgctgtcagtggccggggtgaacttcacctgggaatcttgatcgaaaccatgcgccgcgagggttatgagtttcaggtatcccagcctcaggtgatcttcagaacaattgatggcactccttgtgagcctgtggagactctcgttatggatgtgcctgaagaggcggtgggctcctgtatcgagaaactcggcacccgaaagggcgagatgcaaaacatggagaccggtcaggatggacgcacgcagttggagtttgttgtgccgtcccgcggtctaattggtttcagaggtgaattcattcgtgccacacggggcgaagggatcatgagccattctttctttgaataccggccaatgatgggtgacttcgatacccgcagaaatggtgttctgattgcctttgaggaaggtacagccacgttttacgccctgaagaatgccgaagatcgcggtcagttcttcatctcgcctggcactaaggtctacaagggaatgattatcggtgagaacaatcgcccgcaggatttggaaatcaatgtctgcaaggccaagcaactcaccaacatgcgatctgctggagcggaagaactcgatacgcttcagtctcccgttcagatgactctcgagagagctttggaatatatcggccccgatgaaatgcttgaggtcactccggagtccatccgtctccgcaagttgcctgccaagaggatggccaagcgttga

SEQ ID NO: 3872 - protein, 600 aa, Synechococcus sp. WH 7805
MSAQQKAIRNIAIIAHVDHGKTTLVDSLLAQSGIFRDNEAVPTCVMDSNDLERERGITILSKNTAVTYNETRINIVDTPGHADFGGEVERVLGMVDGCLLIVDANEGPMPQTRFVLKKALEQGLRPIVFVNKIDRARVDPETAVDKVLDLFIELGADDDQCDFPYLFGSGLGGFAKPDMKTDSENMRPLFDAILRHVPPPVGDPEKPLQLQITTLDYSDFLGRIIIGRVHNGVIKQGQSASLIKDDGSVKKGRISKLLGFEGLQRVEIENAAAGDLVAVAGFDDVNIGETIACPDEPTALPLIKVDEPTLQMTFVVNDSPFAGKEGKFVTSRQVRDRLQRELLTNVALRVEDTDSPDRFAVSGRGELHLGILIETMRREGYEFQVSQPQVIFRTIDGTPCEPVETLVMDVPEEAVGSCIEKLGTRKGEMQNMETGQDGRTQLEFVVPSRGLIGFRGEFIRATRGEGIMSHSFFEYRPMMGDFDTRRNGVLIAFEEGTATFYALKNAEDRGQFFISPGTKVYKGMIIGENNRPQDLEINVCKAKQLTNMRSAGAEELDTLQSPVQMTLERALEYIGPDEMLEVTPESIRLRKLPAKRMAKR

SEQ ID NO: 3873 - DNA, 1821 bp, Pseudoalteromonas tunicata D2
  CDS (1)..(1821): transl_table=11
atgagcatcgaaaagataagaaatatcgcgattatcgcgcacgttgaccacggtaaaacaaccttggttgataaactgctagggcagtcaggcacattagcaacacgtggcggtaacgaagagcgtgtaatggactctaatgatattgagaaagagcgtggtattaccattcttgcaaaaaatactgcaatttcttggaatggttaccatatcaatatcgtagatactccaggacacgccgatttcggtggtgaagttgagcgtgtactttcgatggctgactcagtattactattagttgatgcacaagaaggcccaatgccacaaactcgttttgtgacgcaaaaagcattcgcgcaaggtctaaagccaatcgttgttatcaacaaaatcgacaagccaggtgcacgtcctgattgggttatggatcaaatctttgatttattcgataacttaggcgcaactgatgatcagttagattttaaagtaatttatgcatcagctatcaatggctgggcaacattagatttagatgtaccatcagataacatggaacctatgttccaaatgatcgttgatgaagttgctcctccggcggcagatccggaaggtgctttccaaatgcaaatttcgcaacttgattacaactcatatgtaggtgtaattggtgttggtcgtatcaaacgtggttctgttgcaccgaatcagcaagttacgattattagtgctgatggtactaaacgtaatggcaaaattggttcagttcaaagctatttaggccttgagcgtattgagactgaccgtggttatgctggtaacatcgtaactgtaactggtattggtgaacttaagatttctgatacagtttgttgtccaaacaatgttgagccattaccgccactaagtgttgatgagccaacagtaacaatgacattctcggtaaataactcacctttctgtggtaaagaaggtaagtttgttacttcacgtaatatccttgagcgtttacaaaaagaattagttcacaacgttgcgttacgtgttgaagaaactgacagcccagatagcttccgtgtatctggccgcggtgaattacacttaggtatcttaattgaaaacatgcgtcgtgaaggttatgagttagcggtttctcgtccacaagtaatcttacgtactgttgatggtcaattacaagaaccgtttgaagtagtgactatcgactgtcaagaagagcaccaaggttctatcatggagcaattgggtcttcgtaaaggtgaattacgtgatatgtctccagatggtaaaggccgtatgcgtatggacttcatcatcccaagtcgtggtttaattggtttccaaacagacttcatgacgttaacgtctggttctggtttgttataccatacattcgatcattacggtccacacaaaggtggtgagatcggtgttcgtaaaaacggtgtaatgattgcaaatgcaacaggtaaagcgttaacaaatgcattattcaacctacaagagcgtggccgtttatttatcggtcatggtgttgaagtgtatgaaggtatggttattggtattcacagccgtgataacgatttaactgtaaatgcacttaaaggtaagcagttaacaaacgttcgtgcatcaggtactgatgaagcgcaaacgttatcaccacacttaaactattcacttgagcaagcgcttgagttcatcgctgatgatgagttagttgaagtaacaccgttaaacattcgtattcgtaaacgtcatttgacagaaaacgagcgtaaacgtgctggtcgtgcaccaaaataa

SEQ ID NO: 3874 - protein, 606 aa, Pseudoalteromonas tunicata D2
MSIEKIRNIAIIAHVDHGKTTLVDKLLGQSGTLATRGGNEERVMDSNDIEKERGITILAKNTAISWNGYHINIVDTPGHADFGGEVERVLSMADSVLLLVDAQEGPMPQTRFVTQKAFAQGLKPIVVINKIDKPGARPDWVMDQIFDLFDNLGATDDQLDFKVIYASAINGWATLDLDVPSDNMEPMFQMIVDEVAPPAADPEGAFQMQISQLDYNSYVGVIGVGRIKRGSVAPNQQVTIISADGTKRNGKIGSVQSYLGLERIETDRGYAGNIVTVTGIGELKISDTVCCPNNVEPLPPLSVDEPTVTMTFSVNNSPFCGKEGKFVTSRNILERLQKELVHNVALRVEETDSPDSFRVSGRGELHLGILIENMRREGYELAVSRPQVILRTVDGQLQEPFEVVTIDCQEEHQGSIMEQLGLRKGELRDMSPDGKGRMRMDFIIPSRGLIGFQTDFMTLTSGSGLLYHTFDHYGPHKGGEIGVRKNGVMIANATGKALTNALFNLQERGRLFIGHGVEVYEGMVIGIHSRDNDLTVNALKGKQLTNVRASGTDEAQTLSPHLNYSLEQALEFIADDELVEVTPLNIRIRKRHLTENERKRAGRAPK

SEQ ID NO: 3875 - DNA, 1827 bp, Photobacterium sp. SKA34
  CDS (1)..(1827): transl_table=11
atgtctaatcaatcgatcgataaattaagaaatatcgcaattattgctcacgttgaccatggtaaaactaccttggttgataaacttctacagcagtctggcacgttagagggtcgcggcgaagccgaagaacgtgtgatggattctaacgatatcgagaaagagcgtggcattaccattcttgctaagaacacagcaatcaattggaatgactaccgtatcaacatcgtagatacccctggacacgccgatttcggtggtgaagtagagcgtatcatgtctatggttgactctgtattgcttatcgttgacgcagttgacggccctatgcctcaaacacgtttcgtaacgcaaaaagcgtttgcatacggtcttaagccaatcgttgtaattaacaagattgaccgtccaggtgcacgtcctgagtgggttatggatcaaatatttgacctatttgacaaccttggtgcaactgacgaacagcttgatttccaagtggtttacgcatcagcactaaacggttgggctactctagaagaaggcgaaactggcgagaacatggaaccattgttccaatctatcgttgataacgttgcagcgccttcagtagacgttgatggcccacttcagatgcaaatctctcagcttgattacagctcttacgtgggtgttatcggtgttgcgcgtattactcgtggtgctgttaaagctaaccaacaagtaactatcgtaagtgctgatggttctaagcgtaacggtaaagtaggtacagttttaggttacctaggtcttgagcgtcatgaagttgaagaagcgaaagcgggtgacatcattgctatcacaggtcttggcgagcttaagatttctgacactatttgtgaccaaaactgtgttgaagcattaacgccactttctgttgatgaaccaacagttaccatgactttccaagtaaacaactctccgtttgcaggtaaagaaggtaagttcgttacttcacgtaacatcctagagcgtcttcaaaaagagctagtacataacgttgcactacgtgttgaagaaacagctgatccagataaattccgcgtatcaggccgtggtgaacttcacctatctatcctgatcgaaaacatgcgtcgtgaaggctacgaactagcagtatcacgtccagaagttatcatcaaagaagaagatggtaagcaaatggaaccgtttgaagttgtgactatcgacgtggtggaagagcaccaaggcggtatcatggagaacatcggtcttcgtaaaggtgagctaacggatatggcaccagatggtaagggccgtgttcgcatggatttcatgatgccttctcgtggtcttatcggtttccaaactgaattcatgacactgacttcaggctcaggtcttctttaccatacgtttgatcactatggccctcacaagggcggtactatcggtcaacgtaacaatggtgtattgatttctaacgcaacaggtaaagcactgacttatgcattgtttaacctacaagagcgtggccgtctattctctgagcacgcagatgaagtttacgaaggtcagatcatcggtattcataaccgttctaacgaccttacagttaactgtctgaaaggtaagcagcttacaaacgttcgtgcttctggtactgacgaagcgcaaaccctttctcctgctatcaagtacacacttgagcaagcactagaattcatcgacaacgatgagctagtagaagttacgcctgaaaacatccgtattcgtaagaaacttcttactgaaaacgatcgtaagcgtgcaggtcgtgcaaagtaa

SEQ ID NO: 3876 - protein, 608 aa, Photobacterium sp. SKA34
MSNQSIDKLRNIAIIAHVDHGKTTLVDKLLQQSGTLEGRGEAEERVMDSNDIEKERGITILAKNTAINWNDYRINIVDTPGHADFGGEVERIMSMVDSVLLIVDAVDGPMPQTRFVTQKAFAYGLKPIVVINKIDRPGARPEWVMDQIFDLFDNLGATDEQLDFQVVYASALNGWATLEEGETGENMEPLFQSIVDNVAAPSVDVDGPLQMQISQLDYSSYVGVIGVARITRGAVKANQQVTIVSADGSKRNGKVGTVLGYLGLERHEVEEAKAGDIIAITGLGELKISDTICDQNCVEALTPLSVDEPTVTMTFQVNNSPFAGKEGKFVTSRNILERLQKELVHNVALRVEETADPDKFRVSGRGELHLSILIENMRREGYELAVSRPEVIIKEEDGKQMEPFEVVTIDVVEEHQGGIMENIGLRKGELTDMAPDGKGRVRMDFMMPSRGLIGFQTEFMTLTSGSGLLYHTFDHYGPHKGGTIGQRNNGVLISNATGKALTYALFNLQERGRLFSEHADEVYEGQIIGIHNRSNDLTVNCLKGKQLTNVRASGTDEAQTLSPAIKYTLEQALEFIDNDELVEVTPENIRIRKKLLTENDRKRAGRAK

SEQ ID NO: 3877 - DNA, 1812 bp, Oceanospirillum sp. MED92
  CDS (1)..(1812): transl_table=11
gtgatcgaaaacctaagaaacatcgccattatcgcgcacgttgaccatggtaaaacaaccctggttgataagcttctgcagcaatccggcacattaggccgccgtgatgaaggcacagagcgcatcatggactccaacgaccaggagaaagaacgaggcattaccattctggcaaagaacactgccatcaaatggaatgactaccgtatcaatatcgttgacactcctggacacgctgactttggcggtgaagtagaacgcgttctatccatggttgattgtgtatgcttgctggttgacgctgtagacggcccgatgccgcaaacacgctttgtaactcagaaagcttttgatcagggccttcgcccgatcgttgtaatcaacaaaattgaccgtccaggcgcacgcccggattgggttatcgatcaggtattcgatctgttcgacagcctgggtgcaacagatgagcaactggatttccctatcgtttacgcatctgcactaaacggtattgcgggtcttgacccagaagagatggctgaagacatgacaccgctgtttgaagcagtggttgagcacgtagagccaccaaaagttgacgtagacggcccacttcagatgcaggtttctgcactggattataacagctacctgggcgttatcggtgtaggccgtgtaacacgcggcacaatcaacaccaatactcaggttaaagttatcgaccgtgaaggcgctgttcgtagtggccgagtgctgaagatcatgggctaccacggtcttgagcgagttgatgtagaaagcgcaacagcaggcgatattatctgtgtaacaggtattgatgccctaaacatctccgataccctgtgtgatccggataatgttgaggcactgcctgcactgagtgttgatgaaccaactgtatccatgacattccaggtgaatgactctcctttcgcaggccaggatggaaaattcgttaccagccgcaacattaaagagcgcctagatcgcgaacttatccacaacgttgcactgcgcgttgaagaaggcgaaacccctgagaaattcaaagtatcaggccgtggtgaacttcacctgtctgtactgatcgaaacaatgcgtcgtgaaggcttcgagctgggtgtatctcgtcctgaagtaattcagaaagagattgatggcgaaatccaggagccttacgaactggtaatgatcgacgttgaagacgaacaccagggctcagttattgaagagctgggtaaacgtaaaggcgacatgacaaacatggaagtagatgggaaaggccgtgtacgcctgacgttcatgatcccttctcgcggtctgatcggcttccgttcactcttcctgaccatgacctctggcactggtatcatgacctccatcttcgaccattacggtccggtgaaggaaggtgatgttgtaagccgtatcaatggtgtattggtatcgatggtaacaggtaaagcactaggttatgcactttggaaccttcaggatcgcggccgtctggctatcgaccctaacgtagaagtctatgaaggtatgattctgggtattcacagccgtaacaatgaccttgcggttaacccaaccaaaggtaagcaactgactaacgtccgtgcgtctggctcagatgaaaacattcagctaacgccacctgttcgcttcacactggaacaggcactggacttcatcgaagacgatgaactggtagaagtaacacctaacttcattcgcttgcgtaagaagcttcttaaagagaatgagcgtaagcgcgctaagaacaagtaa

SEQ ID NO: 3878 - protein, 603 aa, Oceanospirillum sp. MED92
MIENLRNIAIIAHVDHGKTTLVDKLLQQSGTLGRRDEGTERIMDSNDQEKERGITILAKNTAIKWNDYRINIVDTPGHADFGGEVERVLSMVDCVCLLVDAVDGPMPQTRFVTQKAFDQGLRPIVVINKIDRPGARPDWVIDQVFDLFDSLGATDEQLDFPIVYASALNGIAGLDPEEMAEDMTPLFEAVVEHVEPPKVDVDGPLQMQVSALDYNSYLGVIGVGRVTRGTINTNTQVKVIDREGAVRSGRVLKIMGYHGLERVDVESATAGDIICVTGIDALNISDTLCDPDNVEALPALSVDEPTVSMTFQVNDSPFAGQDGKFVTSRNIKERLDRELIHNVALRVEEGETPEKFKVSGRGELHLSVLIETMRREGFELGVSRPEVIQKEIDGEIQEPYELVMIDVEDEHQGSVIEELGKRKGDMTNMEVDGKGRVRLTFMIPSRGLIGFRSLFLTMTSGTGIMTSIFDHYGPVKEGDVVSRINGVLVSMVTGKALGYALWNLQDRGRLAIDPNVEVYEGMILGIHSRNNDLAVNPTKGKQLTNVRASGSDENIQLTPPVRFTLEQALDFIEDDELVEVTPNFIRLRKKLLKENERKRAKNK

SEQ ID NO: 3879 - DNA, 1806 bp, Flavobacteria bacterium BBFL7
  CDS (1)..(1806): transl_table=11
atgaaagacattagaaacattgcgattattgctcacgtagaccacggtaagactacgttagtagacaagattttacatcactgtgaaattttccgtgagaacgagacgacgggagaattaatccttgataacaatgacattgaacgtgaacgtgggattactatccttgcaaagaacgtttctgttatgtataaaggaactaaaattaatatcatcgacacacctggtcacgccgattttggtggagaggtggaacgtgtattgaatatggcagatggtgttctacttttagtagatgcatttgaaggaccaatgcctcaaactcgttttgtattgcagaaagcaatagacctaggtcttaaaccttgtgtagttgtcaataaagtagataaagagaattgtacaccagatgaggtacatgaatctgtatttgatttaatgtttgaactaggtgcagaagagtggcagttagatttccctacggtatatggtagtgcaaagaataactggatgtctgacgactggcaaaatgaaacaactaatatcgagccgttattagatatggttatcgagcatgttcctgctccaaaggttgaagaaggaacgactcaattgttaattacttcattagatttctctaactatacaggtcgtattgcgataggtcgtattaaaagaggatctattaaagaaggtcaaaacgtgacgctttgtaagcgtgacggttctatgactaagactaaggttaaagaagtttatgtctttgatggtatgggtaaagccaaagctcaagaagtaatggctggtgatatttgtgcaatcgttggtttagaaggttttgaaattggtgacagtgttgctgattttgaaaacccagaagcaatggaaactattgcaattgatgaacctacaatgagtatgttatttactattaacgattccccattctttggaaaggacggaaagtttgtaacatctcgtcacattaatgatcgtttaactaaggagctagaaaagaatcttgctttacaagtacatgatactggtagtgcagataaatttatggttttcggacgtggtgtattacacctttctgtattaattgaaacgatgcgtcgtgaaggttatgaattacaaataggtcaaccacaggtaatcattaaagaaatagatggtgttaagtgtgagcctattgaagagcttacaatcgatttaccagaaacggtaagtggtaaagctgttgaaatggttactttaagaaaaggagaaatgactagtatggcacctaaaggtgagcgtatggtttgtgaatttaaaatcccttctcgtggtattataggattacgtaatcaattaattacagctactgctggtgaggctataatgaatcaccgttttgtaggttttgaaccttataaaggggaaatagcaggtcgtattaatggatctatgatatctatggagactggtacatctattccttattcaatggataagttacaagatcgtggtaaattctttattcacccaggtgaagagatttatggaggtcaggtagtaggtgagaactctagaccagatgatctagctattaaccttaccaaaactaaaaagctttctaacgtacgtagtgctggtaatgatgataaagttaaaatagcaccacctatcaagtttactcttgaagaggcactagaatatatccaaaaagatgagtatgtagaggtaactcctaattacttgagaatacgtaagatatatctagatgagaatgagcgtaagcgtaaggctaaggaactttcttaa

SEQ ID NO: 3880 - protein, 601 aa, Flavobacteria bacterium BBFL7
MKDIRNIAIIAHVDHGKTTLVDKILHHCEIFRENETTGELILDNNDIERERGITILAKNVSVMYKGTKINIIDTPGHADFGGEVERVLNMADGVLLLVDAFEGPMPQTRFVLQKAIDLGLKPCVVVNKVDKENCTPDEVHESVFDLMFELGAEEWQLDFPTVYGSAKNNWMSDDWQNETTNIEPLLDMVIEHVPAPKVEEGTTQLLITSLDFSNYTGRIAIGRIKRGSIKEGQNVTLCKRDGSMTKTKVKEVYVFDGMGKAKAQEVMAGDICAIVGLEGFEIGDSVADFENPEAMETIAIDEPTMSMLFTINDSPFFGKDGKFVTSRHINDRLTKELEKNLALQVHDTGSADKFMVFGRGVLHLSVLIETMRREGYELQIGQPQVIIKEIDGVKCEPIEELTIDLPETVSGKAVEMVTLRKGEMTSMAPKGERMVCEFKIPSRGIIGLRNQLITATAGEAIMNHRFVGFEPYKGEIAGRINGSMISMETGTSIPYSMDKLQDRGKFFIHPGEEIYGGQVVGENSRPDDLAINLTKTKKLSNVRSAGNDDKVKIAPPIKFTLEEALEYIQKDEYVEVTPNYLRIRKIYLDENERKRKAKELS

SEQ ID NO: 3881 - DNA, 1776 bp, delta proteobacterium MLMS-1
  CDS (1)..(1776): transl_table=11
atggatcagcagaaaatcagaaacgttgccatcattgcccacgtcgaccacggcaagaccaccctggtcgatcaactctttcgccaaagcggtatgttccgtgacaatcagcaggtctccgagcggctgatggactccatggatctggaaaaggagcggggtatcactatttccgctaaaaacggaacctttgcccataaaggacaccggatcaatatcatcgacaccccgggccatgccgatttcggtggtcaggtagagcgggtgctgcagatggccgacggctgcctgctgctggtggacgccaaggaggggcccatgccccagaccttcttcgtggtcaaaaaggccctggccgcccagctcccggtgatcgtggtggtcaacaagatcgacaagccggcggcccgtcccgagtgggtggtggatcaggtctttgacctttttgtcaaactgggcgcccccgacgaattgctggatttcgccgtggtttacgcctcggccaaggatggctacgccgcccccgccctgcccgccaccaaccgccaggatatgagcgccattgccgacctgatcgtcgagcagatccccccaccggccggcgatcaacaggccccgctgcaaatgcaggtctccaccctggatgcctccccctacctggggcgtttggccatcggcaaggtgaccagcggcaccctgaacatcaatcattcggtggtggtctgcaaacaggacggctccaccaagccggcccggattaacaagatttaccactttgaaggcaacaccaaggtggccaccaaccaggcgatctgcggcgagatcgtggcggtggccggcatggatgacatcacggtgggggaaaccttcaccgatcccgacgatccccggccgctgccgctgtttgaaatcgacccaccgaccatcgccatgcactttatccccaacgactctccttttgccggcctggaggggaaatttgtcacctcccgccacctcgacgaacggttgcgccgagagaccatcgccgatgtggccctgcgggtggagtcgctgagtgacggtaacggctttgcggtggccggccggggcgagttgcacctctccatcctgatcgagcagatgcggcgggaggggtatgagttccaggtaacccgcccccgggtaatcatgcgcgagcaggacggcgtccaacaggaaccttacgaggaactgaccattgacgtcgatgagcagtacagcggcacggtgatcgagaagctgggccagctcaagggcaaaatgctggagatgcaccaggacaacggcatgacccggttgctctacaagatccccacccggggcctgttgggctaccgggcccgctttatgaccgacaccaagggaatgggggtgatgaactatgtctttgccgagtacggaccctacgccggcgagatcagaaaccgcagcaacggcgccctggtggccaaggagccttgcaccacggtggcctacgccctgtgcaatctgcaagagcggggccggctttttatcggcccgggggaaaaggtctacaaggggcaggtgatcggcgaaaacagccgcgaaggcgacatggtggtcaatccggccaagggcaaaaagctcaccaacatgcgggcctcgggaaccgatgaaaacgtgatcctgacccccccggccaagatgagcctggaggattgcatctcttacatcaacgacgatgaactggtggaggttactcccgcctccatccgcctgcgcaaagccgggtaa

SEQ ID NO: 3882 - protein, 591 aa, delta proteobacterium MLMS-1
MDQQKIRNVAIIAHVDHGKTTLVDQLFRQSGMFRDNQQVSERLMDSMDLEKERGITISAKNGTFAHKGHRINIIDTPGHADFGGQVERVLQMADGCLLLVDAKEGPMPQTFFVVKKALAAQLPVIVVVNKIDKPAARPEWVVDQVFDLFVKLGAPDELLDFAVVYASAKDGYAAPALPATNRQDMSAIADLIVEQIPPPAGDQQAPLQMQVSTLDASPYLGRLAIGKVTSGTLNINHSVVVCKQDGSTKPARINKIYHFEGNTKVATNQAICGEIVAVAGMDDITVGETFTDPDDPRPLPLFEIDPPTIAMHFIPNDSPFAGLEGKFVTSRHLDERLRRETIADVALRVESLSDGNGFAVAGRGELHLSILIEQMRREGYEFQVTRPRVIMREQDGVQQEPYEELTIDVDEQYSGTVIEKLGQLKGKMLEMHQDNGMTRLLYKIPTRGLLGYRARFMTDTKGMGVMNYVFAEYGPYAGEIRNRSNGALVAKEPCTTVAYALCNLQERGRLFIGPGEKVYKGQVIGENSREGDMVVNPAKGKKLTNMRASGTDENVILTPPAKMSLEDCISYINDDELVEVTPASIRLRKAG

SEQ ID NO: 3883 - DNA, 1815 bp, Rickettsiella grylli
  CDS (1)..(1815): transl_table=11
atgattcaaaccatacgtaatattgctatcatcgcccatgttgaccacggaaaaaccacgctcgtggataagttattacaacaatccggcacactgtccagccgagcagcaaccgtggatcgtattatggatagtaacgatttagaacgtgaacgcggtattactatccttgcaaaaaacacatcgataacatggcaaggttatcgtattaacattgtcgacaccccgggccatgctgacttcggtggggaagtagaacgtattttgtccatggtcgactccgtcttactccttgttgatgcggtcgacggaccgatgcctcaaacccgatttgtgacccaaaaagcgtttgccaaaggcttaaaacctattgttgttgttaataaaattgataggccaagcgccagacccgattgggtcgttaatcaagtatttgatctatttgataggttaggtgcaacggaagaacaacttgatttccccattatctatgcgtccgctttgcagggttatgcgacattggatcttaaaaatccgagttcccatttggatccattatttgaaaccattattaataaagtcaatcctcccagagtcgatccagagggaggttttcaaatgcaaattacgacactggattattcgagttatgtcggcaccattggtattggtcgtattcaaagaggatgtgcccaagcgaacatgccggttacactcatcgaccgagaaggaaaaacgcgatcggcacgtatattacaaattttaggttatcacggtctagaacgtattgaaatcgaacacgcacaggctggagacattgtcgctattacgggtattgatacgttaaatatctccgatactttatgtgatcctcattttgtagaagcgttacctgcattaattgtcgatgaacccacgatgagcatgacctttcaagtcaataactcgccttttgcaggtaaagacgggaaatttgttacgagccgacaaattaaagaacgactggataaagaactccttcataacgtagcacttaaagtcgaagatacggacgatcccaatcgatttcgcgtctcgggtcgcggagaactgcatttatcaatactcattgaaaccatgcgtcgcgaaggatatgagctcggtgtctctcgtcctgaggtgattttgaaagaaatagacggtgagctgaaagaaccctatgaaaatctcacggtcgatctagaagagcaacaccaaggtcctattatggaaaaattaggaagtcggcgtggtgatctccttgatatgatagcggatggaaatggacgtgtccgattagattataaaataccgacacgtgctttatttggttttcgtacagaatttttaacggcgacttccggcttagggttaatgcatcatgttttctgtcattatggtcccctaaaaaaaggaacccttgcgagcagagtcaatggtgtccttgtcgcaaaccaactcggtaaatcaactggattctctttatttaatttacaagagcgcggaaaattattaattggaccgcaaaccgatgtctatgaaggaatgatcgttggcattcattcgcgtgataatgacttagttgtgaatgtggtgaaagggaaacaactgaccaacgtccgcgcatctggttccgatgagaatattattttaacgccccccctcacattttctttagaacaagcactcgagtttattgcagatgatgagttactcgaagtcacccctcattccttgcgcctgcgaaaaaaatttttaaaagagcatgagcgtaaacgttccagccgagatgcctaa

SEQ ID NO: 3884 - protein, 604 aa, Rickettsiella grylli
MIQTIRNIAIIAHVDHGKTTLVDKLLQQSGTLSSRAATVDRIMDSNDLERERGITILAKNTSITWQGYRINIVDTPGHADFGGEVERILSMVDSVLLLVDAVDGPMPQTRFVTQKAFAKGLKPIVVVNKIDRPSARPDWVVNQVFDLFDRLGATEEQLDFPIIYASALQGYATLDLKNPSSHLDPLFETIINKVNPPRVDPEGGFQMQITTLDYSSYVGTIGIGRIQRGCAQANMPVTLIDREGKTRSARILQILGYHGLERIEIEHAQAGDIVAITGIDTLNISDTLCDPHFVEALPALIVDEPTMSMTFQVNNSPFAGKDGKFVTSRQIKERLDKELLHNVALKVEDTDDPNRFRVSGRGELHLSILIETMRREGYELGVSRPEVILKEIDGELKEPYENLTVDLEEQHQGPIMEKLGSRRGDLLDMIADGNGRVRLDYKIPTRALFGFRTEFLTATSGLGLMHHVFCHYGPLKKGTLASRVNGVLVANQLGKSTGFSLFNLQERGKLLIGPQTDVYEGMIVGIHSRDNDLVVNVVKGKQLTNVRASGSDENIILTPPLTFSLEQALEFIADDELLEVTPHSLRLRKKFLKEHERKRSSRDA

SEQ ID NO: 3885 - DNA, 1824 bp, Oceanobacter sp. RED65
  CDS (1)..(1824): transl_table=11
atgattgagaacttaagaaacatcgccatcatcgcccacgttgaccatggtaaaaccactttggttgataaattgcttgagcaatcgggcaccctagatcgtaaagagcagggtggcgagcgcatgatggacagtaatgatcaagagaaagaacgtggtattaccatcctttctaagaataccgctattaaatggggcgaataccgcgtaaacatcgtggacacgcctgggcacgccgacttcggtggtgaggttgagcgtgtaatgtctatggtggactctgtgcttcttatcgttgacgcacaagacggtccaatgcctcaaactcgatttgttacacaaaaagcgttcgatcgtggtttgcgtcctatcgttgttattaacaagatcgaccgaccaggtgcgcgccctgattgggtaatggatgaagtctttgacctatttgatcgtctaggtgcgacggaagagcagttagatttccctgtagtttacgcatcggccttaaacggcattgcaggtaatgatcctgatgaaatgggtgaggatatgggtgcgttgttcgatgcgattattgagcatgtgccagcgccagatgttgatccagagggtgacttccaaatgcaggtttcatctttggattatgacccataccaaggtgttatcgggattggtcgtattacccgcggtacccttaaaacgaatcagcctgttgctgtaattgaccgtgatggtaagaagcgtaacggtcgtgtgttggaagtaaaaggttatcatggcttgaaccgcgtggttgtagatcaagccactgctggtgatattgtttgtattacaggtttagagacgctaaatatctcggatacattgtgtgatcctaacaacgttgaagcacttcctaagttgagcgtagatgaaccgaccgtaagcatgactttccaagtaaacgattcaccgtttgctggtaaagaaggtaaatacgttaccagccgtaatattgctgagcgtttagaaaaagaattaatcaccaacgttgcattgcgtgtcgagccaggtgaaagcccagagaagttcaaagtgtctggtcgtggtgagcttcacttgtccgttttgattgaaaacatgcgtcgtgaaggctttgagttggctgtcggtcgtccagaagttgtgcagaaagaaatcgatggtgttattcaagagccatatgagcaagtggtgatcgatgttgaagaagagcatcaaggttcaatcatgtctgccatgggtgaccgtcgcgcggaaatgtcgaatatggttccagatggcaaaggccgagtgcgtttggaattcatgatgccagcccgtggtttaattggtttccgtaacgaattcatgaccatgacatcaggtagcggtattctgactaacgtgttcgatcactatggtccagttaaagataccgaagtggtatcgcgccacaatggtgtattggtctccatggtggcaggtaaagtattaggctacgccctatttactcttcaagagcgtggccgtctattcgtagagccaagccaagaagtttacgagggtcagattgttggtttacatagccgtgataacgaccttgttgttaatccaacaaaagccaagcagttaaccaacgtgcgtgcttcaggtactgacgaagccattaacttaacgccaccagtgaagcatacgctagagcaagctttagactttatcgaagatgatgagctagtggaaattacgccagaaagcattcgcttgcgtaagaagttgttgactgagactgagcgtaagcgtgctaacaacgctgccaagaaaaaataa

SEQ ID NO: 3886 - protein, 607 aa, Oceanobacter sp. RED65
MIENLRNIAIIAHVDHGKTTLVDKLLEQSGTLDRKEQGGERMMDSNDQEKERGITILSKNTAIKWGEYRVNIVDTPGHADFGGEVERVMSMVDSVLLIVDAQDGPMPQTRFVTQKAFDRGLRPIVVINKIDRPGARPDWVMDEVFDLFDRLGATEEQLDFPVVYASALNGIAGNDPDEMGEDMGALFDAIIEHVPAPDVDPEGDFQMQVSSLDYDPYQGVIGIGRITRGTLKTNQPVAVIDRDGKKRNGRVLEVKGYHGLNRVVVDQATAGDIVCITGLETLNISDTLCDPNNVEALPKLSVDEPTVSMTFQVNDSPFAGKEGKYVTSRNIAERLEKELITNVALRVEPGESPEKFKVSGRGELHLSVLIENMRREGFELAVGRPEVVQKEIDGVIQEPYEQVVIDVEEEHQGSIMSAMGDRRAEMSNMVPDGKGRVRLEFMMPARGLIGFRNEFMTMTSGSGILTNVFDHYGPVKDTEVVSRHNGVLVSMVAGKVLGYALFTLQERGRLFVEPSQEVYEGQIVGLHSRDNDLVVNPTKAKQLTNVRASGTDEAINLTPPVKHTLEQALDFIEDDELVEITPESIRLRKKLLTETERKRANNAAKKK

SEQ ID NO: 3887 - DNA, 1833 bp, Desulfitobacterium hafniense DCB-2
  CDS (1)..(1833): transl_table=11
atgaaatcaatgaatattcgtaatatcgccatcatcgctcacgttgaccacggcaaaacaaccctagtcgatgcaatgctcagacaaagcggaaccttccgcgccaatcaaaatgttatggagcgggttatggactccaatgacctggaacgggagagagggattaccattctctccaagaatacagcggtcaattggttggatacaaaaatcaatattgtggatacaccgggtcacgccgattttggcggtgaagtggaacgggtcttgaagatggtgaacggggtgctcctgattgtggattcctttgaagggcccatgccccaaacacgctttgtgttaagaaaagctttagagctgaagcttgttcccatcgttgtgattaataagattgaccgtcctgatgcccgtcctgctgaagtggtggacgaggtcctggatttatttatcgaattaggtgccgatgaggagcaactggatttccccgtggtctacgcttcggcccgggatgggttggccggactggatcccgaccagcttaccgatagcctggagcctcttttcagtgtggtgctggagcatattcccgcgcccagtgtggatgtggaagcccctctgcagctcctggttaccacccttgattatgacgactatgtaggcaagattgtgatcgggcgcattgtccggggcaaggtccgccaaggagagaatatcgccctgatcaaacgggatggtgttttggagcgggccaaaatcggcaaagtctatacctatgaagggttgaaacgtatcgatgtgcccgaggcagaggccggcgaaatcgtggccctcaccggcttgaccactgccaatatcggggaaaccgtagccgatgccaataatccggaagctctgccggtgattgaagtggatgaacccactttgaatatgaattttattgttaacaacagcccttttgccggactggaaggggaatttgtgacctcccgcaaattaagggagcgcttattcaaggagatcgagaccaatgtgagccttcgtgtggaagaaacggattcggcggattcctttaaagtatccggccggggagagctccatttatccattctaattgagaatatgcgccgggaaggctatgagcttcaggtttccaagcccgaggttatctataagatgattgacggggagaaatgtgaaccgattgagtatcttatctgtgatattccggaaaccgctatgggtacagtcattgaattgctggggaaacggaaagcggaaatgatcaatatggcccatatttcccagacccagatacgggtagaattcaaagttcccgcccgggggctgatcggctttcggggggatttcctgaccgaaacccggggcgaagggatcatgagccatgttttccacggttatgagccctataaaggcgaaataccgggcagaagccggggggttttgatcgcgtttgagaccggcgaggcgacaacctatgggctgcattccgctcaagaacggggcatcatctttattgaccccggtaccaagatttatgaaggcatgattgtgggggaaagcaaccgggaacaggacatcgaagtcaatgtggccagaaaaaaacatgtcaccaatatgcgtgccagcaactctgaggaagcccttcgtttggagaaagccaaagtctttaccttggagcaggccctggaatatattgatgatgatgagttggtggagatcacaccgaagagcgttcgcttgcggaaaaagcacctcgacaaaaatgcccgtgtccgctatgccaaatccctggcttccaacagcgcaaaatga

SEQ ID NO: 3888 - protein, 610 aa, Desulfitobacterium hafniense DCB-2
MKSMNIRNIAIIAHVDHGKTTLVDAMLRQSGTFRANQNVMERVMDSNDLERERGITILSKNTAVNWLDTKINIVDTPGHADFGGEVERVLKMVNGVLLIVDSFEGPMPQTRFVLRKALELKLVPIVVINKIDRPDARPAEVVDEVLDLFIELGADEEQLDFPVVYASARDGLAGLDPDQLTDSLEPLFSVVLEHIPAPSVDVEAPLQLLVTTLDYDDYVGKIVIGRIVRGKVRQGENIALIKRDGVLERAKIGKVYTYEGLKRIDVPEAEAGEIVALTGLTTANIGETVADANNPEALPVIEVDEPTLNMNFIVNNSPFAGLEGEFVTSRKLRERLFKEIETNVSLRVEETDSADSFKVSGRGELHLSILIENMRREGYELQVSKPEVIYKMIDGEKCEPIEYLICDIPETAMGTVIELLGKRKAEMINMAHISQTQIRVEFKVPARGLIGFRGDFLTETRGEGIMSHVFHGYEPYKGEIPGRSRGVLIAFETGEATTYGLHSAQERGIIFIDPGTKIYEGMIVGESNREQDIEVNVARKKHVTNMRASNSEEALRLEKAKVFTLEQALEYIDDDELVEITPKSVRLRKKHLDKNARVRYAKSLASNSAK

SEQ ID NO: 3889 - DNA, 1830 bp, Vibrio sp. Ex25
  CDS (1)..(1830): transl_table=11
atggctactccacagattgataaattaagaaatatcgcgatcatcgcgcacgttgaccacggtaaaaccacgttggttgacaagctgctacaacaatcaggcacgcttgagtctcgcggtgaagctgaagagcgagtcatggactcgaacgacatcgagaaagagcgcggtattaccattcttgctaaaaacacagcaatcgactggaacgattaccgtatcaacatcgtagatactccgggacacgcggacttcggtggcgaagttgaacgtatcatgtcgatggtagactctgtactacttatcgttgacgcggttgatggtccaatgcctcaaacgcgtttcgtaacacaaaaagcgtttgctcatggtctaaaaccaatcgttgttatcaacaagattgaccgccctggcgcacgtcctgattgggttatggaccaagtgttcgacctattcgacaacctaggtgcttctgacgaacagttagactttaaagtggtttacgcttctgctcttaacggttgggcttctctagaagaaggcgaaactggcgagaacatggaaccgctattcgaaactatcgttggcgaagtagctgcaccagcagttgacctagatggtccactacagatgcaaatctctcagttggattacagctcttacgttggcgttatcggcgttggccgtgtaactcgtggtagcgttaagccaaaccagcaagtaacggttgttggtgcagacggcaaaactcgcaacggtaaagtgggcacagtaatgggctacctaggcctagagcgtcacgaagttgagcaagctaacgcgggtgatatcattgcaatcactggtcttggcgagcttaaaatctctgacactatctgtgcacaaaacgcagtagaagcactaccagcactgtctgttgatgaaccaacagtaaccatgacgttccaagtaaacacgtctccattcgctggtaaagaaggtaagttcgtcacttcacgtaacatccttgagcgtctagagaaggaactggtacacaacgttgcactgcgcgttgaacaaacagacgatccagacaaattccgcgtatcaggccgtggtgagcttcacctgtctatcctgatcgaaaacatgcgtcgtgaaggcttcgagcttgccgtatctcgtccagaagtaatcatcaaagaagaagatggtcagctaatggaaccgtttgaaacggtaactatcgacgtaatggaagagcaccaaggcggtatcatggagaatatcggcctacgtaaaggtgagctgaaagatatggctccagacggtaaaggccgtgtacgtatggacttcatcatgccatctcgtggtctgatcggcttccaaacggaattcatgacactgacttctggttctggtcttctataccatacgtttgaccactacggcccacacaaaggcggtaacatcggtcagcgtatcaacggtgttctgattgctaacgctgcgggtaaagcgctaactaacgcactgttcaaccttcaagaacgtggtcgtctatttatcggtcacggtgtggaagtttacgaaggcatggttatcggtattcacagccgcgacaacgacctaacagtaaacgcactgaaaggtaagcagctaaccaacgttcgtgcatctggtacagatgacgcacaggttctaactccgccaatcatcatgacactagagcaagcgcttgagttcatcgatgacgacgagctagtagaagtaacacctgaaagcatccgtatccgtaagaaattcctaacggaaagcgatcgtaaacgtgcttctcgtggcgcgaaataa

SEQ ID NO: 3890 - protein, 609 aa, Vibrio sp. Ex25
MATPQIDKLRNIAIIAHVDHGKTTLVDKLLQQSGTLESRGEAEERVMDSNDIEKERGITILAKNTAIDWNDYRINIVDTPGHADFGGEVERIMSMVDSVLLIVDAVDGPMPQTRFVTQKAFAHGLKPIVVINKIDRPGARPDWVMDQVFDLFDNLGASDEQLDFKVVYASALNGWASLEEGETGENMEPLFETIVGEVAAPAVDLDGPLQMQISQLDYSSYVGVIGVGRVTRGSVKPNQQVTVVGADGKTRNGKVGTVMGYLGLERHEVEQANAGDIIAITGLGELKISDTICAQNAVEALPALSVDEPTVTMTFQVNTSPFAGKEGKFVTSRNILERLEKELVHNVALRVEQTDDPDKFRVSGRGELHLSILIENMRREGFELAVSRPEVIIKEEDGQLMEPFETVTIDVMEEHQGGIMENIGLRKGELKDMAPDGKGRVRMDFIMPSRGLIGFQTEFMTLTSGSGLLYHTFDHYGPHKGGNIGQRINGVLIANAAGKALTNALFNLQERGRLFIGHGVEVYEGMVIGIHSRDNDLTVNALKGKQLTNVRASGTDDAQVLTPPIIMTLEQALEFIDDDELVEVTPESIRIRKKFLTESDRKRASRGAK

SEQ ID NO: 3891 - DNA, 1821 bp, Alteromonadales bacterium TW-7
  CDS (1)..(1821): transl_table=11
atgagcatcgaacagttaagaaatatagcgattatcgcgcacgttgaccacggtaaaacaactctggttgacaaactacttgagcaatcaggtacattagaaacacgcggcggtaacgaagagcgcgtgatggactcaaacgacattgagaaagaacgtggtattaccattttagctaaaaacacagctatctcttggaatgattaccatatcaatatcgtagataccccgggacacgccgatttcggtggtgaagttgaacgcgtactttcgatggctgactcagtattattacttgttgatgctcaagaaggtccaatgccacaaacgcgtttcgtaacgcaaaaggcattcgcgcaaggcttaaagccaatcgtcgttatcaataaaattgataagccaggtgcacgcccagattgggttatggatcaaatctttgatttattcgataaccttggtgcaactgatgaacagttagactttaaagtaatctacgcatcagctatcaacggctgggcgacattagatttagacgagccatcagacaacatggaacctatgttcaagatgatcgttgacgaagtatcaccaccggatgcagatcctgaaggtgacttccaaatgcaaatctctcagcttgattacaactcgtacaaaggtgtaatcggtattggtcgtattaaacgtggttctgttgcgactaaccaacaagttacagttattggcgctgacggcacgactcgtaacggtaaaattggttcagtacaaagctacttaggccttgagcgtatcgatactgataaagcttatgctggtaacatcgtaaccgttactggtcttggtgagcttaagatttcagatacgctttgttgtcctaacaatgttgaagcattaccaccactaagtgttgatgagcctacagttacaatgacgttctctgtaaataactctccgttctgtggtaaagaaggtaagtttgtaacatcacgtaatattcgtgaacgtttagacaaagaattagtacacaacgtagcacttcgtgttgcagatactgacaatccagatagcttccgcgtatcaggtcgtggtgaattacacctaggtatcttaattgagaacatgcgtcgtgaaggttatgagcttgctgtatctcgtccagaagtaatcttacgtactgttgatggcgtgttagaagaaccgtatgaaacactaacgattgactgtgaagaagagcaccaaggttctatcatggagcaaattggtcttcgtaagggtgaacttactgacatggcaccagatggtaaaggccgtatgcgtatggactttatgatcccaagccgtggcttaatcggtttccaaactgagttcatgacattaacgtcgggttctggtttactttaccatacgttcgatcactacggtccgcacaaaggtggcgagctaggtgttcgtaagaacggcgtaatgattgcaaacgcaacaggtaaagcacttactaacgcattatttaacttacaagagcgcggccgtttattcatcggtcacggtgttgaagtttatgaaggtatggttatcggtattcatagccgcgataacgaccttactgttaacgcgcttaaaggtaagcaacttactaacgttcgtgcatctggtacagatgaagcacaaacattgacaccacatctgaactattcacttgagcaagcgcttgagtttattgctgatgatgagttagtagaagttacacctgagaacattcgtattcgtaaacgtcatttaactgaaaatgagcgtaaacgtgcgggtcgtgctcctaagtaa

SEQ ID NO: 3892 - protein, 606 aa, Alteromonadales bacterium TW-7
MSIEQLRNIAIIAHVDHGKTTLVDKLLEQSGTLETRGGNEERVMDSNDIEKERGITILAKNTAISWNDYHINIVDTPGHADFGGEVERVLSMADSVLLLVDAQEGPMPQTRFVTQKAFAQGLKPIVVINKIDKPGARPDWVMDQIFDLFDNLGATDEQLDFKVIYASAINGWATLDLDEPSDNMEPMFKMIVDEVSPPDADPEGDFQMQISQLDYNSYKGVIGIGRIKRGSVATNQQVTVIGADGTTRNGKIGSVQSYLGLERIDTDKAYAGNIVTVTGLGELKISDTLCCPNNVEALPPLSVDEPTVTMTFSVNNSPFCGKEGKFVTSRNIRERLDKELVHNVALRVADTDNPDSFRVSGRGELHLGILIENMRREGYELAVSRPEVILRTVDGVLEEPYETLTIDCEEEHQGSIMEQIGLRKGELTDMAPDGKGRMRMDFMIPSRGLIGFQTEFMTLTSGSGLLYHTFDHYGPHKGGELGVRKNGVMIANATGKALTNALFNLQERGRLFIGHGVEVYEGMVIGIHSRDNDLTVNALKGKQLTNVRASGTDEAQTLTPHLNYSLEQALEFIADDELVEVTPENIRIRKRHLTENERKRAGRAPK

SEQ ID NO: 3893 - DNA, 1806 bp, marine gamma proteobacterium HTCC2143
  CDS (1)..(1806): transl_table=11
gtgatagaaaaacttcgtaacatcgcgattattgcccacgttgaccatggtaaaacgactttggttgataaattactggcacagtctggaaccttggagcgccgcgatgaaggtgctgagcgtgtcatggactccaacgaccaggagaaagagcgcggcattactattctggcaaaaaatactgccattgagtggaatggctaccatatcaatatcgttgatacaccaggacatgccgacttcggtggcgaggttgagcgcgtgttgtcgatggtggattgtgtgctgctattggttgatgctgttgatggccctatgccgcaaacgcgttttgtaacttccaaggcttttgagcagggtctaaatcctattgtcgtgatcaataaaatcgatcgtcctggtgctcgtcctgactgggttatggatcaagtgtttgaattgtttgataacttaggcgccaccgatgagcagctggacttccccgttatttacacctccgctatcaatggtatagccggtttggattcggaggaaatggcggaggacatgacgccgctatttgaaatgatcgttgataaagtggacgctcctgatgtcgacatagatggcccggtgcagatgcagatctcggcgttggacttctcaagttatgtaggggttatcggtgtcgggcgtatcgcccgcggcgtactcaagcctaatcaacaagtgatagtagtaggtgcggacggcaaagaaagaaaaggcagggtactgaaagttatgggtcacctaggtcttgagcgcattgaagtgtctgaagcgcgcgctggggatatcgtttgtatcacgggcattgatgggttgagtatttcagacaccttgtgtgacccagataaaattgaagcgttgccaccactgtcagtagatgagccaacggtcagcatgaccttcattgtcaatgattcgccttttgccggtaaagaagggaagtttgttaccacccgcaatatcaaagatcgcctggatcaagagctcatccacaacgtggcactgcgtgttgctgctggcgatagcccggataaatttgtggtctccggtcgcggtgaattgcacttatcggtattgattgaaacgatgcgtcgcgaaggttttgagatgtgtatctctcggcctgaggttgtccagaaagaagtggatggcaaaactcatgaaccctatgaaattgtggttatcgacattgaagatcagcatcagggctcgatcatggaagagttaggtctgcgtaaagcggaactgactaatatggagccagacggaaaaggccgtgtgcggctggaatttcttatgccttcgcgtggcttgattggtttccgtggtttgtttcttacactgacttctgggtcaggtattatgactagtatatttgctcattacggacttgctaaagagggcgatgttgccaagcgtcagaacggcgtgttggtaagcatggtcagtggtaaaacagcagcgtatgcgttgttcaatatccaaagccgaggccgtttattcctcgggcatgcggtcgatatctacgaagggcagattgttggtcttcattcacgtaacaatgatctggctattaatcccatcaagggtaaacagctcaccaatgttcgcgcatcaggtaccgacgaagcgctaacactgtcgccgccagtcacgcatacactggagcaggctttggaatttattgaagatgatgagctggtagaggtgacgccagaaagtattcgcttacgcaaaaaattattaacggaaaatgcgcgtaagcgcgctaaataa

SEQ ID NO: 3894 - protein, 601 aa, marine gamma proteobacterium HTCC2143
MIEKLRNIAIIAHVDHGKTTLVDKLLAQSGTLERRDEGAERVMDSNDQEKERGITILAKNTAIEWNGYHINIVDTPGHADFGGEVERVLSMVDCVLLLVDAVDGPMPQTRFVTSKAFEQGLNPIVVINKIDRPGARPDWVMDQVFELFDNLGATDEQLDFPVIYTSAINGIAGLDSEEMAEDMTPLFEMIVDKVDAPDVDIDGPVQMQISALDFSSYVGVIGVGRIARGVLKPNQQVIVVGADGKERKGRVLKVMGHLGLERIEVSEARAGDIVCITGIDGLSISDTLCDPDKIEALPPLSVDEPTVSMTFIVNDSPFAGKEGKFVTTRNIKDRLDQELIHNVALRVAAGDSPDKFVVSGRGELHLSVLIETMRREGFEMCISRPEVVQKEVDGKTHEPYEIVVIDIEDQHQGSIMEELGLRKAELTNMEPDGKGRVRLEFLMPSRGLIGFRGLFLTLTSGSGIMTSIFAHYGLAKEGDVAKRQNGVLVSMVSGKTAAYALFNIQSRGRLFLGHAVDIYEGQIVGLHSRNNDLAINPIKGKQLTNVRASGTDEALTLSPPVTHTLEQALEFIEDDELVEVTPESIRLRKKLLTENARKRAK

SEQ ID NO: 3895 - DNA, 1818 bp, marine gamma proteobacterium HTCC2080
  CDS (1)..(1818): transl_table=11
gtgatcagccagctgagaaatattgccatcattgcccacgtagaccacggcaaaacaacactcgtggattgtctgcttcagcagtctggaacccttgatcgtaaagccgcagggaccgagcggattatggattccaatgatcaggaaaaagagcgtggcataaccattcttgctaaaaacacggctatccgctggcaagactatcgcatcaatatcgtggacacacccggacacgcagattttggaggcgaagtagagcgtgtgttgtctatggtcgactctgtcttactgctggtagacgccgtagacgggcccatgccacagacccggtttgtcacatcgaaagcatttgaacgcggtctcaacccaattgttgtcattaacaaggtcgatcgtcccggtgccagacctgattgggtggtggatcaggtatttgatctattcgatactttgggcgccaacgaagaacaactcgacttccctattatttacgcctcggcgctaaacggtatatccggcgaagagcatgaggctatgggcacggatatgaatccgttgtttcaaacaatcgtcgataaggtccccgcaccatcggtggacacatcagggcccctgcagttgcaaatctcagccctcgactacagcagctatgtgggtgttattggcgttggtcgtattacccggggttcagtaactccaaacactcaggtggcagttatcgaccgtaatggcgacagtcgtaacggaaaaattctgcaggttatgggttatcagggcctcgagcgcgtcgaggtgagtgaggccggtgctggcgatatcgtttgcgtgacagggattgaagcgctaaatatttctgacaccttgtgcagcccagcaacgcccgagccgttgccacctttgactgtcgatgagccgacggtaagcatgacttttcaagtcaatgattcaccttttgccgggcttgaaggtaagtatgtgacgtcacgaaatattcgtgagcgtcttgagcgcgaactcatacacaacgtggcgctgcgcgtggaagagggtgactcccctgacaagttttccgtatcggggcgcggcgagttgcacctctcagtgctcatagaaagtatgcgtcgcgaaggttttgagttgggtgtctcgagacccgaagtgattcaaaaagagattgatggcgagctctgtgagccctacgaaaatttagtaatcgactgtgagtctgaacatcaaggcggtgtcatggaggagctgggcctgcgcagggccgaaatgaagaacctcgttatcgacggcaatgggcgcgttcgtcttgagtttattgttcccgccagagggttgattgggttccgttcgcaattcctaaccctcacttcgggttcgggcatcatgactcatatctttgatcactacggcccggtgaagcgggcagagttgggcggccgcgtaaatggcgttttagtatccatggttaaaggcaaaactttggcttatgcgctgtacacgctgcaggagcgaggtcgcttattcgtcgaccccaacaaggctgtgtatgaggggcagattgttggcctccatagtcgaggtaacgacttggctgtgaatccgacaaaggcaaagcagctgaccaatgttcgggcttccggtacagatgaagcacttatcctaacttccccagtgcgccacagtctcgaacaggccctggaatttattgaagatgacgagctggttgaagtgacgcctgacagcatacgattgcgaaaaaaattgctactcgaacacgaacgaaagcgagcagcccgcaccgcagcttaa

SEQ ID NO: 3896 - protein, 605 aa, marine gamma proteobacterium HTCC2080
MISQLRNIAIIAHVDHGKTTLVDCLLQQSGTLDRKAAGTERIMDSNDQEKERGITILAKNTAIRWQDYRINIVDTPGHADFGGEVERVLSMVDSVLLLVDAVDGPMPQTRFVTSKAFERGLNPIVVINKVDRPGARPDWVVDQVFDLFDTLGANEEQLDFPIIYASALNGISGEEHEAMGTDMNPLFQTIVDKVPAPSVDTSGPLQLQISALDYSSYVGVIGVGRITRGSVTPNTQVAVIDRNGDSRNGKILQVMGYQGLERVEVSEAGAGDIVCVTGIEALNISDTLCSPATPEPLPPLTVDEPTVSMTFQVNDSPFAGLEGKYVTSRNIRERLERELIHNVALRVEEGDSPDKFSVSGRGELHLSVLIESMRREGFELGVSRPEVIQKEIDGELCEPYENLVIDCESEHQGGVMEELGLRRAEMKNLVIDGNGRVRLEFIVPARGLIGFRSQFLTLTSGSGIMTHIFDHYGPVKRAELGGRVNGVLVSMVKGKTLAYALYTLQERGRLFVDPNKAVYEGQIVGLHSRGNDLAVNPTKAKQLTNVRASGTDEALILTSPVRHSLEQALEFIEDDELVEVTPDSIRLRKKLLLEHERKRAARTAA

SEQ ID NO: 3897 - DNA, 1905 bp, Candidatus Desulfococcus oleovorans Hxd3
  CDS (1)..(1905): transl_table=11
atgacgggttttgttatttcaataaacaacagagacacaacggcggctgtaaaaatgaagaagacaaacaatattcccatcagaaacatcgctatcatcgcccatgtagaccacggcaagacaacactggtggatgccatgttccggcagagcggcctgttccgtgaggggcaggcagtggatgagcggctgatggacagcatggacctggagcgggagcggggcattaccattgccgccaaaaactgcgccatccactggagagacaccaagatcaacatcattgacacgccgggccacgcggatttcggcggagaggtggagcgggcactctccatggccgacggcgccattctcctggtagacgcctccgaaggtcccctgccccagacccgttttgttctggacaaggccctgaaaagcgggctggcgattatcgtggtcatcaacaaaatcgaccgggccgatgcccgtcccgctgaagtgctggacgagatatacagcctgctcatcgaccttggcgcaacagaccggcagatcgagtgcccctgcctctatgccgtgggccggcagggtattgccatgaagtcgccggtggacaaaggagaaaacctgcacctgctgctggacatgatgatagacgaaattcccgggccgtcggccgatccggaagccccctttcagatgctggtatcggacctggggtattcggattacctgggccgcctggccgtgggccgggtggtcaacgggtcggtggaatccagaaaaaacctggtctgcctgaaggaagacggagagcaggcccctttaaaaatttccaggctccaggtatacagcggcccgggcctgaaggatgcccagcgggccgatgccggcgatattgtcgtgttgtccggcatcgaaaatgtacacatcggcgacaccatctgcaccgatgaaacgcccattgccctgccccgcatacgggttgatgaacccacggtcttcatgcggtttgccggcaacacctctcccctggccggcatggagggcaagctggtacaggccagccggatttatgcccgcctggtcaaggaaaccctcatgaacgtctctattcgggtggaggccggtgacgacagggaaagctttatcgtcaagggccggggggaattccagatggccattcttgttgagaccatgcggcgcgaagggtttgagctctgcgtgggccggccccaggtgatttaccggtatgagaacggccggcgactggagccgattgaagacctgctggtcaactgtgaggccgcctacagcggcattgtgacggaaaaacttctgcagcggaaagggaccctggtccgcatggaacgccaggacaacgaccggacccgcctggctttttcagtgccctcccgggcgttgatcgggtttcgggacgagtttctcactgatacccggggcacgggcatcatgaacagcgcccttgcgggctacgaaccttaccggggcgactttcccgggcggtttaccggcagccttgtatcggaccgccagggaaaggccgttgcctttgccctgttcaacctggaggccagggggaagctgtttacccggcccggcgaggtggtgtatgagggcatgatcatcggggagcgcaaccgggacaccgacctgaatgtcaacccctgcaagaccaaacagcttagcaacatgcgggcctcgggcaaggacgaggccgtcaccttgaccccggtgacgcccatgaccctggaaaaggccattcagtttatcggtgacgatgaaatgattgaagtgaccccgaaaagcattcggctgagaaaaaccattctctcggcccacggacgcaaggtgtttgaacgacggggcgctgttgacctatcttctgcctgcgcgtaa

SEQ ID NO: 3898 - protein, 634 aa, Candidatus Desulfococcus oleovorans Hxd3
MTGFVISINNRDTTAAVKMKKTNNIPIRNIAIIAHVDHGKTTLVDAMFRQSGLFREGQAVDERLMDSMDLERERGITIAAKNCAIHWRDTKINIIDTPGHADFGGEVERALSMADGAILLVDASEGPLPQTRFVLDKALKSGLAIIVVINKIDRADARPAEVLDEIYSLLIDLGATDRQIECPCLYAVGRQGIAMKSPVDKGENLHLLLDMMIDEIPGPSADPEAPFQMLVSDLGYSDYLGRLAVGRVVNGSVESRKNLVCLKEDGEQAPLKISRLQVYSGPGLKDAQRADAGDIVVLSGIENVHIGDTICTDETPIALPRIRVDEPTVFMRFAGNTSPLAGMEGKLVQASRIYARLVKETLMNVSIRVEAGDDRESFIVKGRGEFQMAILVETMRREGFELCVGRPQVIYRYENGRRLEPIEDLLVNCEAAYSGIVTEKLLQRKGTLVRMERQDNDRTRLAFSVPSRALIGFRDEFLTDTRGTGIMNSALAGYEPYRGDFPGRFTGSLVSDRQGKAVAFALFNLEARGKLFTRPGEVVYEGMIIGERNRDTDLNVNPCKTKQLSNMRASGKDEAVTLTPVTPMTLEKAIQFIGDDEMIEVTPKSIRLRKTILSAHGRKVFERRGAVDLSSACA

SEQ ID NO: 3899 - DNA, 1821 bp, Pseudomonas putida GB-1
  CDS (1)..(1821): transl_table=11
gtgatcgaaaatctgcgtaacatcgccatcatcgcccacgttgaccatggtaaaaccaccctggtcgacaaactcctgcgtcaatccggcactctggagcgtaacgagctcaacgacgagcgcgtcatggactccaacgaccaggaaaaagagcgcggtattaccattctggcgaaaaacaccgccatcaactggaacggctaccacatcaacatcgtcgacacccccggccacgccgacttcggtggcgaggttgagcgtgtaatgtcgatggtcgactccgtgctgctgctggtcgacgcccaggacggcccaatgccgcaaacccgcttcgtgaccaagaaggccttcgaagccggcctgaagccaatcgtcgtgatcaacaaggttgaccgtccgggcgcacgtcctgactgggttctggaccagatcttcgacctgttcgacaacctcggcgctaccgacgagcagctggacttcaaagtggtctacgcctcggccctgaacggcattgccggtctggaccacaccgaaatgggcgaagacatgaccgccctgtaccagtcgatcatcgacaacgtaccggctccttccgttgaccgtgacggcccgttccagatgcaaatctcggcactggactacaacagcttcctcggcgttatcggtgttggccgtatcgcccgtggtcgcgtcaagccgaacaccccggttgtcgccatcgacaccaacggcaagaagcgtaacggccgtatcctgaagctgatgggtcaccatggcctgcaccgcatcgacgtcgaagaagcccaggctggcgacatcgtctgcatcagcggtttcgacgagctgttcatctccgacaccctgtgcgccccggacgcggtagaagcgatgaagccgctgaccgttgacgagccaaccgtttcgatgaccttccaggtcaacgactcgccgttctgcggtaaagaaggcaagttcgtcaccagccgtaacatcaaggaccgtctggacaaggagctgctgtacaacgttgctctgcgcgttcaggaaaccgattccccagacaagttcaaggtttcgggccgtggtgagctgcacctgtcggtactgatcgaaaccatgcgtcgtgaaggcttcgagatggctgtgggccgtcctgaagtgatcatccgcgaagtcgacggcgtcaagcaggaaccgttcgagaacgtcaccatcgacatccctgaagaatcccagggcaaggtgatggaagagatgggtctgcgtaaaggcgacctgaccaacatggttccggatggcaaaggccgtgttcgcctggagtacaacattccagcccgtggtctgatcggtttccgtaaccagttcctgaccctgaccaacggtgcaggcatcctgacctcgatcttcgatcgctacgacaccatgaagtcgggccagatgtccggccgcctcaacggcgtactggtttcggtcgagaccggcaaggcgctgacctactcgctggaaaccctgcaggcacgtggcaagctgttcgttgaacacggccaggagatctacaacggtcagatcatcggcctgaacagccgcgataacgacctgggcgtgaacccgaccaaaggcaagaagctcgacaacatgcgtgcttcgggcaaagacgaagtcatcgccctggtaccgccagttcgccacaccctcgagcaggccctggaattcatccaggacgacgagctgtgcgaagtgacgccgaagtcgatccgtctgcgcaagaagatcctggacgaaggcgagcgtacccgcgctgccaagaaagccaagaactga

SEQ ID NO: 3900 - protein, 606 aa, Pseudomonas putida GB-1
MIENLRNIAIIAHVDHGKTTLVDKLLRQSGTLERNELNDERVMDSNDQEKERGITILAKNTAINWNGYHINIVDTPGHADFGGEVERVMSMVDSVLLLVDAQDGPMPQTRFVTKKAFEAGLKPIVVINKVDRPGARPDWVLDQIFDLFDNLGATDEQLDFKVVYASALNGIAGLDHTEMGEDMTALYQSIIDNVPAPSVDRDGPFQMQISALDYNSFLGVIGVGRIARGRVKPNTPVVAIDTNGKKRNGRILKLMGHHGLHRIDVEEAQAGDIVCISGFDELFISDTLCAPDAVEAMKPLTVDEPTVSMTFQVNDSPFCGKEGKFVTSRNIKDRLDKELLYNVALRVQETDSPDKFKVSGRGELHLSVLIETMRREGFEMAVGRPEVIIREVDGVKQEPFENVTIDIPEESQGKVMEEMGLRKGDLTNMVPDGKGRVRLEYNIPARGLIGFRNQFLTLTNGAGILTSIFDRYDTMKSGQMSGRLNGVLVSVETGKALTYSLETLQARGKLFVEHGQEIYNGQIIGLNSRDNDLGVNPTKGKKLDNMRASGKDEVIALVPPVRHTLEQALEFIQDDELCEVTPKSIRLRKKILDEGERTRAAKKAKN

SEQ ID NO: 3901 - DNA, 1812 bp, Marinobacter sp. ELB17
  CDS (1)..(1812): transl_table=11
gtgattgaaaagcttcgtaatatcgccattattgcccacgttgaccatggtaaaaccacgctggtcgacaaactgctgcgcctctctggcaccctggaccgtaaagagctcgaaagcgagcgcgttatggattccaacgatcaggaaaaagaacgtggcatcactattttggccaaaaacaccgcgctgaaatggaacggctacgacatcaatatcgtagacaccccggggcacgccgattttggcggcgaagtggaacgtgtaatgagcatggtggactgtgtgctgttggtggttgattccatcgacggcccgatgccacaaactcgctttgtaacccagaaagcctttgctgcgggtttgcgcccgattgtcatcgttaacaaaattgaccgcccgggcgcccgcccggactgggttgtagagcaggtatttgacctgtttgacagcctgggcgctaccgacgagcagctggacttcccgattgtttacgccagtgcgcttaacggtatttccggtttggagcatgaaaacctgatcgacaacatggacccggtatttcaggccatcgttgaccacgtgccggcaccgaatgttgatcgggaaggtgctttccaaatgcagatatcgcagctggactacaacagttttctgggcgttatcggtattggtcgcattgcccgcggcaagataaaaaccaacacacaggtgattgccatcggcaccgacggcaaaaagcgccagggccgtattttgaaaattatgggccactctggcctgcatcgggttgaagtggacgaagcccaggctggcgatattatttgtgtcagcggtctggaccagattcacatctccgacaccctgtgtgacatcaataacgtagaggctttgccgccgctgacggttgacgagcccaccgtgtccatgacgtttcaggtcaacgattcgcccttctgcggtagagaaggcaagttcgtgaccagccgtaacctcaaagatcgccttgaaaaagagctgctgtacaacgtagccctgcgggttgaagacggcgacaccatggacaagttcaaggtgtctggccgtggcgagctgcacctgtcggtgttgattgaaaacatgcgtcgggaaaacttcgagctggccgtaggccgcccggaagtggtcatcaaggtagtggatggggtgaagcaagagccctatgaaaatgtcatcgttgaccttgaagagcagcaccaaggcccgttgatggagcagtttggattgcgcaggggcgaactcaccaatatggttcccgatggtaaaggtcgcatgcgcctggaatacatcattccggcccgcggcctaattggctttcggaactcgtttctgaccatgacatccggtaccggtattctgacttcgaccttcagccattacggcccgatcaaggccggtgaagtcgccagtcgccagaacggcgttctggtttccatggccacaggcacggcgctgacttactcgctggaaaccctgcaaagccgcggcaagctgttccttgacccaggccagtctgtttacgaaggccagttgtgtggcattcacagccgcgacagcgatctggtgatcaacccaaccaagggtaagaaactggataacatgcgcgcgtctggcaaagacgaagtgattcctttggtcccgcccatcaaacacaccctggagcaggcgctggagtttattgacgacgacgagctggtggaagtaacgcccaagtcgatccgtttgcgcaagaagcacctgactgaaaacgatcgtaagcgcgccggcaagaagtaa

SEQ ID NO: 3902 - protein, 603 aa, Marinobacter sp. ELB17
MIEKLRNIAIIAHVDHGKTTLVDKLLRLSGTLDRKELESERVMDSNDQEKERGITILAKNTALKWNGYDINIVDTPGHADFGGEVERVMSMVDCVLLVVDSIDGPMPQTRFVTQKAFAAGLRPIVIVNKIDRPGARPDWVVEQVFDLFDSLGATDEQLDFPIVYASALNGISGLEHENLIDNMDPVFQAIVDHVPAPNVDREGAFQMQISQLDYNSFLGVIGIGRIARGKIKTNTQVIAIGTDGKKRQGRILKIMGHSGLHRVEVDEAQAGDIICVSGLDQIHISDTLCDINNVEALPPLTVDEPTVSMTFQVNDSPFCGREGKFVTSRNLKDRLEKELLYNVALRVEDGDTMDKFKVSGRGELHLSVLIENMRRENFELAVGRPEVVIKVVDGVKQEPYENVIVDLEEQHQGPLMEQFGLRRGELTNMVPDGKGRMRLEYIIPARGLIGFRNSFLTMTSGTGILTSTFSHYGPIKAGEVASRQNGVLVSMATGTALTYSLETLQSRGKLFLDPGQSVYEGQLCGIHSRDSDLVINPTKGKKLDNMRASGKDEVIPLVPPIKHTLEQALEFIDDDELVEVTPKSIRLRKKHLTENDRKRAGKK

SEQ ID NO: 3903 - DNA, 1845 bp, Bacillus sp. SG-1
  CDS (1)..(1845): transl_table=11
ttgaatttaagaaatgatttaagaaatatagcgattattgcccacgttgaccacggtaaaactacattagtcgacgagttgttaaaacaatcaggtatcttccgtacaaatgagcatgttgaagagcgtgccatggattccaatgatcttgaaagagaacgaggaatcacaatcttagccaaaaatacagcaattcaatataaagatactcgtatcaacatccttgatacaccaggacatgctgacttcggtggagaagttgaacgtattatgaaaatggttgacggcgttctgcttgttgtcgatgcttatgaagggtgtatgccacagactcgttttgttcttaagaaagccctggagcaaaacttaacaccaatcgttgtcgttaataaaattgataaagattcagcacgacctgaagaagtcattgatgaagtattggagcttttcatcgagcttgatgccaatgaagaccagctggaattcccggttgtttatgcttcagcaatcaacggtaccgcaagcacagatccggatccagctaaccaggacgaaaacatgcaatgcttatatgaatcagtaattgagcatataccagctccaatcgataatcgtgaagagccgcttcaattccaggtagcacttcttgattacaacgattacgtaggacgtattggtatcggacgcgtattcagagggacaatgaaagttggacagcaagtagcattgatgaaaattgatggaagtgtgaaaaacttccgtgtaacaaaaatcttcggtttcatgggcttgaagcgcgttgagattcaagaagcccatgctggtgatttaatcgcggtatcaggtatggaagatatcaatgttggtgaaacagtttgtcctatcgatcatcaggatcaacttcctgtgcttcgaatcgacgaacctacacttcaaatgacattcctggttaataacagtcctttcgctggccgtgaaggaaagtatgttacttccagaaagattgaagaaagattgcttgcacagctgcaaactgatgtcagcttgcgtgttgaaaacacggattcacctgatgcttggacagtttccggccgtggtgagcttcacctttctatcttgattgaaaacatgcgccgtgaaggatttgagcttcaagtttcaaaaccggaagttatcgtgcgtgaaattgacggtgtgaaatgtgagcctgtagaacgcgttcaaatcgatgttcctgaagagtatacaggaagcatcatcgaatccatgggaactcgtaaaggtgaaatgctcgacatgatcaacaatggcagcgggcaagtaagattgatctttatggtgcctgcgcgtggattgatcggttactcaacagaattcatgactctaactcgtggttatggaatcatcaaccatacattcgacagctaccagcctatgcaaaaaggtcaagtcggaggccgtagacaaggtgttatcgtttcaatggaaacaggtaaatcttctcaatatggtattatgggagtagaagaccgtggaactatcttcgttgagcctggtacagaaatctatgcaggtatgatcgttggagaacatacacgcgagaatgatattacagtaaatatcacaaaaacaaagcaggcgactaacgttcgttctgcaaataaagatcaaacggtaacgattaagaaagcacgtatcatgactcttgaagaatcattggaatatctgaatgatgatgagtactgtgaagtgacaccggaatctattcgtcttcgcaaaaagattcttgataaaaatgaacgtgaaagagttactaaaaagaaaaaggtagctgaaactaactaa

SEQ ID NO: 3904 - protein, 614 aa, Bacillus sp. SG-1
MNLRNDLRNIAIIAHVDHGKTTLVDELLKQSGIFRTNEHVEERAMDSNDLERERGITILAKNTAIQYKDTRINILDTPGHADFGGEVERIMKMVDGVLLVVDAYEGCMPQTRFVLKKALEQNLTPIVVVNKIDKDSARPEEVIDEVLELFIELDANEDQLEFPVVYASAINGTASTDPDPANQDENMQCLYESVIEHIPAPIDNREEPLQFQVALLDYNDYVGRIGIGRVFRGTMKVGQQVALMKIDGSVKNFRVTKIFGFMGLKRVEIQEAHAGDLIAVSGMEDINVGETVCPIDHQDQLPVLRIDEPTLQMTFLVNNSPFAGREGKYVTSRKIEERLLAQLQTDVSLRVENTDSPDAWTVSGRGELHLSILIENMRREGFELQVSKPEVIVREIDGVKCEPVERVQIDVPEEYTGSIIESMGTRKGEMLDMINNGSGQVRLIFMVPARGLIGYSTEFMTLTRGYGIINHTFDSYQPMQKGQVGGRRQGVIVSMETGKSSQYGIMGVEDRGTIFVEPGTEIYAGMIVGEHTRENDITVNITKTKQATNVRSANKDQTVTIKKARIMTLEESLEYLNDDEYCEVTPESIRLRKKILDKNERERVTKKKKVAETN

SEQ ID NO: 3905 - DNA, 1821 bp, Erythrobacter sp. SD-21
  CDS (1)..(1821): transl_table=11
atgtcccgcgaccttcgcaacgtggcgatcatcgcccacgtcgaccatggcaagaccacgctcgtcgaccagctcttccgccagtcgggcactttccgcgaaaaccagcgcgtcgaagagcgcgcgatggattcgaacgacctggaaaaggagcgcgggatcacgattctcgccaagtgcaccagcgtcgaatggaacggcacgcgcatcaacatcgtcgacactccgggtcacgccgacttcggcgccgaggtcgagcgcatcctctccatggtcgacggcgtcatcctgctggtcgacagcgccgaaggcccgatgccgcagaccaagttcgtcaccggaaaggcgcttggtctcggcctgcgcccgatcgtggtcgtcaacaagatcgaccgcggcgacgcgcgtccgcaggaagtgctcgacgaagtgttcgacctcttcgcttcgctggacgcgaacgacgatcagctcgacttcccttcgctttgggcttcgggccgcgacggctacgccagcgaagacgaaaccgcgcgttcgggcgatctggagccgctgttcaagctgatcgtcgaccatgtccccgcaccgggtctcgacaccgaagcgcccttcagcttcctcgccaccctgctcgaccgcgacaacttcatgggccgcgtgctcaccggccgcgtccaatcaggcaagatcgacgtcaacgatccgatccacgcgctcgacggtgatggaaatgtcgtcgaagtcggccgcgcgaccaagctcctgagcttcgacggcctcgaccgcgttccggtcgagcatgcagaagcgggcgacatcatcgcgcttgctggactcgagaaggcgaccgtttcaaacaccgtcgccgatcccagcgtgaagacgccgatcgaagcgcagccgatcgatccgccaacgctcgccatgcagttctcggtcaacgacagcccactggcaggccgcgagggcagcaaggtgacgagccgcatgatccgcgaccgtctctaccgcgaagcggaaaccaatgtggccattcgtattaccgaaagcgccgacaaggacagcttcgaagtcgccggccgcggcgaacttcagctcggtgtgctcatcgaaacgatgcgccgcgaaggcttcgaactcggcatcagccgtccgcgcgtgctgttccgtgaagagaacggccagcgcatggagccgttcgagaccgtcgtcatcgacgtggatgacgagcactccggcacggttgtcgagaagatgcagcgccgcaaggccgagctgaccgaaatgcgcccctctggccagggcaagacccgcatcaccttctccgccccgtcgcgcggccttatcggctaccacggcgaattcctgtccgatacgcgcggcacgggcatcatgaaccgcctgttcgaaaagtacgacacttatcgcgggcctatcgaaggtcgccagaacggcgtgcttatctcgatggtgccgggtgaagccgttccctatgcgctcaatgcactagaagaccgcggcgagctcttcatcggcggcggcgcgaagatctacgaaggcatggtgatcggcgagaacgccaagcccgacgatctggaagtgaacccgatgaagtcgaagcagctgacgaacttccgttcgaccggcaaggacgacgccatccgcctcactccgccgcgcgtgatgacgctggaacaggccatcgcttacatcgacgacgacgagatggtcgaagtgacgccggagaacatccgcttgcgcaaggccatcctcgatccgcacgagcgcaagcgcgccaagcgcgccgcgcagagctga

SEQ ID NO: 3906 - protein, 606 aa, Erythrobacter sp. SD-21
MSRDLRNVAIIAHVDHGKTTLVDQLFRQSGTFRENQRVEERAMDSNDLEKERGITILAKCTSVEWNGTRINIVDTPGHADFGAEVERILSMVDGVILLVDSAEGPMPQTKFVTGKALGLGLRPIVVVNKIDRGDARPQEVLDEVFDLFASLDANDDQLDFPSLWASGRDGYASEDETARSGDLEPLFKLIVDHVPAPGLDTEAPFSFLATLLDRDNFMGRVLTGRVQSGKIDVNDPIHALDGDGNVVEVGRATKLLSFDGLDRVPVEHAEAGDIIALAGLEKATVSNTVADPSVKTPIEAQPIDPPTLAMQFSVNDSPLAGREGSKVTSRMIRDRLYREAETNVAIRITESADKDSFEVAGRGELQLGVLIETMRREGFELGISRPRVLFREENGQRMEPFETVVIDVDDEHSGTVVEKMQRRKAELTEMRPSGQGKTRITFSAPSRGLIGYHGEFLSDTRGTGIMNRLFEKYDTYRGPIEGRQNGVLISMVPGEAVPYALNALEDRGELFIGGGAKIYEGMVIGENAKPDDLEVNPMKSKQLTNFRSTGKDDAIRLTPPRVMTLEQAIAYIDDDEMVEVTPENIRLRKAILDPHERKRAKRAAQS

SEQ ID NO: 3907 - DNA, 1797 bp, unidentified eubacterium SCB49
  CDS (1)..(1797): transl_table=11
atgaaagttataaatattgcaattattgcacacgtagatcacggtaaaactaccttggttgataaaattatgtatcactgtcaattatttcgtgataacgaaaacacaggtgatttaatcttagataataacgatcttgaacgtgagcgtggtattaccattacgtcaaaaaacgtttcggttatttataaagacacaaaaattaatattattgacacccctggtcacgccgattttggtggagaggtagagcgtgtattaaacatggcagatggtgtttgtttgttagtagatgcctttgagggacctatgccacaaacacgttttgtacttcaaaaagcattagacttaggtcttaagccttgtgttgtaataaacaaagttgataaagaaaactgtacaccagaactagttcacgaaaaagtctttgacttaatgtttgagcttggagcagaagagtggcagttagatttccctacagtttatggttctgcaaagaacaactggatgagtgatgactgggaaaaagaaactgaaaatgtagagccacttttagatatggttcttgagcatgtaccaacaccaaaatttgatgaaggtactcctcagttactaattacatcattagattattcttcttttacaggtcgtattgctattggtcgtttaactcgtggaactttaaaagaaggaatgcgcgtttctctagtaaaaagagacggaagtattgtaaaaactaaaatcaaagaagtacacacttttgaaggtttaggacgtaaaaaagtagaagaagttcaagctggagatatttgtgctttagtagggctagaaggttttgagattggagatactgttgcagatatcgaaaatccagaaggactacaaacaatcgcaattgacgagcctacaatgagtatgttgtttacaattaacgattcacctttctttggtaaagatggaaagtttgtaacatctcgtcatattagagaacgtcttgaaaaagaacttgagaaaaacttagccttacgtttagaagaaacaggaagtgccgataaatttttagtatttggtcgtggtatcttgcacttatctgtactaattgaaactatgcgtcgtgaagggtatgaacttcaaataggacaaccacaagtaatcattaaagaaattgatggtgttaaatgtgagccagtagaagagttaactatagatttaccagaaaatgttagtggtacagctgtaaactttgtaaccatccgtaaaggagaaatggtttctatggaagctaaaggagaccgtatggtttgcgaatttataatcccttctagaggtattattggtttacgtaatcaattattaacagctacggcaggtgaagcaataatgacacaccgttttcttgagtatcagcctttaagaggtggtattccagaacgtcaaaatggatctttagtatctatggaaaatggatctgcgatcccttactctattgataaattacaagatagaggtcgtttctttgtaaaccctaatgaagatatctacgaaggacaagtaattggagagaacacacgtcaagatgatatggaagtaaatatcacaaagactaaaaaactttctaacgtacgttctagtggagcagatgacaaggcaaaaattgtcccagctatcaaattctctttagaagaagctctagaatttatacaaaaagatgagtacgtagaagtaacacctaatcacttacgtatccgtaaagtgtttttaaaggctgtagacagaaagcgtaataaaatcacataa

SEQ ID NO: 3908 - protein, 598 aa, unidentified eubacterium SCB49
MKVINIAIIAHVDHGKTTLVDKIMYHCQLFRDNENTGDLILDNNDLERERGITITSKNVSVIYKDTKINIIDTPGHADFGGEVERVLNMADGVCLLVDAFEGPMPQTRFVLQKALDLGLKPCVVINKVDKENCTPELVHEKVFDLMFELGAEEWQLDFPTVYGSAKNNWMSDDWEKETENVEPLLDMVLEHVPTPKFDEGTPQLLITSLDYSSFTGRIAIGRLTRGTLKEGMRVSLVKRDGSIVKTKIKEVHTFEGLGRKKVEEVQAGDICALVGLEGFEIGDTVADIENPEGLQTIAIDEPTMSMLFTINDSPFFGKDGKFVTSRHIRERLEKELEKNLALRLEETGSADKFLVFGRGILHLSVLIETMRREGYELQIGQPQVIIKEIDGVKCEPVEELTIDLPENVSGTAVNFVTIRKGEMVSMEAKGDRMVCEFIIPSRGIIGLRNQLLTATAGEAIMTHRFLEYQPLRGGIPERQNGSLVSMENGSAIPYSIDKLQDRGRFFVNPNEDIYEGQVIGENTRQDDMEVNITKTKKLSNVRSSGADDKAKIVPAIKFSLEEALEFIQKDEYVEVTPNHLRIRKVFLKAVDRKRNKIT

SEQ ID NO: 3909 - DNA, 1818 bp, Moritella sp. PE36
  CDS (1)..(1818): transl_table=11
gtgctagagaaactacgcaacattgcgattatcgctcacgttgaccatggtaaaaccactttagttgacaagttattagaacagtcaggtactttaaaaacacgtggtggtaatgaagaacgtgtaatggattctaacgatcttgaaaaagaacgtggtattactattcttgctaaaaacacagcaattatgtggaaagattaccgtatcaacatcgtagatactcctggacacgccgatttcggtggtgaagttgagcgtattatgtctatggtagacagtgtatgtttgatcgttgacgcagttgatggccctatgccacaaacgcgtttcgtaacacaaaaagcatttgcacacggtcttaagccaattgttgttatcaacaaaatcgataagcctggtgctcgccctgattgggttatggatcaaatctttgatttattcgacaacctaggcgcaactgatgaacagttagactttaaagttgtttacgcttcagcactaaatggctgggctaacggtgagtcagatgaaccaactgaaaacatggaacctttgttccaagctattgttgaccatgttgctccacctgaaggcgatcgtgacggtgatttccaaatgcaaatttcgcaacttgatcacaacgcatatgttggcgtgatcggtgttggccgtgtaacgcgtggttctgttaaagtaaatcaacaagttactgttattggttctgacggtaaagagcgtaaaggtaaagttggccaagtattaggttacttaggtcttgaacgtcatgatgttgaacttgcagaagcgggcgatatcattgcagtaactggcttaggcgaacttaaaatttctgacactatctgtgcacagaataatgttgaagcgctaccaccgttatcagttgatgaaccaactgtaacaatgacgttccaagtaaacaactcaccattctgtggtaaagaaggtaaatttgttacatcacgtaacatccttgaccgtctgaacaaagagttagtacacaacgttgcacttaaagtagaagaaactgctgatccagataaattcaaagtatctggtcgtggtgaacttcacctaggtatcttaattgaaactatgcgtcgtgaaggtttcgagctagcagtatctcgtcctgaagttatcgaacgtatggttgacggtaagctacatgagccaatggaaacattgactattgattgtgaagagcaacatcagggttctgtaatggaacagttaggcatccgtaaagcggaactaactaacatgattccagatggtaaaggtcgtattcgtttagactttatgatcccaagccgtggtttaatcggtttccaaactgaattcctaacaatgacatctggttctggtcttctataccatagcttcgatcactacggcccccataaaggcggtactattggtcaacgtcaaaatggtgtattagtttgtaatcaaactggtaaagctgttacttactctctattcttcttacaagatcgtggtcgcctgttcttaggtcacgctacagaagtatatgaaggtcaaattgttggtattcataaccgttctaacgatttaacagttaactgtattcgtggtaaacagcttactaacgtacgttcttctggtactgatgaagcacaaacgctttcaccagcaatcgttttgactcttgagcaagcgcttgaattcatcgatattgatgaattagtagaagtaacaccgttaagcattcgtatccgtaagaaacttctttcagaaaacgatcgtaaacgtgctagccgtccagctaaataa

SEQ ID NO: 3910 - protein, 605 aa, Moritella sp. PE36
MLEKLRNIAIIAHVDHGKTTLVDKLLEQSGTLKTRGGNEERVMDSNDLEKERGITILAKNTAIMWKDYRINIVDTPGHADFGGEVERIMSMVDSVCLIVDAVDGPMPQTRFVTQKAFAHGLKPIVVINKIDKPGARPDWVMDQIFDLFDNLGATDEQLDFKVVYASALNGWANGESDEPTENMEPLFQAIVDHVAPPEGDRDGDFQMQISQLDHNAYVGVIGVGRVTRGSVKVNQQVTVIGSDGKERKGKVGQVLGYLGLERHDVELAEAGDIIAVTGLGELKISDTICAQNNVEALPPLSVDEPTVTMTFQVNNSPFCGKEGKFVTSRNILDRLNKELVHNVALKVEETADPDKFKVSGRGELHLGILIETMRREGFELAVSRPEVIERMVDGKLHEPMETLTIDCEEQHQGSVMEQLGIRKAELTNMIPDGKGRIRLDFMIPSRGLIGFQTEFLTMTSGSGLLYHSFDHYGPHKGGTIGQRQNGVLVCNQTGKAVTYSLFFLQDRGRLFLGHATEVYEGQIVGIHNRSNDLTVNCIRGKQLTNVRSSGTDEAQTLSPAIVLTLEQALEFIDIDELVEVTPLSIRIRKKLLSENDRKRASRPAK

SEQ ID NO: 3911 - DNA, 1830 bp, Magnetospirillum gryphiswaldense
  CDS (1)..(1830): transl_table=11
ttgaacgacatccccatggaactcaggaacatcgctatcatcgcccacgtcgaccacggcaaaactaccctggtcgacgccatgctcaagcaatccggcactttccgcgaaaaccagcaggttgcggaccgcgtcatggattccaatgacctggaaaaggagcgcggcatcaccattttggccaagtgcacctcggtggactggaagggcgtgcgcatcaacatcgtcgacacccccggccacgccgatttcggcggtgaagtcgaacgcatcctgtccatggtcgatggcgtggtcgtgctggtcgacgccgccgaaggcccgatgccgcagaccaagttcgtcaccggcaaggccctgggcctgggcctgcgccccatcgtcatcgtcaacaaggttgaccgtggcgacgcccgcgcccacgaagtgcacgacgaatgcttcgacctgttctcggcgctcgacgccaccgacgaacagctggacttccccaccttgttcgccgtcggtcgcgacggctgggccgccgaagcgccggaaggccccaaggatgccgggctggagccgctgttcgacctgatcctgcgccacgtaccggcgccttcgcgcgatctggaaaagccgttctccatgctggccaccaccttggaagccgacccctatctgggccgcatcctcaccggccgcatcgaaaccggcatcctgaagctgaaccaggcggttaagggcatcaacaaggatggtctggtcgagcagttccgcgccagcaagatcctgtccttccgtggcatcgatcgtgtgccggtggaaagcgccgaggccggtgacatcgtctgtctggccggcatgaccaaggtcaccgtcgccgacaccatctgcgccgccgaagtggacgagccgttgaaggcccagcccatcgacccgccgaccctggccatgatcttctcggtcaacgacagcccgctggccggcaccgaaggcgacaaggtcaccagccgcgtcatcggcgcccgtctgatgcgtgaagccgaatccaacgtcgccatccgcatcaccgagcaggattcccgcgacgccttcgaagtggcgggccgtggcgaactgcaattaggcgtgctgatcgaaaccatgcgccgtgaaggcttcgagctgtcggtgtcgcgtccgcgcgtgctgttccagaccgagaacggcaagcgcatggagccgatcgaggaagtgttcgtcgacgtcgacgacgagttctcgggcgcggtggtggaaaagatgaccctgcgcaaggccgagctgaccggcatgcgccccaccggtggcggcaagacccgtatcaccttcctggccccctcgcgcggcctgatcggttatcacggcgaattcctgaccgatacccgtggtaccggcctgatgaaccgcgtgttccacggctatgccgaatacaagggccccatcgaaggccgtcgcgccggcgtgctgatcgccaacgcttcgggcgaagcggtggcctatgccctgtggaacctggaagatcgcggcccgatgttcatccccgccggcgtcaaggtctatgaaggcatgatcatcggcgagcacaaccgcagcaacgacctggaagtcaacccgctgaaggccaagcagctgaccaacgtccgcgcctcgggcaaggacgaagcggtgcgcctgaccacgcccaggaagatgagcctggaacaggccatcgcctacatccaggacgacgagctggtggaagtgacccccaagtccatccgcctgcgcaagcgcctgcgcgacccgaacgaacgcaagaaggccagccgttcgatcgaggactaa

SEQ ID NO: 3912 - protein, 609 aa, Magnetospirillum gryphiswaldense
MNDIPMELRNIAIIAHVDHGKTTLVDAMLKQSGTFRENQQVADRVMDSNDLEKERGITILAKCTSVDWKGVRINIVDTPGHADFGGEVERILSMVDGVVVLVDAAEGPMPQTKFVTGKALGLGLRPIVIVNKVDRGDARAHEVHDECFDLFSALDATDEQLDFPTLFAVGRDGWAAEAPEGPKDAGLEPLFDLILRHVPAPSRDLEKPFSMLATTLEADPYLGRILTGRIETGILKLNQAVKGINKDGLVEQFRASKILSFRGIDRVPVESAEAGDIVCLAGMTKVTVADTICAAEVDEPLKAQPIDPPTLAMIFSVNDSPLAGTEGDKVTSRVIGARLMREAESNVAIRITEQDSRDAFEVAGRGELQLGVLIETMRREGFELSVSRPRVLFQTENGKRMEPIEEVFVDVDDEFSGAVVEKMTLRKAELTGMRPTGGGKTRITFLAPSRGLIGYHGEFLTDTRGTGLMNRVFHGYAEYKGPIEGRRAGVLIANASGEAVAYALWNLEDRGPMFIPAGVKVYEGMIIGEHNRSNDLEVNPLKAKQLTNVRASGKDEAVRLTTPRKMSLEQAIAYIQDDELVEVTPKSIRLRKRLRDPNERKKASRSIED

SEQ ID NO: 3913 - DNA, 1995 bp, Arabidopsis thaliana
  CDS (1)..(1995)
atggcggggcctttgcttcgatctctttggtcaaacaccactcgaagatccttctcttctcattcatcaccttccaaattcggatactcgctctcctccttacgctccttttcagcagccaccgcttccacagctgcagccggagctcctaatagctcgcttgaccctaatcgactaagaaacgtggctgtgatagctcatgtcgatcacgggaagacaacacttatggacaggcttcttcgtcagtgtggtgctgatatccctcacgagcgtgctatggattctattaatcttgagcgtgaacgagggatcactatttcttcaaaggtgacatcaatattttggaaggacaacgaacttaacatggtagacacacctggtcacgcagattttggtggtgaggttgaacgagtcgttggtatggttgaaggagctatattagttgttgatgctggagaaggccctcttgcacagactaagtttgttcttgccaaagccttgaagtatggactacgcccaatccttctcttaaacaaggtagatcgaccttcagagaggtgtgatgaagtggagagtttggtgtttgatctttttgcaaattgtggtgctacagaggaacaactagattttccggtgctttatgcctctgcaaaagaagggtgggcatcttctacctataccaaagaccctcctgtagatgcgaagaatatggcagatttgcttgatgccgtagtaagacatgttcagcctccaaaagcaaaccttgatgagccatttctgatgctggtttcaatgatggagaaggacttctatctcggacgaatattaactggaagagtaacttctggagttgtccgtgttggtgacagagtcaatggactacgcaaaactgattctggctctgagaaaatagaagaagcaaaggttgtgaagctaatgaaaaagaaaggtacaaccatagtttcaattgacgctgctggggctggtgatattatctgtatggctggtttgacagctccatcaataggtcacacggtggctagtgcagaggtcacaactgcactccctactgttgagttagatccaccaacaatttctatgacgtttggtgtcaatgactctccgttggctggtcaggatggcacccacttaactggaggaagaatcggggaccggttaatggcagaagctgaaacaaatcttgccataaacgttattccaggcttgtcagagtcatatgaagtccaagggagaggagaacttcaacttggtatcttgattgagaatatgaggcgggaaggttttgagctctcagtctcaccacctaaagtcatgtataaaactgaaaagggacaaaagcttgaaccaattgaagaggtgactattgagattaatgatgaacacgtaggattagtgatggaagctctctcccacaggcgggcggaagttattgacatgggccctgtccctggaaatgagggtaggacgagactgtcactaacttgtccttcaagaggtctggttgggtacagatgtgtgtttagcagcgacacacgaggaactggattcatgcatcgtgctttcctaacttatgaaaagtaccgaggtccgcttggaaatgttaggaaaggagtattggtttccatggcacgtggtactatcacagctcattctctgatgagtttggaagctcgtggaattctctttgtgtctccggggctggattcatatgatggtatgattatcggtgagcattcacgagaaacagatcttgatcttaacccagttaaggccaaagaacttacaaacattcgctctgctgggaaagacgaaaatgtgaagctatctccacctcgtcttatgacacttgaggaagctataggatacgttgcctcagatgagcttatagaggtgacaccaaagacgattcggttgaggaaaagatgtctagacgttaacaagcgtaaatcccagagcaaacgagccaaagactaa

SEQ ID NO: 3914 - protein, 664 aa, Arabidopsis thaliana
MAGPLLRSLWSNTTRRSFSSHSSPSKFGYSLSSLRSFSAATASTAAAGAPNSSLDPNRLRNVAVIAHVDHGKTTLMDRLLRQCGADIPHERAMDSINLERERGITISSKVTSIFWKDNELNMVDTPGHADFGGEVERVVGMVEGAILVVDAGEGPLAQTKFVLAKALKYGLRPILLLNKVDRPSERCDEVESLVFDLFANCGATEEQLDFPVLYASAKEGWASSTYTKDPPVDAKNMADLLDAVVRHVQPPKANLDEPFLMLVSMMEKDFYLGRILTGRVTSGVVRVGDRVNGLRKTDSGSEKIEEAKVVKLMKKKGTTIVSIDAAGAGDIICMAGLTAPSIGHTVASAEVTTALPTVELDPPTISMTFGVNDSPLAGQDGTHLTGGRIGDRLMAEAETNLAINVIPGLSESYEVQGRGELQLGILIENMRREGFELSVSPPKVMYKTEKGQKLEPIEEVTIEINDEHVGLVMEALSHRRAEVIDMGPVPGNEGRTRLSLTCPSRGLVGYRCVFSSDTRGTGFMHRAFLTYEKYRGPLGNVRKGVLVSMARGTITAHSLMSLEARGILFVSPGLDSYDGMIIGEHSRETDLDLNPVKAKELTNIRSAGKDENVKLSPPRLMTLEEAIGYVASDELIEVTPKTIRLRKRCLDVNKRKSQSKRAKD

SEQ ID NO: 3915 - DNA, 2031 bp, Ostreococcus tauri
  CDS (1)..(2031)
atgcgcgcgcacggctcacgcgcggcgtcggcgtcatcgcgcatcgccgccgacgcgaccgcggtcgtgacgacgtcgtcggcgctctgtgcgcgcgcgaacgcgtctctcggagcgtcggctcgacggatgcgcgcgatgtattcgacgatgtcgacgacgacggcggagcgcacgcgaaacgtcgccgtcatcgcgcacgtcgaccacgggaagacgacgctcatggacgctttgatgaagcgcgcgtcgggtggcgcgtcgtcggatgagcgagcgatggattcgagatctttggagaaagagcgagggatcacgatctcggcaaagtacacgagcttacattttgagctcgagggatccggggggtacgtggtgaacgcggtggacacgccgggacacgccgatttcggcggcgaagtcgagcgcgcgctcgacatggtggacgggtgcttgttgttgatcgatccgagcgagggtgtgatggcgcagacgaaattcgtgctcagaaaggcgttaaagaagggattgaagcccatcgtggtttttaataaggtggatcgagacggtgtcacggaggcgtcgtgcgcaaaagtggagacggaagtatttgatttaatggcagcgctcggcgcgaatgacgaacaactagactttccggtggcgtacgcctcggcccgagcgggtgccgcgtcttcgatctcggtcaacgacgcacagcgtcaaatcatcgaaaatagagccagcgttgacgccatattgcgactcgtatgcgatcgcgtgccgccgccgagcggagatgcgaacgagccattctcgatgctggtatcaatgatcgatcgtgatccattcctcggacgcgtcgtcaccggacgcgtcgtcaacggttcgctcaaagtaggggatagaattaacgccttaaagctcgcggatggtagcgttcgagagacggcgcgagtccaaaaaatcttcacgtcaaaatctctgagccgggtggaaatcgatcgatgcgtctccggcgacattgtcaccatagccggcttctccggagccacggtcacggacacactgtgcgacgtaagcgtcgtagatccattagcatcgacgccaatcgatccgccgacgcttcgtatgatgttcagcgtgaacgattcgagcttggcgggaaaggaaggcaagcagctaacagaacgccaaatcgaggaacggttgcgcgcagaggccgagaccgacgtcgcccttcgcgtggagccacaagctggacgagggatcgaagttcaaggacgaggagaattgcacctcggtgtgctgatcgaaactatgcgacgcgagggctttgagttgagcgtctcgccccctactgtgatttacgcaacggatgaagacggacgaaagacggaaccactcgaagaattgatactcgaggtggacgcgaacgacgttgggacggtcattgaagccgtaacccatcgtaagggtgagctcagcgatatggagccgaacgcgggcgaagaaggtcgcacgcgtctggtctttgtcgcgccttcgcgcggtttaatcggctttcgccaagatttcatcaacgcgacgcgaggtacagggttgatgcagcgcgcgttccactcctacggcgcggcacggggaaagatggacaaggtgagaaaaggcatgttgatctccaccacgtccggcgtcacgacgacgtacgcgcttggcgcgctcgaaccgcgagggacgctcttcgtcggcccggcggaggaagtgtacgaagggatgattatcggcgaacactcgcgagagaacaacttagaagtgaacccgaccaaggagaaaaaacttacgaacgttcgagccgatggaaaagacgacactgttcgattgactcctccgaaggcgatcaatctcgaagaggcgatagggtacgtcgccgaggatgaactcatcgaggtcacgccaaaggtcattcgtcttcgcaaggctgagacatcgagctcgatgcgccgtcgtaactctaggcacgcgagcgcgtag

SEQ ID NO: 3916 - protein, 676 aa, Ostreococcus tauri
MRAHGSRAASASSRIAADATAVVTTSSALCARANASLGASARRMRAMYSTMSTTTAERTRNVAVIAHVDHGKTTLMDALMKRASGGASSDERAMDSRSLEKERGITISAKYTSLHFELEGSGGYVVNAVDTPGHADFGGEVERALDMVDGCLLLIDPSEGVMAQTKFVLRKALKKGLKPIVVFNKVDRDGVTEASCAKVETEVFDLMAALGANDEQLDFPVAYASARAGAASSISVNDAQRQIIENRASVDAILRLVCDRVPPPSGDANEPFSMLVSMIDRDPFLGRVVTGRVVNGSLKVGDRINALKLADGSVRETARVQKIFTSKSLSRVEIDRCVSGDIVTIAGFSGATVTDTLCDVSVVDPLASTPIDPPTLRMMFSVNDSSLAGKEGKQLTERQIEERLRAEAETDVALRVEPQAGRGIEVQGRGELHLGVLIETMRREGFELSVSPPTVIYATDEDGRKTEPLEELILEVDANDVGTVIEAVTHRKGELSDMEPNAGEEGRTRLVFVAPSRGLIGFRQDFINATRGTGLMQRAFHSYGAARGKMDKVRKGMLISTTSGVTTTYALGALEPRGTLFVGPAEEVYEGMIIGEHSRENNLEVNPTKEKKLTNVRADGKDDTVRLTPPKAINLEEAIGYVAEDELIEVTPKVIRLRKAETSSSMRRRNSRHASA

SEQ ID NO: 3917 - DNA, 1848 bp, Pasteurella haemolytica
  CDS (1)..(1848): transl_table=11
atgcaaaatgtagatatttcaaaattgcgtaacattgcaattattgcccacgttgaccacggtaaaaccaccttggttgataaacttttacaacaatcaggcacctttggtgaaactcgtggtgacgttgatgagcgtgtaatggattccaacgatcttgaaaaagagcgtggcattaccattcttgcaaaaaatacggcaattaactggaatggttatcacatcaatatcgtagataccccagggcacgctgacttcggtggtgaggttgagcgtgtactttcaatggtagattctgttctgttagtggttgatgcctttgatggcccgatgccgcaaacccgtttcgtcacgcaaaaagcgttcgctcacggtttaaaaccaatcgtagtgatcaataaagttgaccgcccaggtgctcgccctgattgggtggtggatcaagtgttcgacttgtttgtaaatttaggtgcaagtgatgagcagttagatttcccaattatctacgcttcagccttaaatggtgtagcaggcttagaacacgaagacctagcggcagatatgaccccactttatgaagcgattgtcaaacacgttcaaccaccacaagtggaattagatgcaccattccaaatgcagatttcgcaattagactacaacaactatgtgggcgttatcggtattggacgtatcaaacgtggttcggtgaaacctaaccaagcggtaacgattgtagatagcgaaggcaaaactcgccaaggtcgtatcggtcaggtgttggggcatttaggtttacaacgttttgaagcaacagaagcctttgctggcgatattgttgcgattactggtttaggcgaattaaatatttcagatactatttgtgatattaacgcagtagaggctttaccagcattaagcgttgatgaaccaacggtaacgatgttcttctgcgtaaacacctcgccattctgcggtcaagaaggtaaatttgtgacttcacgccaaattcttgagcgtttaaacaaagaattagtccacaacgtggcattgcgtgtggaagaaacttcgaacccagacgaattccgtgtgtcaggtcgtggcgaattacacttatcggtattaatcgaaaatatgcgtcgtgaaggttacgagttagcagtgtctcgcccgaaagtaatctaccgcgaagaagacggcaaaaaacaagagccgtttgagcaagtgacgattgatatcgaagagcaacaccaaggttcagtgatggaagcacttggtatccgtaaaggtgaagtgcgtgatatgattccggacggcaaaggtcgtacccgtttagagtatgtgatcccaagccgtggcttaatcggtttccgtaacgaatttatgacgatgacctcaggtactggtttactttactctacattcagccactatgatgacgtaaaaccgggcgaaatcggtcagcgtaaaaacggtgtgttaatttctaacgcaacgggtaaggcattagcatacgcattatttggcttacaagagcgtggaaaattaatgatcgaccacggtgttgatgtatatgaagggcaaattatcgggattcacagccgttcaaacgatttaaccgtaaactgcttacagggtaagaaattaaccaatatgcgtgcatcaggtaaagacgatgccatcgttttaaccacaccggtgcgtttcactctagaacaagcgttagagtttattgacgatgacgaattagtggaagtaacaccacaatcggtgcgtattcgtaaacgtttattaactgaaaacgaccggaaacgtgcaagccgtactacaaccagtaccagcacgcactaa

SEQ ID NO: 3918 - protein, 615 aa, Pasteurella haemolytica
MQNVDISKLRNIAIIAHVDHGKTTLVDKLLQQSGTFGETRGDVDERVMDSNDLEKERGITILAKNTAINWNGYHINIVDTPGHADFGGEVERVLSMVDSVLLVVDAFDGPMPQTRFVTQKAFAHGLKPIVVINKVDRPGARPDWVVDQVFDLFVNLGASDEQLDFPIIYASALNGVAGLEHEDLAADMTPLYEAIVKHVQPPQVELDAPFQMQISQLDYNNYVGVIGIGRIKRGSVKPNQAVTIVDSEGKTRQGRIGQVLGHLGLQRFEATEAFAGDIVAITGLGELNISDTICDINAVEALPALSVDEPTVTMFFCVNTSPFCGQEGKFVTSRQILERLNKELVHNVALRVEETSNPDEFRVSGRGELHLSVLIENMRREGYELAVSRPKVIYREEDGKKQEPFEQVTIDIEEQHQGSVMEALGIRKGEVRDMIPDGKGRTRLEYVIPSRGLIGFRNEFMTMTSGTGLLYSTFSHYDDVKPGEIGQRKNGVLISNATGKALAYALFGLQERGKLMIDHGVDVYEGQIIGIHSRSNDLTVNCLQGKKLTNMRASGKDDAIVLTTPVRFTLEQALEFIDDDELVEVTPQSVRIRKRLLTENDRKRASRTTTSTSTH

SEQ ID NO: 3919 - DNA, 2007 bp, Arabidopsis thaliana
  CDS (1)..(2007)
atgatggcggggcctttgcttcgatctctttggtcaaacaccactcgaagatccttctcttctcattcatcaccttccaaattcggatactcgctctcctccttacgctccttttcagcagccaccgcttccacagctgcagccggagctcctaatagctcgcttgaccctaatcgactaagaaacgtggctgtgatagctcatgtcgatcacgggaagacaacacttatggacaggcttcttcgtcagtgtggtgctgatatccctcacgagcgtgctatggattctattaatcttgagcgtgaacgagggatcactatttcttcaaaggtgacatcaatattttggaaggacaacgaacttaacatggtagacacacctggtcacgcagattttggtggtgaggttgaacgagtcgttggtatggttgaaggagctatattagttgttgatgctggagaaggccctcttgcacagactaagtttgttcttgccaaagccttgaagtatggactacgcccaatccttctcttaaacaaggtagatcgaccttcagtcacggaagagaggtgtgatgaagtggagagtttggtgtttgatctttttgcaaattgtggtgctacagaggaacaactagattttccggtgctttatgcctctgcaaaagaagggtgggcatcttctacctataccaaagaccctcctgtagatgcgaagaatatggcagatttgcttggtgccgtagtaagacatgttcagcctccaaaagcaaaccttgatgagccatttctgatgctggtttcaatgatggagaaggacttctatctcggacgaatattaactggaagagtaacttctggagttgtccgtgttggtgacagagtcaatggactacgcaaaactgattctggctctgagaaaatagaagaagcaaaggttgtgaagctaatgaaaaagaaaggtacaaccatagtttcaattgacgctgctggggctggtgatattatctgtatggctggtttgacagctccatcaataggtcacacggtggctagtgcagaggtcacaactgcactccctactgttgagttagatccaccaacaatttctatgacgtttggtgtcaatgactctccgttggctggtcaggatggcacccacttaactggaggaagaatcggggaccggttaatggcagaagctgaaacaaatcttgccataaacgttattccaggcttgtcagagtcatatgaagtccaagggagaggagaacttcaacttggtatcttgattgagaatatgaggcgggaaggttttgagctctcagtctcaccacctaaagtcatgtataaaactgaaaagggacaaaagcttgaaccaattgaagaggtgactattgagattaatgatgaacacgtaggattagtgatggaagctctctcccacaggcgggcggaagttattgacatgggccctgtccctggaaatgagggtaggacgagactgtcactaacttgtccttcaagaggtctggttgggtacagatgtgtgtttagcagcgacacacgaggaactggattcatgcatcgtgctttcctaacttatgaaaagtaccgagatccgcttggaaatgttaggaaaggagtattggtttccatggcacgtggtactatcacagctcattctctgatgagtttggaagctcgtggaattctctttgtgtctccggggctggattcatatgatggtatgattatcggtgagcattcacgagaaacagatcttgatcttaacccagttaaggccaaagaacttacaaacattcgctctgctgggaaagacgaaaatgtgaagctatctccacctcgtcttatgacacttgaggaagctataggatacgttgcctcagatgagcttatagaggtgacaccaaagacgattcggttgaggaaaagatgtctagacgttaacaagcgtaaatcccagagcaaacgagccaaagactaa

SEQ ID NO: 3920 - protein, 668 aa, Arabidopsis thaliana
MMAGPLLRSLWSNTTRRSFSSHSSPSKFGYSLSSLRSFSAATASTAAAGAPNSSLDPNRLRNVAVIAHVDHGKTTLMDRLLRQCGADIPHERAMDSINLERERGITISSKVTSIFWKDNELNMVDTPGHADFGGEVERVVGMVEGAILVVDAGEGPLAQTKFVLAKALKYGLRPILLLNKVDRPSVTEERCDEVESLVFDLFANCGATEEQLDFPVLYASAKEGWASSTYTKDPPVDAKNMADLLGAVVRHVQPPKANLDEPFLMLVSMMEKDFYLGRILTGRVTSGVVRVGDRVNGLRKTDSGSEKIEEAKVVKLMKKKGTTIVSIDAAGAGDIICMAGLTAPSIGHTVASAEVTTALPTVELDPPTISMTFGVNDSPLAGQDGTHLTGGRIGDRLMAEAETNLAINVIPGLSESYEVQGRGELQLGILIENMRREGFELSVSPPKVMYKTEKGQKLEPIEEVTIEINDEHVGLVMEALSHRRAEVIDMGPVPGNEGRTRLSLTCPSRGLVGYRCVFSSDTRGTGFMHRAFLTYEKYRDPLGNVRKGVLVSMARGTITAHSLMSLEARGILFVSPGLDSYDGMIIGEHSRETDLDLNPVKAKELTNIRSAGKDENVKLSPPRLMTLEEAIGYVASDELIEVTPKTIRLRKRCLDVNKRKSQSKRAKD

SEQ ID NO: 3921 - DNA, 2004 bp, Arabidopsis thaliana
  CDS (1)..(2004)
atggcggggcctttgcttcgatctctttggtcaaacaccactcgaagatccttctcttctcattcatcaccttccaaattcggatactcgctctcctccttacgctccttttcagcagccaccgcttccacagctgcagccggagctcctaatagctcgcttgaccctaatcgactaagaaacgtggctgtgatagctcatgtcgatcacgggaagacaacacttatggacaggcttcttcgtcagtgtggtgctgatatccctcacgagcgtgctatggattctattaatcttgagcgtgaacgagggatcactatttcttcaaaggtgacatcaatattttggaaggacaacgaacttaacatggtagacacacctggtcacgcagattttggtggtgaggttgaacgagtcgttggtatggttgaaggagctatattagttgttgatgctggagaaggccctcttgcacagactaagtttgttcttgccaaagccttgaagtatggactacgcccaatccttctcttaaacaaggtagatcgaccttcagtcacggaagagaggtgtgatgaagtggagagtttggtgtttgatctttttgcaaattgtggtgctacagaggaacaactagattttccggtgctttatgcctctgcaaaagaagggtgggcatcttctacctataccaaagaccctcctgtagatgcgaagaatatggcagatttgcttgatgccgtagtaagacatgttcagcctccaaaagcaaaccttgatgagccatttctgatgctggtttcaatgatggagaaggacttctatctcggacgaatattaactggaagagtaacttctggagttgtccgtgttggtgacagagtcaatggactacgcaaaactgattctggctctgagaaaatagaagaagcaaaggttgtgaagctaatgaaaaagaaaggtacaaccatagtttcaattgacgctgctggggctggtgatattatctgtatggctggtttgacagctccatcaataggtcacacggtggctagtgcagaggtcacaactgcactccctactgttgagttagatccaccaacaatttctatgacgtttggtgtcaatgactctccgttggctggtcaggatggcacccacttaactggaggaagaatcggggaccggttaatggcagaagctgaaacaaatcttgccataaacgttattccaggcttgtcagagtcatatgaagtccaagggagaggagaacttcaacttggtatcttgattgagaatatgaggcgggaaggttttgagctctcagtctcaccacctaaagtcatgtataaaactgaaaagggacaaaagcttgaaccaattgaagaggtgactattgagattaatgatgaacacgtaggattagtgatggaagctctctcccacaggcgggcggaagttattgacatgggccctgtccctggaaatgagggtaggacgagactgtcactaacttgtccttcaagaggtctggttgggtacagatgtgtgtttagcagcgacacacgaggaactggattcatgcatcgtgctttcctaacttatgaagagtaccgaggtccgcttggaaatgttaggaaaggagtattggtttccatggcacgtggtactatcacagctcattctctgatgagtttggaagctcgtggaattctctttgtgtctccggggctggattcatatgatggtatgattatcggtgagcattcacgagaaacagatcttgatcttaacccagttaaggccaaagaacttacaaacattcgctctgctgggaaagacgaaaatgtgaagctatctccacctcgtcttatgacacttgaggaagctataggatacgttgcctcagatgagcttatagaggtgacaccaaagacgattcggttgaggaaaagatgtctagacgttaacaagcgtaaatcccagagcaaacgagccaaagactaa

SEQ ID NO: 3922 - protein, 667 aa, Arabidopsis thaliana
MAGPLLRSLWSNTTRRSFSSHSSPSKFGYSLSSLRSFSAATASTAAAGAPNSSLDPNRLRNVAVIAHVDHGKTTLMDRLLRQCGADIPHERAMDSINLERERGITISSKVTSIFWKDNELNMVDTPGHADFGGEVERVVGMVEGAILVVDAGEGPLAQTKFVLAKALKYGLRPILLLNKVDRPSVTEERCDEVESLVFDLFANCGATEEQLDFPVLYASAKEGWASSTYTKDPPVDAKNMADLLDAVVRHVQPPKANLDEPFLMLVSMMEKDFYLGRILTGRVTSGVVRVGDRVNGLRKTDSGSEKIEEAKVVKLMKKKGTTIVSIDAAGAGDIICMAGLTAPSIGHTVASAEVTTALPTVELDPPTISMTFGVNDSPLAGQDGTHLTGGRIGDRLMAEAETNLAINVIPGLSESYEVQGRGELQLGILIENMRREGFELSVSPPKVMYKTEKGQKLEPIEEVTIEINDEHVGLVMEALSHRRAEVIDMGPVPGNEGRTRLSLTCPSRGLVGYRCVFSSDTRGTGFMHRAFLTYEEYRGPLGNVRKGVLVSMARGTITAHSLMSLEARGILFVSPGLDSYDGMIIGEHSRETDLDLNPVKAKELTNIRSAGKDENVKLSPPRLMTLEEAIGYVASDELIEVTPKTIRLRKRCLDVNKRKSQSKRAKD

SEQ ID NO: 3923 - DNA, 2031 bp, Trifolium pratense
  CDS (1)..(2031)
atggagaaaatggcactcacttctcaaaacactttattattctcatctacatcacttcctaaaaactcttcttcaccgcttttcttttctaaacaccgtaacaaactttttggactttccttatcttcttccaaacctacccttcgaattgcttcaaggaataacaacattaaccctatcaaatgttctgtttctgaagtcactgagcctataactgaggagaagaggaaattgatgagaagagcagatattagaaatattgcaattgttgctcatgttgatcatggaaaaacaactcttgttgatgctatgctcaaacaaactaaggtgtttcgtgataatcaaactgtacaagaaaggataatggactctaatgatttggagcgcgaaagaggaatcactatactgagtaaaaatacttctgtgacttataaagatgccaagattaatataattgatactcctggtcactctgatttcggtggtgaagttgagcgcatcttgaatatggtcgaaggaatccttctagtggtagattctgttgaagggccaatgccgcagacaagatttgtcttaaagaaggctttagagtttgggcatgcggttgttgtagttgtgaataaaatagacaggtcttctgctcgccctgagtttgtcgtcaattctacttttgaactcttcattgaactaaatgcaacagatgaacagtgtgactttcaggtaatatatgcaagtggtataaaagggaaagcagggttgtctcctgaaaatctggcagaggaccttgggccattgtttgaaaccatcatgagatgtatccctggaccacgtattgataaagatggctcactccaaatgcttgtgacaagtaccgagtatgagggacataaagggcgtatagcaattgggcgcttggaagctggagttttagaaaaagggatggaggtcaaggtatgcacttcagaagattcatgtagatatgcaagagttagcgagctttatgtatatgaaaaattctttagggtccctgcagatagggtggaggctggtgatatatgtgcagtatgtggaatttctgatattcagattggggagacaattgcggataaattgactgggaaggcactaccttccattaaagtggaagaaccaacagtgaaaatggctttcgccataaacacttcaccttttgtcggtcgtgagggaaagtatgttaccagtaggaatttaagggacaggctttatcgtgaacttgagcgaaatctggctatgaaggttgaagatggtgaaacagccgatacattcattgtcagtgggcgtggaactctgcatatcactatactcattgaaaatatgcgaagggaaggatatgaattcatggttggacctcccaaagttatcaacaagaaggtgaacgacaaagtgttggagccatacgagattgcaactgtggaggtaccggaagagcacatgggagcggttgttgaacttcttggcaagagacgagggcaaatgtttgatatgcaaggagttggatcggagggaactacactagtcaaatataagatcccaacccgtggtctacttggattgaggaatgcaattttaactgcttcccgagggacagctattctaaacaccgtctttgattgctatggtccttgggccggtgatatgagcactcgggatttaggctcgctggttgcttttgagggtggaactagtacttcttatgcaattgcaagttcacaggagagggggcaaatgtttattgctcccggaactgaagtgtataaaggtcaaattattggcatccatcaacgccctggggacttggccttgaatgtttgcaagaaaaaagctgcaacaaacattcgttccaacaaggaacaatcagtgattcttgatacaccattggattacagtctggatgactgcattgagtacatccaagaagatgaactagtagagatcaccccccaaagtataagaatgagcaagaatccaaaacttgcaaagaaaggaaggtag

SEQ ID NO: 3924 - protein, 676 aa, Trifolium pratense
MEKMALTSQNTLLFSSTSLPKNSSSPLFFSKHRNKLFGLSLSSSKPTLRIASRNNNINPIKCSVSEVTEPITEEKRKLMRRADIRNIAIVAHVDHGKTTLVDAMLKQTKVFRDNQTVQERIMDSNDLERERGITILSKNTSVTYKDAKINIIDTPGHSDFGGEVERILNMVEGILLVVDSVEGPMPQTRFVLKKALEFGHAVVVVVNKIDRSSARPEFVVNSTFELFIELNATDEQCDFQVIYASGIKGKAGLSPENLAEDLGPLFETIMRCIPGPRIDKDGSLQMLVTSTEYEGHKGRIAIGRLEAGVLEKGMEVKVCTSEDSCRYARVSELYVYEKFFRVPADRVEAGDICAVCGISDIQIGETIADKLTGKALPSIKVEEPTVKMAFAINTSPFVGREGKYVTSRNLRDRLYRELERNLAMKVEDGETADTFIVSGRGTLHITILIENMRREGYEFMVGPPKVINKKVNDKVLEPYEIATVEVPEEHMGAVVELLGKRRGQMFDMQGVGSEGTTLVKYKIPTRGLLGLRNAILTASRGTAILNTVFDCYGPWAGDMSTRDLGSLVAFEGGTSTSYAIASSQERGQMFIAPGTEVYKGQIIGIHQRPGDLALNVCKKKAATNIRSNKEQSVILDTPLDYSLDDCIEYIQEDELVEITPQSIRMSKNPKLAKKGR

SEQ ID NO: 3925 - DNA, 1818 bp, Alvinella pompejana epibiont 6C6
  CDS (1)..(1818): transl_table=11
atgcaaaaaataaaaaatattgctgttattgcccatgttgaccatggaaagacaacattagttgataaacttctacaacagagtggaacatttgcctctcatcagaaggttgaagagagggctttagatagtaatgatttagagaaagagagaggtattacaatactatctaaaaatactgcaatagagtatagtggatataagattaatattatagataccccaggtcatgccgactttggtggagaggttgagagggtgttaaaaatggtagatggggttctactcctagttgatgcccaagagggtgttatgccacaaactaaatttgttcttaaaaaagcgatagagctaaatctaattcctctagtcgtcgtaaataagatagataaaccgagtgcagagccagatagagttgtaaatgaggtatttgacctattagtggcactagatgccaatgatgagcagttggagtttccaatcctatatgcagctggaaaagatggctatgcgaagtgggagattgatgatgagaatatcgatatgaaacctctatttgaggctattattgagtatgtgccatcccctagtggctcaagagataaccctacccaagctcaggtattcaccctcgatagtgataactttgtaggtagaattggtattgttaggatatttaacggtagggtaaaaaggggagaggagtatatccttgttaaagcttcaggggagaaggtgaaatctagagtatcaaagcttattggatttaaagggctggagaggatagatatcgatgaggctgaagctggagatattgtagcaattgcaggatttaatgatatagatgttggagattcgatatgtgatactaaagagcctatcccactagacccgatgcatgtggaagagcctactctatcggttgtcatatctgtaaatgatggtcctctagcaggaacggagggtaaacatgtcacatcaaataagataaaagatagacttcaaaaggagatggagacaaatattgctatgaaaatggagagtctagatgactcatcatttaaggtatctggaagaggtgagcttcagattgcaatattggctgagaatatgagaagagaggggtttgagtttctactcgctcgtccacaagtcgttattaaagaggagagtggtctaaagctagagccatttgagtatctggtgattgatgttcctgaggagtttcagggtacagtgattgagaagcttgggaagagaaaggctgagatgacggcactaaccccaatgcctgatggtacagttagattggagtttgagatacctgctagaggattaatcggatttagaagtgagttcctaactgatacaagaggcgaggggattatgaaccactcatatctagagtatagaccatatacaggtagagttgagagcagaacaaaaggggcattggtctctacagaaaatggagaagctgtggcatttgcactatttaatctacaggcgagaggtgttctgtttgtaaaacctcaagatagggtatatgtcgggatggttattggtgagtcggctagaggtggagatttagatgtaaatccaattaagagtaaacagcttacaaatatgagaaccacaagtgccgatgaggctataaagctagttcctcctaaaattttaactcttgaaggtgcgatggagtggattgaagatgatgagcttattgagataactccagataatattagagttagaaagaaggctctagaccctatcattagaaagagagaggctagggaaaagaagaagaatagataa

SEQ ID NO: 3926 - protein, 605 aa, Alvinella pompejana epibiont 6C6
MQKIKNIAVIAHVDHGKTTLVDKLLQQSGTFASHQKVEERALDSNDLEKERGITILSKNTAIEYSGYKINIIDTPGHADFGGEVERVLKMVDGVLLLVDAQEGVMPQTKFVLKKAIELNLIPLVVVNKIDKPSAEPDRVVNEVFDLLVALDANDEQLEFPILYAAGKDGYAKWEIDDENIDMKPLFEAIIEYVPSPSGSRDNPTQAQVFTLDSDNFVGRIGIVRIFNGRVKRGEEYILVKASGEKVKSRVSKLIGFKGLERIDIDEAEAGDIVAIAGFNDIDVGDSICDTKEPIPLDPMHVEEPTLSVVISVNDGPLAGTEGKHVTSNKIKDRLQKEMETNIAMKMESLDDSSFKVSGRGELQIAILAENMRREGFEFLLARPQVVIKEESGLKLEPFEYLVIDVPEEFQGTVIEKLGKRKAEMTALTPMPDGTVRLEFEIPARGLIGFRSEFLTDTRGEGIMNHSYLEYRPYTGRVESRTKGALVSTENGEAVAFALFNLQARGVLFVKPQDRVYVGMVIGESARGGDLDVNPIKSKQLTNMRTTSADEAIKLVPPKILTLEGAMEWIEDDELIEITPDNIRVRKKALDPIIRKREAREKKKNR

SEQ ID NO: 3927 - DNA, 1854 bp, Xylella fastidiosa
  CDS (1)..(1854): transl_table=11
gtgcaaaactccgggtcgtttcgcatgtccatagaaaatctccgtaatatcgccatcgttgctcacgttgaccatggtaagaccactcttgttgatcagttgcttaagcaatctgggactttcagcgaacgtgcccaggtgggtgagcgcgtgatggacagcaatgaccaggaaaaggaacgcggtatcacaattcttgctaaaaatacggcaatcaaatggaatggtaaccgcatcaacattgttgatactcctgggcatgctgattttggaggggaggttgaacgcgtattgtcgatggttgattcagtcctactgttggtggatgcaatggatgggccaatgccgcagacgcgcttcgtgactcagaaggcttttgcaatggggtttaagccgattgtggtggtcaacaagattgatcgtcctggtgctcgtccggattgggttgttgagcaggtttgggacttattcgaccgtctcggtgctacaccggagcagatggactttccgattgtctatgcctcggcactaaatggctatgccagcttggagtcaagtgcgcgggcgggggatatgaatccgctgtacgaagcgatcatgcagcacgttcaaccgccgcaagttgacctgcatggcccatttcagatgcgtatcagtcaattggactacaacagttacgttggcctcattggtattggtcggattcaacgtggcaaggtgtctactaacatgccggtgacggtcattgatcgcatgggtaataaacataatggtaaagttctccaggtactcggtttccttggtctggagcgtcatgaggttgaggaagcccaggcaggcgatatcgttgctatttcaggtattgagtcactcagtatttccgatacccttactgacccaacggccccagatgcgctgccagcattgagcgttgatgaaccgacaatcagtatgacctttcaagttaataattcgccatttgctgggcagaaggaatattcgggtgggaagttcctgacaagccgtcagatccgtgagcgcttggctcgcgaaactttacataatgttgcgttgcgtgttgaggataccgaggatcctgacagatttaaggtttccggtcgaggtgagctgcacttgtctgtcttgattgagactatgcggcgtgagggctatgaattgggtgtatcgcgcccggaagtcatcatcaaggaaatcgatggaatactccaagagccttacgagcagttagtcgtggacgtggaggaggagcatcaaggtggtgtgatagagcgcttgggcactcgtaaagctcagttgtcgaatatggagttggatggtaaggggcgcgtacgtttggattacattatcccggcgcgtggtttgattggtttccagactgagtttaaaaccatcacttctgggagcggccttctgttccacatctttgatcactacggcccgaaagctgatggtccgattgctaagcgtatcaacggtgtcatgatttctaatggtcatggcaaagcacctgggtacgctttgatgggtttgcaagaacgtgggcgtttgttgattgatgctggtgaggatatttacgaaggcatgttagttggcatccattccaaggataatgacctgaccgtcaatgcacttcgcgagaagcaattgacaaatattcgtgcttctgggaaggacgacgcaatctcattgaccccgcccattaagatgtccttggagcaggcgttagagtttatcgaagatgacgagttggttgaggtcacgccgaaggcaatccggttacggaaaaaatatcttagtgaaaatgatcgcaagcgtgccagtcgtactggctga

SEQ ID NO: 3928 - protein, 617 aa, Xylella fastidiosa
MQNSGSFRMSIENLRNIAIVAHVDHGKTTLVDQLLKQSGTFSERAQVGERVMDSNDQEKERGITILAKNTAIKWNGNRINIVDTPGHADFGGEVERVLSMVDSVLLLVDAMDGPMPQTRFVTQKAFAMGFKPIVVVNKIDRPGARPDWVVEQVWDLFDRLGATPEQMDFPIVYASALNGYASLESSARAGDMNPLYEAIMQHVQPPQVDLHGPFQMRISQLDYNSYVGLIGIGRIQRGKVSTNMPVTVIDRMGNKHNGKVLQVLGFLGLERHEVEEAQAGDIVAISGIESLSISDTLTDPTAPDALPALSVDEPTISMTFQVNNSPFAGQKEYSGGKFLTSRQIRERLARETLHNVALRVEDTEDPDRFKVSGRGELHLSVLIETMRREGYELGVSRPEVIIKEIDGILQEPYEQLVVDVEEEHQGGVIERLGTRKAQLSNMELDGKGRVRLDYIIPARGLIGFQTEFKTITSGSGLLFHIFDHYGPKADGPIAKRINGVMISNGHGKAPGYALMGLQERGRLLIDAGEDIYEGMLVGIHSKDNDLTVNALREKQLTNIRASGKDDAISLTPPIKMSLEQALEFIEDDELVEVTPKAIRLRKKYLSENDRKRASRTG

SEQ ID NO: 3929 - DNA, 1896 bp, Xanthomonas maltophilia
  CDS (1)..(1896): transl_table=11
atgttggacttctttttccaaatccggcgccgactggccccctttcgtatgtccatcgaaaatcttcgcaacatcgccatcgtcgcccacgtcgaccatggcaagaccaccctggtcgaccagctgctgaagcagtccggcaccctgtccgagcgcaccgtcctcgccgagcgcgtgatggacagcaacgaccaggaaaaggaacgcggcatcaccatcctggccaagaacaccgccatcacctgggaagacaagaagaccggtatcaagaaccggatcaacatcgtcgacacccccggccacgccgacttcggtggtgaggtcgagcgcgtgctgtcgatggtcgacaccgtgctgatcctggtcgatgcgatggacggcccgatgccgcagacccgcttcgtgacccagaaggccttcgcgatgggcttcaagccgatcgtcgtggtcaacaaggtcgaccgtccgggcgcccgtccggaatgggtgatcgaccaggtcttcgacctgttcgacaagctcggcgccaccaacgagcagctggacttcccgatcgtctacgcctcgggcctgaacggctacgccggcctggaagacaccgtgcgcgatggcgacatgaccccgctgtacgaagcgatcatgcagcacgcgccgcgtccggaagtggacccggaaggcccgttccagatgcgcatcagccagctggactacaacaacttcgtgggcgtgatcggcatcggccgcatccagcgcggcaccctgaagaagaacatgcaggtcgcggtcatcgaccgtgaaggcaagaagcgcaacggcaaggtgctgcaggtgctgggcttcatgggcctggagcgcatcgagcaggataccgccgaggccggcgacatcgtggccatctccggcatccaggagctgaccatctccgacaccatctgcgccccggacaccccggaagccctgccggcgctgaccgtcgacgagccgaccatctcgatgaccttccaggtcaacaactcgccgttcgccggcaacaaggacctgtccggtggcaagttcctgaccagccgccagatcaaggaccgcctggaccgtgaaaaggtccacaacgtggccctgaaggtcgagcagctggaagacgctgacaagttcctggtttccggccgtggcgaactgcacctgtcggtgctgatcgagaacatgcgtcgcgaaggctacgagctggccgtgtcgcgtccggaagtgatcatcaaggaaatcgacggccagatgatggagccgatcgagcagctggtggtggacatcgaagaaatccaccagggcggcgtgatggaaaagctgggcacccgcaagggccagctgaagaacatggaatcggacggcaagggccgcgtgcgcctggaatactcgatcccggcccgtggcctgatcggtttccagaacgagttcaagaccctgacccagggttcgggcctgctgttccacgtgttcgaccactacggcccgaaggaacagggcgcgatcgccaagcgcatcaacggcgtgatgatcgccaatgcgccgggcaccacgccggcctactcgctgggcccgctgcaggaacgcggcaagctgttcgctgctgaaggcgacaacgtgtatgaaggtcagctggtcggcatccactccaaggacaacgacctgaccgtcaacgcgatcaagaccaagccgctgaccaacatgcgcgcttcgggcaaggacgatgcgatccagctgaccccggcgatcaagtactcgctggaacaggccctggacttcatcgaagacgacgagctggtcgagatcaccccgaaggagatccgtctgcgcaagaagttcctgaccgaaagcgaccgcaagaaggcttcgcgcggcggctga

SEQ ID NO: 3930 - protein, 631 aa, Xanthomonas maltophilia
MLDFFFQIRRRLAPFRMSIENLRNIAIVAHVDHGKTTLVDQLLKQSGTLSERTVLAERVMDSNDQEKERGITILAKNTAITWEDKKTGIKNRINIVDTPGHADFGGEVERVLSMVDTVLILVDAMDGPMPQTRFVTQKAFAMGFKPIVVVNKVDRPGARPEWVIDQVFDLFDKLGATNEQLDFPIVYASGLNGYAGLEDTVRDGDMTPLYEAIMQHAPRPEVDPEGPFQMRISQLDYNNFVGVIGIGRIQRGTLKKNMQVAVIDREGKKRNGKVLQVLGFMGLERIEQDTAEAGDIVAISGIQELTISDTICAPDTPEALPALTVDEPTISMTFQVNNSPFAGNKDLSGGKFLTSRQIKDRLDREKVHNVALKVEQLEDADKFLVSGRGELHLSVLIENMRREGYELAVSRPEVIIKEIDGQMMEPIEQLVVDIEEIHQGGVMEKLGTRKGQLKNMESDGKGRVRLEYSIPARGLIGFQNEFKTLTQGSGLLFHVFDHYGPKEQGAIAKRINGVMIANAPGTTPAYSLGPLQERGKLFAAEGDNVYEGQLVGIHSKDNDLTVNAIKTKPLTNMRASGKDDAIQLTPAIKYSLEQALDFIEDDELVEITPKEIRLRKKFLTESDRKKASRGG

SEQ ID NO: 3931 - DNA, 1830 bp, Shewanella violacea
  CDS (1)..(1830): transl_table=11
atggtaagaggtttatctgtgttagagaatttacgtaacatcgccattattgcacacgttgaccatggtaaaactaccctggtagacaagttgctggcgcagtctggaactcttgagacccgaggagaagccgctgagcgggtgatggattcaaacgatcttgaaaaggaacgtggaatcacgattcttgcaaagaacactgccatcaagtggaatgattaccgcatcaacatcgtggatactcctggtcacgccgatttcggtggtgaagttgagcgtgtactttctatggttgattcagtattacttctagttgacgctgttgatggccctatgccacaaactcgcttcgtaactaagaaagctttcgccctaggccttaagcctattgttgttatcaacaagattgaccgccctggtgcgcgtcctgattgggttatcgaccaagtcttcgacctgttcgacaacttaggcgctaccgatgagcagttggacttcccaattgtttatgcttctgcattgaacggtttcgctggtctggagcctgaaattactgaaggcgacatgacgccactgttcgagactatcgtcgagaaagtttcttcacccgatgctgatgcaactggtgatctacagatgcagatctctcagatagattacaacaactatgttggcgttatcggtattggtcgcatcaagcgcggtagtatcaagactaaccagcaggtcactataatcagtgctgatggtactaagcgtaacggtaaagttggccaggtattaggttacatgggtcttgatcgtaacgaagttgaaatcggtaatgccggtgacatcgtggctattacaggtctaggtcaactacttatctcagatactgtctgtgcaactactaacgtagaagcattgccaccactgtctgtcgatgagcctactctgacaatgaccttccaggtcaacacctctccattcgctggtaaagaaggtaagtacgttacttcacgtaacatcttcgagcgtctgcagcgtgaattagttcacaacgtagcgctacgtgtggaagagactgaaagcccggatcgtttccgtgtttctggtcgtggtgagcttcacctgtcaattctaatcgaaaacatgcgtcgtgaaggttacgagctagctgtttctcgtccagaagttatcgttaaagagatcgatggcgagatgtgtgagccattcgaaaacttgactgttgatattgaagagcagcatcaaggttctgttatcgagaagcttggtatccgtaaagctgatatgaaagacatgcagctagacggtaagggtcgtgttcgtatcgacttcgttatcccaagtcgtggtctaatcggtttccaaactgatttcatgactgctacttctggttcaggtcttatctaccattcattcgaccattacggtccagtgaaaggcggcgatatcggtcagcgtgctcgtggcgtattgatctctaacggtactggtaaagcactgactttcgctctgtttaaccttcaggctcgtggtcgtctatttattggtcacgctgcagaagtgtatgaaggtcaggttgtcggtcttcatgctcgcgcaaatgacttaactgttaactgtttgaaaggtaagcagctgactaacatgcgtgcatcgggtaccgatgaagcacaagtactgactccacctatcaacatgacactcgagcaggcgcttgagtttatcgatgatgatgagttggtagaagtaacgccgttgaacgttcgtgttcgtaagcgttacttgaatgagaacgatcgtaagcgtcataaccgcaagtaa

SEQ ID NO: 3932 - protein, 609 aa, Shewanella violacea
MVRGLSVLENLRNIAIIAHVDHGKTTLVDKLLAQSGTLETRGEAAERVMDSNDLEKERGITILAKNTAIKWNDYRINIVDTPGHADFGGEVERVLSMVDSVLLLVDAVDGPMPQTRFVTKKAFALGLKPIVVINKIDRPGARPDWVIDQVFDLFDNLGATDEQLDFPIVYASALNGFAGLEPEITEGDMTPLFETIVEKVSSPDADATGDLQMQISQIDYNNYVGVIGIGRIKRGSIKTNQQVTIISADGTKRNGKVGQVLGYMGLDRNEVEIGNAGDIVAITGLGQLLISDTVCATTNVEALPPLSVDEPTLTMTFQVNTSPFAGKEGKYVTSRNIFERLQRELVHNVALRVEETESPDRFRVSGRGELHLSILIENMRREGYELAVSRPEVIVKEIDGEMCEPFENLTVDIEEQHQGSVIEKLGIRKADMKDMQLDGKGRVRIDFVIPSRGLIGFQTDFMTATSGSGLIYHSFDHYGPVKGGDIGQRARGVLISNGTGKALTFALFNLQARGRLFIGHAAEVYEGQVVGLHARANDLTVNCLKGKQLTNMRASGTDEAQVLTPPINMTLEQALEFIDDDELVEVTPLNVRVRKRYLNENDRKRHNRK

SEQ ID NO: 3933 - DNA, 1830 bp, Arabidopsis thaliana
  CDS (1)..(1830)
atgccagtagaggtgaagaagaagcagttggataggagggataacgtgaggaatatcgcaatcgttgcacatgttgatcatggcaaaactactttggttgattctatgcttaggcaagctaaggttttccgagataaccaagtcatgcaagagaggatcatggactcaaatgaccttgagcgtgaaagaggaatcactattcttagcaaaaatacctccatcacttacaaaaacactaaagtaaatattatagatactcctggccattctgactttgggggtgaagtggagcgtgtcttgaacatggttgatggagtgcttcttgtggtggactctgttgagggaccaatgccccagacaaggtttgttttaaagaaggctcttgagtttggacatgcagtggtcgtggtcgtaaacaagattgacaggccttctgctcgtcctgaatttgttgtcaattccacttttgaactatttattgaactaaatgcaacagatgaacagtgtgatttccaagcgatatatgctagtgggattaaaggaaaggcggggctttctccggatgaccttgcagaagacctgggacccctgttcgaagctataatcagatgcgtacctgggccaaatattgaaaaagatggtgcacttcagatgcttgccacaaatattgagtatgatgagcataaaggacgcattgctattggacgactacacgcaggggtactgcgcaaaggaatggatgtcagggtgtgcacttctgaagattcctgtagatttgcaagagttagtgagctttttgtatatgagaaattctacagagtacctactgattcagtggaagctggagatatttgcgctgtatgtggcatagacaacattcagattggggagactattgctgataaagtacatgggaagcctctacctacaatcaaagtagaagagccaactgtgaaaatgtccttctctgtaaacacctctccattttctggtcgtgaggggaagtatgtaacaagcaggaacttacgagatcgtttaaaccgtgaacttgaaagaaatctagctatgaaagtggaagatggtgagacagcagacacattcattgttagtgggcgtggtacattacacattaccatcctgatagaaaacatgcgaagagaaggatatgaatttatggttggccccccgaaagttatcaacaaaagggttaacgataaattgctggagccatatgagatagcaactgttgaagtaccagaggctcacatggggcctgttgttgaacttcttggcaaaaggcgtggacagatgtttgatatgcagggtgttgggtcggaaggaacaacctttctgcggtacaaaatcccaacacgtggacttcttggattgaggaacgcaattttaacagcttctcgcgggacagctatccttaacactgtatttgacagttatggaccttgggccggtgatattagcacccgcgatctaggttcgctggttgcctttgaagatggaacatcaacatcatatgccctggcgagtgcgcaggagagagggcaaatgtttgtaggttctggagtggatgtatacaaaggtcagatagttgggatccaccagagacccggcgacttgggtcttaatatctgcaagaagaaggcagcgacaaacataagatccaacaaagatgtaacagtgattcttgacactcccttaacatatagtctggacgactgcatcgaatacattgaagaggatgagttggtggaggttacaccttctagtattaggatgtgcaagaatcagaaaatggcaaagaaaggcaggcagtaa

SEQ ID NO: 3934 - protein, 609 aa, Arabidopsis thaliana
MPVEVKKKQLDRRDNVRNIAIVAHVDHGKTTLVDSMLRQAKVFRDNQVMQERIMDSNDLERERGITILSKNTSITYKNTKVNIIDTPGHSDFGGEVERVLNMVDGVLLVVDSVEGPMPQTRFVLKKALEFGHAVVVVVNKIDRPSARPEFVVNSTFELFIELNATDEQCDFQAIYASGIKGKAGLSPDDLAEDLGPLFEAIIRCVPGPNIEKDGALQMLATNIEYDEHKGRIAIGRLHAGVLRKGMDVRVCTSEDSCRFARVSELFVYEKFYRVPTDSVEAGDICAVCGIDNIQIGETIADKVHGKPLPTIKVEEPTVKMSFSVNTSPFSGREGKYVTSRNLRDRLNRELERNLAMKVEDGETADTFIVSGRGTLHITILIENMRREGYEFMVGPPKVINKRVNDKLLEPYEIATVEVPEAHMGPVVELLGKRRGQMFDMQGVGSEGTTFLRYKIPTRGLLGLRNAILTASRGTAILNTVFDSYGPWAGDISTRDLGSLVAFEDGTSTSYALASAQERGQMFVGSGVDVYKGQIVGIHQRPGDLGLNICKKKAATNIRSNKDVTVILDTPLTYSLDDCIEYIEEDELVEVTPSSIRMCKNQKMAKKGRQ

SEQ ID NO: 3935 - DNA, 1839 bp, Bacillus subtilis
  CDS (1)..(1839): transl_table=11
gtgaaacttcgaaatgatcttcgcaacatcgcgattattgcccacgttgaccatgggaaaacgactctagtcgatcagcttttacatcaggctggtacgttccgtgccaacgaacaggttgctgaacgcgcaatggactctaatgatcttgaacgcgaacgcggcattacaatattggcgaaaaatactgcgattaactataaagatacacgtatcaatattttggacacccctggacatgcagactttgggggagaagtagaacggattatgaaaatggttgacggcgtagtgcttgtcgttgacgcatatgaaggctgtatgcctcaaactcgttttgttctgaaaaaagctcttgagcaaaacctgaaccctgttgttgttgtaaacaaaattgaccgtgactttgctcgtccagaggaagttatcgatgaagttctggatctgttcattgagcttgatgccaatgaagagcagctcgagttcccagtggtatatgcttccgcgattaatggaacagcgagtcttgatccgaaacaacaggatgaaaacatggaagctttatatgaaaccattattaagcatgttccggcacctgttgataatgcagaggagccgcttcaattccaagttgcccttcttgactacaacgactatgtaggccgtatcggaatcggacgcgtattccgcggcacaatgaaagtcggacagcaggtttctcttatgaagcttgacggaacggcaaagtcattccgtgttacaaagatttttggtttccaaggcttaaagcgtgtggaaattgaagaagcaaaagcgggagacctcgttgcggtttccgggatggaagatatcaacgttggtgaaacggtatgtcctgtagaccatcaagatccgcttccggtccttcgcattgatgagccgacacttcaaatgacatttgtcgtgaataacagtccgtttgcaggccgtgaaggcaaatatgtaacggcccgcaaaatcgaagagcgtcttcaatcacagcttcagacggatgtgagcttgcgtgttgagccaacagcttctcctgatgcttgggttgtttcaggacgcggtgagctgcacttgtcaattttaattgaaaatatgcgtcgtgagggctatgagcttcaagtgtcaaaacctgaagttattatcaaagaaatcgacggcgtacgctgtgagcctgttgaacgtgtgcaaattgatgttcctgaagagcatactggctctgtaatggaatcaatgggtgcccgcaaaggcgaaatggttgatatgatcaacaacggaaacggccaagtccgtctcatctttacagttccttcccgcggattgatcggttactctacagaattcctatcattaacacgcggattcggtattttgaaccatacgtttgacagctaccagccgatgcaggcaggccaagtcggcggacgccgtcaaggtgtacttgtgtcaatggaaaacggaaaagcaacatcatacggtattcaaggaattgaagaccgcggtgtcatcttcgttgagccgggtactgaagtatacgaaggaatgatcgttggagagcataaccgtgacaacgaccttgttgttaacgtcagcaaaatgaaacagcaaacaaacgtccgttctgcgacaaaggatcagacaactacaattaaaaaagcgcgcatcatgtctcttgaggagtctctagagtacttaaacgaagatgaatattgtgaagtaacacctgaatccatccgtttaagaaagaagatcctcaataagaacgaacgtgaaaaagcagctaaaaagaaaaaaacagcaggattgtcttaa

SEQ ID NO: 3936 - protein, 612 aa, Bacillus subtilis
MKLRNDLRNIAIIAHVDHGKTTLVDQLLHQAGTFRANEQVAERAMDSNDLERERGITILAKNTAINYKDTRINILDTPGHADFGGEVERIMKMVDGVVLVVDAYEGCMPQTRFVLKKALEQNLNPVVVVNKIDRDFARPEEVIDEVLDLFIELDANEEQLEFPVVYASAINGTASLDPKQQDENMEALYETIIKHVPAPVDNAEEPLQFQVALLDYNDYVGRIGIGRVFRGTMKVGQQVSLMKLDGTAKSFRVTKIFGFQGLKRVEIEEAKAGDLVAVSGMEDINVGETVCPVDHQDPLPVLRIDEPTLQMTFVVNNSPFAGREGKYVTARKIEERLQSQLQTDVSLRVEPTASPDAWVVSGRGELHLSILIENMRREGYELQVSKPEVIIKEIDGVRCEPVERVQIDVPEEHTGSVMESMGARKGEMVDMINNGNGQVRLIFTVPSRGLIGYSTEFLSLTRGFGILNHTFDSYQPMQAGQVGGRRQGVLVSMENGKATSYGIQGIEDRGVIFVEPGTEVYEGMIVGEHNRDNDLVVNVSKMKQQTNVRSATKDQTTTIKKARIMSLEESLEYLNEDEYCEVTPESIRLRKKILNKNEREKAAKKKKTAGLS

SEQ ID NO: 3937 - DNA, 1824 bp, Buchnera aphidicola subsp
  CDS (1)..(1824): transl_table=11
atgcatcatagtataagaaatattgccattatagcacatgttgatcatggtaaaacaacattgcttgataaattattacaacaatcaggaacatttgaagaacatgaagaaaaaactgaaagaattatggattctaatgatttagaaaaagaacgaggtattacaattttatcaaaaaatacttcaataaaatggaataattataaaataaatatagttgacactccgggacatgctgattttggaggtgaagtagaacgtgtaatgtctatggtagactcagtgcttttggtggtagacgcattagatggaccaatgccgcaaactcggtttgtaactaaaaaagcttttaaatatggtttaaaccctatagttgtaattaataaaattgatcgaattcactctcgtcctgattgggtagtagatcaagtttttgatctttttgttaatttgaatgcaagtgatgagcaacttgattttcctattatatatacatctgccgttcttggaacctcagggacagattatttgaatatgcaaaataacatgattccattatatgaatctattatcaaatatgctcctgctcctaacgttaattctgatcaaaagtttcaaatgcaaatctcacaacttgattataatagttatcttggagtcataggggttggacgtgttaaacaaggttctattaagactaatgataaagtgactattattgatagatttggaaaacatcgtagtggtaaagttaataaagtattaaactattttggattaaaaagaatggaaatcaatcaaggatatgctggagatatcattgctattacaggtcttaataaattaaaaatttcagatacaatttgtcatccagataatctacaacctcttccagcattaagtatcgatgaacctactgtaaatatgtttttttcagtaaatacctcacctttttcaggaaaggaagggaaatatattacatctcgtcaaattttagaacgattaaaaaaagaaaccatgcacaatgttgctttacagataaaagaaacgaaggatccaaatattttttctgtatctggacgcggtgagttacatttatctatattaattgaaaatatgcgtcgtgaagggtttgagttagaagtttcccgtcctaaaattatttttcgtgaaattaatgggattcaaaaagaaccttttgaaaacgtaactttagatatagaagaaaaaaatcaaggaagtgttatgcaatttataggtatcagaaaaggggaattaaaaaatatgattccagattcaaaaggaagggtgcgccttgaatatatattatctagcagagcattaatcggatttcgttcggaatttatgagtataacttctggaacaggtctgtgttattcatcttttagtcactatgataacctccaaaatagcaatattggacaaagaaaaaatggagttttaatatcgaatagtacaggtatggcagtagggttttctctatttaatttacaagaaagaggaaaattatttataggacatggcgctcaagtatatgaaggacaaattataggacttcataatcgttctaatgatttaacggttaattgtttaactggaaaaaaattaactaatatgagagcttctggtacagacgaagcaatagttttaacgacagcaattcatttcacattagaagaagcaataggatttatcaacgatgatgaacttgtagaagtcacgcctcattctatacgaatacgtaaattttatttaaaagaaaatgaaagaaaaagagctaatcgtaataaaaaatctatttaa

SEQ ID NO: 3938 - protein, 607 aa, Buchnera aphidicola subsp
MHHSIRNIAIIAHVDHGKTTLLDKLLQQSGTFEEHEEKTERIMDSNDLEKERGITILSKNTSIKWNNYKINIVDTPGHADFGGEVERVMSMVDSVLLVVDALDGPMPQTRFVTKKAFKYGLNPIVVINKIDRIHSRPDWVVDQVFDLFVNLNASDEQLDFPIIYTSAVLGTSGTDYLNMQNNMIPLYESIIKYAPAPNVNSDQKFQMQISQLDYNSYLGVIGVGRVKQGSIKTNDKVTIIDRFGKHRSGKVNKVLNYFGLKRMEINQGYAGDIIAITGLNKLKISDTICHPDNLQPLPALSIDEPTVNMFFSVNTSPFSGKEGKYITSRQILERLKKETMHNVALQIKETKDPNIFSVSGRGELHLSILIENMRREGFELEVSRPKIIFREINGIQKEPFENVTLDIEEKNQGSVMQFIGIRKGELKNMIPDSKGRVRLEYILSSRALIGFRSEFMSITSGTGLCYSSFSHYDNLQNSNIGQRKNGVLISNSTGMAVGFSLFNLQERGKLFIGHGAQVYEGQIIGLHNRSNDLTVNCLTGKKLTNMRASGTDEAIVLTTAIHFTLEEAIGFINDDELVEVTPHSIRIRKFYLKENERKRANRNKKSI

SEQ ID NO: 3939 - DNA, 1830 bp, Buchnera aphidicola subsp
  CDS (1)..(1830): transl_table=11
atgcatcaaaatataagaaacattgctattatagcacatgttgatcatggtaaaaccacgctacttgatcaactattacaacaatctggaacttttcaaaaacatgaagaaaagaaagaacgtattatggattctaatgatttagagaaagagagggggattacaatattatctaaaaatacttctattaaatggaaagaatataaaattaatattgttgatacaccaggtcacgctgattttggcggtgaggtagaacgagtaatgtctatggttgactcagttttactaatagtagatgcattagatggacctatgccacaaactcgtttcgtcactaaaaaagcatttaaatatggcttaaatcctattgtagttattaacaaaattgatagaaaaaattctcgtcctgattgggttataaatgaaattttcgatctctttgttaatcttaatgctaatgataaacaacttgattttccaattatatatacttctgcaattcttggaacttcagggataaattatcttgacatgaaagaaaatatgattccattgtacgaagcaattattaaatatgccccagcgcctaatgtagatcctaatcaaaaatttcaaatgcaaatttcgcaacttgactacaataattatttaggagtaataggtgttggtcgtattaaacaaggtcatataaaaccaaatgattcagtagttattattgatagtttaggaaacaccagaaatggtaaaattaataaggtattaaattattttggacttaaaagattagaaatacaaaaaggagacgcaggtgatataattgctattacaggtttaaataaattaaacatttctgatacaatctgccatccagataatttatgccctcttccaccgttaattatagatgaacctacagtcaacatgtttttttcagtaaatacttcacctttttcaggaaaagaaggtaaatatattacatcacgtcaaattttagaaagattaaaaaaagagaccatacacaacgtagctttgcaagtaaaagaaacaaaagatgcaaatattttttctgtttctggacgtggcgaattgcatttatctatactaatagaaaatatgcgtcgtgaaggattcgaattagaggtatctcgtcccaaaataatttttcgtgaaataaatgatattaagcaagaaccgtttgaaaatatcatcctagacattgaagaaaaacatcaaggcaatattatgaaatttataggagaaaggaaaggtgaattaaaaaatataactgttgatcctaataaaaggatacgtcttgaatatcttttatcgagtagagctttaattggatttcgtacagaatttatgagtataacttcaggaactggacttttttactcatctttcagtcactatcaaaaatatcaaaaaaatgatataggacaaagaaaaaatggcgttttaatatcaaatagtactggtatggcggtagcttttgctctatttaatttacaagaaagaggaaaattgtttttaggacacggtactcaagtctatgaaggtcaaataatcggactacataatcgttctaacgatttaacagtaaattgtcttacaggaaaaaaactaacaaatatgagagcttcagggacagatgaagctataattttaacaacgtttacaaaattcacattagaagaagctttatcttttatcaatgatgatgaattagtagaaatcacaccaaaatcaatacgtttaagaaaacgttatttaaaagaaaacgaacgaaaaaaagccaatcgagatagaactactatagttgattaa

SEQ ID NO: 3940 - protein, 609 aa, Buchnera aphidicola subsp
MHQNIRNIAIIAHVDHGKTTLLDQLLQQSGTFQKHEEKKERIMDSNDLEKERGITILSKNTSIKWKEYKINIVDTPGHADFGGEVERVMSMVDSVLLIVDALDGPMPQTRFVTKKAFKYGLNPIVVINKIDRKNSRPDWVINEIFDLFVNLNANDKQLDFPIIYTSAILGTSGINYLDMKENMIPLYEAIIKYAPAPNVDPNQKFQMQISQLDYNNYLGVIGVGRIKQGHIKPNDSVVIIDSLGNTRNGKINKVLNYFGLKRLEIQKGDAGDIIAITGLNKLNISDTICHPDNLCPLPPLIIDEPTVNMFFSVNTSPFSGKEGKYITSRQILERLKKETIHNVALQVKETKDANIFSVSGRGELHLSILIENMRREGFELEVSRPKIIFREINDIKQEPFENIILDIEEKHQGNIMKFIGERKGELKNITVDPNKRIRLEYLLSSRALIGFRTEFMSITSGTGLFYSSFSHYQKYQKNDIGQRKNGVLISNSTGMAVAFALFNLQERGKLFLGHGTQVYEGQIIGLHNRSNDLTVNCLTGKKLTNMRASGTDEAIILTTFTKFTLEEALSFINDDELVEITPKSIRLRKRYLKENERKKANRDRTTIVD

SEQ ID NO: 3941 - DNA, 1824 bp, Escherichia coli O127
  CDS (1)..(1824): transl_table=11
gtgatcgaaaaattgcgtaatatcgccatcatcgcgcacgtagaccatggtaaaaccaccctggtagacaagctgctccaacaatccggtacgttcgactctcgtgccgaaacccaagagcgcgtgatggactccaacgatttggagaaagagcgtgggattaccatcctcgcgaaaaacaccgctatcaaatggaatgattaccgtatcaacatcgttgataccccggggcacgccgacttcggtggtgaagttgaacgtgtaatgtccatggtagactcagtgctgctggtggttgacgcatttgacggcccgatgccgcaaacgcgcttcgtaaccaaaaaagcgtttgcttacggcctgaagccgattgttgttatcaacaaagttgaccgccctggcgcgcgtcctgattgggttgtggatcaggtattcgatctgttcgttaacctcgacgcgaccgacgagcagctggacttcccgatcgtttacgcttctgcgctgaacggtatcgcgggtctggaccacgaagatatggcggaagacatgaccccgctgtatcaggcgattgttgaccacgttcctgcgccggacgttgaccttgacggtccgttccagatgcagatttctcagctcgattacaacagctatgttggcgttatcggcattggccgcatcaagcgcggtaaagtgaagccgaaccagcaggttactatcatcgatagcgaaggcaaaacccgcaacgcgaaagtcggtaaagtgctgggccacctcggtctggaacgtatcgaaaccgatctggcggaagctggcgatatcgtggcgatcacgggtcttggcgaactgaacatttctgacaccgtttgcgacacgcaaaacgttgaagcgctgccggcactctccgttgatgagccgaccgtttctatgttcttctgcgttaacacctcgccgttctgcggtaaagaaggtaagttcgtaacgtctcgtcagatcctggatcgtctgaacaaagaactggtacacaacgttgcgctacgcgtagaagaaaccgaagacgccgatgcgttccgcgtttctggtcgtggcgaactgcacctgtctgttcttattgaaaacatgcgtcgtgaaggtttcgaactggcggtatcccgtccgaaagtaatcttccgtgaaatcgacggtcgtaaacaagagccgtatgaaaacgtgacgctggacgttgaagaacagcatcagggttctgtgatgcaggcgctgggcgaacgtaaaggcgacctgaaaaacatgaatccagacggtaaaggccgcgtacgtctcgactacgtgatcccaagccgtggtctgattggcttccgttctgagttcatgaccatgacttctggtactggtctgttgtactccaccttcagccactacgacgacgtacgtccgggtgaagtgggtcagcgtcagaacggcgtactgatctctaacggtcagggtaaagcggtagcgttcgcgctgttcggtctgcaggatcgcggtaagctgttcctcggtcacggtgctgaagtttacgaaggtcagattatcggtattcacagccgctctaacgacctgactgtaaactgcctgaccggtaagaaactgaccaacatgcgtgcttccggtactgacgaagccgttgttctggttccgcctatccgcatgactctggaacaagctctggagttcatcgatgatgacgagctggtagaagtgactccgacctctatccgtattcgtaaacgtcacctgacggaaaacgatcgtcgtcgcgccaaccgcgcaccgaaagacgattaa

SEQ ID NO: 3942 - protein, 607 aa, Escherichia coli O127
MIEKLRNIAIIAHVDHGKTTLVDKLLQQSGTFDSRAETQERVMDSNDLEKERGITILAKNTAIKWNDYRINIVDTPGHADFGGEVERVMSMVDSVLLVVDAFDGPMPQTRFVTKKAFAYGLKPIVVINKVDRPGARPDWVVDQVFDLFVNLDATDEQLDFPIVYASALNGIAGLDHEDMAEDMTPLYQAIVDHVPAPDVDLDGPFQMQISQLDYNSYVGVIGIGRIKRGKVKPNQQVTIIDSEGKTRNAKVGKVLGHLGLERIETDLAEAGDIVAITGLGELNISDTVCDTQNVEALPALSVDEPTVSMFFCVNTSPFCGKEGKFVTSRQILDRLNKELVHNVALRVEETEDADAFRVSGRGELHLSVLIENMRREGFELAVSRPKVIFREIDGRKQEPYENVTLDVEEQHQGSVMQALGERKGDLKNMNPDGKGRVRLDYVIPSRGLIGFRSEFMTMTSGTGLLYSTFSHYDDVRPGEVGQRQNGVLISNGQGKAVAFALFGLQDRGKLFLGHGAEVYEGQIIGIHSRSNDLTVNCLTGKKLTNMRASGTDEAVVLVPPIRMTLEQALEFIDDDELVEVTPTSIRIRKRHLTENDRRRANRAPKDD

SEQ ID NO: 3943 - DNA, 1851 bp, Haemophilus influenzae
  CDS (1)..(1851): transl_table=11
atgaaaaacgaaattgatattaaaaaactccgtaacatcgccattattgcgcacgtagaccatggtaaaaccactcttgtagataaacttcttcaacaatctggtacttttgaatctgctcgtggtgatgtggatgaacgcgttatggactcaaacgatcttgaaaaagaacgtggcattaccattcttgcaaaaaataccgcgattaactggaatgactaccgcattaacatcgtggatactccagggcacgcagacttcggtggcgaagttgaacgtgtactttctatggtggattctgttctattagttgttgatgcgtttgatggcccaatgccacaaacgcgtttcgttacacaaaaagcattcgctcacggcttaaaaccaatcgtcgtaattaataaagttgatcgccctggtgcacgtcctgactgggttgtggatcaagtgtttgacttatttgtcaatcttggtgcaagcgatgaacaattagacttccctattatctatgcttcagcattaaatggtgttgctggtcttgaacacgaagatttagcggaagatatgaccccattatttgaagccattgtgaaacatgtagaaccgccaaaagtagaacttgatgcgccattccaaatgcaaatttcacaattagactacaacaactatgtaggcgttattggtattggtcgtattaagcgcggttcgattaaaccaaaccaacctgttactatcatcaatagtgaaggaaaaactcgtcaaggtcgtatcggtcaagtacttggacatcttggtttacaacgttatgaagaagacgttgcttatgctggcgatattgttgctatcactggtttaggagaattaaatatttctgatacgatttgtgatatcaacacagttgaagcactgccatcattaacggttgatgaaccaaccgtaaccatgttcttctgtgtaaatacctctccatttgcgggacaagaaggtaaatacgtcacatcgcgtcaaattcttgaacgcttaaataaagaattggttcacaacgtggcattacgcgtagaagaaaccccaaacccagatgaattccgtgtatctggtcgtggcgaattacatctttccgtgttaatcgaaaatatgcgtcgtgaaggttatgagcttgcggtttctcgtccaaaagtaatttatcgtgatattgacggtaaaaaacaagaaccatacgaacaagtaactatcgatgtggaagaacaacatcaaggttctgtgatggaagcattgggtatccgtaaaggtgaagttcgtgatatgttgcctgacggtaaaggtcgtgtgcgtttggaatacattatccctagtcgtggattgattggcttccgtggtgattttatgaccatgacttctggtacaggcttactttactcaagctttagccactatgatgaaatcaaaggcggcgaaattggtcagcgcaaaaatggtgtgttgatttctaatgcaacaggtaaagcacttggctatgcattatttggcttacaagaacgtggtaagttaatgattgatgcaaacatagaagtttatgaaggtcaaattatcggtattcatagccgctcaaatgacttaaccgtaaactgcttgcaaggtaaaaaactaactaatatgcgtgcgtcaggtaaagacgatgcgattgtgctaactacacctgtaaaattcagtcttgaacaagcgattgaatttatcgatgatgatgaactagtggaagtaacacctgagtcgattcgtatccgtaaaaaacttttaacggaaaacgatcgcaaacgtgcaaatcgtacaacaacaagtactagcacgcattaa

SEQ ID NO: 3944 - protein, 616 aa, Haemophilus influenzae
MKNEIDIKKLRNIAIIAHVDHGKTTLVDKLLQQSGTFESARGDVDERVMDSNDLEKERGITILAKNTAINWNDYRINIVDTPGHADFGGEVERVLSMVDSVLLVVDAFDGPMPQTRFVTQKAFAHGLKPIVVINKVDRPGARPDWVVDQVFDLFVNLGASDEQLDFPIIYASALNGVAGLEHEDLAEDMTPLFEAIVKHVEPPKVELDAPFQMQISQLDYNNYVGVIGIGRIKRGSIKPNQPVTIINSEGKTRQGRIGQVLGHLGLQRYEEDVAYAGDIVAITGLGELNISDTICDINTVEALPSLTVDEPTVTMFFCVNTSPFAGQEGKYVTSRQILERLNKELVHNVALRVEETPNPDEFRVSGRGELHLSVLIENMRREGYELAVSRPKVIYRDIDGKKQEPYEQVTIDVEEQHQGSVMEALGIRKGEVRDMLPDGKGRVRLEYIIPSRGLIGFRGDFMTMTSGTGLLYSSFSHYDEIKGGEIGQRKNGVLISNATGKALGYALFGLQERGKLMIDANIEVYEGQIIGIHSRSNDLTVNCLQGKKLTNMRASGKDDAIVLTTPVKFSLEQAIEFIDDDELVEVTPESIRIRKKLLTENDRKRANRTTTSTSTH

SEQ ID NO: 3945 - DNA, 1800 bp, Helicobacter pylori J99
  CDS (1)..(1800): transl_table=11
atgaaaaatattagaaatatcgctgtaatcgcgcatgttgatcatgggaaaaccactttagtagatggcttactttctcaatctggcacatttagtgagagggaaaaagtggatgaaagggtgatggatagcaatgatttagagaaagaaagagggatcactattctgtctaaaaacaccgctatttattacaaagacactaaaatcaatatcattgacactcccgggcatgctgattttgggggcgaagtggagcgcgttttaaaaatggtggatggggtgttgcttttagtggatgctcaagaaggagtcatgcctcaaactaaattcgtggttaaaaaggctttgagttttgggatttgccctattgtggtggtgaataaaattgataagcctgccgctgaaccggatagggtggtggatgaagtttttgacttgttcgtggcgatgggggctagcgataaacaattggatttccctgtcgtgtatgctgctgctagagatggctatgcgatgaaaagtttagacgatgaaaagaagaatttagagcctttgtttgaaacgattttagagcatgtgccaagccctagcgggagcgttgatgagcctttgcaaatgcaaattttcacgcttgattatgacaattatgtaggcaaaatcggtatcgctagagtgtttaatggctcggttaaaaagaatgaaagcgtgctgttgatgaaaagcgatgggagtaaagaaaatggccgtatcactaaacttataggttttttagggctggctaggactgagattgaaaacgcttatgcgggcgatattgtagcgcttgctgggtttaacgcgatggatgtgggtgatagcgtcgttgatcccactaaccccatgcctttagatcccatgcatttagaagagcctacgatgagcgtgtattttgccgtcaatgattcgcccttagccgggttagaaggaaagcatgttactgccaataaattgaaagacaggctcttaaaagaaatgcaaaccaatatcgctatgaaatgcgaagaaatgggagaaggcaagtttaaagtgagcgggcgtggggaattgcaaatcactattttagctgaaaacttgcgccgtgaagggtttgagtttagcatttcacgccctgaagtcatcattaaagaagaaaatggcgttaaatgcgagccttttgagcatttagtgattgacacgccccaagattttagcggggctatcattgagagattaggcaaaagaaaagccgagatgaaagcgatgaatcccatgagcgatggctatacaagattagaatttgaaattcctgcaagagggcttatcggttataggagcgagtttttaaccgacactaaaggcgaaggcgtgatgaatcatagctttttggaattccgcccttttagcgggagcgtggaatcgcgcaaaaatggggcgctcattagcatggaaaatggcgaagcgaccgctttttcccttttcaatatccaagaaagaggcgcactttttatcaatccccaaactaaggtttatgtgggcatggttattggcgaacacagccgggataatgatttagatgtcaatcctatcaaatccaagcacttaaccaacatgagagcgagcgggagcgatgatgcgatcaaactcaccccgcctaggactatggtgctagaaagggcgttagaatggattgaagaagatgaaattttagaagttacccccttgaatttaaggatcaggaaaaagattttagaccccaacatgaggaaaagggcgaaaaaataa

SEQ ID NO: 3946 - protein, 599 aa, Helicobacter pylori J99
MKNIRNIAVIAHVDHGKTTLVDGLLSQSGTFSEREKVDERVMDSNDLEKERGITILSKNTAIYYKDTKINIIDTPGHADFGGEVERVLKMVDGVLLLVDAQEGVMPQTKFVVKKALSFGICPIVVVNKIDKPAAEPDRVVDEVFDLFVAMGASDKQLDFPVVYAAARDGYAMKSLDDEKKNLEPLFETILEHVPSPSGSVDEPLQMQIFTLDYDNYVGKIGIARVFNGSVKKNESVLLMKSDGSKENGRITKLIGFLGLARTEIENAYAGDIVALAGFNAMDVGDSVVDPTNPMPLDPMHLEEPTMSVYFAVNDSPLAGLEGKHVTANKLKDRLLKEMQTNIAMKCEEMGEGKFKVSGRGELQITILAENLRREGFEFSISRPEVIIKEENGVKCEPFEHLVIDTPQDFSGAIIERLGKRKAEMKAMNPMSDGYTRLEFEIPARGLIGYRSEFLTDTKGEGVMNHSFLEFRPFSGSVESRKNGALISMENGEATAFSLFNIQERGALFINPQTKVYVGMVIGEHSRDNDLDVNPIKSKHLTNMRASGSDDAIKLTPPRTMVLERALEWIEEDEILEVTPLNLRIRKKILDPNMRKRAKK

SEQ ID NO: 3947 - DNA, 1800 bp, Helicobacter pylori
  CDS (1)..(1800): transl_table=11
atgaaaaatattagaaatatcgctgtaatcgcgcatgttgatcatgggaaaaccactctagtagatggcttactttctcaatctggcacatttagtgagagggaaaaagtggatgaaagggtgatggatagcaatgatttggaaagagaaagagggattactatcctgtctaaaaacaccgctatttattacaaagacactaaaatcaatatcattgacactcccgggcatgctgattttgggggcgaagtggagcgcgttttaaaaatggtggatggggtgttgcttttagtggacgctcaagaaggggtcatgcctcaaactaaattcgtggttaaaaaggctttgagttttgggatttgccctattgtggtggtgaataaaattgataagcctgccgctgaaccggacagagtggtggatgaagtttttgacttgttcgtagccatgggggctagcgataagcaattggatttccctgtggtgtatgccgccgcacgagatggctatgcgatgaaaagtttagacgatgaaaagaaaaatttagagcctttgtttgaaacgattttagagcatgtgccaagccctagcgggagcgttgatgagcctttgcaaatgcaaattttcacgcttgattatgacaattatgtgggcaaaatcggtatcgctagggtgtttaatggctcggttaaaaagaatgaaagcgtgctgttgatgaaaagcgatgggagtaaagaaaatggccgtatcactaagcttataggttttttagggctggctaggactgagattgaaaacgcttatgcgggcgatattgtagcgattgccgggtttaatgcaatggatgtgggcgatagcgtcgttgatcctgctaaccccatgcctttagatcccatgcatttagaagagcctacgatgagcgtgtattttgctgtcaatgattcacccttagccgggttagaaggaaagcatgttactgctaataaattgaaagacaggctcttaaaagaaatgcaaaccaatatcgctatgaaatgcgaagaaatgggcgagggcaagtttaaagtgagtgggcgtggggaattgcaaatcactattttagctgaaaacttgcgccgtgaagggtttgaatttagcatttcacgccctgaagtcatcattaaagaagaaaatggcgttaaatgcgagccttttgagcatttagtgattgacacgccccaagattttagtggggctatcattgagagattgggcaaaagaaaagctgagatgaaagcgatgaatcccatgagtgatggctatacaagattagaatttgaaattcctgcaagagggcttatcggttataggagcgagtttttaaccgacaccaagggcgaaggcgtgatgaatcatagctttttagaattccgccctttcagcgggagcgtggaatcgcgcaaaaatggggcgctaatcagcatggaaaatggcgaagcgaccgctttttcccttttcaatatccaagaaagaggcacgctttttatcaacccccaaacgaaggtttatgtgggcatggtcattggcgagcacagccgggataatgatttagatgtcaatcctattaaatccaagcatttaaccaacatgagagcgagcgggagcgatgatgcgatcaaactcaccccgcctaggactatggtgttagaaagagcgttagaatggattgaagaagatgagattttggaagttacccccttgaatttaaggatcaggaaaaagattttagaccctaacatgaggaaaagggcgaaaaaataa

SEQ ID NO: 3948 - protein, 599 aa, Helicobacter pylori
MKNIRNIAVIAHVDHGKTTLVDGLLSQSGTFSEREKVDERVMDSNDLERERGITILSKNTAIYYKDTKINIIDTPGHADFGGEVERVLKMVDGVLLLVDAQEGVMPQTKFVVKKALSFGICPIVVVNKIDKPAAEPDRVVDEVFDLFVAMGASDKQLDFPVVYAAARDGYAMKSLDDEKKNLEPLFETILEHVPSPSGSVDEPLQMQIFTLDYDNYVGKIGIARVFNGSVKKNESVLLMKSDGSKENGRITKLIGFLGLARTEIENAYAGDIVAIAGFNAMDVGDSVVDPANPMPLDPMHLEEPTMSVYFAVNDSPLAGLEGKHVTANKLKDRLLKEMQTNIAMKCEEMGEGKFKVSGRGELQITILAENLRREGFEFSISRPEVIIKEENGVKCEPFEHLVIDTPQDFSGAIIERLGKRKAEMKAMNPMSDGYTRLEFEIPARGLIGYRSEFLTDTKGEGVMNHSFLEFRPFSGSVESRKNGALISMENGEATAFSLFNIQERGTLFINPQTKVYVGMVIGEHSRDNDLDVNPIKSKHLTNMRASGSDDAIKLTPPRTMVLERALEWIEEDEILEVTPLNLRIRKKILDPNMRKRAKK

SEQ ID NO: 3949 - DNA, 1794 bp, Synechocystis sp
  CDS (1)..(1794): transl_table=11
atgtctcttcccatccgcaatgtcgccatcattgcccacgttgatcacggtaaaaccacccttgttgatgctttgttgaagcaatcaggcattttccgggaaggggaagacgtaccggtgtgtgtgatggactccaacgatctggaacgggaacggggcattactatcctctcgaaaaatacggcggtccgctaccaagatacgttaattaatattgtcgatacccctggccacgctgattttggtggggaagtggaacgggtgctgggtatggtggacggttgtgtgttaatcgtcgatgccaatgaaggccccatgccccaaactcggtttgtgctcaaaaaagcgttggaaaaaggtctgcgccccctggtggtggttaataagattgatcgtccccgggccgaccccaacaccgccgtggataaggtatttgatctatttgtggaactgggggcagacgatgaccagtgtgatttcaccactctgtttgcttctggtttagggggctttgctaaagaaagtctggacgacgattccgaggatatgaagcctttgtttgaggcgattttgcaccatgtcccgcccccggccggcgatccgaacaaacccctccagttacaagtgactaccctggattattccgattatttgggacggattattattggccgcatccacaacggtacggttaaagccggacaacaggccgccttggtgaaagaggatggttcgatcgccaaaggaaaagttagtaaactcttgggttttgaagggttgaatcgcatcgaactgccagaagccagtgccggctacattgtggcgatcgccggttttgccgatgccaatatcggtgagactttgacctgtcccgatgaaccccaggctttgcccctgatcaaagtggacgagccgactttgcaaatgaccttttcggtcaatgattctccctttgcgggccaagaaggcaaatttgttacctcccgtcagattcgcgatcgcctcaatcgggaattggaaaccaacgttgctctacgggtggaagatggggaaagtgccgagcaatttttggtctctggtcggggggaattgcacctcggtattttgattgaaaccatgcgacgggaaggttatgaatttcaagtggcccagccccaagtgatttatcgcgaggtcaacggtcaaccctgtgaaccagtggaatatctggttttagatgtaccagaagcggcggtgggagcctgtattgaacggctgggacaacgacggggagaaatgcaagatatgcaaaccagcgtcaacggccgcacccaattggaatttgtcattccggcccggggtttactgggtttccggggggattttatccgcatcacccggggggaaggcatcatgaaccacagctttttggaataccgccccatgagtggtgatttggaaacccgctataacggtgtcatggtggccttcgaggaaggggtggccacattctatgccatgaaaaacgctgaggatcggggcgtatttttcattactcccggcaccaaggtttacaagggcatgatcatcggtgagcataaccggcctcaagatattgaactgaacgtttgtaaaaccaagcagctaaccaaccaccgttcggccaccggggacgaattggtacagctccaagcgccggaagatatgaacctagaaagggctttggaatacattggaccggatgagttagtggaaattacgccggaatccatccgtttacggaaagtagcccggaaaaagttggtcaaacgttaa

SEQ ID NO: 3950 - protein, 597 aa, Synechocystis sp
MSLPIRNVAIIAHVDHGKTTLVDALLKQSGIFREGEDVPVCVMDSNDLERERGITILSKNTAVRYQDTLINIVDTPGHADFGGEVERVLGMVDGCVLIVDANEGPMPQTRFVLKKALEKGLRPLVVVNKIDRPRADPNTAVDKVFDLFVELGADDDQCDFTTLFASGLGGFAKESLDDDSEDMKPLFEAILHHVPPPAGDPNKPLQLQVTTLDYSDYLGRIIIGRIHNGTVKAGQQAALVKEDGSIAKGKVSKLLGFEGLNRIELPEASAGYIVAIAGFADANIGETLTCPDEPQALPLIKVDEPTLQMTFSVNDSPFAGQEGKFVTSRQIRDRLNRELETNVALRVEDGESAEQFLVSGRGELHLGILIETMRREGYEFQVAQPQVIYREVNGQPCEPVEYLVLDVPEAAVGACIERLGQRRGEMQDMQTSVNGRTQLEFVIPARGLLGFRGDFIRITRGEGIMNHSFLEYRPMSGDLETRYNGVMVAFEEGVATFYAMKNAEDRGVFFITPGTKVYKGMIIGEHNRPQDIELNVCKTKQLTNHRSATGDELVQLQAPEDMNLERALEYIGPDELVEITPESIRLRKVARKKLVKR

SEQ ID NO: 3951 - DNA, 2022 bp, Oryza sativa
  CDS (1)..(2022)
atggccacgggcatgctgctccgcggcctccgctcggcggcgagccggacgagccctgtcttcccgacctccgcctcgtccccggcgccctacgtctcgccgctcctccgccgcctctactcggccgccgccgcgtcggcagccgcctccccggccctggggcccggaggcgccctcgacccgtcccgcatccgcaacgtggcggtgatagcccacgtcgaccacgggaagacgacgctgatggaccggctcctgcggcagtgcggcgccgacatcccacacgagcgcgccatggactccatcagcctcgagcgcgagcgcggcatcaccattgcctccaaggtcacttctgtctcttggaaggagaacgaactcaacatggttgatacacctggtcacgctgattttggtggcgaagtcgagagagttgttggaatggttgaaggggcggtcttggttgttgatgctggggagggacctttagcgcagaccaagtttgtactttcaaaggctttgaagtatggcttgcgcccaattctccttctcaacaaggttgacaggccatcagtttcggaagagacctgcaatgaagtagagagcttggtgtttgatctatttgcaaatcttggtgctacagaagaacagttagacttcccagttctttatgcatcggctaaagaaggctgggcttctctagaattcaccaagagccctcctgataatgcgaaaaatatgtctgcattgcttgattccattttacagcatgtgccttctccaaaagctgaccttgaggctccattccaaatgttggtttccatgatggaacgcgatttttatctaggacgaatactgactggacgagtaagatctggggttgtccgtgttggtgacaaagtgcatggtcttcgtagcacagatgatggtgttcagaagatcgaagatggaaaggttgtcaagctcatgaaaaagaaaggaacaagtatggtaatagtagaggctgcaggagctggcgacataatttcaatggctggattggctgctccagcaattgggcatactgtgtcaaattcagatattttgactgcccttcctacaattgagttggaccctcccacaatatctatgacttttggtgtgaatgattcaccactgtctggccgcgatggcactcatctaactggagcgaaaataggcaaccgcctaatggcagaagcagaaacgaacctggcaattaatgttcttcctggaccattatcagaatcttatgaagttcaaggaaggggagaacttcagttaggaatcttgattgagaatatgcgccgcgaaggatttgagctttcagtttcacccccaaaagtgatgtatagaacagaccgtggagaaaggttagagcctattgaagaagtaactgttgaggtagacgaggagcatgttggatttgtcatggaaaccctgacacacaggaagggtgaagtaatggacatgggccctgttccagggacaactgggagaactcggatctttttgacctgcccatctaggggtttggtgggattcaaaggaatattcagcagctttacacgtggaactgggtttatgcatcgcgctttccaggcatatgctaaatacagaggtcagctgggcaatgttagaaaaggagttctggtatctgtcggcaagggacttatcacttcacatgcacttatgagtttagaagctcgtggtattctgtttgtttctcctgggatggaggcgtacgaaggcatgattgttggagagcactcacgtgacagtgatcttgatatcaatcctgtgagaactaaagaacttacaaacattcgagctccaggaaaggatgaaaatgtcaggctttctccaccacgattgatgagtttggaagaggcaattggatatgttgctgcagatgagcttattgaggttactcccaaggtcattcggcttcggaagaaatatctggatgccacgaaacgtaagatgatgaaaaacaaaccaatggattga

SEQ ID NO: 3952 - protein, 673 aa, Oryza sativa
MATGMLLRGLRSAASRTSPVFPTSASSPAPYVSPLLRRLYSAAAASAAASPALGPGGALDPSRIRNVAVIAHVDHGKTTLMDRLLRQCGADIPHERAMDSISLERERGITIASKVTSVSWKENELNMVDTPGHADFGGEVERVVGMVEGAVLVVDAGEGPLAQTKFVLSKALKYGLRPILLLNKVDRPSVSEETCNEVESLVFDLFANLGATEEQLDFPVLYASAKEGWASLEFTKSPPDNAKNMSALLDSILQHVPSPKADLEAPFQMLVSMMERDFYLGRILTGRVRSGVVRVGDKVHGLRSTDDGVQKIEDGKVVKLMKKKGTSMVIVEAAGAGDIISMAGLAAPAIGHTVSNSDILTALPTIELDPPTISMTFGVNDSPLSGRDGTHLTGAKIGNRLMAEAETNLAINVLPGPLSESYEVQGRGELQLGILIENMRREGFELSVSPPKVMYRTDRGERLEPIEEVTVEVDEEHVGFVMETLTHRKGEVMDMGPVPGTTGRTRIFLTCPSRGLVGFKGIFSSFTRGTGFMHRAFQAYAKYRGQLGNVRKGVLVSVGKGLITSHALMSLEARGILFVSPGMEAYEGMIVGEHSRDSDLDINPVRTKELTNIRAPGKDENVRLSPPRLMSLEEAIGYVAADELIEVTPKVIRLRKKYLDATKRKMMKNKPMD

SEQ ID NO: 3953 - DNA, 2010 bp, Oryza sativa
  CDS (1)..(2010)
atgcagatgcaggcggccaccaccaccaccgccgcgcgccgcctcgcgccgaagccgcagccgcaggccaaccggtgccgcccctcgagcgtctccgtcgtcgcggcggggaggtcccggaggaggagcgcgcgctcctccctcagggcctccgcctccctcgaccaggaggtcaaggagcgcgcctcccccgccgctgggaagagtggtcaagcaactagaagagatgtgaggaatatagcaattgttgctcatgtcgatcatggaaagacaactctggtggattcaatgttaaggcaagccaaggttttccgagacaatcaagttgtacaggaaagaataatggactcaaatgatctggagagggaaaggggaatcactatacttagcaaaaacacttcgataacttataagggtactaaaatcaacatcatcgatactcctggacattcagatttcggtggggaggtggaacgcgttctcaacatggtggaaggagttctcctagtggttgattctgtagagggacctatgccacagacaagatttgttctgaagaaagctctagaattcggacatgctgttgtagtggttgtaaacaagattgacagacctactgctcgtcctgagtttgtggtgaattcaacatttgagctatttatcgaattaaatgcaactgatgaacagtgtgattttcaaacagtctatgcaagtggtattaaagggaaggctgggttatctccagaaaatttgggtgacgatcttggacccctttttgaggcaatccttagatgcataccagagccacgtattgagaaagacggtgcactgcaattgcttgtgtctaatactgaatatgatgaacataaaggacggatagcgattgggcgactgcatgcaggagaactgcagcgaggcatggaagtgaaggtttgtacaccagatgatgcttgtagaattagcaaaataagtgagcttttcgtttatcagaacttcagccgagttccagttgataatgttagtgctggtgacatttgtgcagtatgtggaatcaatgatatcatgattggggaaaccatagcagataaagtttctggaacacccttgcccaccatcaaaatagaggaaccgacagtcagaatgtctttttccatcaacacttcaccttttgtcggtaaagaggggaaatatgtcacaagccgtaatctccgtgataggttatatcgtgagcttgaaaggaacttagctatgaaagtagaagacggggaaactgctgatacatttcttgttagtggcagaggcacactgcacctcactatattgatagaaaacatgcggagagaaggatttgagtttatgattggacctccaaaggtcattaacaagacagttgatggaaagctgcaagagccttatgagatagctgctgtggaagttccagaggaatatatgggttcagttgttgagcttttggggaaaaggcgtggacaaatggttgacatgcaacctagtgggccagagggaacaacattactaaaatacaagattcctactagaggcctcattggactcaggaatgcagttttgacagcatctaggggcacagcaatactcaacacaatttttgacagctatggcccatgggctggagatcttagttcacgtgatcaaggctccttggttgcatttgaggatggaagtactacatcgtatgcacttcttaatgctcaagaaagaggtatactatttgtgagtccaggacaggatgtttacaagggccaaatagttggtatccatcagcgaccaggtgatttagcaattaatgtgtgcaagaaaaaggctgcaacaaatgtccgctccaacaaggaaactacagtggttctcgatgaagcgttaagctacagtctggacgactgcatagagtttattcaagaagatgagctagtggaggttactcctgcaagcatccgcatgtgcaagaacccgaaagtttcgaagaaaaaccgataa

SEQ ID NO: 3954 - protein, 669 aa, Oryza sativa
MQMQAATTTTAARRLAPKPQPQANRCRPSSVSVVAAGRSRRRSARSSLRASASLDQEVKERASPAAGKSGQATRRDVRNIAIVAHVDHGKTTLVDSMLRQAKVFRDNQVVQERIMDSNDLERERGITILSKNTSITYKGTKINIIDTPGHSDFGGEVERVLNMVEGVLLVVDSVEGPMPQTRFVLKKALEFGHAVVVVVNKIDRPTARPEFVVNSTFELFIELNATDEQCDFQTVYASGIKGKAGLSPENLGDDLGPLFEAILRCIPEPRIEKDGALQLLVSNTEYDEHKGRIAIGRLHAGELQRGMEVKVCTPDDACRISKISELFVYQNFSRVPVDNVSAGDICAVCGINDIMIGETIADKVSGTPLPTIKIEEPTVRMSFSINTSPFVGKEGKYVTSRNLRDRLYRELERNLAMKVEDGETADTFLVSGRGTLHLTILIENMRREGFEFMIGPPKVINKTVDGKLQEPYEIAAVEVPEEYMGSVVELLGKRRGQMVDMQPSGPEGTTLLKYKIPTRGLIGLRNAVLTASRGTAILNTIFDSYGPWAGDLSSRDQGSLVAFEDGSTTSYALLNAQERGILFVSPGQDVYKGQIVGIHQRPGDLAINVCKKKAATNVRSNKETTVVLDEALSYSLDDCIEFIQEDELVEVTPASIRMCKNPKVSKKNR

SEQ ID NO: 3955 - DNA, 2028 bp, Brassica napus
  CDS (1)..(2028)
atggagctgagcttgagcacttcttatcccgcttctccagcggttttgaggagacaaccttctcctctccttcacaaccaacaagtgctcggcgtaagctttgcctccgctcttaaaccaggaggagctctccggtttcgttcccggaggcgtccccttcatcgccccatcacttgctccgcctctccatccactgccgaaccttcctccgaggtgaagaagaagacgctggtgaggaggaatgacgtgaggaacatagctattgtagctcatgttgatcatggcaaaactactttggttgattctatgctcaggcaagctaaggtgttcagagataaccaagtgatgcaagagaggatcatggactctaacgaccttgagcgtgaaagaggaatcactattcttagcaaaaacacctccatcacttacaaaaacacgaaagtaaatatcattgatactcctggccactctgactttggaggtgaagtggagcgtgtcttgaacatggttgacggagtccttcttgtggtggactctgttgaaggaccaatgcctcagacgaggtttgttttaaagaaggctcttgagttcggacatgcagttgtcgtggtcgtgaacaagattgacaggccttctgctcgtcctgagtttgttgtcaattccacttttgagctgtttattgaacttaacgctacagatgaacagtgtgatttccaagcgatttacgccagtgggattaaaggaaaggcagggcttactccggatgacctttcagaagaccttggacccctgttcgaggccataattagatgtgtccctggcccaaatattgaaaaagatggtgcacttcagatgcttgccacaaatattgagtatgatgagcataaaggacgtattgctattgggcggttacacgcaggggcactacgcaaaggaatggatgtcagggtgtgcacttctgaagattcgtgtagatttgcaagagtgagtgagctctttgtttatgagaaattctacagagtacctgctgatacagtggaagctggagatatttgcgctgtttgtggcatagatgacattcagattggggagactattgctgataaagcacatgggaagcctctgcctacaatcaaagtagaagagccaactgtgaaaatgtcattctctgtcaacacctctcctttctctggtcgtgagggcaagtatgtaacgagcaggaacttgcgagatcgtctaaaccgtgaactcgaaagaaatctagccatgaaagtggaagatggtgagacagcagacacattcatcattagtgggcgcggcacattacacattaccatcctgatagaaaacatgcgaagagagggatatgagtttatggttggacccccaaaagttatcaacaaaagggttaacgataaattgctcgagccgtatgaggtagcaactgttgaagtaccagagaatcacatggggcctgttgttgaacttcttggcaaaaggcgtggacagatgttcgatatgcagggtgttgggtcggaaggaacagtctttctgcggtacaaaatcccaacacgaggacttcttggactgaggaatgcaattttaacagcttctcgtgggacagctatcctcaacaccgtattcgacagctatggaccttgggccggtgatatcagcacccgtgatcttggctcgctggttgcgtttgaagacggaacatcaacatcgtatgctctggcaagtgctcaagagagagggcaaatgtttgtaggtgcaggtgtggatgtatacaaaggtcagatagttgggatccaccagagacctggggacttgggacttaacatctgcaagaagaaagcagcgacaaacatacgctccaacaaagatgtaacagtggttcttgacactcctttgacttatagtctggacgactgcatcgaatacattgaagaagatgaactggtggaagtcacgcctcttagtattaggatgtgcaagaatcctaaaatggccaagaaaggcaggtaa

SEQ ID NO: 3956 - protein, 675 aa, Brassica napus
MELSLSTSYPASPAVLRRQPSPLLHNQQVLGVSFASALKPGGALRFRSRRRPLHRPITCSASPSTAEPSSEVKKKTLVRRNDVRNIAIVAHVDHGKTTLVDSMLRQAKVFRDNQVMQERIMDSNDLERERGITILSKNTSITYKNTKVNIIDTPGHSDFGGEVERVLNMVDGVLLVVDSVEGPMPQTRFVLKKALEFGHAVVVVVNKIDRPSARPEFVVNSTFELFIELNATDEQCDFQAIYASGIKGKAGLTPDDLSEDLGPLFEAIIRCVPGPNIEKDGALQMLATNIEYDEHKGRIAIGRLHAGALRKGMDVRVCTSEDSCRFARVSELFVYEKFYRVPADTVEAGDICAVCGIDDIQIGETIADKAHGKPLPTIKVEEPTVKMSFSVNTSPFSGREGKYVTSRNLRDRLNRELERNLAMKVEDGETADTFIISGRGTLHITILIENMRREGYEFMVGPPKVINKRVNDKLLEPYEVATVEVPENHMGPVVELLGKRRGQMFDMQGVGSEGTVFLRYKIPTRGLLGLRNAILTASRGTAILNTVFDSYGPWAGDISTRDLGSLVAFEDGTSTSYALASAQERGQMFVGAGVDVYKGQIVGIHQRPGDLGLNICKKKAATNIRSNKDVTVVLDTPLTYSLDDCIEYIEEDELVEVTPLSIRMCKNPKMAKKGR

SEQ ID NO: 3957 - DNA, 2043 bp, Glycine max
  CDS (1)..(2043)
atggagaagattgcagcactcgctgctaatactatccacacccctctcttacccaacaacaccactcttccaaagacttcatcttttcaaccctttttttctaaccagctacttggcctccccttatcttcttcttcatcttctgcttcttctttaaccgccgccaaacggttctcttgcaggcctatcaagtgttccgtttccgaagccacagagcccaaaacagagaagaagaggcaattgctgagaagaggggatgtgaggaacatagctattgttgctcacgttgaccatgggaaaactactctcgttgatgccatgctcaaacaaactaaggtatttcgtgataatcagtttgttcaggaaaggataatggactcaaatgatttggagcgcgaaagaggaatcacaatactgagtaaaaatacatctgttacttataaagatgcgaagattaatataatagatactccgggtcactctgattttggtggtgaagtggagcgcatcttaaatatggtggaagggatccttctagtggtagattctgttgaagggccaatgccacagacaagatttgtcttgaagaaggctttagagtttggtcactcagttgtcgtggttgtgaataaaatagataggccttctgctcgcccagaatatgttgtcaactctacttttgaactcttcattgaattaaatgcaacagatgaacagtgtgactttcaagtaatatatgcaagtggtataaaagggcatgcagggttgactcctgaaaatctggcagaagaccttggtccattgtttgaatctatcattagatgcattcctggaccacgtattgacaaagatggtgcccttcaaatgttggttacaaatattgagtatgatgaacataaagggcgcatagcaattgggcgtgtgcaagctggagttttagaaaaaggcttggatgttcgagtatgtacttcagatgattcatgtagatatggaagagttactgagctttatgtgtatgacaaattcaatagggtccctgcaaataaggtggaggcaggagatatatgtgcagtatgtggaattactgatattcagatcggggagacaattgctgataaagtatctgggaaaccactaccttcaatcaaggtggaagaaccaacagtgaaaatgtctttctccataaacacttcaccttttgttggccgtgagggaaagtatgttactagtaggaatttaagggacaggctttatcgtgaacttgagcggaatctggctatgaaagttgaagatggtgaaacagctgatacatttgttgtcagtgggcgtggaactttgcatatcaccatacttatagaaaatatgcgaagagaaggatatgaattcatggttgggcctcccaaagttatcaacaagaaggtggatgaaaaactgttggaaccgtatgagattgcaactgtggaggtaccagaagagcacatgggagctgttgttgaacttcttggcaagagacgaggacaaatgttcgatatgcaaggagttggattggaaggaactacactactcaaatataagatcccaacccgtggccttcttggattgcggaattcaattttaactgcctcccgagggactgctattctcaacactgtttttgatagctatgggccttgggctggtgaaattagtactcgggatcaaggctcattggttgcttttgaggatggaacaagtacttcttatgcaatctctagttcacaggagaggggacagatgtttattggtcctggagtggatgtttataaaggtcaaattgttggcatccatcagcgacctggggacttgtccttgaatgtttgcaagaagaaagctgcaaccaacatacgttccaacaaggaacaaacagtgattcttgatacgccattggactatagtctggatgactgcattgaatacatccaagaagatgaactagtagaggtcacccccgcaagtatccgaatgtccaagaatccaaaaattacaaacaagaaaacaaggtag

SEQ ID NO: 3958 - protein, 680 aa, Glycine max
MEKIAALAANTIHTPLLPNNTTLPKTSSFQPFFSNQLLGLPLSSSSSSASSLTAAKRFSCRPIKCSVSEATEPKTEKKRQLLRRGDVRNIAIVAHVDHGKTTLVDAMLKQTKVFRDNQFVQERIMDSNDLERERGITILSKNTSVTYKDAKINIIDTPGHSDFGGEVERILNMVEGILLVVDSVEGPMPQTRFVLKKALEFGHSVVVVVNKIDRPSARPEYVVNSTFELFIELNATDEQCDFQVIYASGIKGHAGLTPENLAEDLGPLFESIIRCIPGPRIDKDGALQMLVTNIEYDEHKGRIAIGRVQAGVLEKGLDVRVCTSDDSCRYGRVTELYVYDKFNRVPANKVEAGDICAVCGITDIQIGETIADKVSGKPLPSIKVEEPTVKMSFSINTSPFVGREGKYVTSRNLRDRLYRELERNLAMKVEDGETADTFVVSGRGTLHITILIENMRREGYEFMVGPPKVINKKVDEKLLEPYEIATVEVPEEHMGAVVELLGKRRGQMFDMQGVGLEGTTLLKYKIPTRGLLGLRNSILTASRGTAILNTVFDSYGPWAGEISTRDQGSLVAFEDGTSTSYAISSSQERGQMFIGPGVDVYKGQIVGIHQRPGDLSLNVCKKKAATNIRSNKEQTVILDTPLDYSLDDCIEYIQEDELVEVTPASIRMSKNPKITNKKTR

SEQ ID NO: 3959 - DNA, 2016 bp, Zea mays
  CDS (1)..(2016)
atgcagacgcagaccctcatcctacgcgctggcccctccgcccgacgctccacgccgccgccggccagcaccgtgcacctcgccgcctccggaaggtgcctgctgcgtgctcccagctcgctccgacgccgaagaacccgctctctcagggcctctgcctctctcgagcaggtcaaggaagtcgccagctccccagctccctccgcagggaagagtagtcaagcaactagaagagatgtgaggaatatcgcaattgttgctcatgttgatcatgggaaaacaactttggtggattcaatgttaaggcaagccaaggttttccgagataatcaagttgtgcaggaaagaataatggactccaatgacctagaacgggaaagagggatcacgattctgagcaagaatacatcaataacctataagggcactaaaatcaatataattgatactcctggacattcagattttggtggggaggttgagcgtgttctgaacatggtggaaggagttcttctagtggttgattctgtagaggggcctatgccacagacaaggtttgttctgaagaaagctctagaatttggacatgctgttgttgtagttgtaaacaagatcgacagacctactgctcgtcctgagtttgtggtgaattcaacatttgaactatttattgaattaaatgcaactgatgaacagtgtgatttccaaacagtctatgcaagtggaattaaaggaaaggccagtctatctcctgacaatttagctgatgacctaggacccctttttgaggcaattcttagatgcataccagagccacgcgttgagaaagatggtgccctgcaaatgcttgtatctaatactgaatatgatgagcacaaaggaagaattgcaattggacggctgcatgcaggagaacttcagcgtggcatggaggtcaaggtttgtacaccagacgatgcttgcagggttggtaaagtgagtgagctttttgtttatcagaacttcagccgtgcccccgttgaatctgttagtgctggtgacatttgtgctgtatgtggaatcgatgatatcatgatcggggaaactatagctgataaagttacaggaacaccattgcccactatcaaagtggaggagccaacagtcagaatgtctttctccatcaatacatcaccttttgttggacgggaggggaaatatgttactagccgaaatctccgtgacaggttgtatcgcgagctcgaaaggaatttggctatgaaagtagaagacggggaaactgctgatacatttcttgttagtggcagaggcacactacatctcacaatattgatagaaaatatgcggagagaaggatatgaatttatgattggacctccaaaggtcataaacaagacagtcgatggaaaactactagagccttatgagatagctgctgttgaagtcccagaggagtccatgggatcagttgttgagcttttagggaaaaggcgtggacagatggttgacatggaagctaacgggacggagggaacaacattgctgaaatacaagattcctaccagaggccttattggacttcggaatgcaattcttacagcttctcgtggcagagctatattgaatacaatctttgacagctatggcccatgggctggagatcttagctcacgtgatcagggatccttggttgcttttgaagatggaagcactacttcttatgcacttcttaatgcacaagaaagaggtatgttgtttgtccaaccagggcaggatgtttacaaaggtcaaattgttggtatccatcagagacctggtgatttagcaattaatgtgtgcaagaaaaaggctgctacaaatgttcgttccaacaaagaaactacagtggttcttgatgaacctttaagctacagtttggatgactgcatagagtttatccaagaagatgagatagtggaggttactcctgcaagcatccgtatgtgcaagaacccaaaagtttcgaagaaaaagtaa

SEQ ID NO: 3960 - protein, 671 aa, Zea mays
MQTQTLILRAGPSARRSTPPPASTVHLAASGRCLLRAPSSLRRRRTRSLRASASLEQVKEVASSPAPSAGKSSQATRRDVRNIAIVAHVDHGKTTLVDSMLRQAKVFRDNQVVQERIMDSNDLERERGITILSKNTSITYKGTKINIIDTPGHSDFGGEVERVLNMVEGVLLVVDSVEGPMPQTRFVLKKALEFGHAVVVVVNKIDRPTARPEFVVNSTFELFIELNATDEQCDFQTVYASGIKGKASLSPDNLADDLGPLFEAILRCIPEPRVEKDGALQMLVSNTEYDEHKGRIAIGRLHAGELQRGMEVKVCTPDDACRVGKVSELFVYQNFSRAPVESVSAGDICAVCGIDDIMIGETIADKVTGTPLPTIKVEEPTVRMSFSINTSPFVGREGKYVTSRNLRDRLYRELERNLAMKVEDGETADTFLVSGRGTLHLTILIENMRREGYEFMIGPPKVINKTVDGKLLEPYEIAAVEVPEESMGSVVELLGKRRGQMVDMEANGTEGTTLLKYKIPTRGLIGLRNAILTASRGRAILNTIFDSYGPWAGDLSSRDQGSLVAFEDGSTTSYALLNAQERGMLFVQPGQDVYKGQIVGIHQRPGDLAINVCKKKAATNVRSNKETTVVLDEPLSYSLDDCIEFIQEDEIVEVTPASIRMCKNPKVSKKK

SEQ ID NO: 3961 - DNA, 2022 bp, Zea mays
  CDS (1)..(2022)
atggcggcagcccttttgctccgcagtctccgcccatcggtgagccgggcacatatccaccttctttcccatgcctcctccccgacggcgctggggtctccccttttaccccgcctctactcctctgcggcagcgtcaaccgccgcctctcctgttttcacgcccggcggcgtcatggacccatcccgcatccgcaacgtagcggtgatagcccacgtcgaccatgggaagacgacgctcatggaccggctccttcgacagtgcggggccgatatcccccacgagcgcgccatggattcaatcagccttgagcgcgagcgcggcattaccattgcctccaaggtcacttctgtctcttggaaggaaaatgaactcaacatggtcgatacacctggccacgctgattttggtggtgaggttgaacgagttgttggaatggtggaaggagctgtcttggttgttgatgctggagagggacctttagcacaaactaaatttgtgctttcaaaagctttgaagtatggcttgcgtccaattcttctcctcaacaaggttgataggccttcagtttctgaagaaacctgcgatgaagtagagagcttggtttttgatctttttgcaaatcttggtgctacagaagaacagttagatttcccagttctttatgcatccgctaaagagggttgggcttccttaactttcaccaagagcccccctgataatgcaaagaatatgtcttcactgctcgattccattgtacgacatgttccttcaccaaaagctgatcttgaggctccattccaaatgttggtttccatgatggaacgtgatttttatctaggacgaatactcactgggagagtaaggtccggagttgtccgtgttggtgacaaagtccatggtcttcgcagtacagatgatggagttcataaaattgaggatggaaaggttgtcaaactcatgaaaaagaaaggcacaaatatggtaacagtagaggctgcaggggctggtgatataatttcaatggcaggattggctgctccagcaattggacatactgtggcaaattcagagatattgagtgctctgcctacaattgagttggatcctcccacaatatctatgacgtttggcgtgaatgattcaccgttggctggccgggatggcactcatctaactggagcaaaaattggtaaccgcctgatggcagaggcagaaacgaatttggctattaatgttctccctggaccattatcagaatcttatgaagttcaaggaagaggagagcttcagttaggaatattaattgaaaatatgcggcgtgagggatttgagctttcagtttcacctccaaaagtgatgtataaaacagagcgtggtgaaaggttggagcctattgaagaagtgactgttgaggttggtgaagagcatgtgggattcgtcttggaaaccattactcacaggaagggtgaagtagttgacatgggcccggttcctggcacaactggaagaactcgaatcttcatgacctgtccatctaggggtttggtgggtgtcaaaggaattttcagcagctttacacggggaactggatttatgcaccgtgcttttcaggcatatgctaaatacagaggtccactgggcagtgtcagaaaaggagttctgatatctgttggcaagggacttatcacttcacatgcccttatgagtttagaagctcgtgggatcctctttgtatcccctggaatggaggcatatgaagggatgatagttggtgagcactcacgtgacagtgatcttgaggtgaatcctgtgagaactaaagaacttacaaatatccgagcccctggaaaggatgaaaatgtccgtttgtctccaccccgattgatgagtttggaagaggcaattggatatgttgctgcagatgagcttattgaggttactcccaaggtcgtacgtcttcgaaagaagtacttggattccactaagcgtaagatgatgaaaaacaagcctatgaattag

SEQ ID NO: 3962 - protein, 673 aa, Zea mays
MAAALLLRSLRPSVSRAHIHLLSHASSPTALGSPLLPRLYSSAAASTAASPVFTPGGVMDPSRIRNVAVIAHVDHGKTTLMDRLLRQCGADIPHERAMDSISLERERGITIASKVTSVSWKENELNMVDTPGHADFGGEVERVVGMVEGAVLVVDAGEGPLAQTKFVLSKALKYGLRPILLLNKVDRPSVSEETCDEVESLVFDLFANLGATEEQLDFPVLYASAKEGWASLTFTKSPPDNAKNMSSLLDSIVRHVPSPKADLEAPFQMLVSMMERDFYLGRILTGRVRSGVVRVGDKVHGLRSTDDGVHKIEDGKVVKLMKKKGTNMVTVEAAGAGDIISMAGLAAPAIGHTVANSEILSALPTIELDPPTISMTFGVNDSPLAGRDGTHLTGAKIGNRLMAEAETNLAINVLPGPLSESYEVQGRGELQLGILIENMRREGFELSVSPPKVMYKTERGERLEPIEEVTVEVGEEHVGFVLETITHRKGEVVDMGPVPGTTGRTRIFMTCPSRGLVGVKGIFSSFTRGTGFMHRAFQAYAKYRGPLGSVRKGVLISVGKGLITSHALMSLEARGILFVSPGMEAYEGMIVGEHSRDSDLEVNPVRTKELTNIRAPGKDENVRLSPPRLMSLEEAIGYVAADELIEVTPKVVRLRKKYLDSTKRKMMKNKPMN

SEQ ID NO: 3963 - DNA, 2013 bp, Zea mays
  CDS (1)..(2013)
atgcatttgcagaccctcatcctacgcgctggcccctccgcccgacgctccacgccgccgccggccagcaccgtgcacctcgccgcctccggaaggtgcctgctgcgtgctcccagctcgctccgacgccgaagaacccgctctctcagggcctctgcctctctcgagcaggtcaaggaagtcgccagctccccagctccctccgggaagagtagtcaagcaactagaagagatgtgaggaatatcgcaattgttgctcatgttgatcatgggaaaacaactttggtggattcaatgttaaggcaagccaaggttttccgagataatcaagttgtgcaggaaagaataatggactccaatgacctagaacgggaaagagggatcacgattctgagcaagaatacatcaataacctataagggcactaaaatcaatataattgatactcctggacattcagattttggtggggaggttgagcgtgttctgaacatggtggaaggagttcttctagtggttgattctgtagaggggcctatgccacagacaaggtttgttctgaagaaagctctagaatttggacatgctgttgttgtagttgtaaacaagatcgacagacctactgctcgtcctgagtttgtggtgaattcaacatttgaactatttattgaattaaatgcaactgatgaacagtgtgatttccaaacagtctatgcaagtggaattaaaggaaaggccagtctatctcctgacaatttagctgatgacctaggacccctttttgaggcaattcttagatgcataccagagccacgcgttgagaaagatggtgccctgcaaatgcttgtatctaatactgaatatgatgagcacaaaggaagaattgcaattggacggctgcatgcaggagaacttcagcgtggcatggaggtcaaggtttgtacaccagacgatgcttgcagggttggtaaagtgagtgagctttttgtttatcagaacttcagccgtgcccccgttgaatctgttagtgctggtgacatttgtgctgtatgtggaatcgatgatatcatgatcggggaaactatagctgataaagttacaggaacaccattgcccactatcaaagtggaggagccaacagtcagaatgtctttctccatcaatacatcaccttttgttggacgggaggggaaatatgttactagccgaaatctccgtgacaggttgtatcgcgagctcgaaaggaatttggctatgaaagtagaagacggggaaactgctgatacatttcttgttagtggcagaggcacactacatctcacaatattgatagaaaatatgcggagagaaggatatgaatttatgattggacctccaaaggtcataaacaagacagtcgatggaaaactactagagccttatgagatagctgctgttgaagtcccagaggagtccatgggatcagttgttgagcttttagggaaaaggcgtggacagatggttgacatggaagctaacgggacggagggaacaacattgctgaaatacaagattcctaccagaggccttattggacttcggaatgcaattcttacagcttctcgtggcagagctatattgaatacaatctttgacagctatggcccatgggctggagatcttagctcacgtgatcagggatccttggttgcttttgaagatggaagcactacttcttatgcacttcttaatgcacaagaaagaggtatgttgtttgtccaaccagggcaggatgtttacaaaggtcaaattgttggtatccatcagagacctggtgatttagcaattaatgtgtgcaagaaaaaggctgctacaaatgttcgttccaacaaagaaactacagtggttcttgatgaacctttaagctacagtttggatgactgcatagagtttatccaagaagatgagatagtggaggttactcctgcaagcatccgtatgtgcaagaacccaaaagtttcgaagaaaaagtaa

SEQ ID NO: 3964 - protein, 670 aa, Zea mays
MHLQTLILRAGPSARRSTPPPASTVHLAASGRCLLRAPSSLRRRRTRSLRASASLEQVKEVASSPAPSGKSSQATRRDVRNIAIVAHVDHGKTTLVDSMLRQAKVFRDNQVVQERIMDSNDLERERGITILSKNTSITYKGTKINIIDTPGHSDFGGEVERVLNMVEGVLLVVDSVEGPMPQTRFVLKKALEFGHAVVVVVNKIDRPTARPEFVVNSTFELFIELNATDEQCDFQTVYASGIKGKASLSPDNLADDLGPLFEAILRCIPEPRVEKDGALQMLVSNTEYDEHKGRIAIGRLHAGELQRGMEVKVCTPDDACRVGKVSELFVYQNFSRAPVESVSAGDICAVCGIDDIMIGETIADKVTGTPLPTIKVEEPTVRMSFSINTSPFVGREGKYVTSRNLRDRLYRELERNLAMKVEDGETADTFLVSGRGTLHLTILIENMRREGYEFMIGPPKVINKTVDGKLLEPYEIAAVEVPEESMGSVVELLGKRRGQMVDMEANGTEGTTLLKYKIPTRGLIGLRNAILTASRGRAILNTIFDSYGPWAGDLSSRDQGSLVAFEDGSTTSYALLNAQERGMLFVQPGQDVYKGQIVGIHQRPGDLAINVCKKKAATNVRSNKETTVVLDEPLSYSLDDCIEFIQEDEIVEVTPASIRMCKNPKVSKKK

SEQ ID NO: 3965 - DNA, 26 bp, Artificial sequence
  primer
atgatcgaaaaattgcgtaatatcgc

SEQ ID NO: 3966 - DNA, 26 bp, Artificial sequence
  primer
ttagtgacgtttacgaatacggatag

SEQ ID NO: 3967 - protein, 659 aa, Artificial sequence
  consensus sequence
  Variant (3)..(3): Xaa in position 3 is any amino acid
  Variant (19)..(20): Xaa in position 19 to 20 is any amino acid
  Variant (22)..(22): Xaa in position 22 is any amino acid
  Variant (24)..(31): Xaa in position 24 to 31 is any amino acid
  Variant (32)..(37): Xaa in position 32 to 37 is any or no amino acid
  Variant (39)..(39): Xaa in position 39 is any amino acid
  Variant (45)..(45): Xaa in position 45 is any amino acid
  Variant (47)..(47): Xaa in position 47 is any amino acid
  Variant (55)..(55): Xaa in position 55 is any amino acid
  Variant (59)..(66): Xaa in position 59 to 66 is any amino acid
  Variant (67)..(77): Xaa in position 67 to 77 is any or no amino acid
  Variant (81)..(81): Xaa in position 81 is any amino acid
  Variant (96)..(98): Xaa in position 96 to 98 is any amino acid
  Variant (102)..(104): Xaa in position 102 to 104 is any amino acid
  Variant (106)..(106): Xaa in position 106 is any amino acid
  Variant (110)..(111): Xaa in position 110 to 111 is any amino acid
  Variant (118)..(118): Xaa in position 118 is any amino acid
  Variant (121)..(122): Xaa in position 121 to 122 is any amino acid
  Variant (125)..(128): Xaa in position 125 to 128 is any amino acid
  Variant (130)..(130): Xaa in position 130 is any amino acid
  Variant (134)..(135): Xaa in position 134 to 135 is any amino acid
  Variant (138)..(138): Xaa in position 138 is any amino acid
  Variant (140)..(143): Xaa in position 140 to 143 is any amino acid
  Variant (144)..(146): Xaa in position 144 to 146 is any or no amino acid
  Variant (148)..(150): Xaa in position 148 to 150 is any amino acid
  Variant (152)..(157): Xaa in position 152 to 157 is any amino acid
  Variant (160)..(161): Xaa in position 160 to 161 is any amino acid
  Variant (162)..(165): Xaa in position 162 to 165 is any or no amino acid
  Variant (167)..(167): Xaa in position 167 is any amino acid
  Variant (169)..(170): Xaa in position 169 to 170 is any amino acid
  Variant (171)..(171): Xaa in position 171 is any or no amino acid
  Variant (173)..(173): Xaa in position 173 is any amino acid
  Variant (174)..(178): Xaa in position 174 to 178 is any or no amino acid
  Variant (183)..(184): Xaa in position 183 to 184 is any amino acid
  Variant (186)..(186): Xaa in position 186 is any amino acid
  Variant (188)..(190): Xaa in position 188 to 190 is any amino acid
  Variant (192)..(192): Xaa in position 192 is any amino acid
  Variant (194)..(205): Xaa in position 194 to 205 is any amino acid
  Variant (206)..(213): Xaa in position 206 to 213 is any or no amino acid
  Variant (216)..(225): Xaa in position 216 to 225 is any amino acid
  Variant (227)..(231): Xaa in position 227 to 231 is any amino acid
  Variant (232)..(234): Xaa in position 232 to 234 is any or no amino acid
  Variant (236)..(236): Xaa in position 236 is any amino acid
  Variant (238)..(242): Xaa in position 238 to 242 is any amino acid
  Variant (244)..(249): Xaa in position 244 to 249 is any amino acid
  Variant (251)..(254): Xaa in position 251 to 254 is any amino acid
  Variant (257)..(259): Xaa in position 257 to 259 is any amino acid
  Variant (261)..(288): Xaa in position 261 to 288 is any amino acid
  Variant (289)..(297): Xaa in position 289 to 297 is any or no amino acid
  Variant (300)..(300): Xaa in position 300 is any amino acid
  Variant (302)..(306): Xaa in position 302 to 306 is any amino acid
  Variant (307)..(307): Xaa in position 307 is any or no amino acid
  Variant (309)..(309): Xaa in position 309 is any amino acid
  Variant (314)..(317): Xaa in position 314 to 317 is any amino acid
  Variant (319)..(326): Xaa in position 319 to 326 is any amino acid
  Variant (328)..(336): Xaa in position 328 to 336 is any amino acid
  Variant (338)..(342): Xaa in position 338 to 342 is any amino acid
  Variant (344)..(344): Xaa in position 344 is any amino acid
  Variant (347)..(348): Xaa in position 347 to 348 is any amino acid
  Variant (350)..(350): Xaa in position 350 is any amino acid
  Variant (352)..(352): Xaa in position 352 is any amino acid
  Variant (355)..(355): Xaa in position 355 is any amino acid
  Variant (358)..(359): Xaa in position 358 to 359 is any amino acid
  Variant (361)..(362): Xaa in position 361 to 362 is any amino acid
  Variant (363)..(375): Xaa in position 363 to 375 is any or no amino acid
  Variant (377)..(379): Xaa in position 377 to 379 is any amino acid
  Variant (383)..(386): Xaa in position 383 to 386 is any amino acid
  Variant (389)..(390): Xaa in position 389 to 390 is any amino acid
  Variant (392)..(394): Xaa in position 392 to 394 is any amino acid
  Variant (397)..(399): Xaa in position 397 to 399 is any amino acid
  Variant (401)..(409): Xaa in position 401 to 409 is any amino acid
  Variant (410)..(412): Xaa in position 410 to 412 is any or no amino acid
  Variant (414)..(414): Xaa in position 414 is any amino acid
  Variant (420)..(420): Xaa in position 420 is any amino acid
  Variant (422)..(423): Xaa in position 422 to 423 is any amino acid
  Variant (425)..(425): Xaa in position 425 is any amino acid
  Variant (427)..(427): Xaa in position 427 is any amino acid
  Variant (433)..(433): Xaa in position 433 is any amino acid
  Variant (435)..(439): Xaa in position 435 to 439 is any amino acid
  Variant (441)..(441): Xaa in position 441 is any amino acid
  Variant (443)..(448): Xaa in position 443 to 448 is any amino acid
  Variant (449)..(450): Xaa in position 449 to 450 is any or no amino acid
  Variant (452)..(454): Xaa in position 452 to 454 is any amino acid
  Variant (457)..(457): Xaa in position 457 is any amino acid
  Variant (459)..(462): Xaa in position 459 to 462 is any amino acid
  Variant (464)..(469): Xaa in position 464 to 469 is any amino acid
  Variant (471)..(478): Xaa in position 471 to 478 is any amino acid
  Variant (479)..(479): Xaa in position 479 is any or no amino acid
  Variant (482)..(486): Xaa in position 482 to 486 is any amino acid
  Variant (488)..(494): Xaa in position 488 to 494 is any amino acid
  Variant (495)..(497): Xaa in position 495 to 497 is any or no amino acid
  Variant (499)..(503): Xaa in position 499 to 503 is any amino acid
  Variant (505)..(505): Xaa in position 505 is any amino acid
  Variant (511)..(514): Xaa in position 511 to 514 is any amino acid
  Variant (516)..(518): Xaa in position 516 to 518 is any amino acid
  Variant (520)..(520): Xaa in position 520 is any amino acid
  Variant (522)..(522): Xaa in position 522 is any amino acid
  Variant (524)..(528): Xaa in position 524 to 528 is any amino acid
  Variant (530)..(531): Xaa in position 530 to 531 is any amino acid
  Variant (533)..(541): Xaa in position 533 to 541 is any amino acid
  Variant (542)..(544): Xaa in position 542 to 544 is any or no amino acid
  Variant (546)..(547): Xaa in position 546 to 547 is any amino acid
  Variant (549)..(549): Xaa in position 549 is any amino acid
  Variant (551)..(555): Xaa in position 551 to 555 is any amino acid
  Variant (557)..(560): Xaa in position 557 to 560 is any amino acid
  Variant (562)..(568): Xaa in position 562 to 568 is any amino acid
  Variant (571)..(572): Xaa in position 571 to 572 is any amino acid
  Variant (574)..(580): Xaa in position 574 to 580 is any amino acid
  Variant (582)..(582): Xaa in position 582 is any amino acid
  Variant (584)..(586): Xaa in position 584 to 586 is any amino acid
  Variant (588)..(590): Xaa in position 588 to 590 is any amino acid
  Variant (592)..(593): Xaa in position 592 to 593 is any amino acid
  Variant (596)..(597): Xaa in position 596 to 597 is any amino acid
  Variant (599)..(602): Xaa in position 599 to 602 is any amino acid
  Variant (604)..(604): Xaa in position 604 is any amino acid
  Variant (608)..(608): Xaa in position 608 is any amino acid
  Variant (610)..(612): Xaa in position 610 to 612 is any amino acid
  Variant (613)..(613): Xaa in position 613 is any or no amino acid
  Variant (615)..(618): Xaa in position 615 to 618 is any amino acid
  Variant (620)..(621): Xaa in position 620 to 621 is any amino acid
  Variant (623)..(626): Xaa in position 623 to 626 is any amino acid
  Variant (629)..(636): Xaa in position 629 to 636 is any amino acid
  Variant (639)..(640): Xaa in position 639 to 640 is any amino acid
  Variant (645)..(647): Xaa in position 645 to 647 is any amino acid
  Variant (649)..(649): Xaa in position 649 is any amino acid
  Variant (652)..(653): Xaa in position 652 to 653 is any amino acid
  Variant (655)..(656): Xaa in position 655 to 656 is any amino acid
  Variant (657)..(658): Xaa in position 657 to 658 is any or no amino acid
RNXAIIAHVDHGKTTLVDXXLXQXXXXXXXXXXXXXXRXMDSNDXEXERGITILXKNTXXXXXXXXXXXXXXXXXXXINIXDTPGHADFGGEVERXXXMVDXXXLXVDAXXGPMPQTXFVXXKAXXXXLXPIVXXNKXDXXXXXXXRXXXVXXXXXXLFXXXXXXLXAXXXQXXXXXXLDFPXXYXSXXXGXAXXXXXXXXXXXXXXXXXXXXPLXXXXXXXXXXPXXXXXXXXPXQXXXXXLXXXXXXGXXXXGRXXXGXXXXXXXXXXXXXXXXXXXXXXXXXXXXXXXXXXXXXGLXRXXXXXXAXAGDIXXXXGXXXXXXXXTXXXXXXXXXLXXXXXDXPTXXMXFXVNXSPXXGXXXXXXXXXXXXXXXGXXXTSRXXXXRLXXEXXXNVXXXVXXXXXXXXXXXXVXGRGELXLXXLXEXMRREGXEXXXXXPXVXXXXXXXXGXXXEPXEXXXXDXXXXXXGXXXXXXXXXRKXXXXXMXXXXXXXXXXRXXXXXPXRGLIGXXXXFXXXTXGXGXXXXXFXXYXXXXXXXXXXXXRXXGXLXXXXXGXXXXYXXXXXXXRGXXFXXXXXXXYXGXXXGXXXRXXDLXXNXXXXKXLTNXRXXXXDXXXXLXXPXXXXLEXXXXXXXXDEXXEVTPXXXRXRKXXLXXXXR

SEQ ID NO: 3968 - protein, 43 aa, Artificial sequence
  protein pattern
  Variant (15)..(15): Xaa in position 15 is Ala, Gly, Ile or Val
  Variant (16)..(16): Xaa in position 16 is Leu, Met or Val
  Variant (17)..(17): Xaa in position 17 is any amino acid
  Variant (20)..(20): Xaa in position 20 is Asp, Glu or Asn
  Variant (21)..(21): Xaa in position 21 is Ala, Cys, Gly, Ser or Thr
  Variant (22)..(23): Xaa in position 22 to 23 is any amino acid
  Variant (24)..(25): Xaa in position 24 to 25 is Ile, Leu or Val
  Variant (26)..(26): Xaa in position 26 is Ile or Val
  Variant (28)..(28): Xaa in position 28 is Ala, Pro or Ser
  Variant (29)..(29): Xaa in position 29 is any amino acid
  Variant (30)..(30): Xaa in position 30 is Asp or Glu
  Variant (32)..(32): Xaa in position 32 is Ala, Cys, Pro, Thr or Val
  Variant (33)..(33): Xaa in position 33 is Leu or Met
  Variant (34)..(34): Xaa in position 34 is Ala or Pro
  Variant (37)..(37): Xaa in position 37 is any amino acid
  Variant (40)..(41): Xaa in position 40 to 41 is any amino acid
  Variant (43)..(43): Xaa in position 43 is Ala, Ser or Thr
DTPGHADFGGEVERXXXMVXXXXXXXDXXXGXXXQTXFVXXKX

SEQ ID NO: 3969 - protein, 27 aa, Artificial sequence
  protein pattern
  Variant (3)..(3): Xaa in position 3 is Ile or Val
  Variant (6)..(6): Xaa in position 6 is Ile or Val
  Variant (18)..(24): Xaa in position 18 to 24 is any or no amino acid
  Variant (26)..(26): Xaa in position 26 is any amino acid
  Variant (27)..(27): Xaa in position 27 is Ile, Leu or Met
RNXAIXAHVDHGKTTLVXXXXXXXDXX

SEQ ID NO: 3970 - protein, 32 aa, Artificial sequence
  protein pattern
  Variant (2)..(2): Xaa in position 2 is any amino acid
  Variant (3)..(3): Xaa in position 3 is any or no amino acid
  Variant (9)..(9): Xaa in position 9 is any amino acid
  Variant (11)..(11): Xaa in position 11 is Ala, Gly, Ser or Thr
  Variant (12)..(12): Xaa in position 12 is Ile or Val
  Variant (14)..(14): Xaa in position 14 is Ile, Leu or Val
  Variant (16)..(16): Xaa in position 16 is any amino acid
  Variant (22)..(22): Xaa in position 22 is Phe or Tyr
  Variant (24)..(24): Xaa in position 24 is Phe, Ile, Leu, Met or Val
  Variant (25)..(25): Xaa in position 25 is any amino acid
  Variant (26)..(26): Xaa in position 26 is Ala, Ile, Leu or Val
  Variant (27)..(27): Xaa in position 27 is Ala, Gly, Ser or Thr
  Variant (28)..(28): Xaa in position 28 is any amino acid
  Variant (30)..(30): Xaa in position 30 is any amino acid
  Variant (31)..(31): Xaa in position 31 is Ala, Ile or Val
  Variant (32)..(32): Xaa in position 32 is Ile, Leu, Met or Val
VXXGRGELXLXXLXEXMRREGXEXXXXXPXXX

SEQ ID NO: 3971 - protein, 56 aa, Artificial sequence
  protein pattern
  Variant (2)..(6): Xaa in position 2 to 6 is any amino acid
  Variant (7)..(7): Xaa in position 7 is Ala, Gly or Ser
  Variant (8)..(10): Xaa in position 8 to 10 is any amino acid
  Variant (11)..(11): Xaa in position 11 is Ala, Ile, Leu or Val
  Variant (12)..(12): Xaa in position 12 is Ala, Glu, Gln or Ser
  Variant (13)..(13): Xaa in position 13 is any amino acid
  Variant (16)..(16): Xaa in position 16 is any amino acid
  Variant (17)..(17): Xaa in position 17 is any or no amino acid
  Variant (19)..(25): Xaa in position 19 to 25 is any amino acid
  Variant (26)..(26): Xaa in position 26 is any or no amino acid
  Variant (28)..(28): Xaa in position 28 is any amino acid
  Variant (30)..(30): Xaa in position 30 is any amino acid
  Variant (31)..(31): Xaa in position 31 is Ile, Leu or Val
  Variant (32)..(32): Xaa in position 32 is any amino acid
  Variant (34)..(36): Xaa in position 34 to 36 is any amino acid
  Variant (37)..(37): Xaa in position 37 is His, Lys or Arg
  Variant (38)..(39): Xaa in position 38 to 39 is any amino acid
  Variant (41)..(41): Xaa in position 41 is Ile, Leu or Met
  Variant (42)..(42): Xaa in position 42 is any amino acid
  Variant (43)..(43): Xaa in position 43 is Ile, Leu or Val
  Variant (45)..(48): Xaa in position 45 to 48 is any amino acid
  Variant (50)..(51): Xaa in position 50 to 51 is any amino acid
  Variant (52)..(52): Xaa in position 52 is Asp, Ser or Thr
  Variant (54)..(54): Xaa in position 54 is any amino acid
  Variant (56)..(56): Xaa in position 56 is Ala, Gln, Ser or Thr
GXXXXXXXXXXXXRGXXFXXXXXXXXYXGXXXGXXXXXXDXXXNXXXXKXXXNXRX

SEQ ID NO: 3972 - protein, 23 aa, Artificial sequence
  protein pattern
  Variant (3)..(3): Xaa in position 3 is Asn or Ser
  Variant (4)..(4): Xaa in position 4 is any amino acid
  Variant (5)..(5): Xaa in position 5 is Ala, Asp, Glu, Asn, Ser or Thr
  Variant (6)..(6): Xaa in position 6 is any amino acid
  Variant (8)..(8): Xaa in position 8 is any amino acid
  Variant (15)..(15): Xaa in position 15 is any amino acid
  Variant (16)..(16): Xaa in position 16 is Ala or Ser
  Variant (18)..(19): Xaa in position 18 to 19 is any amino acid
  Variant (20)..(20): Xaa in position 20 is Ala, Cys, Gly, Ser or Thr
  Variant (21)..(22): Xaa in position 21 to 22 is any amino acid
  Variant (23)..(23): Xaa in position 23 is Phe, His, Trp or Tyr
MDXXXXEXERGITIXXKXXXXXX

SEQ ID NO: 3973 - protein, 21 aa, Artificial sequence
  protein pattern
  Variant (2)..(2): Xaa in position 2 is Glu or Pro
  Variant (4)..(4): Xaa in position 4 is Ala, Ser or Thr
  Variant (5)..(5): Xaa in position 5 is Ile, Leu, Met or Val
  Variant (6)..(6): Xaa in position 6 is any amino acid
  Variant (7)..(7): Xaa in position 7 is Met or Val
  Variant (8)..(8): Xaa in position 8 is any amino acid
  Variant (9)..(9): Xaa in position 9 is Phe, Ile, Met or Val
  Variant (10)..(11): Xaa in position 10 to 11 is any amino acid
  Variant (13)..(13): Xaa in position 13 is any amino acid
  Variant (16)..(17): Xaa in position 16 to 17 is any amino acid
  Variant (19)..(19): Xaa in position 19 is any amino acid
  Variant (20)..(20): Xaa in position 20 is Asp, Glu, Gly or Ser
DXPXXXXXXXXNXSPXXGXXG

SEQ ID NO: 3974 - protein, 23 aa, Artificial sequence
  protein pattern
  Variant (2)..(2): Xaa in position 2 is Ala, Ser or Thr
  Variant (8)..(13): Xaa in position 8 to 13 is any amino acid
  Variant (14)..(15): Xaa in position 14 to 15 is any or no amino acid
  Variant (17)..(17): Xaa in position 17 is any amino acid
  Variant (18)..(19): Xaa in position 18 to 19 is any or no amino acid
  Variant (21)..(21): Xaa in position 21 is any amino acid
  Variant (22)..(22): Xaa in position 22 is Ala, Gly or Leu
  Variant (23)..(23): Xaa in position 23 is Phe, Ile, Leu, Met or Val
PXRGLIGXXXXXXXXTXXXGXXX

SEQ ID NO: 3975 - protein, 25 aa, Artificial sequence
  protein pattern
  Variant (2)..(2): Xaa in position 2 is Asp or Glu
  Variant (3)..(4): Xaa in position 3 to 4 is any amino acid
  Variant (5)..(5): Xaa in position 5 is Ile, Leu, Met or Val
  Variant (6)..(6): Xaa in position 6 is Ala, Asp, Glu, Gly, Gln or Ser
  Variant (7)..(7): Xaa in position 7 is Phe, Trp or Tyr
  Variant (8)..(10): Xaa in position 8 to 10 is any amino acid
  Variant (11)..(11): Xaa in position 11 is Asp or Gly
  Variant (12)..(12): Xaa in position 12 is Asp or Glu
  Variant (13)..(14): Xaa in position 13 to 14 is any amino acid
  Variant (19)..(21): Xaa in position 19 to 21 is any amino acid
  Variant (23)..(23): Xaa in position 23 is Ile, Leu, Met or Val
  Variant (24)..(24): Xaa in position 24 is any amino acid
LXXXXXXXXXXXXXEVTPXXXRXXK

SEQ ID NO: 3976 - protein, 19 aa, Artificial sequence
  protein pattern
  Variant (2)..(2): Xaa in position 2 is any amino acid
  Variant (3)..(3): Xaa in position 3 is Ile, Leu or Val
  Variant (4)..(4): Xaa in position 4 is any amino acid
  Variant (5)..(5): Xaa in position 5 is Ala, Asp, Glu or Asn
  Variant (8)..(9): Xaa in position 8 to 9 is any or no amino acid
  Variant (11)..(13): Xaa in position 11 to 13 is any amino acid
  Variant (14)..(14): Xaa in position 14 is Asp or Asn
  Variant (15)..(15): Xaa in position 15 is Leu or Val
  Variant (16)..(16): Xaa in position 16 is Ala, Gly or Ser
  Variant (17)..(17): Xaa in position 17 is Ile, Leu or Met
  Variant (18)..(18): Xaa in position 18 is any amino acid
  Variant (19)..(19): Xaa in position 19 is Ile, Leu or Val
RXXXXRLXXEXXXXXXXXX

SEQ ID NO: 3977 - protein, 18 aa, Artificial sequence
  protein pattern
  Variant (3)..(3): Xaa in position 3 is Ile or Leu
  Variant (4)..(4): Xaa in position 4 is Ile or Val
  Variant (5)..(5): Xaa in position 5 is any amino acid
  Variant (6)..(6): Xaa in position 6 is Phe, Ile, Leu, Met or Val
  Variant (7)..(7): Xaa in position 7 is Ala, Glu, Asn, Ser or Thr
  Variant (9)..(13): Xaa in position 9 to 13 is any amino acid
  Variant (14)..(14): Xaa in position 14 is Ile, Leu or Val
  Variant (15)..(15): Xaa in position 15 is Ala, Gly, Ser or Thr
  Variant (16)..(16): Xaa in position 16 is any amino acid
  Variant (17)..(17): Xaa in position 17 is Ser or Thr
  Variant (18)..(18): Xaa in position 18 is Phe, Ile, Leu or Val
GDXXXXXGXXXXXXXXXX

SEQ ID NO: 3978 - DNA, 1128 bp, Saccharomyces cerevisiae
  CDS (1)..(1128)
atgctcagatatcatatgcaaggttttagtgggtacggtgtccagtattctccctttttcgataacaggctcgcggtagctgctggttcaaactttggcctggttgggaatggaaaattgttcatccttgagattgatcgttcaggtagaatagtggaagttaattcctttttaacacaggattgtttatttgatcttgcatggaacgaaagtcatgaaaaccaagtgttggttgcacagggcgatggtacattacgcttgtttgatacaacctttaaagagtttcctattgctatatttaaagagcatgaacgagaagtattcagttgtaattggaacttagtcaacaggcagaatttcttaagtagttcatgggatggatctataaaaatatggtcccctctaagaaagcaaagtttaatgacccttactccacgacctttagagattaccaaaatggtggatccattaaacgccattatattgaaaaagaaaagctttacaggtatttcaaaaaacaggaactgtgtataccaagcacagttctcgccccacgaccaaaatctcgtattatcctgttcagggaattcttatgcaagcttatttgacattagactaccttccggcaaaaatcagaataattttttagtgcattcaggactagaagcattgacttgcgatttcaacaaatacagaccttatgtagttgccacaggaggtgtagataatgccattagaatctgggacattaggatgctaaataaaaatgaatcagcgactatcaagaggactgtgcccggccaacttcacaattcatcatgcatcaatgaaatccctaatgcgcacgggctggcaatcagaaaagttacctggtcccctcatcattccaatattttaatgtcagcttcatatgatatgacctgtcgaatatggagagatctcagcaacgatggtgcaaaagaaacatataaaactaactctacggatgctactaaaggttccattttcaatttcacacagcattcagaattcgtatttggagctgactggagcttgtggggaaagccaggatatgtggcttcaactgcatgggatggaaatttatttgtatggaacggcttaggttga

SEQ ID NO: 3979 - protein, 375 aa, Saccharomyces cerevisiae
MLRYHMQGFSGYGVQYSPFFDNRLAVAAGSNFGLVGNGKLFILEIDRSGRIVEVNSFLTQDCLFDLAWNESHENQVLVAQGDGTLRLFDTTFKEFPIAIFKEHEREVFSCNWNLVNRQNFLSSSWDGSIKIWSPLRKQSLMTLTPRPLEITKMVDPLNAIILKKKSFTGISKNRNCVYQAQFSPHDQNLVLSCSGNSYASLFDIRLPSGKNQNNFLVHSGLEALTCDFNKYRPYVVATGGVDNAIRIWDIRMLNKNESATIKRTVPGQLHNSSCINEIPNAHGLAIRKVTWSPHHSNILMSASYDMTCRIWRDLSNDGAKETYKTNSTDATKGSIFNFTQHSEFVFGADWSLWGKPGYVASTAWDGNLFVWNGLG

SEQ ID NO: 3980 - DNA, 1297 bp, Zea mays
  CDS (119)..(1078)
cattgggaccctcgaggccggccggggaaagatagattgaaaagggaaaataaaattaaaatccaagtcttacgcgagtccccttcccgatccgccggccgatccacccaccgccgccatgccggcgttcaaggccccggcgccgggcttcgccgtgcgcttcagccccttccacgagaaccgcctcctcgccgccacgtcccagcacttcggtctcgtgggtaacggtcacctcatcgtcctcgacctagccggcggcgggcctggggccgccccggcgccggtcttctccttcccgacctccgatgcgctcttcgactgcgcgtggtccgagtcccacgactccctctgcgccgccgcctccggggacggctccgtgcgccttttcgacgccgctctcccgccggcgcagaaccccgtgcggctcctccgggagcacgcacgggaggtgcacggcctcgactggaaccccgtccgccgggacgccttcatctccgcctcctgggacgacacgctcaagctctggtcccccgaccgcccagcctccgtccgcaccttccggggccacgagtactgcgtctacgccgccgcctggtccgcgcgccacccggacgtcttcgcgtcggcctccggggaccgaaccgcgcgcgtctgggacgtccgggatcccgcgcccacgctcatcctgcccgcgcacgaccacgaggtgctctcgctcgactgggacaagtacgacccctccatcctcgccaccgcctccgtcgacaagtccatccgcgtctgggacgtgcgcgcgccgcgggcgcccatcgcgcagctcgccggacacggctacgccgttaagcgggtccgtttctcgccgcaccgccagggcatgctcatgtcatgctcctacgacatgactgtctgcatgtgggactaccgcgccgaggatgctctgctcgccaggtacaaccaccacacggagttcgttgccggcatcgacatgagcgtcctcgtcgatggcttgctcgctagcaccggatgggacgagatggtctacatctggccatttgggacggatccaagagccatgtagcacgcagatgcaatagaccaggtgatttgtactattggttctcagctatgcattgggcggtggtaatactaatacatgctcctacatgttcagttactatctcttcaaatgagttgaagaagttggaataatgtcaaaaatttgttcagttactatctcattgagctctctgccagcgcctcgccaatcaggctcagactagtcgcggatggatatggc

SEQ ID NO: 3981 - protein, 319 aa, Zea mays
MPAFKAPAPGFAVRFSPFHENRLLAATSQHFGLVGNGHLIVLDLAGGGPGAAPAPVFSFPTSDALFDCAWSESHDSLCAAASGDGSVRLFDAALPPAQNPVRLLREHAREVHGLDWNPVRRDAFISASWDDTLKLWSPDRPASVRTFRGHEYCVYAAAWSARHPDVFASASGDRTARVWDVRDPAPTLILPAHDHEVLSLDWDKYDPSILATASVDKSIRVWDVRAPRAPIAQLAGHGYAVKRVRFSPHRQGMLMSCSYDMTVCMWDYRAEDALLARYNHHTEFVAGIDMSVLVDGLLASTGWDEMVYIWPFGTDPRAM

SEQ ID NO: 3982 - DNA, 1177 bp, Triticum aestivum
  CDS (59)..(1021)
accccccactccccatctatccccgccccgcccgtcccggatccacaccgccgccgcgatgccgtcgttcaaggccccggcgccgggcttctccgtccgcttcagcccgttccacgagcatcgcctcctcgctgccacctcgcagcacttcggtctcgtcggcaacgggcacctcctggttctcgacctctccgccgccgggcccggcgggcccggcctcaccccgctcttctccttccccacctccgacgcgctcttcgactgcgcgtggtccgagtcccacgactccctctgcgccgccgcgtcgggggacggctccgtgcggctcttcgacgtcacgctgccgccggcgcagaaccccgtccgcctcctccgggagcacgcgcgggaggtccacgggatcgactggaaccccgtccgccgcgacgccttcctctccgcctcctgggacgacaccctcaagctctggtcccccgaccgccccgcctccgtccgcaccttccgcggccacgagtactgcgtctacgccgccgcgtggtcggcccggcacccggacgtcttcgcgtcggcgtccggcgaccacacggcccgcgtctgggacgtgcgggagccggggcccaccctcgtcatcccggcccacgaccacgaggtgctctccctggattgggacaagtacgacccgtccatcctggccaccggctccgtcgacaagtcgatccgcatctgggacgtccgctcgccgcaggcgcccctcgcccagctcgcggggcacgggtacgccgtcaagcgcgtcaagttctcgccgcatcggcagggcatgctcatgtcctgctcctacgacatgacggtctgcatgtgggattaccggaaagaggacgccctgctgcaaaggtacggccaccacaccgagttcgtagctgggatcgacatgagcgtgctcaccgatgggctgctggccagcaccggctgggacgagatgatctacgtttggccatttgggagtgatcccagagcaatgtaacacaacatattttgataatctgtatcatgtctgttgagtcgatcttacattggctgtgatacatatggaatggaatggaagtaaacacctggtgagttgaagttggaataatgctacggtaccattgtttgcttcacaaattggttaagtttttag

SEQ ID NO: 3983 - protein, 320 aa, Triticum aestivum
MPSFKAPAPGFSVRFSPFHEHRLLAATSQHFGLVGNGHLLVLDLSAAGPGGPGLTPLFSFPTSDALFDCAWSESHDSLCAAASGDGSVRLFDVTLPPAQNPVRLLREHAREVHGIDWNPVRRDAFLSASWDDTLKLWSPDRPASVRTFRGHEYCVYAAAWSARHPDVFASASGDHTARVWDVREPGPTLVIPAHDHEVLSLDWDKYDPSILATGSVDKSIRIWDVRSPQAPLAQLAGHGYAVKRVKFSPHRQGMLMSCSYDMTVCMWDYRKEDALLQRYGHHTEFVAGIDMSVLTDGLLASTGWDEMIYVWPFGSDPRAM

SEQ ID NO: 3984 - DNA, 1369 bp, Pinus radiata
  CDS (223)..(1173)
ccgacgtcattatagaaacccttcatttttaagtagttacagagtgatggctgctatcatatcgttgttcgcaaatcggggcacggttaggtacatgagcatcagttcattatcataatcgcacgcttccaaagttcatctctgattttcttcttcttacacaggaagcaaaatctgagataattgtaaagaccatacaagcttgaatttggatttgccacgatgcctgtatttaggactgcattcaacggctatgctgtcaagttcagtccatttgtggaaactcgtttggctgtggcaacggcccagaattttgggataattgggaatggtcggcagcatgtgctagaacttacacccaatgggatcgttgaggtctgtgcttttgattcatctgatgggctttatgattgtacatggtccgaagctaatgaaaatttagttgtttcagccagtggtgatggcagtgttaaaatttgggatatagcacttccacctgtagcaaatcctattcgaagcttggaagagcatgcacgtgaggtttactctgttgattggaatcttgttagaaaggattgttttttaagtgcgtcctgggatgatactatcagactttggacgattgacaggcctcagtccatgcgtttgttcaaagaacacacttattgtatatatgcagcagtttggaatccaagacatgcagatgttttcgcctctgcttcaggtgattgcactgtgaggatttgggatgtcagagaacccaatgcaaccatcataattccagctcatgaacatgagattctttcttgtgattggaacaagtataatgattgtatgctggtgacggggtctgtggataaactaattaaagtatgggatattaggacctacaggactccaatgacagttttggaaggacacacatatgcaatccggagagttaaattttcacctcaccaggaaagccttattgcatcatgttcctacgatatgacaacatgtatgtgggattatagagctccagaggatgctcttctagctcgatatgatcatcatactgagtttgctgtgggaattgatataagtgttcttgtggagggtctgttggcaagcactggatgggatgaaactgtctatgtttggcagcatggaatggatcctcgagcttgttgagactgggtgtactagcttggcctttccctctcagattactggtttggtcttttacttcctctccgaggatgcaggaactgttttgcatccattttagatagccatttacattttacttattattggacttgtaaagatttttgtacccttgtaaattgcaaatttaatttacatttcttttgcattaaaaaaaaaa

SEQ ID NO: 3985 - protein, 316 aa, Pinus radiata
MPVFRTAFNGYAVKFSPFVETRLAVATAQNFGIIGNGRQHVLELTPNGIVEVCAFDSSDGLYDCTWSEANENLVVSASGDGSVKIWDIALPPVANPIRSLEEHAREVYSVDWNLVRKDCFLSASWDDTIRLWTIDRPQSMRLFKEHTYCIYAAVWNPRHADVFASASGDCTVRIWDVREPNATIIIPAHEHEILSCDWNKYNDCMLVTGSVDKLIKVWDIRTYRTPMTVLEGHTYAIRRVKFSPHQESLIASCSYDMTTCMWDYRAPEDALLARYDHHTEFAVGIDISVLVEGLLASTGWDETVYVWQHGMDPRAC

SEQ ID NO: 3986 - DNA, 954 bp, Arabidopsis thaliana
  CDS (1)..(954)
atgccggtgttcaaagctccgttcaatggctactctgtgaaattcagtccattctacgagtcacgcctcgccgtcgctacagctcagaacttcggaattctcggaaacggccgaatccatgtcctcgagctcgctcctggagctccaggcgtaactgaatccgtctcgtacgatacagccgacgctgtatacgacgtatgttggtcagaatctcatgactctgtgctcatcgccgcaattggtgacggctcagtgaagatttacgacacagctcttcctcctccttctaatccgattagatcattccaagagcacgcgcgtgaggttcaatctgtggattacaatcccacgcggcgcgattcgtttctcacttcttcgtgggatgatacggttaagctttgggctatggatcgtccggcgagtgtaaggacttttaaggaacatgcttattgcgtttatcaagcagtttggaatcctaaacatggtgatgtgtttgcttctgcttctggagattgtactttaaggatttgggatgttagagaacctggatcaactatgatcatccctgctcatgattttgagattttgtcttgtgattggaataagtatgatgattgtattttagctacttcttcagtggataagacagttaaggtttgggatgttaggagttatagagttcctttggctgtgcttaatggtcatggatatgcggtgaggaaggtgaaattctcgccgcataggaggagtttgatagcttcttgctcttatgatatgagtgtttgtctttgggactatatggtggaagatgctttggttggtaggtatgatcatcatacagagtttgctgttgggatcgatatgagtgttcttgttgaaggtttaatggcgagtactggttgggatgagcttgtttatgtttggcagcaagggatggatcctagagccagttga

SEQ ID NO: 3987 - protein, 317 aa, Arabidopsis thaliana
MPVFKAPFNGYSVKFSPFYESRLAVATAQNFGILGNGRIHVLELAPGAPGVTESVSYDTADAVYDVCWSESHDSVLIAAIGDGSVKIYDTALPPPSNPIRSFQEHAREVQSVDYNPTRRDSFLTSSWDDTVKLWAMDRPASVRTFKEHAYCVYQAVWNPKHGDVFASASGDCTLRIWDVREPGSTMIIPAHDFEILSCDWNKYDDCILATSSVDKTVKVWDVRSYRVPLAVLNGHGYAVRKVKFSPHRRSLIASCSYDMSVCLWDYMVEDALVGRYDHHTEFAVGIDMSVLVEGLMASTGWDELVYVWQQGMDPRAS

SEQ ID NO: 3988 - DNA, 972 bp, Magnaporthe grisea 70-15
  CDS (1)..(972)
atgagtgctcctatgcttgagttccggacgcagggcttcaacccctacgccgtcaaatattcgccctattatgacagccggatagctgttgcaagctctgcaaattatggcatcgtcggcaatggaagggtatatgccctgggtctgaatgccgcaggtgtacaagtggaaaagacgtttgacaccaacgatgctcagtatgacctggcatggtctgaactgaacgaaaaccaactcatcgtggcctgtggagatgggtccattaagctgttcgatttaggcgtgaacgactttcctgtcatgaatttccatgagcacaaaagggaagccttctcgtggtcaccaacccgtaaccactcactcaagacgctgccaataggcaactgcacatatagcgcgtccttttgccctctcaacccctctctcatctctgccgtgtcgacagactcacacctccggctgttcgacctccgaacgccggtatcggccaagtaccaccaggtggcagctatcccagtgcacggcgggccacagccgtctccccctgccgaaattctgacgcatgactggaacaagtaccgcgacaccgtcatcgcgaccggcggtgtcgaccgtgtcctgcgcacctttgatattcgcgccggcgtcaactcggtcggtcccatctccgtaatgcagggccacgactttgccgtgcgccggttggcctggagtccgcacgtcagcgatctgctcgtcagtgccagctacgacatgacggtgcgcctctggtctgacggctcgaatcagcagcccgctgctctgccaggtgcgccggttgcggctcagggtagacagttgggactgatgaaccgtcacactgagttcgctaccggccttgactggtgcttgtttggcgccggcggctgggttgcctcttgtgcctgggatcagagggtgctattgtgggacgcaaacgccttcctccggtga

SEQ ID NO: 3989 - protein, 323 aa, Magnaporthe grisea 70-15
MSAPMLEFRTQGFNPYAVKYSPYYDSRIAVASSANYGIVGNGRVYALGLNAAGVQVEKTFDTNDAQYDLAWSELNENQLIVACGDGSIKLFDLGVNDFPVMNFHEHKREAFSWSPTRNHSLKTLPIGNCTYSASFCPLNPSLISAVSTDSHLRLFDLRTPVSAKYHQVAAIPVHGGPQPSPPAEILTHDWNKYRDTVIATGGVDRVLRTFDIRAGVNSVGPISVMQGHDFAVRRLAWSPHVSDLLVSASYDMTVRLWSDGSNQQPAALPGAPVAAQGRQLGLMNRHTEFATGLDWCLFGAGGWVASCAWDQRVLLWDANAFLR

SEQ ID NO: 3990 - DNA, 1080 bp, Gibberella zeae PH-1
  CDS (1)..(1080)
atggctgcgatgctagaataccgaacgcaagggtataatccctatgccgtcaagtactccccatactacgactcgcgagttgccgttgcggcgtcggccaattttggcattgtaggaaatggtcgtgtatttgctctcgcattgactgcgcagggcatagaagttgagaagacgttcgatacaaacgatgcgctttatgacttggcctggtccgagatcaacgagaaccagctgattgtggcttgcggtgacggatctttgaagctattcgacttgggcgtgaacgacttcccagttatgaactttcatgaacataaaagagaaacgttctcgtggtcaccgacacgcaatcactcgataaagacgctacctatcggcacttgtacttacagcacatccttctgcccttccaaccccgccttgatatccgccgtatcttccgattctcacctacgcatcttcgatctccgaacaccatcatcagcaaaataccacctcacagcgacgatacccgttcatgcttcagggccgcagccatcacctggtgcctctgcgccagctgagatcctgactcatgattggaacaagtacagagatacggttatagccacggctggcgtagacagaattctgcggacctttgacatacggaaccctgctggcgggccgctttctgttatgcaaggccatgaatatgctgttcggcgacttgcgtggagtcctcattcgagtgacactctcatcagtgctagttacgatatgacggtgcgtttatggaatgacgggtcgatgcagcagcaacaacaaccacagggtccagggatggctccatcaataggtactcagatgggagtaatgaaccggcataccgagttcgttacaggagttgattggtgtctatttggtatgggcggttgggtggctactgttggctgggatgagagagtcttattgtgggatgccaacatattggcgttactgggagtaagcgtgcctgattcgatctttgtcatggataagaatctccaagcgtcatgtcacgagaacgaagcacatgttgggattatcatcatttcctaa

SEQ ID NO: 3991 - protein, 359 aa, Gibberella zeae PH-1
MAAMLEYRTQGYNPYAVKYSPYYDSRVAVAASANFGIVGNGRVFALALTAQGIEVEKTFDTNDALYDLAWSEINENQLIVACGDGSLKLFDLGVNDFPVMNFHEHKRETFSWSPTRNHSIKTLPIGTCTYSTSFCPSNPALISAVSSDSHLRIFDLRTPSSAKYHLTATIPVHASGPQPSPGASAPAEILTHDWNKYRDTVIATAGVDRILRTFDIRNPAGGPLSVMQGHEYAVRRLAWSPHSSDTLISASYDMTVRLWNDGSMQQQQQPQGPGMAPSIGTQMGVMNRHTEFVTGVDWCLFGMGGWVATVGWDERVLLWDANILALLGVSVPDSIFVMDKNLQASCHENEAHVGIIIIS

SEQ ID NO: 3992 - DNA, 1110 bp, Candida glabrata CBS 138
  CDS (1)..(1110)
atgctccgctatcaaacaacgggattcagtggatacggtgtacaatattcaccatactacgataatatactagctgtgaacactgggtcaaattttggattggttgggaatggtaagttattcatactcgaaattgataataatggtgtagtgaaggagaagaattcgtttcttacaaaagactgcctatttgactctgcatggaatgaattgaaacccaatcaggtagttgtggcacaaggtgacggctctttaagactatttgacactactttacagaaatttcccattgctatgttccatgaacatagcaaagaggtttatagttgcaactggaatttagtgagtaagtctaattttgtcagcagttcgtgggatggccaagtaaagatctggtcgccaaacaggaaggcaagtttaataacgttctccccacaccctatcgatgtctcaagagctttagataatttaccggaagtttcgcagagggataaactttcaccaaatcaagtagctcaaaatagaaattgtatctaccaggcgacattttcgcctcatgatgataaccttattttatgttgtgcgggaaactcatatgtaacactatttgatcttcgacaaaaccctggaaacaatcaaaagaactttattgctcataggggaaaaggtgccctctcatgcgacttcaataaatacagaccaaatataattgcaacttctggggttgataacagtattggcatatgggatataagaatgctacctaactcgtcaaatcaacaagggtttcagacaggcactttggttaacgaaattgttaatgcacacgatttggcggttaagaaagtttgctggtcacctcaccactcagatatactcttatccacatcctatgacatgtcttgtaagatttggaaggatgtatctgtacagaataatgtaccaactggtaagacaaacggctctttactatccaatggacttctttcaaacttcaaacaccacaccgaatttgtatttggtgccgattggagtttatggggtataccaggatatgttgccactgctgggtgggattctaacgtattcatatggaacggcctacaatag

SEQ ID NO: 3993 - protein, 369 aa, Candida glabrata CBS 138
MLRYQTTGFSGYGVQYSPYYDNILAVNTGSNFGLVGNGKLFILEIDNNGVVKEKNSFLTKDCLFDSAWNELKPNQVVVAQGDGSLRLFDTTLQKFPIAMFHEHSKEVYSCNWNLVSKSNFVSSSWDGQVKIWSPNRKASLITFSPHPIDVSRALDNLPEVSQRDKLSPNQVAQNRNCIYQATFSPHDDNLILCCAGNSYVTLFDLRQNPGNNQKNFIAHRGKGALSCDFNKYRPNIIATSGVDNSIGIWDIRMLPNSSNQQGFQTGTLVNEIVNAHDLAVKKVCWSPHHSDILLSTSYDMSCKIWKDVSVQNNVPTGKTNGSLLSNGLLSNFKHHTEFVFGADWSLWGIPGYVATAGWDSNVFIWNGLQ

SEQ ID NO: 3994 - DNA, 1119 bp, Kluyveromyces lactis NRRL Y-1140
  CDS (1)..(1119)
atgttaaagtatcatatgaaaggctatagtggttacggtgtagcttactcacctttctacgataacaaacttgcggttgcttcaggttctaactttggtttggttggtaatggaaaactaataattttagacataatgccaaatggtcagttagtagagtctaattctttcctaactcaagatgggcttttcgacttggcatggaatgaatctcatgagaaccagtgccttgttgctcaaggcgatggttctttgaggttattcgatattaaattgaaggactatccaatagccatatataaggaacaccaacgtgaagtattcagctgcaattggaatatgatacaaaagcagatgtttgtcagcagttcttgggatggaaaagtgaagctatggtctttgatgagacctcaaagtttgatgactatgagtccgaacgacactaatgctgcttcaactctcagtagaacctccgctgttgcgccggtacgtgtaccaatgtccaatcagaaagagcaccagcacgctgatggaaacaaagaatgtatctaccaggctaccttttctccgcatgatccaaacctagtcttatgttcttctggaaattcattcatttcgctttacgatctaagggtgcctaataatgggttaccgcaacatcaatttcttggccatgggggatttgaagccttgacctgtgattttaacaaatatagacctcatataattgctacgggtggagtggataagatgataaaagtatgggatttgagaatgtgcagaaaaatgctgtcacaaggacatcaaccaatcaacattaatgaaattcaaggccatgaattagccgttagaaaagtgacatggtcacctcatcatagtaacatgttactttcaacatcatatgatatgacgtgcagagtttggacagatctaagtgatgatggtcatgggctgaccgggaaaacgaatagcattgatccagcccatggttgtagattcatatttatggagcattccgagttcgtttttggagcagattggagtttatggggtacgccaggctttgttgcttcgactggctgggatggtcaagtttgcatttggaatggcataagatag

SEQ ID NO: 3995 - protein, 372 aa, Kluyveromyces lactis NRRL Y-1140
MLKYHMKGYSGYGVAYSPFYDNKLAVASGSNFGLVGNGKLIILDIMPNGQLVESNSFLTQDGLFDLAWNESHENQCLVAQGDGSLRLFDIKLKDYPIAIYKEHQREVFSCNWNMIQKQMFVSSSWDGKVKLWSLMRPQSLMTMSPNDTNAASTLSRTSAVAPVRVPMSNQKEHQHADGNKECIYQATFSPHDPNLVLCSSGNSFISLYDLRVPNNGLPQHQFLGHGGFEALTCDFNKYRPHIIATGGVDKMIKVWDLRMCRKMLSQGHQPININEIQGHELAVRKVTWSPHHSNMLLSTSYDMTCRVWTDLSDDGHGLTGKTNSIDPAHGCRFIFMEHSEFVFGADWSLWGTPGFVASTGWDGQVCIWNGIR

SEQ ID NO: 3996 - DNA, 1122 bp, Debaryomyces hansenii CBS767
  CDS (1)..(1122)
atgctatcatttagaacagcaggctataatggatatggggttcaatattcgccattcttcgataataagttagcggtagctacttccgctaattatgggttggtggggaatgggagactattcatattaggaattgaacctaatggatctattggcaacccaatttcttgggagacacaggatggattatttgatgttgcatggagtgagattcatgaaaatcaagtagttgcagcaagtggagacggctcaatcaagatattcgatatcactgtacctaattttccagtgatgaactatagagaacatacaaaagaagttttttccgttaattggaacttggtagataaaagtaactttgtatctgcttcatgggatgggacaatgaagatatggtcgccccaaagacaagaatccttacttacgttgagtccgaaggtagattatacgactaaaacttcgcctgtcgctcaaacggccaaacctccattatcacaccagcaacagcatcaacagcttaacactacaaattgtatatataatgcatccttctcacctcattctccttccacgattattagttgcaatgggtcttcacatgtacaagtatgggacataagatcacctcatccattacagttggattatattgcacatggtggattggaggctttaagttgtgattggaataaatacaaatcaactatagtcgcatccgctggaactgataaatcaatcagaatttgggatttaagaatgataactggtattgaccatccaaactccaacagtccaatgcctgcatatcatactataggtccaaccccgttaaatcaacttttgggccatgaatttgctgtgagaaaggtattgtggtcccctcacagtggtcaagaattaatgagtgcttcttatgatatgacgtgtagagtatggaacgatcaatctaacgaaaaagcgaggtttttgaatactccgaatggtggttgtactggcgttatgggaagacataaggaattcgctatagggtgcgactatagtttgtggggtgaaccaggatgggccgcatcgactggttgggatgaaatggtttatatatgggattctaagagattggcctga

SEQ ID NO: 3997 - protein, 373 aa, Debaryomyces hansenii CBS767
MLSFRTAGYNGYGVQYSPFFDNKLAVATSANYGLVGNGRLFILGIEPNGSIGNPISWETQDGLFDVAWSEIHENQVVAASGDGSIKIFDITVPNFPVMNYREHTKEVFSVNWNLVDKSNFVSASWDGTMKIWSPQRQESLLTLSPKVDYTTKTSPVAQTAKPPLSHQQQHQQLNTTNCIYNASFSPHSPSTIISCNGSSHVQVWDIRSPHPLQLDYIAHGGLEALSCDWNKYKSTIVASAGTDKSIRIWDLRMITGIDHPNSNSPMPAYHTIGPTPLNQLLGHEFAVRKVLWSPHSGQELMSASYDMTCRVWNDQSNEKARFLNTPNGGCTGVMGRHKEFAIGCDYSLWGEPGWAASTGWDEMVYIWDSKRLA

SEQ ID NO: 3998 - DNA, 1071 bp, Yarrowia lipolytica CLIB122
  CDS (1)..(1071)
atgttgggattcaaaacacagggattcaacggctacgcggccaactactcgccgtttttcaacgacaagattgcggtcggaacggcggccaactacgggctggtcggaaacggaaaactcttcattctgggcatctctcccgagggccgcatggtctgcgaaggccagtttgacacccaggacggcatttttgatgtcgcgtggtccgagcaacacgaaaaccacgtggcaaccgcctgcggagacggatcagtcaagctgttcgacatcaaggccggtgccttccctctggtatcgttcaaggagcacacacgggaagtcttctctgtcaactggaacatggccaacaaggcgctcttctgcacatcttcatgggactctacaatcaaaatctggacgccggaacgtacaaactccatcatgacccttggccagcctgctccggcccagggaacaaacgcttcagctcacattggccgtcagacggcccccaaccaggcagcagcccaggagtgcatttattcggcgaaattctcgcctcacacagactcgattattgcatccgcacactccacaggaatggtcaaggtgtgggacactcgagcaccccagcctctccagcaacagttttccacgcagcaaaccgagtctggaggaccaccagaggttctgtcgctggactggaacaagtacagacccacagtgattgccacaggtggcgttgatcggtctgttcaggtctacgatatccgaatgactcaacctgcagccaaccaacccgttcagccattgagcttgattctgggccacagactacccgtcagaggagtttcgtggtcaccgcatcatgccgacttgctgctgtcgtgttcttacgacatgactgctcgagtttggcgggacgctagcactggaggcaactatctggctcgacagcggggtggaacagaagtgaaatgcatggacagacacacagagttcgttattggcggcgactggtcgttatggggcgatcctggatggatcaccaccgttggatgggaccagatggtttatgtttggcatgcgtaa

SEQ ID NO: 3999 - protein, 356 aa, Yarrowia lipolytica CLIB122
MLGFKTQGFNGYAANYSPFFNDKIAVGTAANYGLVGNGKLFILGISPEGRMVCEGQFDTQDGIFDVAWSEQHENHVATACGDGSVKLFDIKAGAFPLVSFKEHTREVFSVNWNMANKALFCTSSWDSTIKIWTPERTNSIMTLGQPAPAQGTNASAHIGRQTAPNQAAAQECIYSAKFSPHTDSIIASAHSTGMVKVWDTRAPQPLQQQFSTQQTESGGPPEVLSLDWNKYRPTVIATGGVDRSVQVYDIRMTQPAANQPVQPLSLILGHRLPVRGVSWSPHHADLLLSCSYDMTARVWRDASTGGNYLARQRGGTEVKCMDRHTEFVIGGDWSLWGDPGWITTVGWDQMVYVWHA

SEQ ID NO: 4000 - DNA, 1068 bp, Aspergillus nidulans FGSC A4
  CDS (1)..(1068)
atgcttcattttcgtaccgaaggctatcaaggctatgcggtcaaatactcgccgttcttcgacaaccgattagcggttgcttcatccgccaacttcggcctcgtcggtaatggccgtctatatatcctcgagttgactccaaacggcattgtgccggcgaaatggttcacaacccaagacgccctttacgatctcgcctggtccgaagccaacgagcaccaagtcctaaccgctaccggcgacggcagcattaagctcttcgacagcacactcaacgacttccccattcagaattggaaagagcataatcgcgaagtattcagtgtatcctggaatctagtagcaaaggataccttttgctcgagcagctgggatggcaccgtgcgcatctggtccccgcaacggccgcactcgctcgtcactctgccgacacacagttgcacatacagcgcctccttttccccgcactcgcctgatattctttcctgcgtctcctcagattcatacctgcgggtatacgatctacggactccagcctccgcgtcaaaccaccttactctccagatacccatccatgcggcacctgcctcgccgattccgggaaaccccggggcgccacccgccgcatgtccgccatctgaagcgctgacccatgactggaacaagtatcggccgtctgttgttgcagtggccggcgtggacaggacgatcaggacgttcgacataagggctccacagcaggggccgcaggctattatgatcggacatgactacgcggttcgacgggtggcttggtcaccgcatctgtcgaatgtactgctgagcgcgagctatgatatgacctgccgggcttggagcgatcagtcgccgcccggagtagtcggggacacggatctcatgcggtctgggccgtcgcccgttatgggcgcggagctgggaaggatgaaccgacatacagaatttgtgacgggcgtggattggtgtctttttgggagcgaggggtggtgcgcaagcgttgggtgggatgagagcgtttatgtatgggatgtgcgtgcggtgatgggatag

SEQ ID NO: 4001 - protein, 355 aa, Aspergillus nidulans FGSC A4
MLHFRTEGYQGYAVKYSPFFDNRLAVASSANFGLVGNGRLYILELTPNGIVPAKWFTTQDALYDLAWSEANEHQVLTATGDGSIKLFDSTLNDFPIQNWKEHNREVFSVSWNLVAKDTFCSSSWDGTVRIWSPQRPHSLVTLPTHSCTYSASFSPHSPDILSCVSSDSYLRVYDLRTPASASNHLTLQIPIHAAPASPIPGNPGAPPAACPPSEALTHDWNKYRPSVVAVAGVDRTIRTFDIRAPQQGPQAIMIGHDYAVRRVAWSPHLSNVLLSASYDMTCRAWSDQSPPGVVGDTDLMRSGPSPVMGAELGRMNRHTEFVTGVDWCLFGSEGWCASVGWDESVYVWDVRAVMG

SEQ ID NO: 4002 - DNA, 1143 bp, Candida albicans SC5314
  CDS (1)..(1143): transl_table=12
atgctttcatttagaactaaaggatataatggttatggaatccaatattcgccattctacgataacaagctagcggtggcaacagcagcaaactatggattggtaggtaatgggagattatttatattaaatatagaacccaatggaactgtatccgatcaaatatcatgggagacgcaagatggtttattcgatatcgcatggagtgagattcatgaaaatcaagccgtagtggcttcaggagatgggactttaaaattgtttgatttgactgtacctaatttcccagtaatgaattggaaagaacattcaagagaggttttttgtgtcaattggaatcttgtagataagacaaatttcgtgagtgggagttgggatggaaatatcaaattatggtcacctaatagaccacaatcattattgacattaaattcaaatgttatggattactcaacacgagttgcaccaaatgcaggttcagcatcagttccgttatcgcatcaaccagcacatcaaccacaacaacaacagcagcagcaagtgaatactgccaattgcatatactcagcccaattttccccacattctccttccatggtggttagttgtaatggtgggtcacaagtacaagtctgggatgttcgtagtccgaatccgttgcaattgaaattcactgctcatggtggattagaagctttgtcagtagattggaataaatacaagtctactgtgattgcttcgggaggaactgataaatcagtgagaatatgggatttacgatcaattacaaaaatcgaccaacctatagcccaatcaccaatggcaagtgggcatatacgtggtccaactccattaaacgaattaattggtcatgaatttgctgttagacgagtacaatggtcacctcacaatccaaaagaattaatgtctacttcctatgatatgacagccagaatatggaatgatgaactggatgaaagagcaagattcttgaattcacgagtaggtggattgaaaggagtgtttggaagacacaaagagtttgttataggcagtgattacagtttatggggagaacctggctgggtagcaactacaggatgggatgaaatggtttatatatgggactctaaacgattataa

SEQ ID NO: 4003 - protein, 380 aa, Candida albicans SC5314
MLSFRTKGYNGYGIQYSPFYDNKLAVATAANYGLVGNGRLFILNIEPNGTVSDQISWETQDGLFDIAWSEIHENQAVVASGDGTLKLFDLTVPNFPVMNWKEHSREVFCVNWNLVDKTNFVSGSWDGNIKLWSPNRPQSLLTLNSNVMDYSTRVAPNAGSASVPLSHQPAHQPQQQQQQQVNTANCIYSAQFSPHSPSMVVSCNGGSQVQVWDVRSPNPLQLKFTAHGGLEALSVDWNKYKSTVIASGGTDKSVRIWDLRSITKIDQPIAQSPMASGHIRGPTPLNELIGHEFAVRRVQWSPHNPKELMSTSYDMTARIWNDESDERARFLNSRVGGLKGVFGRHKEFVIGSDYSLWGEPGWVATTGWDEMVYIWDSKRL

SEQ ID NO: 4004 - DNA, 1068 bp, Ustilago maydis 521
  CDS (1)..(1068)
atgtatccaccgcaaccgccgcttgcgcgcgtccgcacgcccggttatgcaggctactcgatcgcatggtcgcccttctttgctcaccggctggctgttgcctcgtcggccaactacggcttggtaggtaacggtcgcttgcacattctctccctctctccgcccgcttcgtcaggtcctgcgtcgctcaccatcgaaaaggtattcgacactcaagacggtctttacgatctcgccttctccgaggctcatgaaaatcagctggtcaccgcctcgggtgacggatcgatcaagctctgggattgtgcattgcaggagcatcccatccggaattggtccgagcacacccgagaggtgttctgcgtcgactggaacaacatcaacaaggagctctttgcaagttccagttgggatgcaagcgttagaatttggcatccagaacgaccgacgagcttgacagcaattacggcgcataccggctgcgtatatgcctgtgcgttttcgccacataatccagatctgttggctacagcgtgcgcggatggtcatctgaggctgttcgatttgcgccaatcaaccgcacagcagccgagtgtaacactacccgtgggcggtgaagtgctctgtctggattggaacaagtatcgacccatgaccatcgccaccggcagcacagatcgagtcatcaagacgtgggatctccgaagtgcaaccaacaacacgcacgtcggtgcacccgtgacaccgttgcagatgggaacaccgacagcagcaattctaggccacgagtacgcgatccgtaaagtagcctactctccacattcacctcagatgctagcgagcgcgagctacgacatgacagctaggatatgggacaccgacgctgccgccatggctggtttgcacaccgcccagcacgcacaaccacctccagccaccggtaccatgaggaagattcacgatacacatactgaatttgtcgtcggcgtcgcctggagtttctttcaagacggtttggtggctagcactgcatgggattcagagacgcatctgtggactgcgccgtaa

SEQ ID NO: 4005 - protein, 355 aa, Ustilago maydis 521
MYPPQPPLARVRTPGYAGYSIAWSPFFAHRLAVASSANYGLVGNGRLHILSLSPPASSGPASLTIEKVFDTQDGLYDLAFSEAHENQLVTASGDGSIKLWDCALQEHPIRNWSEHTREVFCVDWNNINKELFASSSWDASVRIWHPERPTSLTAITAHTGCVYACAFSPHNPDLLATACADGHLRLFDLRQSTAQQPSVTLPVGGEVLCLDWNKYRPMTIATGSTDRVIKTWDLRSATNNTHVGAPVTPLQMGTPTAAILGHEYAIRKVAYSPHSPQMLASASYDMTARIWDTDAAAMAGLHTAQHAQPPPATGTMRKIHDTHTEFVVGVAWSFFQDGLVASTAWDSETHLWTAP

SEQ ID NO: 4006 - DNA, 1002 bp, Cryptococcus neoformans var. neoformans B-3501A
  CDS (1)..(1002)
atgcaatacctccgcctctctctccctccgtttgcacataacaacctcgccttctctccgttttacgatcatcatttggctcttgcttccggttccaactttgggctagtcggcaatggcagggtgcacgtcgtcaagatggaccagcaggtcgcgggtggattggggctggtgagaagttgggatacagcagattgcgtgtatgacgtggcttggagcgagatacacgagaatcagatagcagcagcttgcggtaacggtgccatcaaactttttgatctcgctctcgaaggactacctatacaagcttggcaagaacatacggctgaagtcacgtccatcgaatggaacaacattgaaaaggaattgtttgtgactggttcatgggaccaatctgtcaaaatctggaaccccaatcgacagtcatcaatcctaaccatacctgcccatgcaggccaaatatactcctccacttggtctcctcattcaccaaccattatcgcgacttgtgcttctgatgggtttatccggatatgggatacacgtattctcccctcccccatccaagaaatcttccctccctccgccgcccctaatccaatgtcatcacgttctgctggagaaatacttagctgtgactggaataaatatactccacagctgctagcgttctcttctcaagatggaggggtcagtacggtggatttaagacacgtacctcgcaacgcagagaagatggcggtaaggctagtgggaaaacatggtttaccggcgaggaaagtgaaatgggacccgcataatggaaccagattactgagtgcaggctacgatatgacttgtagagtctggcaaactgatctgccaccagccgcacctttaagagaactatttagtcatcaaaaccatacggagtttgtaatggctgcagattgggccttgtttgaccccggattaatagctagtgcggggtgggacggggatttgcatatgtatcgtatctag

SEQ ID NO: 4007 - protein, 333 aa, Cryptococcus neoformans var. neoformans B-3501A
MQYLRLSLPPFAHNNLAFSPFYDHHLALASGSNFGLVGNGRVHVVKMDQQVAGGLGLVRSWDTADCVYDVAWSEIHENQIAAACGNGAIKLFDLALEGLPIQAWQEHTAEVTSIEWNNIEKELFVTGSWDQSVKIWNPNRQSSILTIPAHAGQIYSSTWSPHSPTIIATCASDGFIRIWDTRILPSPIQEIFPPSAAPNPMSSRSAGEILSCDWNKYTPQLLAFSSQDGGVSTVDLRHVPRNAEKMAVRLVGKHGLPARKVKWDPHNGTRLLSAGYDMTCRVWQTDLPPAAPLRELFSHQNHTEFVMAADWALFDPGLIASAGWDGDLHMYRI

SEQ ID NO: 4008 - DNA, 1053 bp, Penicillium chrysogenum
  CDS (1)..(1053)
atgctccattaccgcacacaaggatataacggttgcgctgtcaaatactccccattctttgacaatcgcctagctgttgcaagctcttcaaactttggcctagttggcaatggccgcctgcatattctagagctgactgccaatggaatccaaccactaaaatggtttacaacacaagactcactatatgacctcgcatggtctgaaatccacgagaaccaagtcctcgccgcatcaggcgacggcagcatcaagttattcgactgcacagcgaacgacttcccaatctcaaactggaaagagcacgcgcgggaagtattcagcgtaagctggaaccccgtcgcaaaggaccgtttctgctcaagtagctgggacggcacagtccgcatctggtcgccacatcgcccacagtccctcctcaccctcccaacccacagctgcacctactccgcatccttctgtccacacagtccagatattatctcgtgcgtgacgtcagactcatacgtgcgcgttttcgatctccgcaccccggcctccgcctcaaaccacctcgtcactcagatccccatccacgccggaccccccgcgcccgcaatccccggccaaccgggtggccctgccccgcctgctgaggccctcacccacgactggaacaagtaccgtcctaccgttctggccacagccggtgttgaccgtgccatccgcacgtttgatatccgggccccgcaacaagggccgctgtccactatgctcggacatgaatatgctgtgcggaaattggcttggtcgccgcatctttctaatgtccttttaagtgctagttacgatatgacttgtcgagtgtggagtgaccggtcagatgtggcaggcggggatatggatatgatgcgcgctggtccagtggttggcgcggaacttggacgcatgggtagacatactgagtttgtgacgggtgtggactggtgtctctttggaagtgagggctggtgtgctagcgttggctgggatgagaatctgtatgtgtgggatgtgcgagctacgatgtcataa

SEQ ID NO: 4009 - protein, 350 aa, Penicillium chrysogenum
MLHYRTQGYNGCAVKYSPFFDNRLAVASSSNFGLVGNGRLHILELTANGIQPLKWFTTQDSLYDLAWSEIHENQVLAASGDGSIKLFDCTANDFPISNWKEHAREVFSVSWNPVAKDRFCSSSWDGTVRIWSPHRPQSLLTLPTHSCTYSASFCPHSPDIISCVTSDSYVRVFDLRTPASASNHLVTQIPIHAGPPAPAIPGQPGGPAPPAEALTHDWNKYRPTVLATAGVDRAIRTFDIRAPQQGPLSTMLGHEYAVRKLAWSPHLSNVLLSASYDMTCRVWSDRSDVAGGDMDMMRAGPVVGAELGRMGRHTEFVTGVDWCLFGSEGWCASVGWDENLYVWDVRATMS

SEQ ID NO: 4010 - DNA, 951 bp, Vitis vinifera
  CDS (1)..(951)
  misc_feature (271)..(271): y is t or c
atgccagtcttcaaaaccccattcaacggctatgccgtgaagttcagccccttctacgagtcccgtctcgccgtcgccaccgcccagaactttgggatcctcggcaacggccgcctccatgtcctcgaactctcccccgccggacctatctccgaattcgcctccttcgacactgccgacggtgtctacgatgtcacctggtccgagtcccacgaatctctcctcatcgccgccgtcgctgacggctctgtcaagctctacgacctcgccytccctcccgcctccaatcctgttcgctccctccaagaacactcccgcgaagtccactccctcgacttcaaccccgtccgccgtgactcctttttgtcttcttcttgggacgacaccatcaagctctggactctcgatcgacccacaagtgtccgtactttcaaggagcatgcctattgcgtttactcttccgtttggaaccctcgccacgccgatgtctttgcctccgcctccggcgactgcacaatccgggtatgggacgtgcgcgagccgggctcgactatgatcctccctgcccacgaattcgagatccttgcgtgtgattggaacaagtatgatgactgtgtcttagtgtctgcttcggttgataagtccattaaggtgtgggacgtgaggaattttcgaattccggtctctgtgctcaatgggcacagctatgctgttcggaaggtgaaattttcaccgcataggcggggtgcgattgcctcctgttcatatgatatgactgtttgtctgtgggattacatggttgaggatgctctgattgggaggtatgatcaccacaccgagtttgcggttggggttgacatgagtgtgcttgtagaggggcttcttgcaagtacagggtgggatgaacttgtgtatgtttggcaacatggaactgatccgagagcgccttaa

SEQ ID NO: 4011 - protein, 316 aa, Vitis vinifera
  misc_feature (91)..(91): The Xaa at location 91 stands for Leu, or Phe.
MPVFKTPFNGYAVKFSPFYESRLAVATAQNFGILGNGRLHVLELSPAGPISEFASFDTADGVYDVTWSESHESLLIAAVADGSVKLYDLAXPPASNPVRSLQEHSREVHSLDFNPVRRDSFLSSSWDDTIKLWTLDRPTSVRTFKEHAYCVYSSVWNPRHADVFASASGDCTIRVWDVREPGSTMILPAHEFEILACDWNKYDDCVLVSASVDKSIKVWDVRNFRIPVSVLNGHSYAVRKVKFSPHRRGAIASCSYDMTVCLWDYMVEDALIGRYDHHTEFAVGVDMSVLVEGLLASTGWDELVYVWQHGTDPRAP

SEQ ID NO: 4012 - DNA, 1047 bp, Ostreococcus tauri
  CDS (1)..(1047)
atgccttctagctccagaacgcacggctttaacggctatgcggtgaagttctcgccgtatttcccacaaagaatcgcaatcgcgtcggcgcagaatttcggcatcatcgggaatggcgcgcaaatcatcgccgacgtggacccgacgacgggttcgctcgtagagatcgcgagattccccacccgtgatggtctgtacgactgcgcgtggagcgaagggcacgagagcgtgctggtttcggcgtgcggagacgggagcgtcaaggcgtgggacgtcggcggaggaccgagcgcgaatccgttgaggagctttcacgagcacacgcacgaggtgtatggggtgtcgtggaacgttgcgggtgggagagattcgttcttaagcgcgtcgtgggacgataagatcaagctatggacgctggatcgaccggagagcattcggacgttcgcggagcacgcgtattgcgtctacgcggctgagtggagtccgcatcatgcggacatattcgcgagcgcttcgggggattgcctgttgaaaatttgggacgttcgacagccgcatgcgacgctgagcgtccccgtgcacgattacgaggctctgtgctgcgattggaacaagtggaacgacagcgtcatcgccactgggagcgtggacaagactgtgaagttgtgggacattcggaatccgtctcgagagcttcgcacactcgtcgggcatgagtacgccgtgcggcgggtgaagtgctcgccgcattcggagagcatcgtgtacacatgctcgtacgatatgtccgtggcgatgtgggacacaaaggctcccggcgagccgttgttaaatcgctggacgcatcacacggagtttgccgttggtttggacacgtcgtgtcttatcgacggtctgatcgcatcgtgcgggtgggacgaaatggtacacgcgtggaacacaatcgatgggtcccctccgcccgcgcccgggatccgccctccggtgggcgcgcccatggcgcctccgtcttcgatgggcgcgcagcctcacgtgccggtgagatga

SEQ ID NO: 4013 - protein, 348 aa, Ostreococcus tauri
MPSSSRTHGFNGYAVKFSPYFPQRIAIASAQNFGIIGNGAQIIADVDPTTGSLVEIARFPTRDGLYDCAWSEGHESVLVSACGDGSVKAWDVGGGPSANPLRSFHEHTHEVYGVSWNVAGGRDSFLSASWDDKIKLWTLDRPESIRTFAEHAYCVYAAEWSPHHADIFASASGDCLLKIWDVRQPHATLSVPVHDYEALCCDWNKWNDSVIATGSVDKTVKLWDIRNPSRELRTLVGHEYAVRRVKCSPHSESIVYTCSYDMSVAMWDTKAPGEPLLNRWTHHTEFAVGLDTSCLIDGLIASCGWDEMVHAWNTIDGSPPPAPGIRPPVGAPMAPPSSMGAQPHVPVR

SEQ ID NO: 4014 - DNA, 1077 bp, Podospora anserina
  CDS (1)..(1077)
atggcctccctcctcgaagcccgaaccccgggcttcaacccttactcggtcaaatactccccctactacgactcccgcctcgccgtcgcctcctcctccaactacggcatcgtcggcaacggccgcctcttcatcttgggtctcggcccccagggcatcgccatcgaaaaaacctacgacacaaacgacgcccagtacgacctcgcctggtcagaaatcaacgaaaaccaatgcgcggtagcatgcggcgatggctccatcaagctcttcgacctcaacgtgcccgaatttcccgtcatgaacttccacgagcacaagcgagagaccttttccgtctgttggaaccccctcacaaaagacaccttcctctcctcatcatgggatggtaccgtcaaaatctggtccccaacccgcccagcaagcctcaaaaccctccccgtaggcaactgcacctactcggcctccttcagcccccacaacccctccctcatctcctgcgtcagttccgattcccacctccgcctgttcgacctccgcactcctgtcaacgcaaaataccacctcgtcgcccagattccgatccactcccccccttccataccccagtccaccatcctcccccgcctctccaacggcaccacctacgcgggtgccatcccgaacgaagccctcacgcacgattggaacaaatactcggacactgtcatcgccaccggcggggtggaccgcaccatccggacgtttgacattcgcaacccgaccggcggcccgacggcggtgttgctgggtcatgagtttgccgttaggaagctccagtggtcgccgcatgcgcgggatgtgcttgccagcgcagggtacgacatgacggtgagggtttggagtgatgggagcgcgatgccgtttccgcaggaggagaacgtcattagggtggggcaggagttggggttgatgaataggcacaccgagttttgcacgggggtggactggtgtctttttgggacggggggttgggtggctagtgttgggtgggatgagagggttttggtttgggatgcgcatacgcttttgaggaggtga

SEQ ID NO: 4015 - protein, 358 aa, Podospora anserina
MASLLEARTPGFNPYSVKYSPYYDSRLAVASSSNYGIVGNGRLFILGLGPQGIAIEKTYDTNDAQYDLAWSEINENQCAVACGDGSIKLFDLNVPEFPVMNFHEHKRETFSVCWNPLTKDTFLSSSWDGTVKIWSPTRPASLKTLPVGNCTYSASFSPHNPSLISCVSSDSHLRLFDLRTPVNAKYHLVAQIPIHSPPSIPQSTILPRLSNGTTYAGAIPNEALTHDWNKYSDTVIATGGVDRTIRTFDIRNPTGGPTAVLLGHEFAVRKLQWSPHARDVLASAGYDMTVRVWSDGSAMPFPQEENVIRVGQELGLMNRHTEFCTGVDWCLFGTGGWVASVGWDERVLVWDAHTLLRR

SEQ ID NO: 4016 - DNA, 1065 bp, Phaeosphaeria nodorum
  CDS (1)..(1065)
atgctggagttccgaacgcagggctacagtggctacagcgtcaaatactcgccatttttcgattcacggatagcggtcgctgcatctgcgaacttcgggctcgtagggaatggaagactgtacatcctcggccttaccgccaatggtatcgtcgcagaaaagtggttcgacacgcaagactccctcttcgacagcacctggtccgaatcgcacgagaaccagatcctcaccgccggcggcgacggctccgtcaaactcttcgacatcacgctgtcccaattccccgtgcaatcctggaccgagcacgcgcgcgaagtcttcagcgtgtcctggaacctcgttgccaaagacacattcctgtccagcagctgggacggcacgattaagatctggaacccgaacgcgagtgcgagtatcactacgctgccgacgcattcgtgcacgtattcggcggcgtttagtccgcatagcccgagtgtgctgagcagtgtgagctcggatagtcacttgagggtgtttgatttgaggacgccggcgagcgcaagtaatcatcttaccatgagtgtgccgatacatacgccgccgaaggcgaggatgggggttgcagcgcccgtgggcatagcgccgtcggaagcgctgacgcatgattggaataaataccgcgactcgattgttgcgacggcaggggtggatcgtgtcatacggacgtttgatattcggatgccgaatcatggaccaatcgcggtattgccagggcatgaatacgcggtgaggaagttgacgtggtcgccgcatttgtcggatatcttgctaagtgcaagttatgacatgacgtgtcgggtgtggacggatggtagtgccatgggtgtggggtcgttgaagcaagagaacatgctggaggatcccatgttctatggaggtggaagagaaatgggaagaatgggacgacacacagagtttgtgactggcgtggactggtgcctgtttggagctgaggggtggtgcgcgagtacaggatgggacgagaaggttatggtgtgggactgcagagctattatgcaataa

SEQ ID NO: 4017 - protein, 354 aa, Phaeosphaeria nodorum
MLEFRTQGYSGYSVKYSPFFDSRIAVAASANFGLVGNGRLYILGLTANGIVAEKWFDTQDSLFDSTWSESHENQILTAGGDGSVKLFDITLSQFPVQSWTEHAREVFSVSWNLVAKDTFLSSSWDGTIKIWNPNASASITTLPTHSCTYSAAFSPHSPSVLSSVSSDSHLRVFDLRTPASASNHLTMSVPIHTPPKARMGVAAPVGIAPSEALTHDWNKYRDSIVATAGVDRVIRTFDIRMPNHGPIAVLPGHEYAVRKLTWSPHLSDILLSASYDMTCRVWTDGSAMGVGSLKQENMLEDPMFYGGGREMGRMGRHTEFVTGVDWCLFGAEGWCASTGWDEKVMVWDCRAIMQ

SEQ ID NO: 4018 - DNA, 954 bp, Brassica campestris
  CDS (1)..(954)
atgccgatgttcaaggcgccgttcaacggctactcagtgaaattcagccctttctacgagtcccgcctcgccgtcgccacagctcagaacttcggtatcctcggaaacggccggatccacgtcctcgagctctctcccggaggtcccggcgtcacagagtccatcgccttcgacacagccgacgcagtctacggcgtctgctggtcagaatctcacgactccgttctcatcgccgccatcggcgacggctccgtcaagatctacgacacagcgctcccgcctccctccaaccccatccgatcgttccaagaacacgcgcgtgaggttcactcggttgattacaaccccacgcgccgtgactccttcctcacggcgtcgtgggacgatacggtgaagctgtgggctatggatcgtcccgcgagcataaggactttcaaggagcacgcgtattgcgtttaccaagcggtgtggaaccctaagcatggagacgtcttcgcctctgcttccggcgactgtaccctaagggattgggatgtgagagagcctggtccaaccatgatcatccctgggcatgacctcgagatactgtcgtgtgattggaacaagtatgatgattgtgttttagcgacttcttcggtggataagacgattaaggtgtgggatgtgaggagttacagagctcctttggctgtgctcaacgggcatgggtatgcggtgaggaaggtgaagttctcgccgcataggaggaacttgattgcttcttgctcgtatgatatgagtgtgtgcctttgggactatatggtggaggatgctttggtggggaggtatgatcatcacactgagtttgctgttggggttgatatgagtgttcttgttgaaggtttgatggcgagtactggttgggacgagctcgtttatgtttggcagcaagggatggatccaagagcgagttga

SEQ ID NO: 4019 - protein, 317 aa, Brassica campestris
MPMFKAPFNGYSVKFSPFYESRLAVATAQNFGILGNGRIHVLELSPGGPGVTESIAFDTADAVYGVCWSESHDSVLIAAIGDGSVKIYDTALPPPSNPIRSFQEHAREVHSVDYNPTRRDSFLTASWDDTVKLWAMDRPASIRTFKEHAYCVYQAVWNPKHGDVFASASGDCTLRDWDVREPGPTMIIPGHDLEILSCDWNKYDDCVLATSSVDKTIKVWDVRSYRAPLAVLNGHGYAVRKVKFSPHRRNLIASCSYDMSVCLWDYMVEDALVGRYDHHTEFAVGVDMSVLVEGLMASTGWDELVYVWQQGMDPRAS

SEQ ID NO: 4020 - DNA, 1068 bp, Aspergillus oryzae
  CDS (1)..(1068)
atgctgcattttcgcaccgagggctataacggctgtgcggttaagtactccccgttcttcgataaccgactggccgtcgctgggtcggccaactttggactcgtaggaaatggacggatgtacattttggagctgactccaaacggaattgtacccgtgaaatggtttaccacccaagactcactctacgatcttgcatggtccgagatccatgaaaatcaagttcttacagcctccggggatggtagcattaagctatttgattgcaacctgaacgacttccccgtccagaattggaaggaacacaaccgcgaagtcttcagtgtgcactggaatcttgtcgcgaaagaccgtttctgctccagcagctgggacggtactgtgcgcgtctggactcccgatcgaccacattcactcgtcactcttcctacacacagctgcacatactccgcatctttctcgccacattcacccgacatcctttcctgtgttacctccgactcttacgtccgtctgttcgaccttcgcaccccggcatccgcctccaaccacctcactctccagattccgatccatgcagccccggtatctccgattcctggtaaaccgggcgttccaccggccgcctgtcctccttccgaagctctgacacatgactggaataaatatcgaccgtctatcctggccaccgcgggcgtggatcggacgatccgcacctttgatatccgtgccccgcagcagggcccacaaaccgtgatggttgggcatgactacgccatccgcaagatctcctggtcgccacacttgtccaatgttctccttagtggaagctacgacatgacatgtcgtgcatggaacgaccaatctcccccaggagttgttggggatgtcgactcgatgcgagcgggtcctagtccaacgatgggagtggagatgggccgaatgtcgcgtcatacagagttcgtgactggagtcgattggtgtatgttcggaagtgagggttggtgtgccagtgtgggatgggacgaaagtctgtatgtgtgggatgttcgggcagtcatgggatag

SEQ ID NO: 4021 - protein, 355 aa, Aspergillus oryzae
MLHFRTEGYNGCAVKYSPFFDNRLAVAGSANFGLVGNGRMYILELTPNGIVPVKWFTTQDSLYDLAWSEIHENQVLTASGDGSIKLFDCNLNDFPVQNWKEHNREVFSVHWNLVAKDRFCSSSWDGTVRVWTPDRPHSLVTLPTHSCTYSASFSPHSPDILSCVTSDSYVRLFDLRTPASASNHLTLQIPIHAAPVSPIPGKPGVPPAACPPSEALTHDWNKYRPSILATAGVDRTIRTFDIRAPQQGPQTVMVGHDYAIRKISWSPHLSNVLLSGSYDMTCRAWNDQSPPGVVGDVDSMRAGPSPTMGVEMGRMSRHTEFVTGVDWCMFGSEGWCASVGWDESLYVWDVRAVMG

SEQ ID NO: 4022 - DNA, 954 bp, Brassica napus
  CDS (1)..(954)
atgccggtgttcaaagctccgttcaatggctactcagtgaaattcagccctttctacgagtcccgcctcgccgtcgccacagctcagaacttcggtatcctcggaaacggccggatccacgtcctcgagctctctcccggaggtcccggtgtcacggagtccatcgccttcgacacagccgacgcagtctacgacgtctgctggtcagaatctcacgactccgtactcatcgccgccatcggcgacggctccgtcaagatctacgacacagcgctcccgcctccctccaatcccatccgatcgttccaagaacacgcgcgtgaggttcactcggttgattacaaccccacgcgccgtgactccttcgtcacggcgtcgtgggacgataccgtgaagctgtgggccatggatcgtcccgcgagcatcaggaccttcaaggagcacgcgtattgcgtttaccaagcggtgtggaaccctaagcatggagacgtcttcgcctctgcttccggcgactgcaccctgaggatatgggatgtgagagagcctggctccaccatgatcatccctgcgcatgacctcgagatactgtcgtgtgattggaacaagtatgatgattgtgttttagcgacttgttcggtggataagacgattaaggtgtgggatgtgaggagttacagagctcctttggctgtgctgaacgggcatgggtatgcggtgaggaaggtgaagttctcgccgcataggaggaacttgattgcttcttgctcgtatgatatgagtgtgtgcctttgggactatatggtggaggatgccttggtggggaggtatgatcatcacactgagtttgctgttgggattgatatgagtgttcttgttgaaggtttgatggcgagtactggttgggacgagctcgtttatgtttggcagcaagggatggatcctagagccagttga

SEQ ID NO: 4023 - protein, 317 aa, Brassica napus
MPVFKAPFNGYSVKFSPFYESRLAVATAQNFGILGNGRIHVLELSPGGPGVTESIAFDTADAVYDVCWSESHDSVLIAAIGDGSVKIYDTALPPPSNPIRSFQEHAREVHSVDYNPTRRDSFVTASWDDTVKLWAMDRPASIRTFKEHAYCVYQAVWNPKHGDVFASASGDCTLRIWDVREPGSTMIIPAHDLEILSCDWNKYDDCVLATCSVDKTIKVWDVRSYRAPLAVLNGHGYAVRKVKFSPHRRNLIASCSYDMSVCLWDYMVEDALVGRYDHHTEFAVGIDMSVLVEGLMASTGWDELVYVWQQGMDPRAS

SEQ ID NO: 4024 - DNA, 1089 bp, Pichia angusta
  CDS (1)..(1089)
atgctccaatacaggactacgggatataatggttacgcgtgcaaatattcccctttctacgacaacaagcttgcagtagccactgcagccaactatgggcttgtggggaatggaaaactcgtcatattgtctattcaagacaatggcatggtggtgcaagatacagagtttgagacccaagacggtttgttcgacgtggcgtggtctgagattcacgaaaaccaggttctgacatgtgctggtgatggctccatttctttgtttgacatttccctgcaaagattccccattcaaagataccaagagcataccagagaggtcttttccgtttattggaacatggtagacaaaggaattttctgctcctcgtcatgggacggtacgatcaaagtctggtcaccaaacagacagcagtccatgcttacactagtgtcatcgacggattcttcgcccaaagtggacggacctttggtcccgctttccaccaagcaaacaggaaagcatcccgcagattgcatgtaccaggctacgttttctccccacacaccgtcacagctggtttctgtgagctcatcttcacactgtcacgtttgggatatcagggcgccgcagcccttgcagattgatttcatagcacataacggcatggaagtgctgtcttgtgattacaacaaatacagaccaacagtcattgcgacagcctctgtggacaaatcgataaaagtttgggatctccgcatgattccaaatgtccagcatcatgttctggggacggcgaacaagactggaccatcatctgtcaacagattcatagggcacgattttgctgttcgcaaagtcagctggtcaccacactactcggacactttgctcagctgttcgtatgacatgacatgccgggtttggaaagatcagaccgataataacgcgcggttcatgaacaatagattatggcacggtcgatctctactcaagacgttcgataagcataaggagtttgtcattggctgtgactggtctctttggggctctggatttgctgctagcgtaggatgggacgaaatgtgctacatttggaaagctgtataa

SEQ ID NO: 4025 - protein, 362 aa, Pichia angusta
MLQYRTTGYNGYACKYSPFYDNKLAVATAANYGLVGNGKLVILSIQDNGMVVQDTEFETQDGLFDVAWSEIHENQVLTCAGDGSISLFDISLQRFPIQRYQEHTREVFSVYWNMVDKGIFCSSSWDGTIKVWSPNRQQSMLTLVSSTDSSPKVDGPLVPLSTKQTGKHPADCMYQATFSPHTPSQLVSVSSSSHCHVWDIRAPQPLQIDFIAHNGMEVLSCDYNKYRPTVIATASVDKSIKVWDLRMIPNVQHHVLGTANKTGPSSVNRFIGHDFAVRKVSWSPHYSDTLLSCSYDMTCRVWKDQTDNNARFMNNRLWHGRSLLKTFDKHKEFVIGCDWSLWGSGFAASVGWDEMCYIWKAV

SEQ ID NO: 4026 - DNA, 954 bp, Solanum lycopersicum
  CDS (1)..(954)
atgccggtatttaaaactccatttaacggttactccgtaaaattcagtcccttctacgaaaacaaactagctgtggccactgcgcagaatttcggcatccttggtaacgggagagttcacattcttcagctcaatccaaacggaccggtatcggaacttgcggcttttgacacagctgatggagtttacgacgtttgctggtcggaagctcacgattcacttgttattgctggaagtggcgatggttctgtgaaactctatgacctttctttgcctcccaccaataaccctattcgttcttttaaggaacatacacgggaagttcactctgttgactataataccgtgagaaaagattccttcttgtcagcgtcttgggatgatactgtgaagctatggactgttgatagaaatgccagtgtaaggacttttaaggaacatgcttattgtgtctattccgctgcttggaatccaagacatgctgatatctttgcatctgcttctggggattgtactactcgcatctgggatgtccgcgaaccaggttctacaatgattctgcctgcacacgagtttgaaatcctcacatgtgattggagtaagtatgacgattgtatcattgcaactgcatccgttgataagtcaatcaaggtttgggatgttaggaattatagagtgccaatatcagtgcttaatgggcatggatatgcagtgaggaaagtgaggttttcaccacatagagcgagtgcaatggtttcttgttcatatgacatgacagtttgcatgtgggattacatggtggaagatgcacttattgggaggtatgatcatcacacagagtttgctgtaggagttgatatgatgagcgttctcgttgaaggtctattggctagtacaggatgggatgaacttgtttatgtttggcaacatggaatggaccctagagcttcttga

SEQ ID NO: 4027 - protein, 317 aa, Solanum lycopersicum
MPVFKTPFNGYSVKFSPFYENKLAVATAQNFGILGNGRVHILQLNPNGPVSELAAFDTADGVYDVCWSEAHDSLVIAGSGDGSVKLYDLSLPPTNNPIRSFKEHTREVHSVDYNTVRKDSFLSASWDDTVKLWTVDRNASVRTFKEHAYCVYSAAWNPRHADIFASASGDCTTRIWDVREPGSTMILPAHEFEILTCDWSKYDDCIIATASVDKSIKVWDVRNYRVPISVLNGHGYAVRKVRFSPHRASAMVSCSYDMTVCMWDYMVEDALIGRYDHHTEFAVGVDMMSVLVEGLLASTGWDELVYVWQHGMDPRAS

SEQ ID NO: 4028 - DNA, 954 bp, Gossypium hirsutum
  CDS (1)..(954)
atgcccgttttcaaaactccgttcaacggctactccgttaggttctcacccttttacgaatcccgtttagccgtagccaccgcccagaatttcggcatattagggaacggccgtgtccacgtcatcgacctctctccgaacgcccctgtcatcaacgaactcatcgcctacgacaccgccgatggtgtctacgatgtagcctggtccgaatcgcatgattccgtcctcgtcgctgccgtcgccgacggatctatcaaagtctacgacactgccccccctcctcactccaaccctctccgctccctcaaagaacacgcccgtgaagtccacggtctcgattacaacccaacgcggcgcgactcgttcctctccgcttccttggacgattccgtcaagctctggacccttgaccgccctgcttcccttcgcactttccgtgaacacgcgtattgcgtgtattccgtcgcgtggaaccctaaacatgccgacgttttcgcctcggcgtccggagactgtacggtaagaatctgggacgttagggaacccggttcaacgatgataatcccgggtcacgaacacgaaatattgtcgtgtgattggaataaatgtgatgaatgcctgattgctagtgcaagtgtagataagagtattaaaatttgggatgtaagaaactatagggtcccggtttcggtccttaatggccatggctatgctgttaggaaatttaagttttcaccgcataggaggaatttgattgtgtcttgttcgtatgatatgaccgtttgtttgtgggattttatgatagaagatgcacttgttggaaggtatgatcatcataccgagtttgctgttggggtcgatctcagtgttcttgttgatgggcttatggccagtactggatgggatgagcttgtttacgtttggcagcaggggatggaccccagagcagcttag

SEQ ID NO: 4029 - protein, 317 aa, Gossypium hirsutum
MPVFKTPFNGYSVRFSPFYESRLAVATAQNFGILGNGRVHVIDLSPNAPVINELIAYDTADGVYDVAWSESHDSVLVAAVADGSIKVYDTAPPPHSNPLRSLKEHAREVHGLDYNPTRRDSFLSASLDDSVKLWTLDRPASLRTFREHAYCVYSVAWNPKHADVFASASGDCTVRIWDVREPGSTMIIPGHEHEILSCDWNKCDECLIASASVDKSIKIWDVRNYRVPVSVLNGHGYAVRKFKFSPHRRNLIVSCSYDMTVCLWDFMIEDALVGRYDHHTEFAVGVDLSVLVDGLMASTGWDELVYVWQQGMDPRAA

SEQ ID NO: 4030 - DNA, 954 bp, Arabidopsis thaliana
  CDS (1)..(954)
atgccggtgttcaaagctccgttcaatggctactctgtgaaattcagtccattctacgagtcacgcctcgccgtcgctacagctcagaacttcggaattctcggaaacggccgaatccatgtcctcgagctcgctcctggagctccaggcgtaactgaatccgtctcgtacgatacagccgacgctgtatacgacgtatgttggtcagaatctcatgactctgtgctcatcgccgcaaatggtgacggctcagtgaagatttacgacacagctcttcctcctccttctaatccgattagatcattccaagagcacgcgcgtgaggttcaatctgtggattacaatcccacgcggcgcgattcgtttctcacttcttcgtgggatgatacggttaagctttgggctatggatcgtccggcgagtgtaaggacttttaaggaacatgcttattgcgtttatcaagcagtttggaatcctaaacatggtgatgtgtttgcttctgcttctggagattgtactttaaggatttgggatgttagagaacctggatcaactatgatcatccctgctcatgattttgagattttgtcttgtgattggaataagtatgatgattgtattttagctacttcttcagtggataagacagttaaggtttgggatgttaggagttatagagttcctttggctgtgcttaatggtcatggatatgcggtgaggaaggtgaaattctcgccgcataggaggagtttgatagcttcttgctcttatgatatgagtgtttgtctttgggactatatggtggaagatgctttggttggtaggtatgatcatcatacagagtttgctgttgggatcgatatgagtgttcttgttgaaggtttaatggcgagtactggttgggatgagcttgtttatgtttggcagcaagggatggatcctagagccagttga

SEQ ID NO: 4031 - protein, 317 aa, Arabidopsis thaliana
MPVFKAPFNGYSVKFSPFYESRLAVATAQNFGILGNGRIHVLELAPGAPGVTESVSYDTADAVYDVCWSESHDSVLIAANGDGSVKIYDTALPPPSNPIRSFQEHAREVQSVDYNPTRRDSFLTSSWDDTVKLWAMDRPASVRTFKEHAYCVYQAVWNPKHGDVFASASGDCTLRIWDVREPGSTMIIPAHDFEILSCDWNKYDDCILATSSVDKTVKVWDVRSYRVPLAVLNGHGYAVRKVKFSPHRRSLIASCSYDMSVCLWDYMVEDALVGRYDHHTEFAVGIDMSVLVEGLMASTGWDELVYVWQQGMDPRAS

SEQ ID NO: 4032 - DNA, 1131 bp, Pichia pastoris
  CDS (1)..(1131)
atgtttaagttccaaacaaacggttttagtgggtatgccgtaagatattcgccgttttatgataacaagatagctgtggccacttccgccaattatgggctcgtcggtaatgggcgtttatacgtgctatccataatggatgacggcaatataataaccgacatatcttatgacacacaggatggtctcttcggtgtcgcttggtctgagactaatgaaaaccatgttttgactagctctggagatggctgcgttagcctatttgacacaacactaaaggattatccagtaatgaaatttacagagcatcagcgggaagtattctccgtcgattggagtaatatagataaaaatctgttttgttcagcatcatgggatggttcagtaaaagtatggagtcccggatccaatagaaatacatccctgttaacgttaagatcattagcaagtagggaagaaaaaaccggaagaatagaaaaaccaataccagtggttcaaccttctcaagtccctatgtcaaaaacacgtcctaatataaggaatgacaataatgactgcgtttacgatgctaagttctcctttcatgatcccaatatcataatgtcatgtaattcagattctcacttgcagctttgggatacgaggctacctaatccccttttcatggactttgttgcacacaacggcctagaagctctttcgtgcgactttaatcgttatcgaccttttgtagttgctagtgccggtgttgacaagctcgcaaaggtctgggatacccgcatgatacaaccaaatgttcattcaaggcctcccagagctctaaataagttcatgggccacgagtttgcgataagaaaactagcctggtctcctcatggccctactcaacttttgacatgttcgtatgatatgacggttcgtgtttggaatgacagtccttctcctacttctcgtgttggcctgctggacggagccagtcaacctcatgcaccaccgtgttccaagatattctctgcacatacagaattcgtaatgggttgtgattggagtttatggggtgaaccaggctgggttgtcacaacaggctgggatgaaatggtatacgtttggaatacacagagacttcagtaa

SEQ ID NO: 4033 - protein, 376 aa, Pichia pastoris
MFKFQTNGFSGYAVRYSPFYDNKIAVATSANYGLVGNGRLYVLSIMDDGNIITDISYDTQDGLFGVAWSETNENHVLTSSGDGCVSLFDTTLKDYPVMKFTEHQREVFSVDWSNIDKNLFCSASWDGSVKVWSPGSNRNTSLLTLRSLASREEKTGRIEKPIPVVQPSQVPMSKTRPNIRNDNNDCVYDAKFSFHDPNIIMSCNSDSHLQLWDTRLPNPLFMDFVAHNGLEALSCDFNRYRPFVVASAGVDKLAKVWDTRMIQPNVHSRPPRALNKFMGHEFAIRKLAWSPHGPTQLLTCSYDMTVRVWNDSPSPTSRVGLLDGASQPHAPPCSKIFSAHTEFVMGCDWSLWGEPGWVVTTGWDEMVYVWNTQRLQ

SEQ ID NO: 4034 - DNA, 969 bp, Oryza sativa
  CDS (1)..(969)
atgccggcgttcaaggcgccggcgccgggcttctccgtgcgcttcagcccgttccacgagcagcgcctcctcgcggccgcctcccagcacttcggattagtcggcaacggccacctcctcgtcctcgacctctccgccgccgccgccccggggggcgcgccggcgcccccgccggtgttcgccttcccgacctccgacgcgctgttcgactgcgcgtggtcggagtcccacgagtccctctgcgccgccgcctccggggacgggtccgtgcgcctgttcgacgtcgcgctgccgcccgcgcagaaccccgtccgcctcctccgggagcacgcgcgggaggtgcacggcctcgactggaaccccgtccgccgcgacgccttcctctccgcgtcctgggacgacacgctcaagctctggtccccggaccgcccggcctccgtgcgcaccttccgcggccacgagtactgcgtctacgccgccgcgtggtcggcgcgccacccggacgtcttcgcctccgcgtccggcgaccgcaccgcccgcgtctgggacgtgcgcgagccggcgcccacgctggtcatcccggcgcacgaccacgaggtgctctcgctcgactgggacaagtacgatccgtccatcctcgccaccggctccgtcgacaagtcgatccgcgtctgggacgtccgcgcgccgcgggcgccgctggcgcagctcgccgggcacgggtacgccgtcaagcgcgtcaagttctcgccgcaccggcagggcatgctcatgtcctgctcctacgacatgacggtgtgcatgtgggattaccgcaaggaggacgcgctgctcgcgaggtatggccaccacactgaattcgttgccgggatcgacatgagcgtgctcgtggaagggttgctcgcgagcaccgggtgggacgagatgatctatgtgtggccatttggctctgatcctagagcaatgtaa

SEQ ID NO: 4035 - protein, 322 aa, Oryza sativa
MPAFKAPAPGFSVRFSPFHEQRLLAAASQHFGLVGNGHLLVLDLSAAAAPGGAPAPPPVFAFPTSDALFDCAWSESHESLCAAASGDGSVRLFDVALPPAQNPVRLLREHAREVHGLDWNPVRRDAFLSASWDDTLKLWSPDRPASVRTFRGHEYCVYAAAWSARHPDVFASASGDRTARVWDVREPAPTLVIPAHDHEVLSLDWDKYDPSILATGSVDKSIRVWDVRAPRAPLAQLAGHGYAVKRVKFSPHRQGMLMSCSYDMTVCMWDYRKEDALLARYGHHTEFVAGIDMSVLVEGLLASTGWDEMIYVWPFGSDPRAM

SEQ ID NO: 4036 - DNA, 960 bp, Zea mays
  CDS (1)..(960)
atgccggcgttcaaggccccggcgccgggcttcgccgtgcgcttcagccccttccacgagaaccgcctcctcgccgccacgtcccagcacttcggtctcgtgggtaacggtcacctcatcgtcctcgacctagccggcggcgggcctggggccgccccggcgccggtcttctccttcccgacctccgatgcgctcttcgactgcgcgtggtccgagtcccacgactccctctgcgccgccgcctccggggacggctccgtgcgccttttcgacgccgctctcccgccggcgcagaaccccgtgcggctcctccgggagcacgcacgggaggtgcacggcctcgactggaaccccgtccgccgggacgccttcatctccgcctcctgggacgacacgctcaagctctggtcccccgaccgcccagcctccgtccgcaccttccggggccacgagtactgcgtgtacgccgccgcctggtccgcgcgccacccggacgtcttcgcgtcggcctccggggaccgaaccgcgcgcgtctgggacgtccgggatcccgcgcccacgctcatcctgcccgcgcacgaccacgaggtgctctcgctcgactgggacaagtacgacccctccatcctcgccaccgcctccgtcgacaagtccatccgcgtctgggacgtgcgcgcgccgcgggcgcccatcgcgcagctcgccggacacagctacgccgttaagcgggtccgtttctcgccgcaccgccagggcatgctcatgtcatgctcctacgacatgactgtctgcatgtgggactaccgcgccgaggatgctctgctcgccaggtacaatcaccacacggagttcgttgccggcatcgacatgagcgtcctcgtcgacggcttgctcgctagcaccggatgggacgagatggtctacatctggccatttgggacggatccaagagccatgtag

SEQ ID NO: 4037 - protein, 319 aa, Zea mays
MPAFKAPAPGFAVRFSPFHENRLLAATSQHFGLVGNGHLIVLDLAGGGPGAAPAPVFSFPTSDALFDCAWSESHDSLCAAASGDGSVRLFDAALPPAQNPVRLLREHAREVHGLDWNPVRRDAFISASWDDTLKLWSPDRPASVRTFRGHEYCVYAAAWSARHPDVFASASGDRTARVWDVRDPAPTLILPAHDHEVLSLDWDKYDPSILATASVDKSIRVWDVRAPRAPIAQLAGHSYAVKRVRFSPHRQGMLMSCSYDMTVCMWDYRAEDALLARYNHHTEFVAGIDMSVLVDGLLASTGWDEMVYIWPFGTDPRAM

SEQ ID NO: 4038 - DNA, 25 bp, Artificial sequence
  primer
atgctcagatatcatatgcaaggtt

SEQ ID NO: 4039 - DNA, 25 bp, Artificial sequence
  primer
tcaacctaagccgttccatacaaat

SEQ ID NO: 4040 - protein, 427 aa, Artificial sequence
  consensus sequence
  Variant (2)..(9): Xaa in position 2 to 9 is any amino acid
  Variant (10)..(11): Xaa in position 10 to 11 is any or no amino acid
  Variant (13)..(14): Xaa in position 13 to 14 is any amino acid
  Variant (16)..(17): Xaa in position 16 to 17 is any amino acid
  Variant (21)..(24): Xaa in position 21 to 24 is any amino acid
  Variant (29)..(31): Xaa in position 29 to 31 is any amino acid
  Variant (33)..(33): Xaa in position 33 is any amino acid
  Variant (35)..(36): Xaa in position 35 to 36 is any amino acid
  Variant (40)..(43): Xaa in position 40 to 43 is any amino acid
  Variant (45)..(49): Xaa in position 45 to 49 is any amino acid
  Variant (50)..(52): Xaa in position 50 to 52 is any or no amino acid
  Variant (54)..(61): Xaa in position 54 to 61 is any amino acid
  Variant (62)..(68): Xaa in position 62 to 68 is any or no amino acid
  Variant (70)..(70): Xaa in position 70 is any amino acid
  Variant (72)..(74): Xaa in position 72 to 74 is any amino acid
  Variant (76)..(77): Xaa in position 76 to 77 is any amino acid
  Variant (81)..(88): Xaa in position 81 to 88 is any amino acid
  Variant (90)..(90): Xaa in position 90 is any amino acid
  Variant (95)..(98): Xaa in position 95 to 98 is any amino acid
  Variant (100)..(105): Xaa in position 100 to 105 is any amino acid
  Variant (106)..(107): Xaa in position 106 to 107 is any or no amino acid
  Variant (109)..(113): Xaa in position 109 to 113 is any amino acid
  Variant (116)..(116): Xaa in position 116 is any amino acid
  Variant (120)..(121): Xaa in position 120 to 121 is any amino acid
  Variant (122)..(124): Xaa in position 122 to 124 is any or no amino acid
  Variant (126)..(131): Xaa in position 126 to 131 is any amino acid
  Variant (132)..(132): Xaa in position 132 is any or no amino acid
  Variant (134)..(136): Xaa in position 134 to 136 is any amino acid
  Variant (140)..(144): Xaa in position 140 to 144 is any amino acid
  Variant (146)..(148): Xaa in position 146 to 148 is any amino acid
  Variant (149)..(150): Xaa in position 149 to 150 is any or no amino acid
  Variant (152)..(153): Xaa in position 152 to 153 is any amino acid
  Variant (155)..(156): Xaa in position 155 to 156 is any amino acid
  Variant (158)..(162): Xaa in position 158 to 162 is any amino acid
  Variant (163)..(200): Xaa in position 163 to 200 is any or no amino acid
  Variant (202)..(202): Xaa in position 202 is any amino acid
  Variant (204)..(204): Xaa in position 204 is any amino acid
  Variant (206)..(208): Xaa in position 206 to 208 is any amino acid
  Variant (210)..(227): Xaa in position 210 to 227 is any amino acid
  Variant (229)..(229): Xaa in position 229 is any amino acid
  Variant (231)..(231): Xaa in position 231 is any amino acid
  Variant (233)..(235): Xaa in position 233 to 235 is any amino acid
  Variant (236)..(245): Xaa in position 236 to 245 is any or no amino acid
  Variant (247)..(248): Xaa in position 247 to 248 is any amino acid
  Variant (249)..(272): Xaa in position 249 to 272 is any or no amino acid
  Variant (274)..(274): Xaa in position 274 is any amino acid
  Variant (276)..(277): Xaa in position 276 to 277 is any amino acid
  Variant (283)..(287): Xaa in position 283 to 287 is any amino acid
  Variant (289)..(291): Xaa in position 289 to 291 is any amino acid
  Variant (294)..(299): Xaa in position 294 to 299 is any amino acid
  Variant (301)..(301): Xaa in position 301 is any amino acid
  Variant (303)..(306): Xaa in position 303 to 306 is any amino acid
  Variant (307)..(325): Xaa in position 307 to 325 is any or no amino acid
  Variant (327)..(330): Xaa in position 327 to 330 is any amino acid
  Variant (331)..(331): Xaa in position 331 is any or no amino acid
  Variant (334)..(335): Xaa in position 334 to 335 is any amino acid
  Variant (339)..(342): Xaa in position 339 to 342 is any amino acid
  Variant (346)..(351): Xaa in position 346 to 351 is any amino acid
  Variant (353)..(353): Xaa in position 353 is any amino acid
  Variant (359)..(361): Xaa in position 359 to 361 is any amino acid
  Variant (363)..(376): Xaa in position 363 to 376 is any amino acid
  Variant (377)..(396): Xaa in position 377 to 396 is any or no amino acid
  Variant (401)..(402): Xaa in position 401 to 402 is any amino acid
  Variant (404)..(404): Xaa in position 404 is any amino acid
  Variant (406)..(411): Xaa in position 406 to 411 is any amino acid
  Variant (412)..(412): Xaa in position 412 is any or no amino acid
  Variant (414)..(415): Xaa in position 414 to 415 is any amino acid
  Variant (418)..(418): Xaa in position 418 is any amino acid
  Variant (422)..(426): Xaa in position 422 to 426 is any amino acid
MXXXXXXXXXXGXXVXXSPFXXXXLAVAXXXNXGXXGNGXXXXLXXXXXXXXGXXXXXXXXXXXXXXXTXDXXXDXXWSEXXXXXXXXAXGDGSXXXXDXXXXXXXXPXXXXXEHXREVXXXXXNXXXXXXXFXXXSWDXXXXXWXXXXXRXXSXXTXXXXXXXXXXXXXXXXXXXXXXXXXXXXXXXXXXXXXXXXXXXCXYXAXXXPXXXXXXXXXXXXXXXXXXDXRXPXXXXXXXXXXXXXHXXXXXXXXXXXXXXXXXXXXXXXXXXEXLXXDWNKYXXXXXAXXXVDXXXXXXDXRXXXXXXXXXXXXXXXXXXXXXXXPXXXXXGHXXAVRXXXXSPHXXXXXXSXSYDMTXXXWXXXXXXXXXXXXXXXXXXXXXXXXXXXXXXXXXXHTEFXXGXDXXXXXXXGXXASXGWDXXXXXW

SEQ ID NO: 4041 - protein, 37 aa, Artificial sequence
  protein pattern
  Variant (2)..(5): Xaa in position 2 to 5 is any amino acid
  Variant (6)..(8): Xaa in position 6 to 8 is any or no amino acid
  Variant (11)..(11): Xaa in position 11 is Phe or Tyr
  Variant (12)..(12): Xaa in position 12 is any amino acid
  Variant (13)..(13): Xaa in position 13 is Ala, Asp, Glu or Asn
  Variant (14)..(15): Xaa in position 14 to 15 is any amino acid
  Variant (16)..(16): Xaa in position 16 is Ile, Leu or Val
  Variant (19)..(19): Xaa in position 19 is Ala, Gly or Asn
  Variant (20)..(20): Xaa in position 20 is Ala, Gly, Ser or Thr
  Variant (21)..(21): Xaa in position 21 is Ala, Gly or Ser
  Variant (22)..(22): Xaa in position 22 is Ala, Gln or Ser
  Variant (24)..(24): Xaa in position 24 is Phe or Tyr
  Variant (26)..(26): Xaa in position 26 is Ile or Leu
  Variant (27)..(27): Xaa in position 27 is Ile, Leu or Val
  Variant (31)..(31): Xaa in position 31 is Lys or Arg
  Variant (32)..(33): Xaa in position 32 to 33 is any amino acid
  Variant (34)..(34): Xaa in position 34 is Ala, Ile or Val
  Variant (35)..(35): Xaa in position 35 is Ile or Leu
  Variant (36)..(36): Xaa in position 36 is Ala, Asp, Glu, Gly, Asn, Gln or Ser
  Variant (37)..(37): Xaa in position 37 is Ile or Leu
YXXXXXXXSPXXXXXXAVXXXXNXGXXGNGXXXXXXX

SEQ ID NO: 4042 - protein, 32 aa, Artificial sequence
  protein pattern
  Variant (2)..(2): Xaa in position 2 is Asp, Glu, Gly or Ser
  Variant (3)..(3): Xaa in position 3 is any amino acid
  Variant (5)..(5): Xaa in position 5 is Ile or Val
  Variant (6)..(7): Xaa in position 6 to 7 is Lys or Arg
  Variant (8)..(8): Xaa in position 8 is Phe, Ile, Leu or Val
  Variant (9)..(9): Xaa in position 9 is any amino acid
  Variant (10)..(10): Xaa in position 10 is Phe, Trp or Tyr
  Variant (14)..(17): Xaa in position 14 to 17 is any amino acid
  Variant (18)..(18): Xaa in position 18 is Ile, Leu or Met
  Variant (19)..(19): Xaa in position 19 is any amino acid
  Variant (21)..(21): Xaa in position 21 is Ala, Cys, Gly or Thr
  Variant (26)..(26): Xaa in position 26 is Ser or Thr
  Variant (27)..(27): Xaa in position 27 is Ala, Cys or Val
  Variant (28)..(29): Xaa in position 28 to 29 is any amino acid
  Variant (31)..(31): Xaa in position 31 is any or no amino acid
HXXAXXXXXXSPHXXXXXXSXSYDMXXXXWXD

SEQ ID NO: 4043 - protein, 36 aa, Artificial sequence
  protein pattern
  Variant (2)..(2): Xaa in position 2 is Ala, Cys, Gly or Ser
  Variant (3)..(3): Xaa in position 3 is any amino acid
  Variant (4)..(4): Xaa in position 4 is Phe or Tyr
  Variant (5)..(5): Xaa in position 5 is Asp or Gly
  Variant (6)..(6): Xaa in position 6 is any amino acid
  Variant (7)..(7): Xaa in position 7 is Ala, Cys or Thr
  Variant (8)..(8): Xaa in position 8 is Phe or Trp
  Variant (9)..(9): Xaa in position 9 is Asn or Ser
  Variant (11)..(12): Xaa in position 11 to 12 is any amino acid
  Variant (13)..(13): Xaa in position 13 is Asp, Glu or Pro
  Variant (14)..(16): Xaa in position 14 to 16 is any amino acid
  Variant (17)..(17): Xaa in position 17 is Ala, Ile, Leu or Val
  Variant (18)..(18): Xaa in position 18 is Ala, Ser, Thr or Val
  Variant (20)..(20): Xaa in position 20 is any amino acid
  Variant (24)..(24): Xaa in position 24 is Ser or Thr
  Variant (25)..(25): Xaa in position 25 is Ile, Leu or Val
  Variant (26)..(26): Xaa in position 26 is Lys or Arg
  Variant (27)..(27): Xaa in position 27 is Ala, Ile or Leu
  Variant (28)..(28): Xaa in position 28 is Phe, Trp or Tyr
  Variant (30)..(33): Xaa in position 30 to 33 is any amino acid
  Variant (34)..(35): Xaa in position 34 to 35 is any or no amino acid
DXXXXXXXXEXXXXXXXXAXGDGXXXXXDXXXXXXP

SEQ ID NO: 4044 - protein, 26 aa, Artificial sequence
  protein pattern
  Variant (2)..(2): Xaa in position 2 is Ser or Thr
  Variant (3)..(3): Xaa in position 3 is any amino acid
  Variant (5)..(5): Xaa in position 5 is Phe, Trp or Tyr
  Variant (6)..(6): Xaa in position 6 is Asp, Asn or Ser
  Variant (7)..(7): Xaa in position 7 is Lys or Arg
  Variant (8)..(8): Xaa in position 8 is any amino acid
  Variant (9)..(9): Xaa in position 9 is Asp, Asn, Arg or Ser
  Variant (10)..(10): Xaa in position 10 is Asp, Glu or Pro
  Variant (11)..(11): Xaa in position 11 is any amino acid
  Variant (12)..(12): Xaa in position 12 is Ile, Leu, Met or Val
  Variant (13)..(13): Xaa in position 13 is Ile, Leu or Val
  Variant (14)..(14): Xaa in position 14 is Ala or Val
  Variant (15)..(15): Xaa in position 15 is Ser, Thr or Val
  Variant (16)..(16): Xaa in position 16 is Ala, Cys, Gly or Ser
  Variant (17)..(17): Xaa in position 17 is Gly or Ser
  Variant (20)..(21): Xaa in position 20 to 21 is any amino acid
  Variant (22)..(22): Xaa in position 22 is Ala, Ile, Leu or Val
  Variant (23)..(24): Xaa in position 23 to 24 is any amino acid
  Variant (25)..(25): Xaa in position 25 is Phe, Trp or Tyr
LXXDXXXXXXXXXXXXXVDXXXXXXD

SEQ ID NO: 4045 - protein, 15 aa, Artificial sequence
  protein pattern
  Variant (2)..(3): Xaa in position 2 to 3 is any amino acid
  Variant (6)..(6): Xaa in position 6 is Cys, Thr or Val
  Variant (7)..(7): Xaa in position 7 is Ala or Gly
  Variant (10)..(10): Xaa in position 10 is Glu, Gly, Gln or Ser
  Variant (11)..(13): Xaa in position 11 to 13 is any amino acid
  Variant (14)..(14): Xaa in position 14 is Ala, Ile, Leu or Val
GXXASXXWDXXXXXW

SEQ ID NO: 4046 - protein, 12 aa, Artificial sequence
  protein pattern
  Variant (2)..(2): Xaa in position 2 is any amino acid
  Variant (5)..(5): Xaa in position 5 is any or no amino acid
  Variant (7)..(7): Xaa in position 7 is any or no amino acid
  Variant (9)..(9): Xaa in position 9 is any amino acid
  Variant (11)..(11): Xaa in position 11 is any amino acid
  Variant (12)..(12): Xaa in position 12 is Cys or Ser
HXEFXVXGXDXX

SEQ ID NO: 4047 - DNA, 165 bp, Saccharomyces cerevisiae
  CDS (1)..(165)
atgagactacataaaacatttatctgttttagtcaaaacaaacgtggttgtagaaatattctgcaagaaaattcgcggatgatatttgagaataaaatactcataatgatattgaggcagggtatattttttaatattagcgtgagcaccaagatcagtttctaa

SEQ ID NO: 4048 - protein, 54 aa, Saccharomyces cerevisiae
MRLHKTFICFSQNKRGCRNILQENSRMIFENKILIMILRQGIFFNISVSTKISF

SEQ ID NO: 4049 - DNA, 24 bp, Artificial sequence
  primer
atgagactacataaaacatttatc

SEQ ID NO: 4050 - DNA, 20 bp, Artificial sequence
  primer
ttagaaactgatcttggtgc

SEQ ID NO: 4051 - DNA, 1851 bp, Saccharomyces cerevisiae
  CDS (1)..(1851)
atgaaaaatatcatttcattggtaagcaagaagaaggctgcctcaaaaaatgaggataaaaacatttctgagtcttcaagagatattgtaaaccaacaggaggttttcaatactgaagattttgaagaagggaaaaaggatagtgcctttgagctagaccacttagagttcaccaccaattcagcccagttaggagattctgacgaagataacgagaatgtgattaatgagatgaacgctactgatgatgcaaatgaagctaacagcgaggaaaaaagcatgactttgaagcaggcgttgctaaaatatccaaaagcagccctgtggtccatattagtgtctactaccctggttatggaaggttatgataccgcactactgagcgcactgtatgccctgccagtttttcagagaaaattcggtactttgaacggggagggttcttacgaaattacttcccaatggcagattggtttaaacatgtgtgtcctttgtggtgagatgattggtttgcaaatcacgacttatatggttgaatttatggggaatcgttatacgatgattacagcacttggtttgttaactgcttatatctttatcctctactactgtaaaagtttagctatgattgctgtgggacaaattctctcagctataccatggggttgtttccaaagtttggctgttacttatgcttcggaagtttgccctttagcattaagatattacatgaccagttactccaacatttgttggttatttggtcaaatcttcgcctctggtattatgaaaaactcacaagagaatttagggaactccgacttgggctataaattgccatttgctttacaatggatttggcctgctcctttaatgatcggtatctttttcgctcctgagtcgccctggtggttggtgagaaaggatagggtcgctgaggcaagaaaatctttaagcagaattttgagtggtaaaggcgccgagaaggacattcaagttgatcttactttaaagcagattgaattgactattgaaaaagaaagacttttagcatctaaatcaggatcattctttaattgtttcaagggagttaatggaagaagaacgagacttgcatgtttaacttgggtagctcaaaatagtagcggtgccgttttacttggttactcgacatatttttttgaaagagcaggtatggccaccgacaaggcgtttactttttctctaattcagtactgtcttgggttagcgggtacactttgctcctgggtaatatctggccgtgttggtagatggacaatactgacctatggtcttgcatttcaaatggtctgcttatttattattggtggaatgggttttggttctggaagcagcgctagtaatggtgccggtggtttattgctggctttatcattcttttacaatgctggtatcggtgcagttgtttactgtatcgttgctgaaattccatcagcggagttgagaactaagactatagtgctggcccgtatttgctacaatctcatggccgttattaacgctatattaacgccctatatgctaaacgtgagcgattggaactggggtgccaaaactggtctatactggggtggtttcacagcagtcactttagcttgggtcatcatcgatctgcctgagacaactggtagaaccttcagtgaaattaatgaacttttcaaccaaggggttcctgccagaaaatttgcatctactgtggttgatccattcggaaagggaaaaactcaacatgattcgctagctgatgagagtatcagtcagtcctcaagcataaaacagcgagaattaaatgcagctgataaatgttaa

SEQ ID NO: 4052 - protein, 616 aa, Saccharomyces cerevisiae
MKNIISLVSKKKAASKNEDKNISESSRDIVNQQEVFNTEDFEEGKKDSAFELDHLEFTTNSAQLGDSDEDNENVINEMNATDDANEANSEEKSMTLKQALLKYPKAALWSILVSTTLVMEGYDTALLSALYALPVFQRKFGTLNGEGSYEITSQWQIGLNMCVLCGEMIGLQITTYMVEFMGNRYTMITALGLLTAYIFILYYCKSLAMIAVGQILSAIPWGCFQSLAVTYASEVCPLALRYYMTSYSNICWLFGQIFASGIMKNSQENLGNSDLGYKLPFALQWIWPAPLMIGIFFAPESPWWLVRKDRVAEARKSLSRILSGKGAEKDIQVDLTLKQIELTIEKERLLASKSGSFFNCFKGVNGRRTRLACLTWVAQNSSGAVLLGYSTYFFERAGMATDKAFTFSLIQYCLGLAGTLCSWVISGRVGRWTILTYGLAFQMVCLFIIGGMGFGSGSSASNGAGGLLLALSFFYNAGIGAVVYCIVAEIPSAELRTKTIVLARICYNLMAVINAILTPYMLNVSDWNWGAKTGLYWGGFTAVTLAWVIIDLPETTGRTFSEINELFNQGVPARKFASTVVDPFGKGKTQHDSLADESISQSSSIKQRELNAADKC

SEQ ID NO: 4053 - DNA, 1864 bp, Cryptococcus neoformans var. neoformans B-3501A
  CDS (23)..(1675)
ccgacggatcaaacagcacaccatgaacctcaacgaagagaagaacgtagaagcattcgccttggacagtgaagataacaaggatggcaaggactttgacaaatcgatcgtgcacctggagaatgccggtgcagccaacagtcaacagtgggatcagcttcgactcgatgcgatggctgccgaggagctcgaacactccatgggtttaaagcaggccttgcgtgtttatcccaaggcagctttctggtctttctctatctcactctgcatcgtcatggaggggtatgacatcggcttgcttggtagcatcatcggactgcccacctatcgtgaaaagtatggacactattccgaaagtgccggcagctaccagttatctccctcttggcagactgccgttggtcaagcctcaactatcggctgcttcattggtatttttgcatgctcctgggcccaagacagatggggatatcgccgaacaatccaggcggcactcatcgcccttactggcttcatttttatcgtcttctttgcgcctaatatcgaagttctctttgtcggacaaatgctctgcggtctaccctggggagcttttgctagttctgcggtatcttacgcaagtgacgtgacgccagtcccattacgtggctacctcacaacctatgtcaatttgtgctgggtcattggacaattcatcgctgctggggtattgcaaagcacttcgacccggactgatcaatggggatacagaatcccgtttgcgattcagtggctctggcctcttcccctcttcatcctcgtaacgttggcgccagagagtccatggtacctggtccgtaaaggaaaactggaagaggcgaaacaggctgtggcgagactttccaggagaggcgatgtcaccgatcccgcccagacggtagccatgatgatccgtaccaaccaaatcgagctcgcgaatcaaactggctccagctatttcgattgtttcaaaggcagcgatcttcgccgtacggaaattgcgtgtctgggatgggctgcccagatccttgccggtagtacttttgcgaatacacctacttactttttccagcaagctggactcagtaccgcaaattctttcaagctgggccttgggactacagcactagcctttgttggtacttgcggttcttggatcactcttacgtactttgggcggcgaactatttacttgtccggtctggtggtcctcactgttctgcttttcgtcgtgggtggggtctccttcccagcagagaccaacagcaacgctgcctggggtcaagccgcagcaattttaatctgggttcttgtatatgacttcactgtcggcccgctagcctattgtatcgtaggcgaagtatcgtcaacccgtctgaggtcaaagacagttggtctatctaggaacctctacaacattctcagtgtcgtctctggaatcctcaacacctaccagataaacccggacgcgtggaactggaaaggaaaagctggtttcttctggggagcatccgccgggctcatcgccacttgggcgtacttccgattgcccgaatgcaagggtagaacgtatcgagagctcgacatcatgtttgagcgtggcattcccgctagacgattcaaggacacggtcgtcgacaaagaggctgaggagtaatgagagaagggggggaaggggtcaaaggacctatccggtggcgagaggtgttggtaaggttagcaaagaccgagggaggcatagctgcaaatatgtggtaattagtgccgtttcagatatatgaaggattatgatagtgattcaaacgcctagaagcaatatagcttgaatgcgttcttcatgctatta

SEQ ID NO: 4054 - protein, 550 aa, Cryptococcus neoformans var. neoformans B-3501A
MNLNEEKNVEAFALDSEDNKDGKDFDKSIVHLENAGAANSQQWDQLRLDAMAAEELEHSMGLKQALRVYPKAAFWSFSISLCIVMEGYDIGLLGSIIGLPTYREKYGHYSESAGSYQLSPSWQTAVGQASTIGCFIGIFACSWAQDRWGYRRTIQAALIALTGFIFIVFFAPNIEVLFVGQMLCGLPWGAFASSAVSYASDVTPVPLRGYLTTYVNLCWVIGQFIAAGVLQSTSTRTDQWGYRIPFAIQWLWPLPLFILVTLAPESPWYLVRKGKLEEAKQAVARLSRRGDVTDPAQTVAMMIRTNQIELANQTGSSYFDCFKGSDLRRTEIACLGWAAQILAGSTFANTPTYFFQQAGLSTANSFKLGLGTTALAFVGTCGSWITLTYFGRRTIYLSGLVVLTVLLFVVGGVSFPAETNSNAAWGQAAAILIWVLVYDFTVGPLAYCIVGEVSSTRLRSKTVGLSRNLYNILSVVSGILNTYQINPDAWNWKGKAGFFWGASAGLIATWAYFRLPECKGRTYRELDIMFERGIPARRFKDTVVDKEAEE

SEQ ID NO: 4055 - DNA, 2155 bp, Cryptococcus neoformans var. neoformans B-3501A
  CDS (214)..(1911)
tcatcgcatacctgagccaattctagatagttctaaaatctcttccgcgcaccagttcttctccaacaacggccgacgttgactgtgtatttcccaccaaacaaccatctttctaaagaattcgatttcgatattcgattcatcactcgacatttaaattgatcccaatctttcgatcctcccagcaccacatagcccaatcgaataaataatatggccggtgaagaccttgctatcacctcgacttctgtcgagaatgtccccaacagtccttctcgcaaggtgtctgaagatggactattattgcaggaagacaaggaaatggctgccatgtacgccaatgctgccgccgcaacagaaaaggaacagaacatgactcttctagagggtctccgattgtatcccaaggccatcgcctggtctatcctcatctcttcatgttgtgccatggaaggctacgacatctctttacttggtaacttctacgcgtttgacccttttaaccgaaaattcggtgtggaactcgatgacggtacttggcaggttcctgcacgatggcaaacggggctgtcaaacggtgcccagtgtgggcagatcattggtttgatcgtcaacggtattttcactgaacgatatggttatcgaaaggttcttatagcgagtcttctctggcttgcggctgttatcaccattttcttctgcgctcccaacattcaagtcctccttgcaggtgagattttggccggtattccttggggtgttttccagtctattgccatttcctatgccagtgatgtctgccctatcgctcttcgtggctacttgacctgttatgccaacttctgctggggttggggccagctcataggtgtcggggtcatcagggctatgttctcacgtgatgatcagtgggcttatcgtatcccttatgctgttcagtgggtatggcctcctctcattctcgcgggtgtcatcttcgctcccgaatctccttggtggttgattcgacacggccgactggaagaagcgaagaagtctctgatgcgccttgcctccccgaaacgcaatgtctcttatgacgttgatgagactgccgacatgatccgtcacactactgaactcgaaaaggacattacttccggtgcttctttcttggactgcttcaggggtgtggacctccgtcgtactgaaattgtttgcgccatctggagtatgcagaacctttcaggtaacactttcagtaactacagtacctacttctttgagcaagctggtctcacgggtactgtcccttacgatttcgctatgggacagtacgcaatcaacatggtcggtgtctttggcgcctggagtcttatggcccttgggttcggtcgaaggcagcttatcctcattggtctatctggtctctttgtcgctctcttgatcatgggcttcatgggcttgatcccggattctaagcaaagggaagctggtttggctactggttctctcatgttggtctgggctatcttctaccagtgcactgtaggtaccgttgcttattccttggtcggtgaaattgcttctcgacgactctcgatcaagaccgtcgctctcgggcgtgctgcctacaacgttattgccatcatctgcaatgtccttactccttacatgatcaaccctaccgcttggaactggggcaactacgctggtttcttctgggccggttcttgtttcctctgtcttatctacgcatacttccgtgtaccggaaccttccggccgaacctatgcggagcttgacttgctctttgagcgcaagatctctgctcgcaagttcgccagcacccatgtcaacgctttcgatgtcgcccttcaccaccaggtcggtgaagacaagggcgtctctgaccacgtcgagaaggcctaaatttgtcaaattatcttctaaaggagatgggaaaagcgtttagcatcttgttggcaacaaagagtaccatcttctatatacaagttttataactctaggatcttatagatctgttttatgataaggaatccgggtttaagaatcgtttcatctttttgttaggttgtgtcttcataaatgtaatagaattatattagatctcggtggatatatgtcggcagcagttatgcataaatgctcatgc

SEQ ID NO: 4056 - protein, 565 aa, Cryptococcus neoformans var. neoformans B-3501A
MAGEDLAITSTSVENVPNSPSRKVSEDGLLLQEDKEMAAMYANAAAATEKEQNMTLLEGLRLYPKAIAWSILISSCCAMEGYDISLLGNFYAFDPFNRKFGVELDDGTWQVPARWQTGLSNGAQCGQIIGLIVNGIFTERYGYRKVLIASLLWLAAVITIFFCAPNIQVLLAGEILAGIPWGVFQSIAISYASDVCPIALRGYLTCYANFCWGWGQLIGVGVIRAMFSRDDQWAYRIPYAVQWVWPPLILAGVIFAPESPWWLIRHGRLEEAKKSLMRLASPKRNVSYDVDETADMIRHTTELEKDITSGASFLDCFRGVDLRRTEIVCAIWSMQNLSGNTFSNYSTYFFEQAGLTGTVPYDFAMGQYAINMVGVFGAWSLMALGFGRRQLILIGLSGLFVALLIMGFMGLIPDSKQREAGLATGSLMLVWAIFYQCTVGTVAYSLVGEIASRRLSIKTVALGRAAYNVIAIICNVLTPYMINPTAWNWGNYAGFFWAGSCFLCLIYAYFRVPEPSGRTYAELDLLFERKISARKFASTHVNAFDVALHHQVGEDKGVSDHVEKA

SEQ ID NO: 4057 - DNA, 1680 bp, Cryptococcus neoformans var. neoformans B-3501A
  CDS (1)..(1680)
atgtccggcgtaacaggtataagtctaagtctctcttcagaggagctgaagactcaagacgtggagcaaaatgaaaagcttgacagcaccacaaacatgtttaccaacgccgctgcagcgactgacaaggaacataacatgaccttgtggcagggctgtaaactctaccccaaagcgatcttgtggtccgtccttatatcttcctgttgcgcaatggaaggttacgacatatctcttgtagggaatttctacgcctttgaccctttcaatcgaaagtatggagtgcaaggagttgatggcacatatcaagtccccgctcgatggcaaactggcctaagtaacggagcgcaatgtggccaaatcttgggtttgattgttaatggtctcgcaactgagcgtttcggttatcgaattgtaatcttgggctgtctaatctggctcactggtgtgaccgcaatcttcttttgcgctcccaatattcaaacgttactcgcgggtgaaattcttgctggtatcccgtggggtgtttttcagtcgattgccatatcttacgctgctgaagtttgcccagtggcacttcgaggatatctcaccagttatggtaatttctgctggggatggggacagctcattggtattggagtaataaaatctcaattcggtcgaaccgatcaatgggcataccgcataccttatggacttatgtggatgttctatcctcccttaattattggtatctactttgctcccgaatctccctggtggctggtccgcaaaggtcgaattgaacaagccaagaaatctttgcttcgattgacttcttccaagaccgatcctacatttgatgctaccgaaacaatcgacatgattcgacacactactgaattggaaaaagatatgacttctggtgcctcttacctcgactgctttaaaggtgtcaatctccgcaggactgagatcgtttgtatgctttgggctactcaaaatttggctggcaacacgttctccaattattccacttacttcttcgagcaggctggtcttaccggtgaaatcccatacgatttcgcgatgggtcagtacgccatcaacatggtcggtacttttggggcatggtatctcatgactaaaatgggtcgacgaactcttttcattggtggtctctgcggtctatgcgttaccttgttgtctatcggcttcgtcggtctcgttcctgaatctaaaaagcaagccgcttctcttgctacaggtgctttaatgctggtgtgggcggtgttctaccagtgctccgttggaactctcgccttctcccttgttgccgagatgtcaactcgacgacttcaaatcaagaccgtcgctctgggccgagctgcttacaacgtcgctgccatcatcagtaacgtccttaccccgtatatgattaaccctactgcttggaactggggaaattatgctggtttcttctggggaggatcatgttttttggtattggtttacgcctatttccgggtacccgagccttccggcagaactttcgctgagctcgatattctattcgaacgaaaagttccagctcgaaaattcaaaaccaccgaagtcaacgctttcgatgttgttttgcatcaccaagttgccgaagacaaacctgacggtgaagttagccatgtcgaacgagtttga

SEQ ID NO: 4058 - protein, 559 aa, Cryptococcus neoformans var. neoformans B-3501A
MSGVTGISLSLSSEELKTQDVEQNEKLDSTTNMFTNAAAATDKEHNMTLWQGCKLYPKAILWSVLISSCCAMEGYDISLVGNFYAFDPFNRKYGVQGVDGTYQVPARWQTGLSNGAQCGQILGLIVNGLATERFGYRIVILGCLIWLTGVTAIFFCAPNIQTLLAGEILAGIPWGVFQSIAISYAAEVCPVALRGYLTSYGNFCWGWGQLIGIGVIKSQFGRTDQWAYRIPYGLMWMFYPPLIIGIYFAPESPWWLVRKGRIEQAKKSLLRLTSSKTDPTFDATETIDMIRHTTELEKDMTSGASYLDCFKGVNLRRTEIVCMLWATQNLAGNTFSNYSTYFFEQAGLTGEIPYDFAMGQYAINMVGTFGAWYLMTKMGRRTLFIGGLCGLCVTLLSIGFVGLVPESKKQAASLATGALMLVWAVFYQCSVGTLAFSLVAEMSTRRLQIKTVALGRAAYNVAAIISNVLTPYMINPTAWNWGNYAGFFWGGSCFLVLVYAYFRVPEPSGRTFAELDILFERKVPARKFKTTEVNAFDVVLHHQVAEDKPDGEVSHVERV

SEQ ID NO: 4059 - DNA, 1830 bp, Saccharomyces cerevisiae
  CDS (1)..(1830)
atgaaaaacttatcttttctcataaacagaagaaaggaaaatacaagtgactcgaatgtatacccaggaaaggctaagtcgcatgaacccagctggatagaaatggatgatcaaactaagaaggacggcttagatattgttcatgttgagttcagtccggatacaagagcgccaagcgatagcaataaagtaataacagagatatttgacgctactgaggatgccaaggaggcagacgaaagtgaaagaggaatgccacttgcgacagcattgaatacatatcccaaggcagcagcttggtcactattggtctctacaactttaatcatggaagggtacgacacagctattcttggagctttctacgccttgcctatttttcagagaaagtttggctcacaaaatgacaaaactggagaatgggaaatttcagcgtcatggcaaatcgggctgaccttatgttatatggcaggtgaaattgtggggctacagctaacggggccctccgtggatcttgttggaaatcgttacacattgattattgcattgttttttttagctgccttcacttttatactgtacttttgcaatagtttaggcatgattgctgtgggacaagcattgtgcgggatgccatggggttgttttcagtgtttgacggtgtcttacgcttctgaaatatgcccattggctctgagatattaccttacaacctattcaaacttgtgctggttatttggacaactttttgcagctggaatcatgaaaaattctcaaaaaaaatatgcggattcagaattaggatataaactaccatttgccctacagtggattttgccagttcctttagcactgggaattttttttgcacctgaatctccatggtggctagttaaaaaaggaaggtttgatgaggcaaggagatcacttagaagaactttaagcggcaagggacctgaaaaagaaatactagtaactctggaggtggacaaaataaaagtgactatagataaggaaaagagactcacaagtaaagaaggctcctatagtgattgttttgaagacaagattaatcgaagaagaacgagaattacttgtctctgctgggctggtcaagccacttgtggttcaatactaataggttattcaacttacttttacgaaaaggctggcgttagtactgaaatgtccttcacttttagtattattcaatactgtctcggtatttgtgctacatttctatcttggtgggcgtcaaagtattttggtagatatgacctttacgcttttggactagccttccaaaccattgtttttttcattattggcggtttggggtgctcaagtacgcacggttccaaaatgggaagtggttctcttttaatggctgtagcatttttttacaatttaggaattgccccggtcgttttttgcctagtctctgaaatgccatcttcaagactaagaacgaaaacaatcattctagcacgtaacacttataatgtggtcagtatcatatgtagcgttctcatcttataccaactgaactctaagaagtggaactggggcgctaagtcaggctttttctggggtgtcttatgcttttgtactttaatctgggctgtggttgacctaccagaaactgccggaaagactttcgtggaaataaatgagttatttaaacttggagtttctgcaagaaagttcaaatcgacgaaagtagatccgtttgttgtcaaaacccccctaaagacgtctctcataacgaccccaagggagatatcgaagcttccattgcagaggaatagcaatgtatcccatcacctatga

SEQ ID NO: 4060 - protein, 609 aa, Saccharomyces cerevisiae
MKNLSFLINRRKENTSDSNVYPGKAKSHEPSWIEMDDQTKKDGLDIVHVEFSPDTRAPSDSNKVITEIFDATEDAKEADESERGMPLATALNTYPKAAAWSLLVSTTLIMEGYDTAILGAFYALPIFQRKFGSQNDKTGEWEISASWQIGLTLCYMAGEIVGLQLTGPSVDLVGNRYTLIIALFFLAAFTFILYFCNSLGMIAVGQALCGMPWGCFQCLTVSYASEICPLALRYYLTTYSNLCWLFGQLFAAGIMKNSQKKYADSELGYKLPFALQWILPVPLALGIFFAPESPWWLVKKGRFDEARRSLRRTLSGKGPEKEILVTLEVDKIKVTIDKEKRLTSKEGSYSDCFEDKINRRRTRITCLCWAGQATCGSILIGYSTYFYEKAGVSTEMSFTFSIIQYCLGICATFLSWWASKYFGRYDLYAFGLAFQTIVFFIIGGLGCSSTHGSKMGSGSLLMAVAFFYNLGIAPVVFCLVSEMPSSRLRTKTIILARNTYNVVSIICSVLILYQLNSKKWNWGAKSGFFWGVLCFCTLIWAVVDLPETAGKTFVEINELFKLGVSARKFKSTKVDPFVVKTPLKTSLITTPREISKLPLQRNSNVSHHL

SEQ ID NO: 4061 - DNA, 1659 bp, Magnaporthe grisea 70-15
  CDS (1)..(1659)
atggcagcaggcgaaaagaccgacgtgcccgtcgaggccacggccagccatgtggctgcccccaaggggtctgaggctcatggagccggcgaggcgtctacagccttgcagattgagcgtgacatgagcatgagggatacctttcgcttctggcccaaggctatcttcttctcgttcatgctgtcgcttgctatcatcatggaggcctatgacctcaacctcatgagcaacttctacccattcccggccttcaaaaacagattcggcgacgaagtcgaccccgatggcggcatgctggtttcggccaggtggcagaccatcatcaacaacggtgtgcaggccggttccatcatcggtctgctgatcaacggttacgtgaccgagtggttcggctaccgcaagaccatgatcggcgccatgttcttcatgatcggaggcatcttcatccccttcttctcgactgggctacccatgttcctggctggtgccctcgtgcagggtctgccgtggggtgtcttccagactctgagtgtcacgtacgccgccgacttgtgcccgaccaagttgaggcagtacatgacatcttacgtcaacatctgctgggtcgtcggaggtattctggcaaagggcatgctcaagggtctgatgcagaggaccgaccagtggggatacagaatcccctttgctctgcaatggatctggcccggccccatcatcatcgccgccatcttcgtacccgagtccccgtggtggctgatccgcaagggccgctacgatgaggccagaaaggccgtcgagcgtctcaccagccccagcagcggcgtgcactttgaccttgacgcacacatggagatgatgaaggctaccaaccagctcgagatggagatgtccaccggtggcaacttctgggactgcttccgcggtgtcgaccttcgccgtactgagattgcttgcgtggtctggctgacccaagccttctgtggtgttcctttcatgtcttatggtatccagttcctcatcaacgccggaatgagccccgacaacgccttcaccatgggtcttgttgagaactgcatcggcctcatcggatgcctgctcgcctggtggatcatgaactacgtcggccgtcgctctctctacctctacggactcagcgccatgtttgtgatcctgatgattatcggatttatgggcatcccgactggcaaggagaacgaggagaggctcggctggggtatcggcgctttgatcatcacgatgctgttcctcttccagctcagcgtcggcccgtcctgctactgccttgtcgccgagatcccctcaacccgccttcgagtcaagaccgtggcacttgcgcgtgctacctacaacctcgccggcttcatcaccaatgcattgatgcctcccatgattggaaagaatgattgggcatggggcgcaaaagccgctttcttttgggccggtatcgacgtcatctttttgtgttgggtgttcttccgtctgcccgagccttttggtttgacgtattcggaaatcgacctccttttcgagcacaaggtcagtgcgcgcgggttctctcaggagaaggccgacgcgctcaagccagagctggacgagctggcacgcaggacagaaaagaatgttcaggaagaactctga

SEQ ID NO: 4062 - protein, 552 aa, Magnaporthe grisea 70-15
MAAGEKTDVPVEATASHVAAPKGSEAHGAGEASTALQIERDMSMRDTFRFWPKAIFFSFMLSLAIIMEAYDLNLMSNFYPFPAFKNRFGDEVDPDGGMLVSARWQTIINNGVQAGSIIGLLINGYVTEWFGYRKTMIGAMFFMIGGIFIPFFSTGLPMFLAGALVQGLPWGVFQTLSVTYAADLCPTKLRQYMTSYVNICWVVGGILAKGMLKGLMQRTDQWGYRIPFALQWIWPGPIIIAAIFVPESPWWLIRKGRYDEARKAVERLTSPSSGVHFDLDAHMEMMKATNQLEMEMSTGGNFWDCFRGVDLRRTEIACVVWLTQAFCGVPFMSYGIQFLINAGMSPDNAFTMGLVENCIGLIGCLLAWWIMNYVGRRSLYLYGLSAMFVILMIIGFMGIPTGKENEERLGWGIGALIITMLFLFQLSVGPSCYCLVAEIPSTRLRVKTVALARATYNLAGFITNALMPPMIGKNDWAWGAKAAFFWAGIDVIFLCWVFFRLPEPFGLTYSEIDLLFEHKVSARGFSQEKADALKPELDELARRTEKNVQEEL

SEQ ID NO: 4063 - DNA, 1650 bp, Magnaporthe grisea 70-15
  CDS (1)..(1650)
atggcctccaatcgagaagccacggctggcgcagacgcagaaaagagtccgacaatggcaccccctcgcaatgtcgacatggacacctccccctcctccctggctctcgaagccaaacacgccgcgtcctcggaacaggaaatgaccctctgggccgccatcaagacctaccccaaagcaatcggctggtctgtcctgctatcctctaccctgatcatggaaggatacgacctcgccctgctgtcctccctctacaactcgcccgtcttcaaccaaaagtacggcgagttcaacccggccaccgggaagtgggtcatcagcgccgcgtggcagtcgggcctgtccaacggcgcccgggccggcgagatcctgggcctgatcctcgccggctgggcctcggaccgctggggctacagggtgacgacgatgctgggcctcgtgctcatgatggccttcatctttgtgctcttcttggcgcccagcgtcgaggtcctcgtcctcggcgaggtgctctgcggcataccctggggcgccttccagtccgtgacccccgcctacgcgtccgaggtggcccccgtcgcgctgcgcccgtacctgaccacctttatcaacatgtgctgggtcgtcgggcagttcttggcccaggccgtcaactacaacagcatccgccggaccgacgagtgggcctacaggatcccctttggcgtgcagtgggtctggcccgtccccatcctggtcggcgtgtggttcgcccccgagagcccctggtggttcgtgcggcacggcgaccgcgccgccgccaagcggtccctgctccggctgaccagcccaggccagcccgggttcgacgccgacgagaccatcgccatgatcgagcacaccaacgagctggagcggcgcgtcaaggagggcgtgcggttccgcgactgcttcaggggcgtcgacctgcgccgcaccgaggtcgtggtcggcatctggctggtgcagacgctgggcggccagaacctgatgggctacttctcgtactttctgacgcaggccggcatggacgccagcaactcgctcgcgctgtccatgggccagtacgcgctgggcatggtcggcacggcggggagctggctgctgatggcgcgcgtcggccgccgcaccatccactttgccggcctgaccgcgcagctgctgatcctgctggtggtcggcgggctggcctttgccggcaccaacgcgggcgtctgggccatcggcggcatgctcatcgccttcacctttgtctacgactttaccgtcggccccgtcacgtactcgctcgtctcggagctgtcgagcacgcgcctcaaggcaaagaccatcgtctcggcccgcgccgcctacaacgccagcaacatctttgtcaacgtcatgaccaactaccagctgagcagcgccagcaccggctggaactggggcgcaaaaacggccttcttctgggccggcaccgccgccctgagcgccgtctgggtcttcttccgagtgcccgagcccaagggtcggacgtatgccgagctcgatatcctctttgagcagggcgtatctgcaaggaagtttgctagcacaaagattgatccgtatgagcatggtgtagaaagtaccgcaaaagaagagcaagtgtaa

SEQ ID NO: 4064 - protein, 549 aa, Magnaporthe grisea 70-15
MASNREATAGADAEKSPTMAPPRNVDMDTSPSSLALEAKHAASSEQEMTLWAAIKTYPKAIGWSVLLSSTLIMEGYDLALLSSLYNSPVFNQKYGEFNPATGKWVISAAWQSGLSNGARAGEILGLILAGWASDRWGYRVTTMLGLVLMMAFIFVLFLAPSVEVLVLGEVLCGIPWGAFQSVTPAYASEVAPVALRPYLTTFINMCWVVGQFLAQAVNYNSIRRTDEWAYRIPFGVQWVWPVPILVGVWFAPESPWWFVRHGDRAAAKRSLLRLTSPGQPGFDADETIAMIEHTNELERRVKEGVRFRDCFRGVDLRRTEVVVGIWLVQTLGGQNLMGYFSYFLTQAGMDASNSLALSMGQYALGMVGTAGSWLLMARVGRRTIHFAGLTAQLLILLVVGGLAFAGTNAGVWAIGGMLIAFTFVYDFTVGPVTYSLVSELSSTRLKAKTIVSARAAYNASNIFVNVMTNYQLSSASTGWNWGAKTAFFWAGTAALSAVWVFFRVPEPKGRTYAELDILFEQGVSARKFASTKIDPYEHGVESTAKEEQV

SEQ ID NO: 4065 - DNA, 1677 bp, Gibberella zeae PH-1
  CDS (1)..(1677)
atgtcggacgaaaaggtctcggctgttgccccagtggctcacgacacagaccccagcaagacccatcccgatgttatcgaccatgcgcgctccgcagcgaataaagaacagaacatgaccctcatgcagggcataaagctttatcccaaggctgtcgcatggagtgttctcatctcgacatgcattgtcatggaaggattcgacattgtacttgtcaacaacttttacgcctttccccagtggaacagaaaatacggaactcttcaacccgacggttcatatcaagtgtcggcagcatggcaagccggcctcagcaatggtgccaacgtcggttccatcatcggtctcttcctcaacggttggctgtcagagcgcttcggttatcgatacacaatcatcggctgtctcatctggctctcgggctgcattaccctcttcttcaccgcccaaaacgtccagatgctcctcgccgccgaaatcctctgtggcctgccatggggtatcttccagaccatctgcgtcacctacgcctccgaagtttgccccatcgccctccgcggttaccttaccacatatgtcaacttttgctggggtctcggacaagagattggtatcggaatattacgatccatgatcggccgaacggatcagtgggcttacagaatcccctacggtctgcagtggatctggcctctgcctttgatcgtcggactttggcttgcgcccgagagtccttggtggcttgttcgcaagggtcgtgttgctgatgctaagaagagtctcttgagactgactagtctcaatcgcgagacggatttcgatgcagacgagaccgtggctatgatggtgcacacaactgctctcgaggagaagctcaccagcggaagctcatatatcgactgcttcaagggtgtcaaccgtcgtcgaacagaaatcgtctgtatggtttgggctatgcagaacctcagcggaaactcgttttccaactactctacctacttcctcgaacaagccggtctgtccaccaagcacgcctattctttcgctcttggacaatatgccatcaacatgattggtgtgtttggtgcttgggcattgatgagccgaggaatcggccgtcgcactctctatctgtatggactttgcggtctctgcactgtcctctgcatcctcggcttccttggtctcgttcccgaggctgaccgtgagaagggtgctcttgccactggaagtcttatgattggatgggccgtggtttaccagcttactgttggctcggtggcctactctcttgttagtgagcttccttcccgaagactccagatcaagaccgttgctcttggccgtatcttttatggtatcgtcggtattatcaatgctgttttgacaccttatatgctcaaccctaccgcgtgggactggagcaactacaccggattcttctggggtggtatctgcttcctttgcatcatctacacctacttccgcctccccgaacccaacggccgtacctttgccgagctcggtgttttgttcgagaagggtatcagcgctcgcaagttcgctactacaaaggtcgacgtcttccacgaatcagtcgatgagcatgttctcgatgagctcaacaaggtcgataccgccacagttgagaccgtggagaaggcaggcggcaagtag

SEQ ID NO: 4066 - protein, 558 aa, Gibberella zeae PH-1
MSDEKVSAVAPVAHDTDPSKTHPDVIDHARSAANKEQNMTLMQGIKLYPKAVAWSVLISTCIVMEGFDIVLVNNFYAFPQWNRKYGTLQPDGSYQVSAAWQAGLSNGANVGSIIGLFLNGWLSERFGYRYTIIGCLIWLSGCITLFFTAQNVQMLLAAEILCGLPWGIFQTICVTYASEVCPIALRGYLTTYVNFCWGLGQEIGIGILRSMIGRTDQWAYRIPYGLQWIWPLPLIVGLWLAPESPWWLVRKGRVADAKKSLLRLTSLNRETDFDADETVAMMVHTTALEEKLTSGSSYIDCFKGVNRRRTEIVCMVWAMQNLSGNSFSNYSTYFLEQAGLSTKHAYSFALGQYAINMIGVFGAWALMSRGIGRRTLYLYGLCGLCTVLCILGFLGLVPEADREKGALATGSLMIGWAVVYQLTVGSVAYSLVSELPSRRLQIKTVALGRIFYGIVGIINAVLTPYMLNPTAWDWSNYTGFFWGGICFLCIIYTYFRLPEPNGRTFAELGVLFEKGISARKFATTKVDVFHESVDEHVLDELNKVDTATVETVEKAGGK

SEQ ID NO: 4067 - DNA, 1653 bp, Gibberella zeae PH-1
  CDS (1)..(1653)
atgtctcccgattcaaaggttgaccatggcatcgcgccacacgtcccagccgttgttgacgccaacgtcgcccatgaagctgccgccgcaacagaggcagagcaaaacatggggctcgtcaagtctctcaagctctacaagaaagcctgtctctggtctgtcttcttgtcactctgcatcatcatggagggttttgacgttgttcttctcaacaacctctttgcctatcctccgttccagcgcaagtttggtgtcgagcagcctgatggtacttatcagttgacagctgcttggcagtctggtctctccaacggtactctttgtggtcagattctcggtctcttcatcaacggtatcattgccgatcgctttggataccgcaagactctcatcggtgctctcattggatgcatcggcttcatcttcatcatcttcttttccgagactctggttcagcttctcattggagagatctttatcggtattccctggggtgtcttccagactcttaccactacctacgcctctgaagtctgccctacccacctccgcgcctatctgacaacctacgtcaacctctgctgggttctgggacagtttatcgcctctggtgtcctccgcgccatggtcacccgcgacgaccagtggggttacaagatcccctttgctctgcagtggatgtggcccgttcctctcatcatcggcatctacctcgcccccgagtctccctggtggctcgtccgaaagggccgcatcgaagaggccaaggtttccctgcagcgacttaccgcccgcaacaccgagtccgagttcaagcccgacgagacgatttccatgatgattcacaccaacgagatggagaaggaagctcaggccggtacctcatactttgatctcttcaagggcactagtctgcgacgaacagagattgtttgctgtacctggatggttcagactctttgcggtgctacttttatgggatactctacctacttctaccagatggctggcatggctgttgagaacagtttctccatgtctcttggtcaatacgccatcggtgctgttggcactgtcttttcctggttcctcatgggctggttcggtcgccgcacactctacctctggggtcagctggccatgtgtgtccttcttctcaccatcggctgtgtcgcttttgccggaaaggagaacgtcgctgctcaatgggttatcggatcacttctcctcatctacacctttacctacgattcgaccgtcggccccgtctgctactccctcgtcgccgaactgtcctcgacccgtctccgaaccaagaccgtcgtcctcgcccgaaacacatataacattgtcggtatcatgaccaacatcatcactcctcgcatgttgaaccctactgcttggaactggggtgccaaggctggtttcttctgggctggaacttgtgctctgtgcgctatctggacttacttccgtcttcccgagcccaagggccgcacttatggtgaactcgatgttctctttgagcgtggtatcagtgctcgcaagttcaagtctacacaggttgagcgactggatgctgagtttgttgatgttacaaaggaaaaggcttctgctgtttatgttgagcaggtcaagagcaaccagtcttag

SEQ ID NO: 4068 - protein, 550 aa, Gibberella zeae PH-1
MSPDSKVDHGIAPHVPAVVDANVAHEAAAATEAEQNMGLVKSLKLYKKACLWSVFLSLCIIMEGFDVVLLNNLFAYPPFQRKFGVEQPDGTYQLTAAWQSGLSNGTLCGQILGLFINGIIADRFGYRKTLIGALIGCIGFIFIIFFSETLVQLLIGEIFIGIPWGVFQTLTTTYASEVCPTHLRAYLTTYVNLCWVLGQFIASGVLRAMVTRDDQWGYKIPFALQWMWPVPLIIGIYLAPESPWWLVRKGRIEEAKVSLQRLTARNTESEFKPDETISMMIHTNEMEKEAQAGTSYFDLFKGTSLRRTEIVCCTWMVQTLCGATFMGYSTYFYQMAGMAVENSFSMSLGQYAIGAVGTVFSWFLMGWFGRRTLYLWGQLAMCVLLLTIGCVAFAGKENVAAQWVIGSLLLIYTFTYDSTVGPVCYSLVAELSSTRLRTKTVVLARNTYNIVGIMTNIITPRMLNPTAWNWGAKAGFFWAGTCALCAIWTYFRLPEPKGRTYGELDVLFERGISARKFKSTQVERLDAEFVDVTKEKASAVYVEQVKSNQS

SEQ ID NO: 4069 - DNA, 1677 bp, Gibberella zeae PH-1
  CDS (1)..(1677)
atggcgtcccccaaaccctttccagaaaaacaacccaacgcgcagcatgatgaggctgtcacccccgaaacacttgcctcggaagccaaggtcgctgctgaagctgaacactacatgactctatgggaagctgtaaaaacttacccaaaagccattggctggtccgttctgttgtctaccactcttatcatggagggctacgaccttgctttgctaggtaatctgtacgcttcccctgtattcaacgagaagtttggcacgtatgatgccaaaaaagagaagttcgctgtttcagctgcttggcaatctggattgtcaaacggtgcccgtgctggagagatcattggtctgatccttgcgggatgggcatctgaccgatacggatacaagatgactactgttggagcacttgttctgatgattgcatttgtctttgttttattctttgccccaaacatcaagattcttgttctgggagaggttctctgtggtacgtatctatccgttgactacaagtacacatttgctgatgagacaggtattccatggggcgcgttccagagcgtgacacccgcgtatgcgtctgaagtagcacccgtcgtgctccgaccgtacctgacgacattcatcaatatgtgttgggtcattgggcagttctttgctgctgccgttaacaagggctctgtcggacgaggggatgagtgggcctatcgcatcccgtttggagtacaatgggtatggcctgttccaatccttgcaggtgtcatttttgctcccgagtccccatggtggcatgtccgcaaaggcaatcgttccgctgcaaagaagtctcttctccgactcacatctcctcaacaacccaatttcaacgccgatgaaaccattgccatgattgagcacacaaacgagatggaaaagaacttgaaggagggcaccagctacagagactgcttcaaaggcgttgatctccgacgcacagagatcgtgattggtatctggctcgtccagactcttggcggtcaaaatctcatgggatatttctcatatttcttgactcaagccggcatggatgctagcaactcgttctcactctccatggcacagtacgcacttggcatggtcggcacatttgggtcttggttcttgatggccagggttggtcgaaggacgattcactttactggtctatgcacccaacttgtcattctcatcattgttgggtcgctgtcctttgccaacaacaacggttcagtttgggccatcggcgcaatgctcatcgtcttcacatttgtatatgacttcaccgttggaccggtcacatattcattgatctccgagctgtcctcaacccgtctcaaggcaaagacaattgttatggctcgcgctgcttacaacgctagtaacatatttgtcaacgtcatgaccaactaccagttgtcgtcgagtgcgtggaattggggcgcccgcacggcttatttctgggctggaacctgtttactttccgccatctgggtatatttcaggctccctgaacccagaaataggacatatgcagagttggatgtgttgttcgagaaacgcgtgtcggcgaggaaatttgcccagacagaagttgatccatattcccattcggttatttctgacaagaagccgacatctgagaaggagattcagtag

SEQ ID NO: 4070 - protein, 558 aa, Gibberella zeae PH-1
MASPKPFPEKQPNAQHDEAVTPETLASEAKVAAEAEHYMTLWEAVKTYPKAIGWSVLLSTTLIMEGYDLALLGNLYASPVFNEKFGTYDAKKEKFAVSAAWQSGLSNGARAGEIIGLILAGWASDRYGYKMTTVGALVLMIAFVFVLFFAPNIKILVLGEVLCGTYLSVDYKYTFADETGIPWGAFQSVTPAYASEVAPVVLRPYLTTFINMCWVIGQFFAAAVNKGSVGRGDEWAYRIPFGVQWVWPVPILAGVIFAPESPWWHVRKGNRSAAKKSLLRLTSPQQPNFNADETIAMIEHTNEMEKNLKEGTSYRDCFKGVDLRRTEIVIGIWLVQTLGGQNLMGYFSYFLTQAGMDASNSFSLSMAQYALGMVGTFGSWFLMARVGRRTIHFTGLCTQLVILIIVGSLSFANNNGSVWAIGAMLIVFTFVYDFTVGPVTYSLISELSSTRLKAKTIVMARAAYNASNIFVNVMTNYQLSSSAWNWGARTAYFWAGTCLLSAIWVYFRLPEPRNRTYAELDVLFEKRVSARKFAQTEVDPYSHSVISDKKPTSEKEIQ

SEQ ID NO: 4071 - DNA, 1716 bp, Gibberella zeae PH-1
  CDS (1)..(1716)
atggctgacacccaagacaaggtgtcgccggccccggctacggccccgccctcagataccaccgccgatgccccggccggtgctgacattcaggatccgagcaagacacacatcaacatcgtcgagcatgcccgctctgcagctcacaaagagcgtaacatgactattcgtcaaggtatcaagctctaccccaaggccatcttttggagtgtcctcatctccacctgtatcgtaatggagggttatgatatctcccttgttaataacttctatgcatttcctcagttcaacaaaaagtatggtgttctgggcgatgatggagagtatcaggtgccagccgcttggcaagctggtctgagcaacggagcccactgtggtgagattatcggtctttttatcaacggttggatctcagaacgatttggttaccgctatacggtcatggcatgccttgtctgtgtagccggtttcacaaccatcttctttactgcccagaatgttcagactctgcttgtggccgagatcctttgcggtattccttggggcatcttccaaacactgacaatcacatatgcatccgaggtctgcccagtcgctctgcgtggctatctgaccacatatgtcaacttctgctggggtttgggccaggaaattggtataggagtaattcactccatgctcaagcgtgaagatgaatgggcataccgtatcccgtatgcccttcagtggatatggccgttgccgctcctgatcggtatcttctttgctcccgaatcgccgtggtggctagtccgacgaggccgcaaccaggacgccaaggaagctttgctacgcttaaccagtctcgatcgtgagactgacttcgacgccgacgaaaccatcgccatgatggtacacaccaccgcccttgaagagaagattacagcgggagcatcctactgggattgtttcaagggtactgaccgtcgccgtacagagattgtttgcatgatctgggccatccagaatttgagcggcaactctttctctaattattcgacttatttccttgaacaagctggcctctcagccgacaaggcgtactcgtttgcccttggccagtatggcatcaatatggcaggtgtctttggtgcttggggacttatgagcctgggcatcggcagaaggtcgttggtactctatggcctctgtggtctttgttccatgctactcatcatggggttccttggcttggtgcccgaggcccatcgcacccaatcttcattggcgaccggttgcatgatgatcatctgggctctcttctaccagttgaccataggcaccgtatgctattctcttgttggagaactgtcgtctcgtcgcttgcaaatcaagacagttgttcttggccgcaatctatacaacgttgttggcatcatcaacagtattttgactccctacatgctcaaccccacagcctgggactggggcaactatgcaggattcttctggggcggcatttgctttctgtgcattatttacaccttctttcgtctgccggagccgagtggccgcacctttgcagagcttgacgtgcttttcgagagaggcatcagcgcaaggaagtttgcttcgaccgaggtggacgtgtttcatgagacagtcgaggagaatgttatgaaccgttatgaggagcttgcggatgtgccatccaagaaagtccataacaaagcatga

SEQ ID NO: 4072 - protein, 571 aa, Gibberella zeae PH-1
MADTQDKVSPAPATAPPSDTTADAPAGADIQDPSKTHINIVEHARSAAHKERNMTIRQGIKLYPKAIFWSVLISTCIVMEGYDISLVNNFYAFPQFNKKYGVLGDDGEYQVPAAWQAGLSNGAHCGEIIGLFINGWISERFGYRYTVMACLVCVAGFTTIFFTAQNVQTLLVAEILCGIPWGIFQTLTITYASEVCPVALRGYLTTYVNFCWGLGQEIGIGVIHSMLKREDEWAYRIPYALQWIWPLPLLIGIFFAPESPWWLVRRGRNQDAKEALLRLTSLDRETDFDADETIAMMVHTTALEEKITAGASYWDCFKGTDRRRTEIVCMIWAIQNLSGNSFSNYSTYFLEQAGLSADKAYSFALGQYGINMAGVFGAWGLMSLGIGRRSLVLYGLCGLCSMLLIMGFLGLVPEAHRTQSSLATGCMMIIWALFYQLTIGTVCYSLVGELSSRRLQIKTVVLGRNLYNVVGIINSILTPYMLNPTAWDWGNYAGFFWGGICFLCIIYTFFRLPEPSGRTFAELDVLFERGISARKFASTEVDVFHETVEENVMNRYEELADVPSKKVHNKA

SEQ ID NO: 4073 - DNA, 1623 bp, Gibberella zeae PH-1
  CDS (1)..(1623)
atgtcatcctccccaaaggacaaccttgctcaggttgagcatatcgatcctgactccaagatgggtttcgacgaggttgagaagcctgctgcgcgcgaggccaatgatcgcgagcatgatcttactctgcgcgatagtttccgcttgtatcccaaggccattgccttttctctgctgttctccactgcgatcatcatggaaggttatgatctgagtcttcttggtagcttctacggctatgatgcattcaagcaaaagtttggtaacgaaatcgactcggacggcaaccctattgtctcagcagattggcaaacatatatccaagtcggtggcatgtgtggtcaaatcatcggtctctacatcaacggttgggtctctgatcacttcggttacaagaagaccatgatggcttctcagatgctcatgatcggactcatcttcttccccttctttgcgcccaacctcaacgtcctcctcgccggaaacattctcctcggtcttccatggggtatcttccagaccctcacactcgcctatgcttccgacgtcgcgcccgttgtcctgcgcccataccttactgcctacgtcaacctttgctgggtcattggtcagctcatcggtgccggagttcttcgcggattcagcaccatgggtggtgactggtcatacagaattccctttgctttgcagtgggcttggcctccattcatcatgcttggtaccattttcgctcccgagtctccctggtggcttgtccgcaaggagcgctacgaggatgccaagcgatccattcttgcgctcgtcacccaatgtgatgttccctttgacgctgatgcgcaggttgagcttctcaaggctaccaaccagatggagaaggagaactctgccggaaccaactactggcactgcttcatgcgcagcgatttgagacgaactgaggttgcctctattacttacaccgcccaggccctttgtggtagcgctctcatgggttactctgttcagttctatctcgaggccggtctatctcccgagaaggcccttgatttcaacgtcatccagtactgcgtcggcgctgttggcgttgttctctcctggttcttgatgtcccgcttcggtcgtcgtgatatctacatctgcggcatggcaactctcttctgtatccttattgtcgttggtgctctcggatgcatcaacaagaccgagagcgtcggctgggccatcggtagcttgctcatcgtgtacactttcgtttacgacatgaccatcggacccatcgcctacaccatcgtcgccgaggtctcatccacgcgtctcaaggccaagaccatcgttctggcccgtaacttcagcaacattgctggccttgtcaccaacaccttgatgccccgcatgcttggccgaaactcgtggaactggggcgccaagactggtctcttctgggcaggttggtgtctgttgatctttatctgggccttcttccgtctgcccgagcctaaggatagaacttatggtgagctggatctgctttttgagcacaaggttcctgcgcgcaagtttgccaagaccaaggttgatcaattccctacttctggttccaccgagaaggtccaggagcagtaa

SEQ ID NO: 4074 - protein, 540 aa, Gibberella zeae PH-1
MSSSPKDNLAQVEHIDPDSKMGFDEVEKPAAREANDREHDLTLRDSFRLYPKAIAFSLLFSTAIIMEGYDLSLLGSFYGYDAFKQKFGNEIDSDGNPIVSADWQTYIQVGGMCGQIIGLYINGWVSDHFGYKKTMMASQMLMIGLIFFPFFAPNLNVLLAGNILLGLPWGIFQTLTLAYASDVAPVVLRPYLTAYVNLCWVIGQLIGAGVLRGFSTMGGDWSYRIPFALQWAWPPFIMLGTIFAPESPWWLVRKERYEDAKRSILALVTQCDVPFDADAQVELLKATNQMEKENSAGTNYWHCFMRSDLRRTEVASITYTAQALCGSALMGYSVQFYLEAGLSPEKALDFNVIQYCVGAVGVVLSWFLMSRFGRRDIYICGMATLFCILIVVGALGCINKTESVGWAIGSLLIVYTFVYDMTIGPIAYTIVAEVSSTRLKAKTIVLARNFSNIAGLVTNTLMPRMLGRNSWNWGAKTGLFWAGWCLLIFIWAFFRLPEPKDRTYGELDLLFEHKVPARKFAKTKVDQFPTSGSTEKVQEQ

SEQ ID NO: 4075 - DNA, 1740 bp, Debaryomyces hansenii CBS767
  CDS (1)..(1740)
atgagtgcacaacatgtcgaggatattgacaagcctggagtggtgattgaggtgaatccgcttaacaagaatatgacagacgattcgatggcacatgaggcacaggactttatggataagttcttagatatgtcggaaaacgcaaaagataacgatagaaaggagaaatatatgccgttgaaagaaggcctaaagacgtttccaaaggctgcaatgtggtcggttattttaagtactgctttaattatggaaggatatgataccaatcttttgaactcattatacgcatttccagatttcgccaaaaagtttggagagtacagtgaatccgatggactgtatcagatacctgctaaatggcaaacttctttgagtatgtgtgtaaacgttggtgaaattattggattatttattgcaggtattattgccgataggattgggtacagaaagacacttattggtgctttgatgcttactactgggtttatatttatcgtgttctttgctgttaatgttgaaatgttattagctggtgagctattattgggtcttccttggggggcattccagacgctaacagtttcgtatgcttctgaagtttgccccaccactctacgggtatatttgacaacttacgttaacgtttgctgggtttttgggcaattgatttcatcaggtatccttcgtggacttgtttcaagcgatatagaagatgtttaccgtattccatttgctgtccaatgggtttggcctattccgattgctataggtatctatttggctcccgaatctccatggtggttggcaagaaagaatagaattcaagaggctaaacattcaatcaaaagattactcacagtaaacgaacatttaccagataaagaaatcttggctgaagcaatggtgcaaaaaatacaaatgactttgaaagaagaagcccttacaaataatggagaatcattcttagattgttttaagggtcaagatcttcgtagaaccagaattgctgccatcgtatgggtcagtcaaaacttaactggttcctcgttaatgggatattcaacttatttttaccaacaagctggccttggacagaatatgtccttcactttttcaatcattcaatactgctttggtatagtcggtactcttggttcatggttgctttctcaaaaagctggtagatttacaatttatttctacgggctctgctctttgttttgcatcttatttgttgttggatgtcttggtatcaacccaacagagtcctcatcctggggcgttggaagtttattattggtatacacttttgtctatgacctcactatcgggccactttgttattgtatcgttgctgaaattccttcaacaaaacttcgtaccaaaacgattattattgctagaaatgcgtataatattgccggaattgtcgttgcaattatcactccatacatgttaaacccaactgcttggaactggaaagccaagactggattcttttggtcaggatttgcattttttgcagcaatttggtgttggtttgatttaccagaaaccaagggtaaaacttttgctgaattggatcaattatttgaaaataaagttaaggctagacaattcaagaaaacagaagttgaggtctttaatacagacgagcttattgaaaggttaggagaagatggtatcaaagatcttgtagttactgatgcctctaaagatgaattctcagaaaaagtttga

SEQ ID NO: 4076 - protein, 579 aa, Debaryomyces hansenii CBS767
MSAQHVEDIDKPGVVIEVNPLNKNMTDDSMAHEAQDFMDKFLDMSENAKDNDRKEKYMPLKEGLKTFPKAAMWSVILSTALIMEGYDTNLLNSLYAFPDFAKKFGEYSESDGLYQIPAKWQTSLSMCVNVGEIIGLFIAGIIADRIGYRKTLIGALMLTTGFIFIVFFAVNVEMLLAGELLLGLPWGAFQTLTVSYASEVCPTTLRVYLTTYVNVCWVFGQLISSGILRGLVSSDIEDVYRIPFAVQWVWPIPIAIGIYLAPESPWWLARKNRIQEAKHSIKRLLTVNEHLPDKEILAEAMVQKIQMTLKEEALTNNGESFLDCFKGQDLRRTRIAAIVWVSQNLTGSSLMGYSTYFYQQAGLGQNMSFTFSIIQYCFGIVGTLGSWLLSQKAGRFTIYFYGLCSLFCILFVVGCLGINPTESSSWGVGSLLLVYTFVYDLTIGPLCYCIVAEIPSTKLRTKTIIIARNAYNIAGIVVAIITPYMLNPTAWNWKAKTGFFWSGFAFFAAIWCWFDLPETKGKTFAELDQLFENKVKARQFKKTEVEVFNTDELIERLGEDGIKDLVVTDASKDEFSEKV

SEQ ID NO: 4077 - DNA, 1749 bp, Debaryomyces hansenii CBS767
  CDS (1)..(1749)
atgtcacgcttatcttttatcgttaaaaacgaagtggaacctaatattgaaattgagaacaaaactaaatatgaacaggtgaatttcgaagtagatcctaccgctgataaggatattaatgattatatcgaaaagtttctagacatttcggataatgcaagaaataacgacaagcaagaaaaagagatgtcactacttgagggattgaaaacatatcccaaagcagctgcatggtcagtgattctatcaacagctttggttatggaaggttatgatacttcgctcatgggatcattatatggtatgcctgcatttgctgagaaatttggtatgtttgagccatcttctcaatcgtatcaaattccggcaaaatatcagaccatcatgggtacttgtggtaatgctagttctataattggactctggtttgctggtattcttgcagataggtttggatatagaaaaactattatagctaacttgatcttggttgcaatttttattttcattgtttttttcgcaaagaatattggtatgttaatggcaggtaacattttactaggctttccctggggtgcctttcagacattatcagttgcttatgcttctgaagtatgtcctatggttttgagaatttacttgacgacatattccaatatttgttggatttttgggcaattactctcagctggtgtaatgcgggcatttgttactagcacctcagagcaatcctataaagtaccatttgctattcaatgggtatggcctgttccaattatcatcggtgtattttttgctccagaatcaccttattggttagtcaagaatgacaaatataaagaggccaagagatcgattgagaggctcattactgaaaacaaaaatgtggacaaaaatatactttctgaagcgatgttacaaaaaatgcaaatgacagttaaaggtgagcagcaagaaaaaaagctaccttcttatttggaatgtttcaaaggtgtagagcttcgtcggacacgaattgctgcattgacttggctaactcaaaacctatgtggcgccactctcttgagttattcgagctacttctatattcaagcaggtatggctccagagatgtcatttacatttacaattattcaatttgcacttggtattgtaggcactattgggtcttggtttttgtctaagagatttggtcgctttacaatttattttggagggctttgtgctttagctgtaatattgatggtgataggcgggcttggctgctcaactgataagaattctatgtggggtgttggcactcttctaattatttacgttatggtctacgatttaactgtcggtccgttatgttattgtattgttgctgaaataccttctgttcgtcttcgcgcaaagagtattattattgctagaaacctctacaatatttctggaatagttttgagtatacttactccttatatgcttaatccaggagcttgggattggctggcaaaggttgggtttttctggtcaggattcactattgtttgtgcagtctggtgcttttttgatttaccagagaccaagggaaaaacttttgcggatcttgattatcttttccaacaaaatatcaaatcaagagacttcaaaaatacggaagcttctgtttttgatgccgagagctacatccataaactaggagatgatgggataaagcagcttgttgagcagaatgagtttgccaataatactggaaaagtataa

SEQ ID NO: 4078 - protein, 582 aa, Debaryomyces hansenii CBS767
MSRLSFIVKNEVEPNIEIENKTKYEQVNFEVDPTADKDINDYIEKFLDISDNARNNDKQEKEMSLLEGLKTYPKAAAWSVILSTALVMEGYDTSLMGSLYGMPAFAEKFGMFEPSSQSYQIPAKYQTIMGTCGNASSIIGLWFAGILADRFGYRKTIIANLILVAIFIFIVFFAKNIGMLMAGNILLGFPWGAFQTLSVAYASEVCPMVLRIYLTTYSNICWIFGQLLSAGVMRAFVTSTSEQSYKVPFAIQWVWPVPIIIGVFFAPESPYWLVKNDKYKEAKRSIERLITENKNVDKNILSEAMLQKMQMTVKGEQQEKKLPSYLECFKGVELRRTRIAALTWLTQNLCGATLLSYSSYFYIQAGMAPEMSFTFTIIQFALGIVGTIGSWFLSKRFGRFTIYFGGLCALAVILMVIGGLGCSTDKNSMWGVGTLLIIYVMVYDLTVGPLCYCIVAEIPSVRLRAKSIIIARNLYNISGIVLSILTPYMLNPGAWDWLAKVGFFWSGFTIVCAVWCFFDLPETKGKTFADLDYLFQQNIKSRDFKNTEASVFDAESYIHKLGDDGIKQLVEQNEFANNTGKV

SEQ ID NO: 4079 - DNA, 1593 bp, Aspergillus nidulans FGSC A4
  CDS (1)..(1593)
atggagaaccatgaccctcaacccaagcaggagctggcccacggccagcagggtgctcgccaggaacagggaatgagcctctggcagggtctccgtctttatcccaaggccgttgcctggtccgttctgttatcctcgaccctgatcatggaaggctacgatctcgccctgctcggttccctgtacgcgtccccggcattcaaccaaaggtacggtgtccaggccgccaatggcgattggggcgtccctgcctcctggcaatcggcgctatccaacggtgctcgcgtcggcgaggtgatcggtctgatcatcagcggtttcgtctctgagcgcctcggctatcggtggacgatgatctacgccctcatcgccatgaatgctgtcatcttcctcttcttcttcgccgtcaacgtccaaatgcttctctccgcagagatcctggccggtataccttggggcatctttcagacccttccagctgcctacgcaagcgaggtttgccccgtcgtcctccgcccctaccttaccacctacatcaatatgtgctgggtcatgggccaatttatcgccgccggcgtcaatcgcggctcctttcagcgcatggaccaatggtcctaccgcgtccctttcgctgtgcaatgggcctggcccctccccatccttaccggcatcctcttcgctccagagtccccctggtggcacgtccgtcgcggcgatatcgcgagggcgaagcacgccctgcaacgcctcacctctccgcaagatgcctccttcgacgcggacgctacaatcgccatgattcagcacaccaacgaactcgaaaaatccctgtctgccggtacaagctacctcgactgcttccgcggcgttaaccgccgccgcaccgagatcgtctgtggcatttggatcgtgcagacactcagcggccagaacataatgggctacttcgcatacttctgcgtccaggctggcctacccgagatccattccttcaacctctcgcttggccagtatgcccttggtgtcctcggcaccatcggctcttggttcctgatgtccgcgctgggccgccgcacaatccacctcctcggcttgtcgttgctcttcactctcctcattatcaccggcagtctttcctttgcgccggactccaacaacgccgcgaaatgggcaatcggggccatgctcatggttttcacattagtctacgatatcagcatcgggcccgtgacatattccctcgtctcggagctctcgtcgacgcgtctaaaggcgaaaaccatcaacctggcccgcgcagggtacaatatcagcaacatagtcgtcaacgtgctgacgaactaccagctcaacgactctgcttgggcctggggcgcgcgctcagcgtacttctgggccggcacctgccttctttgtctgtgctggtcagcgatgcgtgtcccggagccaaagggccgcacgtatgaagagctggatctcctgtttgagcagagagttccggcatggaggttcaagaagactgcggtagatccgtaccagggcttggctgagactgagggtcatgttagggaggatcagcaaaagagtagctga

SEQ ID NO: 4080 - protein, 530 aa, Aspergillus nidulans FGSC A4
MENHDPQPKQELAHGQQGARQEQGMSLWQGLRLYPKAVAWSVLLSSTLIMEGYDLALLGSLYASPAFNQRYGVQAANGDWGVPASWQSALSNGARVGEVIGLIISGFVSERLGYRWTMIYALIAMNAVIFLFFFAVNVQMLLSAEILAGIPWGIFQTLPAAYASEVCPVVLRPYLTTYINMCWVMGQFIAAGVNRGSFQRMDQWSYRVPFAVQWAWPLPILTGILFAPESPWWHVRRGDIARAKHALQRLTSPQDASFDADATIAMIQHTNELEKSLSAGTSYLDCFRGVNRRRTEIVCGIWIVQTLSGQNIMGYFAYFCVQAGLPEIHSFNLSLGQYALGVLGTIGSWFLMSALGRRTIHLLGLSLLFTLLIITGSLSFAPDSNNAAKWAIGAMLMVFTLVYDISIGPVTYSLVSELSSTRLKAKTINLARAGYNISNIVVNVLTNYQLNDSAWAWGARSAYFWAGTCLLCLCWSAMRVPEPKGRTYEELDLLFEQRVPAWRFKKTAVDPYQGLAETEGHVREDQQKSS

SEQ ID NO: 4081 - DNA, 1641 bp, Aspergillus nidulans FGSC A4
  CDS (1)..(1641)
atgacatctcaacgtgtcgttccttctgaacgtgaggtcgctgagcttcggagggtagagggtcagacagccgatctcatccgccaggcgcaagagagcgatgaagccgatcgcaagttgaccatccgtcaggccgtgaagaaatacaaaaaagcagtcttctgggccttatttctgtctactagtttggtcatggaggggtatgacctggtgataatcacttcattctacggccaaacccagttcaaggagcgtttcggcgtctacgacccagcttcagaccagaagctgattccagctgcatggcagtccggtatatcgaactcggctctggtcggccaactagctggtcttgttgtcaacagcatctgccaggaccggttcggctgccgtcgaacaatgatggtcttcatggtgtggatggctgtcgccatattcgttcctgtctttgcgccatctcttccagtgctcgcttttggagaggcattttgcggtataccctggggcgtatttcagacgctgtcaaccacatatgcttccgaagtagtgccaacagttctcagaccatatgtcaccgcgtatgtctgtatgtgctggggcgccggcatccttctctcctctggcgttgttagggctgtagcaggactccagggcgaattgggctggcggctcccattcatgttgcaatgggtctggccccttccacttttcatcggcgcatactttgctccagaatccccttggaactcggtgcgtcgggataagatcgacgaggcaaggacaaacttgatgcggctataccaggatatgccggagcgagagcatcaagtggaacaaaccttggcctatatcaaatacacgacagagatggagaaagccgagactgccaacgctagctttctcgaatgcttcaaggggaccaacctgcggcgaactgagattaattgtgttgtttgggcagcccaaattctctgcggaaacgcgatccttggatactcagtcgtgtttctccaggccgcgggcttcagcgaactgcaagcattcaacatcaacatttcgttatcggcctgttacattgtcggcggcatcatttgttggttcctcttcccccacgtcgggagggcgacaatctacatgagcgggctgaccttcatgttcttctgcctggtcaccatcggaggactagcttggggtccagggaaagacgcccagcttgccatcggtatcctccttgtcatttccacgttatgcaacatgattgccattgggccgacatgctaccccattgtcgcagagacaccgtccggaaggctgagatacaagacaatcaccattggtcggtttgtttataacctaaccagcatattcaccaactctgtcacgcctcgcatgctctcctccacatcctggaattggggagccaaggccgccttcttctacgcagggaccaacctgctttgcaacatctggtgctggtttcggcttcctgagacgaaagatcggacgtttggtgaaatcgatctgctttttacccatcgtgttccggcgaggaagttcaagtctactcatgtcaaccaattcgcccatggcggcgactatgtgtcgaagcaagaggtcgaacacaaggagaacgtggaatag

SEQ ID NO: 4082 - protein, 546 aa, Aspergillus nidulans FGSC A4
MTSQRVVPSEREVAELRRVEGQTADLIRQAQESDEADRKLTIRQAVKKYKKAVFWALFLSTSLVMEGYDLVIITSFYGQTQFKERFGVYDPASDQKLIPAAWQSGISNSALVGQLAGLVVNSICQDRFGCRRTMMVFMVWMAVAIFVPVFAPSLPVLAFGEAFCGIPWGVFQTLSTTYASEVVPTVLRPYVTAYVCMCWGAGILLSSGVVRAVAGLQGELGWRLPFMLQWVWPLPLFIGAYFAPESPWNSVRRDKIDEARTNLMRLYQDMPEREHQVEQTLAYIKYTTEMEKAETANASFLECFKGTNLRRTEINCVVWAAQILCGNAILGYSVVFLQAAGFSELQAFNINISLSACYIVGGIICWFLFPHVGRATIYMSGLTFMFFCLVTIGGLAWGPGKDAQLAIGILLVISTLCNMIAIGPTCYPIVAETPSGRLRYKTITIGRFVYNLTSIFTNSVTPRMLSSTSWNWGAKAAFFYAGTNLLCNIWCWFRLPETKDRTFGEIDLLFTHRVPARKFKSTHVNQFAHGGDYVSKQEVEHKENVE

SEQ ID NO: 4083 - DNA, 1698 bp, Aspergillus nidulans FGSC A4
  CDS (1)..(1698)
atggagtcctccaaggctcaggatgtgatcactccggtcaagaatgaacagtcgccagattctcacgggtcgccgacgccgatggcgaaggtcgttgcaaacgcgagggcagctgctcacaaggagcagaagatgacgctattacaggggataaaactctatcccaaggctgtcatgtggagcgttatcatctctacaacaattgctatggaaggttatgatatttctttggtcaacaacttctatgcctttgaacagtttaatcgcaaatatggcgagctgggagcaaacggggagtatcaagtacctgcacggtggcagtccggtttgagtaacggggcgtatgtcggcgaaatcatcggtctattgctcaacggttgggcctctgaaaggttcggataccggtatacggtcatggcttgtcttatcctcatcacagcctggacagccatcttcttcacggctcctaatgtccaagctctactggccgccgaaatactcgctggtgtaccctggggagtcttccaaacattatgcgtcacctatgcctccgaggtctgtccggttgcgctacgcagctacctcaccacgtacgtcaatttctgttggggtctgggacaacttataggcgtcggcgtgatccggtcgatgatcggccgggaggatgaatgggcttatcgcattccgtacggattacaatggatgtggccggtgccacttttcatcgggatttggttggcgcccgagtcgccctggtggctagtccggaggggcaagacacaggacgctaaaaagtcactgcagcgtttgacgagtccacaccgagataccgacttcaatgcggacgaaaccatcgccatgatggtccacaccacagctctggaacagaaattaacatcgggcgctagctatttagattgcttcaaaggagttgatctgcggcgcacagaaatcgtctgcatggtatgggctatccaaaacctcagcggcaattctttctcgaactactcgacgtactttctccaacaggcgggactggacgacgagaaggcatactcatttgcaatgggccagtacggcatcaacatggttggagtctttggagcatggttcctcatgtcgtggggtatcggccgtcgaaagctctatctttacggtttatgtgggctctgcgtaatgctgctggttatgggatttctcggccttgttccagagtctcaccggacacagtcttcgctcgccaccgggtcaatgatgcttatatgggcgctgttctaccagttaacagttggaaccgtggcctactctctcgtcgcagaaatctcgacacgccgtctgcagatcaagaccgtcgttctcggccgtatcctatacaacattgttgccatcatctgcggtgttctcacgccgtacatggtgaacccgacggcttgggactggggcaactttgctggtcttttctggggagggatttgctttctttgcatcatctatacctattttcgcgttcctgaaccgcgggggcgcacattcgccgagctggacgttctctttgagcgcaggatcagtgctcgtaagtttgaaagcacgcaggtcgatgtttttgatgagacatttgaaggcaaggtggttgaggactatcaaaaccagaaagggctcccggatgatccggagaaactacctactggcgtgttctga

SEQ ID NO: 4084 - protein, 565 aa, Aspergillus nidulans FGSC A4
MESSKAQDVITPVKNEQSPDSHGSPTPMAKVVANARAAAHKEQKMTLLQGIKLYPKAVMWSVIISTTIAMEGYDISLVNNFYAFEQFNRKYGELGANGEYQVPARWQSGLSNGAYVGEIIGLLLNGWASERFGYRYTVMACLILITAWTAIFFTAPNVQALLAAEILAGVPWGVFQTLCVTYASEVCPVALRSYLTTYVNFCWGLGQLIGVGVIRSMIGREDEWAYRIPYGLQWMWPVPLFIGIWLAPESPWWLVRRGKTQDAKKSLQRLTSPHRDTDFNADETIAMMVHTTALEQKLTSGASYLDCFKGVDLRRTEIVCMVWAIQNLSGNSFSNYSTYFLQQAGLDDEKAYSFAMGQYGINMVGVFGAWFLMSWGIGRRKLYLYGLCGLCVMLLVMGFLGLVPESHRTQSSLATGSMMLIWALFYQLTVGTVAYSLVAEISTRRLQIKTVVLGRILYNIVAIICGVLTPYMVNPTAWDWGNFAGLFWGGICFLCIIYTYFRVPEPRGRTFAELDVLFERRISARKFESTQVDVFDETFEGKVVEDYQNQKGLPDDPEKLPTGVF

SEQ ID NO: 4085 - DNA, 1704 bp, Aspergillus nidulans FGSC A4
  CDS (1)..(1704)
atggatacagactggaatcagaatcgagacccagagcgggccagcagtgcagaatcagggtccggatcatcgagggcaattgctatcgacctcgagcaagcccgcatcgcaacggcccaagaacacagcctgagcttcacagagggcctgcgcacgtaccgaaaggccgtgatgtggtcgatgctcttctcattagcaataataatggaagggtatgacacgacccttctacagtccttttttgcgtttcccgagttcgtgcgcaagtacgggtcccccatctatacctccacctccaacgcatcctcaagtccagggccgggagaagaggtggaaacccacgaactctccgccgcctggcaaagtgccctcacaaacggtgcgtatattggtgaaatactcggtctgttcatcacgggccttgttatcgaaaagacggggtatagacggctcatgttcgcatcggccctctcccttggagggtttattttcatcctggtcttcgcacccgatctcccaacattgctggtcggtgaaattctttgcggcattccctggggtgtatttcaaactgtgacaacagcgtatgcggcagatgtatgtcccgtacttttgagggggtacctgacaacgtacgtcaatctgtgttgggtgcttgggcagtttgtggcgacgggggtgttgcgggcttgcctgcatataggtccagtccaggatgcgggacaaggtgacgaatggagttatcgcatcccgttcatgatacaatgggtatggctgccgtttattttggtcattgtgtgggttgggccggagagtccgtggtggctagtgaggaagggaaagttgagtgaggctaaaagcgttctcgaaaggctttctgcctccaccctttcttcatcctccacacccggcaaggctttggaacgaggccaaacagaaaccacccttgccctgatgctatacaccatccagatggaaaacgaatatgtttctcaatctcatgagtcctacctttcctgcttccactctacgaaccgccgccgcacggaaatcacctgtctgacctgggcaatccaggccctctgtggctcctcgttcatgggctattcgacttacttctaccagcaggcaggtctatccgtatcgcagtccttcaatatgtcgctaggccagtacgcgtttgggatcgtcggaacactcgtctcgtggttgttaatgactcggtttggacggcgcaccctctacgtcgtcggtcttctccttctggtcatcatacttttctctgtgggttttacctctttgtctgatacgaagacagcgagctgggctattggctctttattactactgtttacatttacgtacgattgcactatcgggccggtatgttatagtattgtctccgagatcccttcgacgcagctccgaggaaagacaatcgtactggcaagaaatgtatataacatgttcatgatcgtgaatgggattattgtcccgaggatgttgaaccctacggcctgggactggagaggactcgccgggttcttctggggtgggattacactggtattgctttgttggtcttatttcagactgcctgagagtaagggaaggacgtttgcggagatggatattctgttcgaaaggagagtgaatgcgagacggttcagaaaggaggaggtttgtttccatacaaataactag

SEQ ID NO: 4086 - protein, 567 aa, Aspergillus nidulans FGSC A4
MDTDWNQNRDPERASSAESGSGSSRAIAIDLEQARIATAQEHSLSFTEGLRTYRKAVMWSMLFSLAIIMEGYDTTLLQSFFAFPEFVRKYGSPIYTSTSNASSSPGPGEEVETHELSAAWQSALTNGAYIGEILGLFITGLVIEKTGYRRLMFASALSLGGFIFILVFAPDLPTLLVGEILCGIPWGVFQTVTTAYAADVCPVLLRGYLTTYVNLCWVLGQFVATGVLRACLHIGPVQDAGQGDEWSYRIPFMIQWVWLPFILVIVWVGPESPWWLVRKGKLSEAKSVLERLSASTLSSSSTPGKALERGQTETTLALMLYTIQMENEYVSQSHESYLSCFHSTNRRRTEITCLTWAIQALCGSSFMGYSTYFYQQAGLSVSQSFNMSLGQYAFGIVGTLVSWLLMTRFGRRTLYVVGLLLLVIILFSVGFTSLSDTKTASWAIGSLLLLFTFTYDCTIGPVCYSIVSEIPSTQLRGKTIVLARNVYNMFMIVNGIIVPRMLNPTAWDWRGLAGFFWGGITLVLLCWSYFRLPESKGRTFAEMDILFERRVNARRFRKEEVCFHTNN

SEQ ID NO: 4087 - DNA, 1767 bp, Candida albicans SC5314
  CDS (1)..(1767): transl_table=12
atgaccattgaagaatatagacccgaatcagatgaaaaaaatgtgtcgactccatccatcgtgagtttggatgataagacaactaatgcttcacatatttccaatgctgctcaagaaaatgtcgatgactatatcgccaagttcttggatatgtccaatactgctaaagctgaagatgaaagagataaaactatgccgcttaaagaatgtataaaaactttccctaaggcgtgcttttggtcagtggttttatcgtcagctttaattatggaaggttatgatactaatttgctcgctagtttttacgcttatcaaggttttgctaagaaatttggtagatattacgaaaatttgggtgaataccaagtcccagcaaaggatcaacttgggttgtcaatgtgttatcaaactggtcaattagtcggtgtttatattggtgctcatttagttgatattattggttacagatatacacttattccagctttggcttcttcaattgggttgattttcattcaattttttgctccaaatgttcatgtattaatggtttcttatgtgttgttagggattaattggggtagttatcaaacagtgtgtgtttcttacgctatggatatagcccctacaacattgcgactttatcttaccacctatatcaactgttgttgggttttcggtcaattaatttcatcaggggttgttaaagccatcctgcaactgtccgatcctcatgcatatcgtattgcctttgctatacaatggatttggcccattccaattatgactggtatctttttcgctcctgaatcaccttggttcttggtcagaaaaggtcgtttggaacaagccaagcatgccttggaacgtttattgtctcaaagtgaacatatccccgataagtctatcatttcccaaagtatgttgacaaaaatccaaatgactatcaaagaagaagatgctgtttctgctggttcatctattattgaatgttttaaaggtacaaactttaggagaactagaattgctgctttcacttggttgattcaaaacattaccggatcaagtttgatgggttattcaacatatttctatcaaaacgctggtgttccagtttccatgtcattcactttctcgatcattcaatattgtttaggtatcgttggtaccattggatcttggttcttgtcacaaaaatgtggtcgtttcacaatctacttttatggattatgtgccatgacagtacttttgttgcttactggtggtatgggtacgtccgacaaaaaatcacttagtatggccgttggtagtatgcttttggtttacacatttgtttacgatttgaccatcggaccaatgtgttactgcattgttggtgaaatgccatcatccaaacttagagccaagacggtgatgttggcaagaaacttgtataatattgctggtattattgttgctattgttactccatacatgttgaatcctactcaatggaattggaaggcaaaatctgcattcttgtgggctggtttcgcaatcttatctgctatttgggtatactttgaattacctgaaactaaaggtagaacttttgctgaattggataagatgtttgaagataaagttccagcaagaaaattcaaatacactactccaaccacttttgatgctggagaaatgatggaaaagatgggtaattctggtctcaaaagtattgttcacgatactgagcatgttgagagttctcatatcgaaacaaaggcttga

SEQ ID NO: 4088 - protein, 588 aa, Candida albicans SC5314
MTIEEYRPESDEKNVSTPSIVSLDDKTTNASHISNAAQENVDDYIAKFLDMSNTAKAEDERDKTMPLKECIKTFPKACFWSVVLSSALIMEGYDTNLLASFYAYQGFAKKFGRYYENLGEYQVPAKDQLGLSMCYQTGQLVGVYIGAHLVDIIGYRYTLIPALASSIGLIFIQFFAPNVHVLMVSYVLLGINWGSYQTVCVSYAMDIAPTTLRLYLTTYINCCWVFGQLISSGVVKAISQSSDPHAYRIAFAIQWIWPIPIMTGIFFAPESPWFLVRKGRLEQAKHALERLLSQSEHIPDKSIISQSMLTKIQMTIKEEDAVSAGSSIIECFKGTNFRRTRIAAFTWLIQNITGSSLMGYSTYFYQNAGVPVSMSFTFSIIQYCLGIVGTIGSWFLSQKCGRFTIYFYGLCAMTVLLLLTGGMGTSDKKSLSMAVGSMLLVYTFVYDLTIGPMCYCIVGEMPSSKLRAKTVMLARNLYNIAGIIVAIVTPYMLNPTQWNWKAKSAFLWAGFAILSAIWVYFELPETKGRTFAELDKMFEDKVPARKFKYTTPTTFDAGEMMEKMGNSGLKSIVHDTEHVESSHIETKA

SEQ ID NO: 4089 - DNA, 1743 bp, Ustilago maydis 521
  CDS (1)..(1743)
atgctggtcgacaagaacgaggtggctcgcatcgatgtggacactcgcgagaagctcatccacaagtttggcgaccgtttcgaagaggttgtcgagcgcagcgcgcgtagcacaatgtggcaaaccaactcatctattggtgagactttccgacgatggccaatgtcggtcacctggtccatcctcttctctctagccatagtgcaaatagggtttgattcctctattctctcgtcattttttgctcaaccagcgtttaccgagaagtttggcgaatgtaaagtggcagtagatggttccaaggattgcgagatctctgcgccatggcagcagggtttgactaatggagcttggattggaggcattgttggtctccaactcgccggtagcattgctgagcgaattggtcaccttcgtcttatgatgatcagcaccacgcttatgctagcctttgtcttcattccgttttttgccaccagtcttcccgtcttcctcgtcggtcagatctttatgggcatcccttggggcggattccaatcgcttgcttccgcctacgcttctgaaatctgccccgtttcccttcgaccacttctgacgacctacgtcaacctgtgctgggtgtttggacagttgctcgccgctggtgtacttcgtggaaccgtagggcgttcagatgtctgggcttggaagatcccttacgcggttcagttcttttggcctttcccagtgtttattacttgcatctttgcgcccgaatcgccgtggtggttgactcgacacggtaaacacgatcaggcgaacaagtcgctcgacaggctgctcaacaagcaagggttgtcggcttcggaagcgcaagaactcgtcaaggactaccaagccatgattcaatacacggaggccatggagcagatcaacgaaaacgaacagaccaaccaaaagacgaaccgctacatcgactgcttcaagggcgtcgatttgcgccgtaccgagatcgcctgctgggcgtggctgattcagatcacgtctggtgcgccacttcaaggattttccacctactttttcagtcaagcgggcctttcgacagtcaacgccttcaacatgtcgatggccatgtatgcgctcggtgcggtgggaacgatcagctcttggttcttggtcaaccgcgtgggccgtcgacagatgtatctctggggattgggcgctatgtttacaaccatgctcatcaccggtatcctcggatttgttcgtcagacctccgctgtctcgtgggctgtaggcgctatgctgctgctctgcacgtttttctacgatctcactatcggaccaatctgctttgccatcatcgccgaggtctcttcgaccaggctcaggagcaagacgattgtattggcgtgcaacacgtacaacgttgcattgattgtggccaacgttcttcaaccttacatgctcaactcggacgaatggaactggggtcccaagacggggctcttctgggctggcacggcggcggtatcaatggtgtggacctacttccgcttgcccgagcttgccaacaggacttatggagagctcgacgtacttttcgctgccaaggttccggcacgcaagtttgccagcaccaccatcgatcagttccgtaccatcgagcaagaagcggcttcggtggatgtagaaaagtcgagcgtttccgaaaagtacacgactgaagacgagcagattgcgctggctgctttgtccaagtga

SEQ ID NO: 4090 - protein, 580 aa, Ustilago maydis 521
MLVDKNEVARIDVDTREKLIHKFGDRFEEVVERSARSTMWQTNSSIGETFRRWPMSVTWSILFSLAIVQIGFDSSILSSFFAQPAFTEKFGECKVAVDGSKDCEISAPWQQGLTNGAWIGGIVGLQLAGSIAERIGHLRLMMISTTLMLAFVFIPFFATSLPVFLVGQIFMGIPWGGFQSLASAYASEICPVSLRPLLTTYVNLCWVFGQLLAAGVLRGTVGRSDVWAWKIPYAVQFFWPFPVFITCIFAPESPWWLTRHGKHDQANKSLDRLLNKQGLSASEAQELVKDYQAMIQYTEAMEQINENEQTNQKTNRYIDCFKGVDLRRTEIACWAWLIQITSGAPLQGFSTYFFSQAGLSTVNAFNMSMAMYALGAVGTISSWFLVNRVGRRQMYLWGLGAMFTTMLITGILGFVRQTSAVSWAVGAMLLLCTFFYDLTIGPICFAIIAEVSSTRLRSKTIVLACNTYNVALIVANVLQPYMLNSDEWNWGPKTGLFWAGTAAVSMVWTYFRLPELANRTYGELDVLFAAKVPARKFASTTIDQFRTIEQEAASVDVEKSSVSEKYTTEDEQIALAALSK

SEQ ID NO: 4091 - DNA, 1722 bp, Ustilago maydis 521
  CDS (1)..(1722)
atgggtcttattcaaggtcaacaggtcgcacgcatcgactccaaggcagctgcggccatcgcctcaaacgtcgaggattacgatgcgctcgttcacgatgctgccgaggctacgcgctcgcaggagcagatgagcctccgcaaggcgctcaagacctacccgaacgccatctttttctcggtcatcctttcgctggccgtcgtcatggagggttacgatacgctgctgatcggcaactttttcgccatgcccgcatttgccaaaaagtacggcgtatgcgacgccacaggcaagtgcgagatcccggctccctggcagtcgggcctcacaaacggttcgcaggtgggctccatcattggtctgcagctcaccggtatcgcatcggaacgcttcggttaccgcaagaccatcctggctgcactggtcgccatgacggcgtttatctttatcccgttctttgctcctaacctcaccgtgctgctcgtcggtcagatcctccagggtcttccctggggtgtcttccagacgctcaccacctcgtacgccgccgaagtgacgccggttgctcttcgtcccttcctcaccacctgggtcaacggatgctgggtcgtcggtcaactcatcgcctcgggtgttctgcgcgccacggttaaccgcaccgatcactgggcctacaagatcccttatgcgattcagtgggtttggccggtgcccatctttatcggctgctgctttgcgcccgagtcgccctggtggctggtgcgtcagaaccgtctcgaagatgccaagcactcgctccgtcgactcgctgccaacgaccgcgagttctccgagcacgatgctgaccagaccgttcagatgatgatccacaccaacgagctcgaaaaggcagctgccgagggcggaagctactgggactgcctcaagcgcaccgatcgtcgacgtaccgagattgcctgcgtcgtctggctgattcaggtgttctgcggtggtccattgatgggtctctcttcctacttctacacaaaggcgggtctccccaccgatcaggcattcaacttgaccatcggccagttctccatgggtctcgtcggcacgctcagctcttggttcctgcttcgaaagattggtcgtcgtacgctctacctgtacggtcagctggtgctgtttgtgctcatgatcacgattggcggtctcgctttcaagtcggacaacacgggcgtctcttgggcgatcggttccatgctgctcatctttacctttatctacgacttgactgtcggtcccgtttgctactgcttggttgccgagatctcgtcgacgcgtctgcgtgcaaagacgattgtactggcacgtaacgcatacaacattggcggtatcattgccaacatcctttcgccccgcatgctcaactcgaccgagtggaactggggtgccaaggcgggcttcttctgggcaggcactggcttcctctgcatcgtatggaccttcttccgtctccccgagaccaaggaccgatcctacggtacactcgacattctctttgaacaaaaggtctcggcacgcaagtttgcctcgaccgaggtcgacatgtttgcctcgcacacccaggccgccgtcgccgcgcagaccggctcgatcgacgaaaaggccagctcgaccgacaaggtcgacaacgtcgtcgccaacacctcgggcctcggctacaagtacgaagcctaa

SEQ ID NO: 4092 - protein, 573 aa, Ustilago maydis 521
MGLIQGQQVARIDSKAAAAIASNVEDYDALVHDAAEATRSQEQMSLRKALKTYPNAIFFSVILSLAVVMEGYDTLLIGNFFAMPAFAKKYGVCDATGKCEIPAPWQSGLTNGSQVGSIIGLQLTGIASERFGYRKTILAALVAMTAFIFIPFFAPNLTVLLVGQILQGLPWGVFQTLTTSYAAEVTPVALRPFLTTWVNGCWVVGQLIASGVLRATVNRTDHWAYKIPYAIQWVWPVPIFIGCCFAPESPWWLVRQNRLEDAKHSLRRLAANDREFSEHDADQTVQMMIHTNELEKAAAEGGSYWDCLKRTDRRRTEIACVVWLIQVFCGGPLMGLSSYFYTKAGLPTDQAFNLTIGQFSMGLVGTLSSWFLLRKIGRRTLYLYGQLVLFVLMITIGGLAFKSDNTGVSWAIGSMLLIFTFIYDLTVGPVCYCLVAEISSTRLRAKTIVLARNAYNIGGIIANILSPRMLNSTEWNWGAKAGFFWAGTGFLCIVWTFFRLPETKDRSYGTLDILFEQKVSARKFASTEVDMFASHTQAAVAAQTGSIDEKASSTDKVDNVVANTSGLGYKYEA

SEQ ID NO: 4093 - DNA, 1845 bp, Saccharomyces cerevisiae
  CDS (1)..(1845)
atgaagggcttatcctcattaataaacagaaaaaaagacaggaacgactcacacttagatgagatcgagaatggcgtgaacgctaccgaattcaactcgatagagatggaggagcaaggtaagaaaagtgattttgatctttcccatcttgagtacggtccaggttcactaataccaaacgataataatgaagaagtccccgaccttctcgatgaagctatgcaggacgccaaagaggcagatgaaagtgagaggggaatgccactcatgacagctttgaagacatatccaaaagctgctgcttggtcactattagtttccacaacattgattcaagagggttatgacacagccattctaggagctttctatgccctgcctgtttttcaaaaaaaatatggttctttgaatagcaatacaggagattatgaaatttcagtttcctggcaaatcggtctatgtctatgctacatggcaggtgagattgtcggtttgcaaatgactgggccttctgtagattacatgggcaaccgttacactctgatcatggcgttgttctttttagcggctttcattttcattctgtatttttgcaagagtttgggtatgattgccgtgggacaggcattgtgtggtatgccatggggttgtttccaatgtttgaccgtttcttatgcttctgaaatttgtcctttggccctaagatactatttgacgacttattctaatttatgttgggcgttcggtcaacttttcgctgctggtattatgaaaaactcccaaaataagtaccctaactcagatctaggctataagctaccttttgctttgcagtggatctggccccttcctttggcggtaggtattttttttgcaccagagtctccatggtggctggttaaaaaaggaaggattgatcaagcgaggagatcacttgaaagaacattaagtggtaaaggacccgagaaagaattactagtgagtatggaactcgataaaatcaaaactactatagaaaaggagcagaaaatgtctgatgaaggaacttactgggattgtgtgaaagatggtattaacaggagaagaacgagaatagcttgtttatgttggatcggtcaatgctcctgtggtgcatcattaattggttattcaacttacttttatgaaaaagctggtgttagcactgatacggcttttactttcagtattatccaatattgtcttggtattgctgcaacgtttgtatcctggtgggcttcaaaatattgtggcagatttgacctttatgcttttgggctggcttttcaggctattatgttcttcattatcggtggtttaggatgttcagacactcatggcgctaaaatgggtagtggtgctcttctaatggttgtcgcgttcttttacaacctcggtattgcacctgttgttttttgcttagtgtctgaaataccgtcttcaaggctaagaaccaaaacaattattttggctcgtaatgcttacaatgtgatccaagttgtagttacagttttgatcatgtaccaattgaactcagagaaatggaattggggtgctaaatcaggctttttctggggaggattttgtctggccactttagcttgggctgttgtcgatttaccagaaaccgctggcaggacttttattgagataaatgaattgtttagacttggtgttccagcaagaaagttcaagtcgactaaagtcgacccttttgcagctgccaaagcagcagctgcagaaattaatgttaaagatccgaaggaagatttggaaacttctgtggtagatgaagggcgaagcaccccatctgttgtgaacaaatga

SEQ ID NO: 4094 - protein, 614 aa, Saccharomyces cerevisiae
MKGLSSLINRKKDRNDSHLDEIENGVNATEFNSIEMEEQGKKSDFDLSHLEYGPGSLIPNDNNEEVPDLLDEAMQDAKEADESERGMPLMTALKTYPKAAAWSLLVSTTLIQEGYDTAILGAFYALPVFQKKYGSLNSNTGDYEISVSWQIGLCLCYMAGEIVGLQMTGPSVDYMGNRYTLIMALFFLAAFIFILYFCKSLGMIAVGQALCGMPWGCFQCLTVSYASEICPLALRYYLTTYSNLCWAFGQLFAAGIMKNSQNKYPNSDLGYKLPFALQWIWPLPLAVGIFFAPESPWWLVKKGRIDQARRSLERTLSGKGPEKELLVSMELDKIKTTIEKEQKMSDEGTYWDCVKDGINRRRTRIACLCWIGQCSCGASLIGYSTYFYEKAGVSTDTAFTFSIIQYCLGIAATFVSWWASKYCGRFDLYAFGLAFQAIMFFIIGGLGCSDTHGAKMGSGALLMVVAFFYNLGIAPVVFCLVSEIPSSRLRTKTIILARNAYNVIQVVVTVLIMYQLNSEKWNWGAKSGFFWGGFCLATLAWAVVDLPETAGRTFIEINELFRLGVPARKFKSTKVDPFAAAKAAAAEINVKDPKEDLETSVVDEGRSTPSVVNK

SEQ ID NO: 4095 - DNA, 1596 bp, Aspergillus oryzae
  CDS (1)..(1596)
atgactaccccagacgccattgaagccaacgatggtgcccagcgaaagtcctcgctggtgcaaggcaaacgtgccgctcagcaagagcagtctatgaccctatggcaggcgattcgtttgtatcccaaggccgttgggtggtcggttctactttcctcgaccctcatcatggaaggctacgatctagccctactgagctccatgtatgcctcaccggcattcaatcagaagttcgggaggcaagccagtgacggtaaatggaccgtcccagcgtcctggcagtcggctctatccaacggagcccgagttggcgaggtaattggtcttttgatcaatggtctcgtctcagaacgactcggctaccgctggaccatggtctctgcattaacagccatgatcggtgtgatctttctgttcttcttcgctgtcaacgtccaaatgttactcgcagcagagatcctcgccggtattccatggggtgtgttccagactctacccgcagcgtatgcgtcggaggtctgtcccgtggtgctgcgaccatacctaaccaccttcatcaatatgtgctgggtcttcggccagttcgtcgccgtcggtgtaaaccgtggctcaatccaaagagacgaccaatgggcctggcgtatcccatttgcagtacaatgggcatggccgctccctattctaataggctgcctcttcgctccagaatcaccctggtggcacgtccgtcgcggaaatctatccggtgccaaacgtgctctgctccgactaacctccagcgacccagcctttgaccccgatgccacaattgccatgattcagcacacaaatgaactcgagatgtctgcgacaaagggaacgagatacagagattgtttccagggcgtcaacctacggcgaacagaagtcgtttgcggtgtctggctagtccaaaccctctgcggccaaaacctcatgggctacttcgcctacttctgcgtacaagccggcctccccaccgtccgctccttcgacctctccctagtccaatacgccctcggcgtcataggaaccctaggctcctggtacctaatgacgatagcaggccgtcgaaccctccacctcgcaggcttaactagtctctttacccttcttataataacagggagtctttcctttgcaccagactccaacagtggcgcaaaatgggccatcggcgtcatgcttatcatattcactttctgctacgacttcactattgggcccgtaacatactgtctcgtctcggaattgtcatcaacaaggctcaaggccaagacaatcgtcctagcaagagcaggttacaatatcagcaacatcgttgtcaacgtcttgacaaactatcaactgaatgacacggcctggaactggagctcaaggagtgcgtatttctgggccggaacttgtttagtctgtctggtctggtcgttctttagaatgcctgaacctaagggccgaacgtatgaggagctagatgtgctttttgagcagagggtttctgcacgcaaatttgcggatacggttgtggacccttatgcagatgctgttgaggttagggttgattctgctaaggagtag

SEQ ID NO: 4096 - protein, 531 aa, Aspergillus oryzae
MTTPDAIEANDGAQRKSSLVQGKRAAQQEQSMTLWQAIRLYPKAVGWSVLLSSTLIMEGYDLALLSSMYASPAFNQKFGRQASDGKWTVPASWQSALSNGARVGEVIGLLINGLVSERLGYRWTMVSALTAMIGVIFLFFFAVNVQMLLAAEILAGIPWGVFQTLPAAYASEVCPVVLRPYLTTFINMCWVFGQFVAVGVNRGSIQRDDQWAWRIPFAVQWAWPLPILIGCLFAPESPWWHVRRGNLSGAKRALLRLTSSDPAFDPDATIAMIQHTNELEMSATKGTRYRDCFQGVNLRRTEVVCGVWLVQTLCGQNLMGYFAYFCVQAGLPTVRSFDLSLVQYALGVIGTLGSWYLMTIAGRRTLHLAGLTSLFTLLIITGSLSFAPDSNSGAKWAIGVMLIIFTFCYDFTIGPVTYCLVSELSSTRLKAKTIVLARAGYNISNIVVNVLTNYQLNDTAWNWSSRSAYFWAGTCLVCLVWSFFRMPEPKGRTYEELDVLFEQRVSARKFADTVVDPYADAVEVRVDSAKE

SEQ ID NO: 4097 - DNA, 2209 bp, Pichia angusta
  CDS (23)..(1771)
cgacacactagtgtccatcatcatgcctgagttcgtcgaaaacatcgagaagcctgaagaagctgaagtcattccagacatcacaaagaaaattaacacactctctgacagtgatgatggaagtggtgctttcaacgattacatcgccagattcgtcgagatttcgacaaatgcccaaaataatgagcaccaagaaaagcacatgtcgctgaaggaaggtctgaaaactttcccaaaagctgcctgctggtcgattgtgctttccacagccatcatcatggaaggatacgataccacgctcctgaacagtctgtactcaatgcaatctttcgccaaaaagtacggcaagtactacccagaaattgaccagtaccaggtccctgccaagtggcagacatcgctttcgatgtcgacttatgtcggtgaaattgtcggactgtacattgcaggtcttgttgccgagaaatggggatacaggcgtacgttaatatcgttcatggcagccgttgtgggtttaatcttcattcttttctttgcggtcgacgtgcagatgctgcttgccggcgagctgctctgtggtattgtctggggtgcattccagaccctcacagtgtcatacgcctcggaagtgtgtccagtagttctgagaatctaccttaccacttatgtcaatgcttgctgggttatcggacagttgattgctgcttgtttgctgagaggcactatgaccctgaccagcgagtggtcatacaagattcctttcgctgtccagtggatctggcctgtgccaatcatgattggaatctacctggccccggagtcgccctggtggctggttaaaaagaaccgagacgcagaagctaagaaaagtatcacaaggcttttgagtccaaacaccgaggtgccagatgttgctccgctagccgaggcaatgctgaataaaatgcaactaaccatcaaggaagagtctgcgcgcacgtccaatgtctcgtactttgactgcttcaaacacgggaacttcagaagaacaaggattgccgccatgatctggctcatccagaatatcactggatctgtcttgatgggctattcgacctacttttacatccaggcaggacttgacagcagtatgtctttcactttctctatcatccaatatgcactcggtcttcttggaacacttgcctcgtggctcctctcgcaaaaattgggccgttttgacatctacttcttgggtctgagcataaacacgtgcattctgataattgtcggaggtttgggcttttcttcgtcgacgagtgcgtcttgggcaattggctcgctgctccttgtcttcacttttgtctacgactcgtccatcggtcccatcacctactgcacggttgcagaaatcccttcgtcgacggtgcgtgccaagaccgttgcccttgcaagaaactggtacaatctgtctcaaattccgctctccattgtcactccgtacatgctgaacccgactgcttggaactggaaagcaaaagcggcccttttatgggcaggcttgtctatttgctcactgatctacatctggtttgaattcccagaaacaaaaggaagaacttatgctgaactggacatcctcttcaaaaacggtaccagtgcccgtaaatttaggtccactcaggtggaaacattcaatcctcaggaaatgttaaaaaaaatgaataatgaggatattatacaggttgttgatggcgacctggacgccggtgcggccactgctaaagtttaaaaatgaaatgtatagtttcagttctgcgatgttattactttacaattgaatatgtttcctcgactaatcttttgtaatggccgtagatgtctttattattgcgttttaagggatcaaaattattttatgtgcaccttttattttgcggatcaataagattttgcgcgagacttccccacatgttaaatgcaaataatgtgcaatatttttaactacattttctcgagacatttttatgcctctcggtacacgtgcaaaaccccaaacgcctggccataaatcccattccaaaaggccgtatatcaggccttgtgacgcgtgcgcgttcaaacgagtacgttgcgacgctgagttcaaattggatcgcagatgcaccaactgtttagttaatggaattgagtgtacaaacaacagagtaaagcagagatctggacccag

SEQ ID NO: 4098 - protein, 582 aa, Pichia angusta
MPEFVENIEKPEEAEVIPDITKKINTLSDSDDGSGAFNDYIARFVEISTNAQNNEHQEKHMSLKEGLKTFPKAACWSIVLSTAIIMEGYDTTLLNSLYSMQSFAKKYGKYYPEIDQYQVPAKWQTSLSMSTYVGEIVGLYIAGLVAEKWGYRRTLISFMAAVVGLIFILFFAVDVQMLLAGELLCGIVWGAFQTLTVSYASEVCPVVLRIYLTTYVNACWVIGQLIAACLLRGTMTLTSEWSYKIPFAVQWIWPVPIMIGIYLAPESPWWLVKKNRDAEAKKSITRLLSPNTEVPDVAPLAEAMLNKMQLTIKEESARTSNVSYFDCFKHGNFRRTRIAAMIWLIQNITGSVLMGYSTYFYIQAGLDSSMSFTFSIIQYALGLLGTLASWLLSQKLGRFDIYFLGLSINTCILIIVGGLGFSSSTSASWAIGSLLLVFTFVYDSSIGPITYCTVAEIPSSTVRAKTVALARNWYNLSQIPLSIVTPYMLNPTAWNWKAKAALLWAGLSICSLIYIWFEFPETKGRTYAELDILFKNGTSARKFRSTQVETFNPQEMLKKMNNEDIIQVVDGDLDAGAATAKV

SEQ ID NO: 4099 - DNA, 2708 bp, Saccharomyces cerevisiae
  CDS (838)..(2682)
cttaaaccccgtgtttagcgaaattttcaacgaagcgcgcaataaggagaaatattatataaaagcgagagtttaagcgaggttgcaagaatctctacggtacagatgcaacttactatagccaaggtctattcgtattggtatccaagcagtgaagctactcaggggaaaacatattttcagagatcaaaattacgtcagtctctttttcatgtgtaacttaacgtttgtgcaggtatctctacggtacagatgcaacttacaatagccaaggtctattcgtattggtatccaagcagtgaagctactcaggggaaaacatattttcagagatcaaaattacgtcagtctctttttcatgtgtaacttaacgtttgtgcaggtatctctacggtacagatgcaacttacaatagccaaggtctattcgtattggtatccaagcagtgaagctactcaggggaaaacatattttcagagatcaaagttatgtcagtctctttttcatgtgtaacttaacgtttgtgcaggtatcataccggcctctacataatttttgtggggaagacgttgttgtagcagtctccttatactctccaacaggtacttaaagacttcttcaggcctcatagtctacatctggagacaacattagatagaagtttccacagaggcagctttcaatatactttcggctgtgtacatttcatcctgagtgagcgcatattgcataagtactcagtatataaagagacacaatatactccatacttgttgtgagtggttttagcgtattcagtataacaataagaattacatccaagactattaattaactatgaagggattatcctcattaataaacagaaaaaaagacaggaacgactcacacttagatgagatcgagaatggcgtgaacgctaccgaattcaactcggtagagatggaggagcaaggtaagaaaagtgattttgatctttcccatcatgagtacggtccaggttcactaacaccaaacgataataatgaagaagtccccgaccttctcgatgaagctatgcaggacgccaaagaggcagatgaaagtgagaggggaatgccactcatgacagctttgaagacatatccaaaagctgctgcttggtcactattagtttccacaacattgattcaagagggttatgacacagccattctaggatctttctatgccctgcctgtttttcaaaaaaaatatggttctttgaatagcaatacaggagattatgaaatttcagtttcctggcaaatcggtctatgtctatgctacatggcaggtgagattgtcggtttgcaaatgactggaccttctgtagattacatgggcaaccgttacactctgatcatggcgttgttctttttagcggctttcattttcattctgtatttttgcaagagtttgggtatgattgccgtgggacaggcattgtgtggtatgccatggggttgtttccaatgtttggccgtttcttatgcttctgaaatttgtcctatggccctaagatactatttgacgacttattctaatttatgttgggcgttcggtcaacttttcgctgctggtattatgaaaaattcccagaacaaatatgccaactcagaactaggatataagctaccttttgctttgcagtggatctggccccttcctttggcggtaggtattttttttgcaccagagtctccatggtggctggttaaaaaaggaaggattgatcaagcgaggagatcacttgaaagaacattaagtggtaaaggacccgagaaagaattactagtgagtatggaactcgataaaatcaaaactactatagaaaaggagcagaaaatgtctgatgaaggaacttactgggattgtgtgaaagatggtattaacaggagaagaacgagaatagcttgtttatgttggatcggtcaaaccacctgtggtgcatcattaattggttattcaacttacttttatgaaaaagctggtgttagcactgatacggcttttactttcagtattatccaatattgtcttggtattgctgcaacgtttgtatcctggtgggcttcaaaatattgtggcagatttgacctttatgcttttgggctggcttttcaggctattatgttcttcattatcggtggtttaggatgttcagacactcatggcgctaaaatgggtagtggtgctcttctaatggttgtcgcgttcttttacaacctcgctattgcacctgttgttttttgcttagtgtctgaaatgccgtcttcaaggctaagaaccaaaacaattattttggctcgtaatgcttacaatgtgatccaaattgtagttacagttttgatcatgtatcaattgaactcagagaaatggaattggggtgctaaatcaggctttttctggggaggattttgtctggccactttagcttgggctgttgtcgatttaccagaaaccgctggcaggacttttattgagataaatgaattgtttagacttggtgttccagcaagaaagttcaagtcgactaaagtcgacccttttgcagctgccaaagcagcagctgcagaaattaatgttaaagatccgaaggaagatttggaaacttctgtggtagatgaagggcgaagcaccccatctgttgtgaacaaatgatttttttagccagtaggtagatacgg

SEQ ID NO: 4100 - protein, 614 aa, Saccharomyces cerevisiae
MKGLSSLINRKKDRNDSHLDEIENGVNATEFNSVEMEEQGKKSDFDLSHHEYGPGSLTPNDNNEEVPDLLDEAMQDAKEADESERGMPLMTALKTYPKAAAWSLLVSTTLIQEGYDTAILGSFYALPVFQKKYGSLNSNTGDYEISVSWQIGLCLCYMAGEIVGLQMTGPSVDYMGNRYTLIMALFFLAAFIFILYFCKSLGMIAVGQALCGMPWGCFQCLAVSYASEICPMALRYYLTTYSNLCWAFGQLFAAGIMKNSQNKYANSELGYKLPFALQWIWPLPLAVGIFFAPESPWWLVKKGRIDQARRSLERTLSGKGPEKELLVSMELDKIKTTIEKEQKMSDEGTYWDCVKDGINRRRTRIACLCWIGQTTCGASLIGYSTYFYEKAGVSTDTAFTFSIIQYCLGIAATFVSWWASKYCGRFDLYAFGLAFQAIMFFIIGGLGCSDTHGAKMGSGALLMVVAFFYNLAIAPVVFCLVSEMPSSRLRTKTIILARNAYNVIQIVVTVLIMYQLNSEKWNWGAKSGFFWGGFCLATLAWAVVDLPETAGRTFIEINELFRLGVPARKFKSTKVDPFAAAKAAAAEINVKDPKEDLETSVVDEGRSTPSVVNK

SEQ ID NO: 4101 - DNA, 2708 bp, Saccharomyces cerevisiae
  CDS (838)..(2682)
cttaaaccccgtgtttagcgaaattttcaacgaagcgcgcaataaggagaaatattatgtaaaagcgagagtttaagcgaggttgcaagaatctctacggtacagatgcaacttactatagccaaggtctattcgtattggtatccaagcagtgaagctactcaggggaaaacatattttcagagatcaaagttatgtcagtctctttttcatgtgtaacttaacgtttgtgcaggtatctctacggtacagatgcaacttacaatagccaaggtctattcgtattggtatccaagcagtgaagctactcaggggaaaacatattttcagagatcaaaattacgtcagtctctttttcatgtgtaacttaacgtttgtgcaggtatctctacggtacagatgcaacttacaatagccaaggtctattcgtattggtatccaagcagtgaagctactcaggggaaaacatattttcagagatcaaagttatgtcagtctctttttcatgtgtaacttaacgtttgtgcaggtatcataccggcctccacataatttttgtggggaagacgttgttgtagcagtctccttatactctccaacaggtacttaaagacttcttcaggcctcatagtctacatctggagacaacattagatagaagtttccacagaggcagctttcaatatactttcggctgtgtacatttcatcctgagtgagcgcatattgcataagtactcagtatataaagagacacaatatactccatacttgttgtgagtggttttagcgtattcagtataacaataagaattacatccaagactattaattaactatgaagggattatcctcattaataaacagaaaaaaagacaggaacgactcacacttagatgagatcgagaatggcgtgaacgctaccgaattcaactcggtagagatggaggagcaaggtaagaaaagtgattttgatctttcccatcatgagtacggtccaggttcactaacaccaaacgataataatgaagaagtccccgaccttctcgatgaagctatgcaggacgccaaagaggcagatgaaagtgagaggggaatgccactcatgacagctttgaagacatatccaaaagctgctgcttggtcactattagtttccacaacattgattcaagagggttatgacacagccattctaggatctttctatgccctgcctgtttttcaaaaaaaatatggttctttgaatagcaatacaggagattatgaaatttcagtttcctggcaaatcggtctatgtctatgctacatggcaggtgagattgtcggtttgcaaatgactgggccttctgtagattacatgggcaaccgttacactctgatcatggcgttgttctttttagcggctttcattttcattctgtatttttgcaagagtttgggtatgattgccgtgggacaggcattgtgtggtatgccatggggttgtttccaatgtttggccgtttcttatgcttctgaaatttgtcctatggccccaagatactatttgacgacttattctaatttatgttgggcgttcggtcaacttttcgctgctggtattatgaaaaattcccagaacaaatatgccaactcagaactaggatataagctaccttttgctttgcagtggatctggccccttcctttggcggtaggtattttttttgcaccagagtctccatggtggctggttaaaaaaggaaggattgatcaagcgaggagatcacttgaaagaacattaagtggtaaaggacccgagaaagaattactagtgagtatggaactcgataaaatcaaaactactatagaaaaggagcagaaaatgtctgatgaaggaacttactgggattgtgtgaaagatggtattaacaggagaagaacgagaatagcttgtttatgttggatcggtcaaaccacctgtggtgcatcattaattggttattcaacttacttttatgaaaaagctggtgttagcactgatacggcttttactttcagtattatccaatattgtcttggtattgctgcaacgtttgtatcctggtgggcttcaaaatattgtggcagatttgacctttatgcttttgggctggcttttcaggctattatgttcttcattatcggtggtttaggatgttcagacactcatggtgctaaaatgggtagtggtgctcttctaatggttgtcgcgttcttttacaacctcggtattgcacctgttgttttttgcttagtgtctgaaatgccgtcttcaaggctaagaaccaaaacaattattttggctcgtaatgcttacaatgtgatccaagttgtagttacagttttgatcatgtaccaattgaactcagagaaatggaattggggtgctaaatcaggctttttctggggaggattttgtctggccactttagcttgggctgttgtcgatttaccagaaaccgctggcaggacttttattgagataaatgaattgtttagacttggtgttccagcaagaaagttcaagtcgactaaagtcgacccttttgcagctgccaaagcagcagctgcagaaattaatgttaaagatccgaaggaagatttggaaacttctgtggtagatgaagggcgaagcacctcatctgttgtgaacaaatgatttttttagccagtaggtagatacgg

SEQ ID NO: 4102 - protein, 614 aa, Saccharomyces cerevisiae
MKGLSSLINRKKDRNDSHLDEIENGVNATEFNSVEMEEQGKKSDFDLSHHEYGPGSLTPNDNNEEVPDLLDEAMQDAKEADESERGMPLMTALKTYPKAAAWSLLVSTTLIQEGYDTAILGSFYALPVFQKKYGSLNSNTGDYEISVSWQIGLCLCYMAGEIVGLQMTGPSVDYMGNRYTLIMALFFLAAFIFILYFCKSLGMIAVGQALCGMPWGCFQCLAVSYASEICPMAPRYYLTTYSNLCWAFGQLFAAGIMKNSQNKYANSELGYKLPFALQWIWPLPLAVGIFFAPESPWWLVKKGRIDQARRSLERTLSGKGPEKELLVSMELDKIKTTIEKEQKMSDEGTYWDCVKDGINRRRTRIACLCWIGQTTCGASLIGYSTYFYEKAGVSTDTAFTFSIIQYCLGIAATFVSWWASKYCGRFDLYAFGLAFQAIMFFIIGGLGCSDTHGAKMGSGALLMVVAFFYNLGIAPVVFCLVSEMPSSRLRTKTIILARNAYNVIQVVVTVLIMYQLNSEKWNWGAKSGFFWGGFCLATLAWAVVDLPETAGRTFIEINELFRLGVPARKFKSTKVDPFAAAKAAAAEINVKDPKEDLETSVVDEGRSTSSVVNK

SEQ ID NO: 4103 - DNA, 2414 bp, Saccharomyces cerevisiae
  CDS (544)..(2388)
cttaaaccccgtgtttagcgaaattttcaacgaagcgcgcaataaggagaaatattatgtaaaagcgagagtttaagcgaggttgcaagaatctctacggtacagatgcaacttactatagccaaggtctattcgtattggtatccaagcagtgaagctactcaggggaaaacatattttcagagatcaaagttatgtcagtctctttttcatgtgtaacttaacgtttgtgcaggtatcataccggcctctacataatttttgtggggaagacgttgttgtagcagtctccttatactctccaacaggtgcttaaagacttcttcaggcctcatagtctacatctggagacaacattagatagaagtttccgcagaggcagctttcaatatactttcggctgtgtacatttcatcctgagtgagcgcatattgcataagtactcagtatataaagagacacaatatactccatacttgttgtgagtggttttagcgtattcagtataacaataagaattacatccaagactattaattaactatgaagggattatcctcattaataaacagaaaaaaagacaggaacgactcacacttagatgagatcgagaatggcgtgaacgctaccgaattcaactcgatagagatggaggagcaaggtaagaaaagtgattttgatctttcccatcatgagtacggtccaggttcactaataccaaacgataataatgaagaagtccccgaccttctcgatgaagctatgcaggacgccaaagaggcagatgaaagtgagaggggaatgccactcatgacagctttgaagacatatccaaaagctgctgcttggtcactattagtttccacaacattgattcaagagggttatgacacagccattctaggatctttctatgccctgcctgtttttcaaaaaaaatatggttctttgaatagcaatacaggagattatgaaatttcagcttcctggcaaatcggtctatctctatgctacatggcaggtgagattgtcggtttgcaaataactgggccttctgtagattacatgggcaaccgttacactctgatcatggcgttgttctttttagcggctttcattttcattctgtatttttgcaagagtttgggtatgattgccgcgggacaggcattgtgtggtatgccatggggttgtttccaatgtttgaccgtttcttatgcttctgaaatttgtcctttggccctaagatactatttgacgacttattctaatttatgttggacgttcggtcaacttttcgctgctggtattatgaaaaattcccagaacaaatatgtcaactcagaactaggatataagctaccttttgctttgcagtggatctggccccttcctttggcggtaggtattttttttgcaccagagtctccatggtggctggttaaaaaaggaaggattgatcaagcgaggagatcacttgaaagaacattaagtggtaaaggacccgagaaagaattactagtgactatggaactcaataaaatcaaaactactatagaaaaggagcagaaaatgtctgatgaaggaacttactgggattgtgtgaaagatggtattaacaggagaagaacgagaatagcttgtttatgttggatcggtcaatgctcctgtggtgcatcattaattggttattcaacttacttttatgaaaaagctggtgttagcactgatacggcttttactttcagtattatccaatattgtcttggtattgctgcaacgtttgtatcctggtgggcttcaaaatattgtggcagatttgacctttatgcttttgggctggcttttcaggctattatgttcttcattatcggtggtttaggatgttcagacactcatggcgctaaaatgggtagtggtgctcttctaatggttgtcgcgttcttttacaacctcggtattgcacctgttgttttttgcttagtgtctgaaatgccgtcttcaaggctaagaaccaaaacaattattttggctcgtaatgcttacaatgtgatccaaattgtagttacagttttgatcatgtatcaattgaactcagagaaatggaattggggtgctaaatcaggctttttctggggaggattttgtctggccactttagcttgggctgttgtcgatttaccagaaaccgctggcaggacttttattgagataaatgaattgtttagacttggtgttccagcaagaaagttcaagtcgactaaagtcgacccttttgcagctgccaaagcagcagctgcagaaattaatgttaaagatccgaaggaagatttggaaacttctgtggtagatgaagggcgaagcacctcatctgttgtgaacaaatgatttttttagccagtaggtagatacgg

SEQ ID NO: 4104 - protein, 614 aa, Saccharomyces cerevisiae
MKGLSSLINRKKDRNDSHLDEIENGVNATEFNSIEMEEQGKKSDFDLSHHEYGPGSLIPNDNNEEVPDLLDEAMQDAKEADESERGMPLMTALKTYPKAAAWSLLVSTTLIQEGYDTAILGSFYALPVFQKKYGSLNSNTGDYEISASWQIGLSLCYMAGEIVGLQITGPSVDYMGNRYTLIMALFFLAAFIFILYFCKSLGMIAAGQALCGMPWGCFQCLTVSYASEICPLALRYYLTTYSNLCWTFGQLFAAGIMKNSQNKYVNSELGYKLPFALQWIWPLPLAVGIFFAPESPWWLVKKGRIDQARRSLERTLSGKGPEKELLVTMELNKIKTTIEKEQKMSDEGTYWDCVKDGINRRRTRIACLCWIGQCSCGASLIGYSTYFYEKAGVSTDTAFTFSIIQYCLGIAATFVSWWASKYCGRFDLYAFGLAFQAIMFFIIGGLGCSDTHGAKMGSGALLMVVAFFYNLGIAPVVFCLVSEMPSSRLRTKTIILARNAYNVIQIVVTVLIMYQLNSEKWNWGAKSGFFWGGFCLATLAWAVVDLPETAGRTFIEINELFRLGVPARKFKSTKVDPFAAAKAAAAEINVKDPKEDLETSVVDEGRSTSSVVNK

SEQ ID NO: 4105 - DNA, 1851 bp, Saccharomyces cerevisiae
  CDS (1)..(1851)
atgaaaaatatcatttcattggtaagcaagaagaaggctgcctcaaaaaatgaggataaaaacatttctgagtcttcaagagatattgtaaaccaacaggaggttttcaatactgaaaattttgaagaagggagaaaggatagtgcctttgagctagaccacttagagttcaccaccaattcagcccagttaggagattctgacgaagataacgagaatgtgattaatgagacgaacactactgatgatgcaaatgaagctaacagcgaggaaaaaagcatgactttaaagcaggcgttgctaatatatccaaaagcagccctgtggtccatattagtgtctactaccctggttatggaaggttatgataccgcactactgaacgcactgtatgccctgccagtttttcagagaaaattcggtactttgaacggggagggttcttacgaaattacttcccaatggcagattggtttaaacatgtgtgtccaatgtggtgagataattggtttgcaaatcacgccttatatggttgaatttatggggaatcgttatacgatgattacagcacttggtttgttaactgcttatgtctttatcctctactactgtaaaagtttagctatgattgctgtgggacaagttctctcagctatgccatggggttgtttccagggtttgactgttacttatgcttcggaagtttgccctttagcattaagatattatatgaccagttactccaacatttgttggttatttggtcaaatcttcgcctctggtattatgaaaaactcacaagagaatttagggaactctgacttgggctataaattgccatttgctttacaatggatttggcctgctcctttaatgatcggtatctttttcgctcctgagtcgccctggtggttggtgagaaaggatagggtcgctgaggcaagaaaatctttaagcagaattttgagtggtaaaggcgccgagaaggacattcaaattgatcttactttaaagcagattgaattgactattgaaaaagaaagacttttagcatctaaatcaggatcattctttgattgtttcaagggagttaatggaagaagaacgagacttgcatgtttaacttgggtagctcaaaatactagcggtgcctgtttacttggttactcgacatatttttttgaaagagcaggtatggccaccgacaaggcgtttactttttctgtaattcagtactgtcttgggttagcgggtacactttgctcctgggtaatatctggccgtgttggtagatggacaatactgacctatggtcttgcatttcaaatggtctgcttatttgttattggtggaatgggttttggttctggaagcggcgctagtaatggtgccggtggtttattgctggctttatcattcttttacaatgctggtatcggtgcagttgtttactgtatcgtaactgaaattccatcagcggagttgagaactaagactatagtgctggcccgtatttgctacaatctcatggccgttatcaacgctatattaacgccctatatgctaaacgtgagcgattggaactggggtgccaaaactggtctatactggggtggtttcacagcagtcactttagcttgggccatcatcgatctgcctgagacaactggtagaaccttcagtgaaattaatgaacttttcaaccaaggggttcctgccagaaaatttgcatctactgtggttgatccattcggaaagggaaaaactcaacatgattcgctagctgatgagagtatcagtcagtcctcaagcataaaacagcgagaattaaatgcagctgataaatgttaa

SEQ ID NO: 4106 - protein, 616 aa, Saccharomyces cerevisiae
MKNIISLVSKKKAASKNEDKNISESSRDIVNQQEVFNTENFEEGRKDSAFELDHLEFTTNSAQLGDSDEDNENVINETNTTDDANEANSEEKSMTLKQALLIYPKAALWSILVSTTLVMEGYDTALLNALYALPVFQRKFGTLNGEGSYEITSQWQIGLNMCVQCGEIIGLQITPYMVEFMGNRYTMITALGLLTAYVFILYYCKSLAMIAVGQVLSAMPWGCFQGLTVTYASEVCPLALRYYMTSYSNICWLFGQIFASGIMKNSQENLGNSDLGYKLPFALQWIWPAPLMIGIFFAPESPWWLVRKDRVAEARKSLSRILSGKGAEKDIQIDLTLKQIELTIEKERLLASKSGSFFDCFKGVNGRRTRLACLTWVAQNTSGACLLGYSTYFFERAGMATDKAFTFSVIQYCLGLAGTLCSWVISGRVGRWTILTYGLAFQMVCLFVIGGMGFGSGSGASNGAGGLLLALSFFYNAGIGAVVYCIVTEIPSAELRTKTIVLARICYNLMAVINAILTPYMLNVSDWNWGAKTGLYWGGFTAVTLAWAIIDLPETTGRTFSEINELFNQGVPARKFASTVVDPFGKGKTQHDSLADESISQSSSIKQRELNAADKC

SEQ ID NO: 4107 - DNA, 3183 bp, Torulaspora delbrueckii
  CDS (1207)..(3090)
tagattccttgaaccattcgtgttcactggaacaatggttgataactaaatccgtaataaatttcatacccatttcatgggtcttttcaatcaatttgaagcaatcttcattggtgccataagtaggccaaaccttctcatagttagcaatatcgtaacccatatcatcctgtggagaatcgtagaaaggggaaatccaaatggcatcgattccaagatcttttaggtactccaactttgaggcaatacctttcatatcaccccaaccatcattattcgagtccttgaaactagctgggtagatctgataaacgctagcttctttccaccactttggtagagtttctggatggtttataacttcgggcatactctgtttgtttcctaagagtctggtatggaacttgttgttagttggaaagatcaaagcatcctagaccaactttatatatttgaaaatatcattattctcctgaattcttcttgactaaacggtggttaattcgcgagcatcttcatctccatctcatgttactactggtaaaagaaacatcgtcagaccattcttaagctcgacgtaagactccacagacaacaccggaaaaggaaagaagatctatatggctcgagggggcaaaacgttcgaacgacttcagcttttgcttacgcaacaaatctcgagatctctaaggttgcctcttctataaaaattactctttagagtaacagggtcgttcaatgtggggcgagcatttagacttcctcggtttttattgtgcggccgagctagaaacttgaagcgctgagagctcgaacgtggggaagaccagcaaaatcgcggggtgagttaagctattcaacagttgactacacatacgaacggtcgtcttacgctttcgataggttcgtcaagattcgtgtccgtactttgaccagtttggaaaaattctttgaatgtaggggatggtgtgatgcaaccaaagttgggtccatcttcaacaaaaggatatgtcctaagtttacgatcctcattcaatgatccgatcggcatgggcgtttgaaggattagtttagaatcttttatttttcaatttctttttataggtgtatatataagcctgccagtaatcaaagctgattgaatatcgtgtagattattctctttattttgtttgttaatattcttaacggcagccatttatcagaatgaaaagcctcgcacaaatagttaataggaagaacaaaaaaaatctggaggagccggacattgtccgtgctggcgtctctagtggcagccggctgagcttgaataggtctaattttgaactggaggatactgataagaagaaagcgagcgatgctttggaattggaccacttggagtttacttctgacgttgcacagattaacgaagaggaggaccaaaatgaccatgcccttggtgttatcaatgcggctgatgatgcgcaagaggccaatgaggaagaaaagaaaatgactctggtgcaggcgttgaaggcatatccaaaggcagccgcttggtctgtgctggtttcgacgactttggttatggaaggttacgatacctcgctgctaaatgctcttttcgctttgcctgttttccaagagaaatttggctcaataagtaagactggggagtacgaaatttcatctcaatggcagatcggacttaacatgtgtatttttgtcggggaaataataggtttgcaaatgacaggttttctggtggaatggtttggtaaccgttggacaatgattggagctttgggtttattgacagcttatatctttctcctgtacttctgcaaaagtttagcgatgatcgctgtggcccaaattttgtcagctatgccttggggttgttttcaaagtttggctgtcacttatgcctctgaagtttgtcctttgacattgagatattaccttactacctactcaaatatgtgttggctatttggccagattttttccgcaggtatcatgaaaaactcccagtccaaccttggaaattcagacttaggttataagatgccttttgcgctacaatggatttggcctgcacctttagcgctaggaatatacttggctcctgagtccccatggtacttggtaaggaaaagcaaattcgcagaagccaaaaaatctttgaacagaatcttgagtggaagtggcccacaaaaggaaattcaagtggatctaaacttaaaacagattgaactgaccatcgaaaaggaaaggaagcttaagcaaaagaagggctcattctgggactgttttaaaggagttgatggacgaagaacaaggattacctgtcttacttgggtgtctcaaaatacaagtggctctgcattattaggttactccacgtatttcttcgagagagcaggtatggatacttccaatgcatttactttctctattatctcttatctccttgggctagttggcactatgacatcatggattatttcgggacgtttaggtagatggcaaatcttggctggcggcctgtgttttcaaatgcttgttcttttcgtcattggcggtctaggcttttccgacagtccaggtgcaagtaacggggctggtggattattgttagctttgtccttcttttccaatgtgggaatcggttcagtttgttactgtattgttgccgaaatgccatcggctgaattgagaactcagaccatcgttcttgcacgtaactgttacaacttgatggctattgtaaatgcaatcttaacaccctatatgttgaacactggtgattggaattggggtgccaagacaggtctatattggggtggtatgacagctctgactctagcctgggttataattgatctgcctgagactgctgggagaacttttagtgaaattaatgagcttttcgctaggggagttccagcgagaaaatttaaatcaactgtagtcgatcctttcgcaaaaggaaggattgcagacgatattgcagaagatgacctagatgctgaagtcacaagtgtattccgtgaggacgacgttgagttgggtagcgcctgcgatccaggcaagacgtcattatgatttatagacttctaagtggcgagctaagtctccgatccaagatattcagaaattaaatttttgtactctctattaaagcaacgatgatcaatt

SEQ ID NO: 4108 - protein, 627 aa, Torulaspora delbrueckii
MKSLAQIVNRKNKKNLEEPDIVRAGVSSGSRLSLNRSNFELEDTDKKKASDALELDHLEFTSDVAQINEEEDQNDHALGVINAADDAQEANEEEKKMTLVQALKAYPKAAAWSVLVSTTLVMEGYDTSLLNALFALPVFQEKFGSISKTGEYEISSQWQIGLNMCIFVGEIIGLQMTGFLVEWFGNRWTMIGALGLLTAYIFLLYFCKSLAMIAVAQILSAMPWGCFQSLAVTYASEVCPLTLRYYLTTYSNMCWLFGQIFSAGIMKNSQSNLGNSDLGYKMPFALQWIWPAPLALGIYLAPESPWYLVRKSKFAEAKKSLNRILSGSGPQKEIQVDLNLKQIELTIEKERKLKQKKGSFWDCFKGVDGRRTRITCLTWVSQNTSGSALLGYSTYFFERAGMDTSNAFTFSIISYLLGLVGTMTSWIISGRLGRWQILAGGLCFQMLVLFVIGGLGFSDSPGASNGAGGLLLALSFFSNVGIGSVCYCIVAEMPSAELRTQTIVLARNCYNLMAIVNAILTPYMLNTGDWNWGAKTGLYWGGMTALTLAWVIIDLPETAGRTFSEINELFARGVPARKFKSTVVDPFAKGRIADDIAEDDLDAEVTSVFREDDVELGSACDPGKTSL

SEQ ID NO: 4109 - DNA, 1848 bp, Saccharomyces pastorianus
  CDS (1)..(1848)
atgaagggattatcctcattaataaacagaaaaaaagacaggaacgactcacacttagatgagatcgagaatggcgtgaacgctaccgaattcaactcgatagagatggaggagcaaggtaagaaaagtgattttgatctttcccatcatgagtacggtccaggttcactaacaccaaacgataataatgaagaagtccccgaccttctcgatgaagctatgcaggacgccaaagaggcagatgaaagtgagaggggaatgccactcatgacagctttgaagacatatccaaaagctgctgcttggtcactattagtttccacaacattgattcaagagggttatgacacagccattctaggatctttctatgccctgcctgtttttcaaaaaaaatatggttctttgaatagcaatacaggagattatgaaatttcagcttcctggcaaattggcttgtccttatgcgttacggctggtgaaattgtaggtttgcaaatgactgggccttttgtagattatatgggtaatcgctatacattgattttggcattgattcttcttgctgcattcacctttattctgtatttttgcaagggtttgggtatgattgctgtgggacaagtattgtgtggtatgccatggggttgtttccaatgtttgaccgtttcttatgcttctgaaatttgtcctatggccctaagatactatttgacgacttattctaatttatgttggacgttcggtcaacttttcgctgctggtattatgaaaaactcccaaaataagtaccctaactcagaactaggatataagctaccttttgctttgcagtggatctggcctgctcctcttgcaataggtattttttttgcaccagagtctccatggtggctggttaaaaaaggaaggattgatcaagcaaggagatcacttgaaagaacattgagtggtaaaggacccgagaaggaattactggtaagtatggagctagataatatcaaagtaaccattgaaaaggaaaaaaagctgtcagactcagaaggttcctattgggattgtctgaaggacagtgttaataggagaagaacgagaatagcttgtttatgttgggtcggtcaaaccacctgtggtacatcattaattggtaattcaacttacttttatgaaaaagctggagttggtactgatacggctttcactttcagtattatccaatattgtcttggtattgccgcaacatttctttcttggtgggcttcaaaatattttggtaggtttgacctttacgcatttggattggctatacaaacagtttcattgtttatcataggaggtttgggatgctccgactcgcatggcgctgaaatgggaagtggttctcttttaatggttctttccttcttctacaatttgggtattgctcccgttgtgttttgcttagtgtccgaaataccatcctcaaggctaagaactaaatcgattattctggctcgtaacgcatataatatggcatctattgtaactactgttttgatcatgtaccaattgaactcagaaaaatggaactggggtgccaagtcgggctttttctggggagggttatgttttgccactctagtttgggccgtaattgacctaccagaaactgctggcaggacttttattgagataaatgaattgtttagacttggtgttccagcaagaaagttcaagtcgactaaagtcgacccttttgcagctgccaaagcagcagctgcagaaattaatgttaaagatccgaaggaagatttggaaacttctgtggtagatgaagggcgaagcaccccatctgttgtgaacaaatga

SEQ ID NO: 4110 - protein, 615 aa, Saccharomyces pastorianus
MKGLSSLINRKKDRNDSHLDEIENGVNATEFNSIEMEEQGKKSDFDLSHHEYGPGSLTPNDNNEEVPDLLDEAMQDAKEADESERGMPLMTALKTYPKAAAWSLLVSTTLIQEGYDTAILGSFYALPVFQKKYGSLNSNTGDYEISASWQIGLSLCVTAGEIVGLQMTGPFVDYMGNRYTLILALILLAAFTFILYFCKGLGMIAVGQVLCGMPWGCFQCLTVSYASEICPMALRYYLTTYSNLCWTFGQLFAAGIMKNSQNKYPNSELGYKLPFALQWIWPAPLAIGIFFAPESPWWLVKKGRIDQARRSLERTLSGKGPEKELLVSMELDNIKVTIEKEKKLSDSEGSYWDCLKDSVNRRRTRIACLCWVGQTTCGTSLIGNSTYFYEKAGVGTDTAFTFSIIQYCLGIAATFLSWWASKYFGRFDLYAFGLAIQTVSLFIIGGLGCSDSHGAEMGSGSLLMVLSFFYNLGIAPVVFCLVSEIPSSRLRTKSIILARNAYNMASIVTTVLIMYQLNSEKWNWGAKSGFFWGGLCFATLVWAVIDLPETAGRTFIEINELFRLGVPARKFKSTKVDPFAAAKAAAAEINVKDPKEDLETSVVDEGRSTPSVVNK

SEQ ID NO: 4111 - DNA, 1620 bp, Aspergillus oryzae
  CDS (1)..(1620)
atgactccagagaaggccgctatgtctgaacatattgaaaacgataacccagcgaggcatgatgatatcgacctccccaacagtagcgaggcacataccgccattgcgaaagaacgtgagatgactctatggcaagcgctaagactttatccgaaggcggtggcgtggtctcttctgttctcctgtgccattatcatggaaggctacgatgttgttcttatcggttccttcctcgcatttcctgccttcaacgaaaaatacggaggtctcatgtccgacgggacatatgggctcgaagctaggtggcaagcaggtgttaacaacgcgatggcctgcggccagattatcggactttttctcaatggactggtctcagagcgcttgggataccgaaagaccctgatggcatgccttgccgcgaccgttggtttcgttttcattctgttctttgcgcccaatattcaaactctcgttgtcggcgagctctttatgggcatccctcttggtgtataccaaaccctcgttgtgacatacgcatccgaagtgtgccctgtcgcattgcgcgcatatctcaccacctatgttaacctttgctgggtgctaggtcaattgctcgcctctggcgtgctgaagggtctggccgagcgcaccgatcaatgggcataccgtatcccctttgctctgcagtggatctggccaattcccattttcatcggggtgtttctggcccccgagagcccctggtggctcgttcgacaagaccgccgcgaagatgccgtcaaggcattgaaacgactgaccagcgctaacgcagacttcaacgccgaagaaaccgtcgcaatgatcgtatacaccgacgcactcgagcgacgtgctgaaaccggtacctcctaccttgactgcttcaagaaaagcgacttacgccgaaccgaaatctcctgctgcgcatgggcggcgcagagtctatgtggcgcaggcctcatgggctattcgactgtcttttaccagcgcgcaggtctcgccgtgtcgcagtccttcaccatgtcgctcgtgcaatatgccctaggcgtggtggggacattcgtctcctggacactaatgtcgtacttcggccgtcgcaccctctacgtcggcggtctatttatcctagccatcgtattattcgtcatcgggttcgtctccatcgctccatccacacccgccatctcctgggccaccggctccatgcttctcgtctatacctttatctacgactcctccatcggccccgtctgcttcgccctcgtctccgaaatcccatcctccagactccgtaccaagaccgtcgtgctggcccgaaacgtctacaatatcctcaacctcgtcaccggaatcattatcccgtatatgctgaacgtcgacgcatggaactggcgcggtaaatcaggtttcttctggggtgcactctgcgtttgctgcttgacgtggtcgttcttccggctgccagaacctaagggacggtcgtatgctgagttggatctgttgtttgagagaggggtgaagacgagggagtttgcgactgctaagactgggttggaggatttgcagggcgaggggaaggatgatatggtgaaggtttga

SEQ ID NO: 4112 - protein, 539 aa, Aspergillus oryzae
MTPEKAAMSEHIENDNPARHDDIDLPNSSEAHTAIAKEREMTLWQALRLYPKAVAWSLLFSCAIIMEGYDVVLIGSFLAFPAFNEKYGGLMSDGTYGLEARWQAGVNNAMACGQIIGLFLNGLVSERLGYRKTLMACLAATVGFVFILFFAPNIQTLVVGELFMGIPLGVYQTLVVTYASEVCPVALRAYLTTYVNLCWVLGQLLASGVLKGLAERTDQWAYRIPFALQWIWPIPIFIGVFLAPESPWWLVRQDRREDAVKALKRLTSANADFNAEETVAMIVYTDALERRAETGTSYLDCFKKSDLRRTEISCCAWAAQSLCGAGLMGYSTVFYQRAGLAVSQSFTMSLVQYALGVVGTFVSWTLMSYFGRRTLYVGGLFILAIVLFVIGFVSIAPSTPAISWATGSMLLVYTFIYDSSIGPVCFALVSEIPSSRLRTKTVVLARNVYNILNLVTGIIIPYMLNVDAWNWRGKSGFFWGALCVCCLTWSFFRLPEPKGRSYAELDLLFERGVKTREFATAKTGLEDLQGEGKDDMVKV

SEQ ID NO: 4113 - DNA, 1767 bp, Kluyveromyces lactis
  CDS (1)..(1767)
atgcttcataagattgataacagaaagttctttattcacttcaaacaaaacagtaaagctgaattaattcaatacaactattacaacaagggacagaatcacttcacaatggattcttcatcgtccgtgcttcagaaagacacaaaacaggtcgatattgaacatagggaagaagcaagctccaacgatcagtttgtagatcaaaatgccttattagatagcttccttggtgacgtcgatgtgctgcgagcgctgatgcgactggaaaaaagtatgtctctcttagaaaggttgcgccaagtacatccgaaagctgtaggttggtccttaatgggttcaaccggcttaatcatggaagggtacgacactgctttcattaacaatctgtttgctcttccaatttttcgaaccactttcggtgaatacaatcaagcgaatgacatttgggagattccttccaaatggcaaattggtttggggatgtgtgttgcctgtggtgagattattggtttgcagataactggtatattcgcagatcgttacggttacaggcttgtgttgattgctggcttggttcttttgattgctttcaattttattctctactttgcaaacagtttgactatgattgctataggccaaattttaagtggtatcccatggggctcattccaaacactctgcgtttcatatgctagtgaggtctgtccattggttttgagatactatttgacaacatacatcaatttatgttggcttatcgggcaagtgattgccgctggagttttgaaggcatgtcaggaacatcttgccaatgatgagctaggttggagacttccatttgcgttacagtggatatggccggttcctttgattgtaggtatttaccttgctccagaatctccttggtggttggttagaaagggcaggatcgatcaagccaaacgatccgtcacaagaattctaaccctgcccacttctgaaaaggacaagctaactgacataatgatcacaaaaatgagaatgactgtcgagaaagaaaaccgtcttgcttccgaatcaagttcttatatggactgtttcaagggcattgatgcgagaagaaccaggataacgtgtctcacatgggtcatgcaaaatttaacgggatccgctttgatgggatactccacctatttctatgaaaaagccgggttggacacttctgcagccttcactttttccatcattcaatacgtgattggtattgttggtaccttaacatcatggttcctatcttccagagctggtcgcttcacgattctcttttggggtgtctttttccagacgatagttatgttcattactggtggcctcggattcagcagctctgaaggtgccagttggggtgctggttccatgttgctgatctacaacttcttttacaactccaccttaggtcctgttgtttactgtgtggtgtcagaaattcctagtgacagattgagaactaaaactgtagttctagcacgtaactcctacaacttgatagctattgtaaattctattttgacaccgtatatgttaaactccgaccaatggaactggggtgcaaagacaggtttgttctggggtggattagctgccatctcattagtttgggcttacttcgatctcccagaaactaagggcagaacatttgcagagcttgatgagttattccatcaaagagttccagcaaggaagtttaacagtacacatgtggagccttctctcgtgagacaataa

SEQ ID NO: 4114 - protein, 588 aa, Kluyveromyces lactis
MLHKIDNRKFFIHFKQNSKAELIQYNYYNKGQNHFTMDSSSSVLQKDTKQVDIEHREEASSNDQFVDQNALLDSFLGDVDVLRALMRLEKSMSLLERLRQVHPKAVGWSLMGSTGLIMEGYDTAFINNLFALPIFRTTFGEYNQANDIWEIPSKWQIGLGMCVACGEIIGLQITGIFADRYGYRLVLIAGLVLLIAFNFILYFANSLTMIAIGQILSGIPWGSFQTLCVSYASEVCPLVLRYYLTTYINLCWLIGQVIAAGVLKACQEHLANDELGWRLPFALQWIWPVPLIVGIYLAPESPWWLVRKGRIDQAKRSVTRILTLPTSEKDKLTDIMITKMRMTVEKENRLASESSSYMDCFKGIDARRTRITCLTWVMQNLTGSALMGYSTYFYEKAGLDTSAAFTFSIIQYVIGIVGTLTSWFLSSRAGRFTILFWGVFFQTIVMFITGGLGFSSSEGASWGAGSMLLIYNFFYNSTLGPVVYCVVSEIPSDRLRTKTVVLARNSYNLIAIVNSILTPYMLNSDQWNWGAKTGLFWGGLAAISLVWAYFDLPETKGRTFAELDELFHQRVPARKFNSTHVEPSLVRQ

SEQ ID NO: 4115 - DNA, 1845 bp, Saccharomyces cerevisiae
  CDS (1)..(1845)
atgaagggattatcctcattaataaacagaaaaaaagacaggaacgactcacacttagatgagatcgagaatggcgtgaacgctaccgaattcaactcgatagagatggaggagcaaggtaagaaaagtgattttgatctttcccatcttgagtacggtccaggttcactaataccaaacgataataatgaagaagtccccgaccttctcgatgaagctatgcaggacgccaaagaggcagatgaaagtgagaggggaatgccactcatgacagctttgaagacatatccaaaagctgctgcttggtcactattagtttccacaacattgattcaagagggttatgacacagccattctaggagctttctatgccctgcctgtttttcaaaaaaaatatggttctttgaatagcaatacaggagattatgaaatttcagtttcctggcaaatcggtctatgtctatgctacatggcaggtgagattgtcggtttgcaaatgactgggccttctgtagattacatgggcaaccgttacactctgatcatggcgttgttctttttagcggctttcattttcattctgtatttttgcaagagtttgggtatgattgccgtgggacaggcattgtgtggtatgccatggggttgtttccaatgtttgaccgtttcttatgcttctgaaatttgtcctttggccctaagatactatttgacgacttattctaatttatgttgggcgttcggtcaacttttcgctgctggtattatgaaaaattcccagaacaaatatgccaactcagaactaggatataagctaccttttgctttgcagtggatctggccccttcctttggcggtaggtattttttttgcaccagagtctccatggtggctggttaaaaaaggaaggattgatcaagcgaggagatcacttgaaagaacattaagtggtaaaggacccgagaaagaattactagtgagtatggaactcgataaaatcaaaactactatagaaaaggagcagaaaatgtctgatgaaggaacttactgggattgtgtgaaagatggtattaacaggagaagaacgagaatagcttgtttatgttggatcggtcaatgctcctgtggtgcatcattaattggttattcaacttacttttatgaaaaagctggtgttagcactgatacggcttttactttcagtattatccaatattgtcttggtattgctgcaacgtttatatcctggtgggcttcaaaatattgtggcagatttgacctttatgcttttgggctggcttttcaggctattatgttcttcattatcggtggtttaggatgttcagacactcatggcgctaaaatgggtagtggtgctcttctaatggttgtcgcgttcttttacaacctcggtattgcacctgttgttttttgcttagtgtctgaaataccgtcttcaaggctaagaaccaaaacaattattttggctcgtaatgcttacaatgtgatccaagttgtagttacagttttgatcatgtaccaattgaactcagagaaatggaattggggtgctaaatcaggctttttctggggaggattttgtctggccactttagcttgggctgttgtcgatttaccagaaaccgctggcaggacttttattgagataaatgaattgtttagacttggtgttccagcaagaaagttcaagtcgactaaagtcgacccttttgcagctgccaaagcagcagctgcagaaattaatgttaaagatccgaaggaagatttggaaacttctgtggtagatgaagggcgaaacacctcatctgttgtgaacaaatga

SEQ ID NO: 4116 - protein, 614 aa, Saccharomyces cerevisiae
MKGLSSLINRKKDRNDSHLDEIENGVNATEFNSIEMEEQGKKSDFDLSHLEYGPGSLIPNDNNEEVPDLLDEAMQDAKEADESERGMPLMTALKTYPKAAAWSLLVSTTLIQEGYDTAILGAFYALPVFQKKYGSLNSNTGDYEISVSWQIGLCLCYMAGEIVGLQMTGPSVDYMGNRYTLIMALFFLAAFIFILYFCKSLGMIAVGQALCGMPWGCFQCLTVSYASEICPLALRYYLTTYSNLCWAFGQLFAAGIMKNSQNKYANSELGYKLPFALQWIWPLPLAVGIFFAPESPWWLVKKGRIDQARRSLERTLSGKGPEKELLVSMELDKIKTTIEKEQKMSDEGTYWDCVKDGINRRRTRIACLCWIGQCSCGASLIGYSTYFYEKAGVSTDTAFTFSIIQYCLGIAATFISWWASKYCGRFDLYAFGLAFQAIMFFIIGGLGCSDTHGAKMGSGALLMVVAFFYNLGIAPVVFCLVSEIPSSRLRTKTIILARNAYNVIQVVVTVLIMYQLNSEKWNWGAKSGFFWGGFCLATLAWAVVDLPETAGRTFIEINELFRLGVPARKFKSTKVDPFAAAKAAAAEINVKDPKEDLETSVVDEGRNTSSVVNK

SEQ ID NO: 4117 - DNA, 2769 bp, Saccharomyces cerevisiae
  CDS (875)..(2719)
ttatgtaatttagttacgcttgactgatgtacatttgagattatcaaaaaaactgcttaagagatggatgatttaattttttagagacgtattaatggaactttttataccttgcccagagcgcctcaagaaaatgatgctgcaagaagaattgaggaaggaactactcatcttacgttgtttgtatcatcccacgatccaaatcatgttacctacgttaggtacgctaggaactaaaaaaagaaaagaaaagtatgcgttatcactcttcgagccaattcttaattgtgtggggtccgcgaaaatttccggataaatcctgtaaactttaacttaaaccccgtgtttagcgaaattttcaacgaagcgcgcaataaggagaaatattatctaaaagcgagagtttaagcgagttgcaagaatctctacggtacagatgcaacttactatagccaaggtctattcgtattggtatccaagcagtgaagctactcaggggaaaacatattttcagagatcaaagttatgtcagtttctttttcatgtgtaacttaacgtttgtgcaggtatcataccggcctccacataatttttgtggggaagacgttgttgtagcagtctccttatactctccaacaggtgcctaaagacttcttcaggcctcatagtctacatctggagacaacattagatagaagtttccacagaggcagctttcaatatactttcggctgtgtacatttcatcctgagtgagcgcatattgcataagtactcagcatataaagagacacaatatactccatacttgttgtgagtggttttagcgtattcagtataacaataagaattacatccaagactattaattaactatgaagggattatcctcattaataaacagaaaaaaagacaggaacgactcacacttagatgagatcgagaatggcgtgaacgctaccgaattcaactcgatagagatggaggagcaaggtaagaaaagtgattttgatctttcccatcttgagtacggtccaggttcactaataccaaacgataataatgaagaagtccccgaccttctcgatgaagctatgcaggacgccaaagaggcagatgaaagtgagaggggaatgccactcatgacagctttgaagacatatccaaaagctgctgcttggtcactattagtttccacaacattgattcaagagggttatgacacagccattctaggagctttctatgccctgcctgtttttcaaaaaaaatatggttctttgaatagcaatacaggagattatgaaatttcagtttcctggcaaatcggtctatgtctatgctacatggcaggtgagattgtcggtttgcaagtgactgggccttctgtagattacatgggcaaccgttacactctgatcatggcgttgttctttttagcggctttcattttcattctgtatttttgcaagagtttgggtatgattgccgtgggacaggcattgtgtggtatgccatggggttgtttccaatgtttgaccgtttcttatgcttctgaaatttgtcctttggccctaagatactatttgacgacttattctaatttatgttggacgttcggtcaacttttcgctgctggtattatgaaaaattcccagaacaaatatgccaactcagaactaggatataagctaccttttgctttgcagtggatctggccccttcctttggcggtaggtatttttttggcaccagagtctccatggtggctggttaaaaaaggaaggattgatcaggcgaggagatcacttgaaagaatattaagtggtaaaggacccgagaaagaattactagtgagtatggaactcgataaaatcaaaactactatagaaaaggagcagaaaatgtctgatgaaggaacttactgggattgtgtgaaagatggtattaacaggagaagaacgagaatagcttgtttatgttggatcggtcaatgctcctgtggtgcatcattaattggttattcaacttacttttatgaaaaagctggtgttagcactgatacggcttttactttcagtattatccaatattgtcttggtattgctgcaacgtttgtatcctggtgggcttcaaaatattgtggcagatttgacctttatgcttttgggctggcttttcaggctattatgttcttcattatcggtggtttaggatgttcagacactcatggcgctaaaatgggtagtggtgctcttctaatggttgtcgcgttcttttacaacctcggtattgcacctgttgttttttgcttagtgtctgaaatgccgtcttcaaggctaagaaccaaaacaattattttggctcgtaatgcttacaatgtgatccaagttgtagttacagttttgatcatgtaccaattgaactcagagaaatggaattggggtgctaaatcaggctttttctggggaggattttgtctggccactttagcttgggctgttgtcgatttaccagaaaccgctggcaggacttttattgagataaatgaattgtttagacttggtgttccagcaagaaagttcaagtcgactaaagtcgacccttttgcagctgccaaagcagcagctgcagaaattaatgttaaagatccgaaggaagatttggaaacttctgtggtagatgaagggcgaagcaccccatctgttgtgaacaaatgatttttttagccagtaggtagatcggcgttatttaattttattttatataa

SEQ ID NO: 4118 - protein, 614 aa, Saccharomyces cerevisiae
MKGLSSLINRKKDRNDSHLDEIENGVNATEFNSIEMEEQGKKSDFDLSHLEYGPGSLIPNDNNEEVPDLLDEAMQDAKEADESERGMPLMTALKTYPKAAAWSLLVSTTLIQEGYDTAILGAFYALPVFQKKYGSLNSNTGDYEISVSWQIGLCLCYMAGEIVGLQVTGPSVDYMGNRYTLIMALFFLAAFIFILYFCKSLGMIAVGQALCGMPWGCFQCLTVSYASEICPLALRYYLTTYSNLCWTFGQLFAAGIMKNSQNKYANSELGYKLPFALQWIWPLPLAVGIFLAPESPWWLVKKGRIDQARRSLERILSGKGPEKELLVSMELDKIKTTIEKEQKMSDEGTYWDCVKDGINRRRTRIACLCWIGQCSCGASLIGYSTYFYEKAGVSTDTAFTFSIIQYCLGIAATFVSWWASKYCGRFDLYAFGLAFQAIMFFIIGGLGCSDTHGAKMGSGALLMVVAFFYNLGIAPVVFCLVSEMPSSRLRTKTIILARNAYNVIQVVVTVLIMYQLNSEKWNWGAKSGFFWGGFCLATLAWAVVDLPETAGRTFIEINELFRLGVPARKFKSTKVDPFAAAKAAAAEINVKDPKEDLETSVVDEGRSTPSVVNK

SEQ ID NO: 4119 - DNA, 1809 bp, Saccharomyces cerevisiae
  CDS (1)..(1809)
atgaaaaacttatcttttctcataaacagaagaaaggaaaatacaagtgactcgaatgtatacccaggaaaggctaagtcgcatgaacccagctggatagaaatggatgatcaaactaagaaggacggcttagatattgttcatgttgagttcagtccggatacaagagcgccaagcgatagcaataaagtaataacagagatatttgacgctactgaggatgccaaggaggcagacgaaagtgaaagaggaatgccacttgcgacagcattgaatacatatcccaaggcagcagcttggtcactattggtctctacaactttaatcatggaagggtacgacacagctattcttggagctttctacgccttgcctatttttcagagaaagtttggctcacaaaatgacaaaactggagaatgggaaatttcagcgtcatggcaaatcgggctgaccttatgttatatggcaggtgaaattgtggggctacagctaacggggccctccgtggatcttgttggaaatcgttacacattgattattgcattgttttttttagctgccttcacttttatactgtacttttgcaatagtttaggcatgattgctgtgggacaagcattgtgcgggatgccatggggttgttttcagtgtttgacggtgtcttacgcttctgaaatatgcccattggctctgagatattaccttacaacctattcaaacttgtgctggttatttggacaactttttgcagctggaatcatgaaaaattctcaaaaaaaatatgcggattcagaattaggatataaactaccatttgccctacagtggattttgccagttcctttagcactgggaattttttttgcacctgaatctccatggtggctagttaaaaaaggaaggtttgatgaggcaaggagatcacttagaagaactttaagcggcaagggacctgaaaaagaaatactagtaactctggaggtggacaaaataaaagtgactatagataaggaaaagagactcacaagtaaagaaggctcctatagtgattgttttgaagacaagattaatcgaagaagaacgagaattacttgtctctgctgggctggtcaagccacttgtggttcaatactaataggttattcaacttacttttacgaaaaggctggcgttagtactgaaatgtccttcacttttagtattattcaatactgtctcggtatttgtgctacatttctatcttggtgggcgtcaaagtattttggtagatatgacctttacgcttttggactagccttccaaaccattgtttttttcattattggcggtttggggtgctcaagtacgcacggttccaaaatgggaagtggttctcttttaatggctgtagcatttttttacaatttaggaattgccccggtcgttttttgcctagtctctgaaatgccatcttcaagactaagaacgaaaacaatcattctagcacgtaacacttataatgtggtcagtatcatatgtagcgttctcatcttataccaactgaactctaagaagtggaactggggcgctaagtcaggctttttctggggtgtcttatgcttttgtactttaatctgggctgtggttgacctaccagaaactgccggaaagactttcgtggaaataaatgagttatttaaacttggagtttctgcaagaaagttcaaatcgacgaaagtagatccgtttgttgtcaaaaccccccctaaagacgtctctcataacgaccccaagggagatatcgaagcttccattgcagaggaatag

SEQ ID NO: 4120 - protein, 602 aa, Saccharomyces cerevisiae
MKNLSFLINRRKENTSDSNVYPGKAKSHEPSWIEMDDQTKKDGLDIVHVEFSPDTRAPSDSNKVITEIFDATEDAKEADESERGMPLATALNTYPKAAAWSLLVSTTLIMEGYDTAILGAFYALPIFQRKFGSQNDKTGEWEISASWQIGLTLCYMAGEIVGLQLTGPSVDLVGNRYTLIIALFFLAAFTFILYFCNSLGMIAVGQALCGMPWGCFQCLTVSYASEICPLALRYYLTTYSNLCWLFGQLFAAGIMKNSQKKYADSELGYKLPFALQWILPVPLALGIFFAPESPWWLVKKGRFDEARRSLRRTLSGKGPEKEILVTLEVDKIKVTIDKEKRLTSKEGSYSDCFEDKINRRRTRITCLCWAGQATCGSILIGYSTYFYEKAGVSTEMSFTFSIIQYCLGICATFLSWWASKYFGRYDLYAFGLAFQTIVFFIIGGLGCSSTHGSKMGSGSLLMAVAFFYNLGIAPVVFCLVSEMPSSRLRTKTIILARNTYNVVSIICSVLILYQLNSKKWNWGAKSGFFWGVLCFCTLIWAVVDLPETAGKTFVEINELFKLGVSARKFKSTKVDPFVVKTPPKDVSHNDPKGDIEASIAEE

SEQ ID NO: 4121 - DNA, 27 bp, Artificial sequence
  primer
atgaaaaatatcatttcattggtaagc

SEQ ID NO: 4122 - DNA, 27 bp, Artificial sequence
  primer
ttaacatttatcagctgcatttaattc

SEQ ID NO: 4123 - protein, 554 aa, Artificial sequence
  consensus sequence
  Variant (2)..(7): Xaa in position 2 to 7 is any amino acid
  Variant (9)..(10): Xaa in position 9 to 10 is any amino acid
  Variant (12)..(12): Xaa in position 12 is any amino acid
  Variant (14)..(19): Xaa in position 14 to 19 is any amino acid
  Variant (20)..(20): Xaa in position 20 is any or no amino acid
  Variant (25)..(26): Xaa in position 25 to 26 is any amino acid
  Variant (29)..(31): Xaa in position 29 to 31 is any amino acid
  Variant (33)..(37): Xaa in position 33 to 37 is any amino acid
  Variant (42)..(49): Xaa in position 42 to 49 is any amino acid
  Variant (51)..(51): Xaa in position 51 is any amino acid
  Variant (53)..(53): Xaa in position 53 is any amino acid
  Variant (55)..(56): Xaa in position 55 to 56 is any amino acid
  Variant (58)..(58): Xaa in position 58 is any amino acid
  Variant (60)..(64): Xaa in position 60 to 64 is any amino acid
  Variant (65)..(73): Xaa in position 65 to 73 is any or no amino acid
  Variant (75)..(80): Xaa in position 75 to 80 is any amino acid
  Variant (81)..(87): Xaa in position 81 to 87 is any or no amino acid
  Variant (90)..(91): Xaa in position 90 to 91 is any amino acid
  Variant (93)..(98): Xaa in position 93 to 98 is any amino acid
  Variant (100)..(100): Xaa in position 100 is any amino acid
  Variant (102)..(102): Xaa in position 102 is any amino acid
  Variant (105)..(107): Xaa in position 105 to 107 is any amino acid
  Variant (109)..(114): Xaa in position 109 to 114 is any amino acid
  Variant (116)..(116): Xaa in position 116 is any amino acid
  Variant (118)..(118): Xaa in position 118 is any amino acid
  Variant (120)..(123): Xaa in position 120 to 123 is any amino acid
  Variant (125)..(131): Xaa in position 125 to 131 is any amino acid
  Variant (133)..(145): Xaa in position 133 to 145 is any amino acid
  Variant (147)..(148): Xaa in position 147 to 148 is any amino acid
  Variant (150)..(150): Xaa in position 150 is any amino acid
  Variant (152)..(152): Xaa in position 152 is any amino acid
  Variant (153)..(168): Xaa in position 153 to 168 is any or no amino acid
  Variant (172)..(172): Xaa in position 172 is any amino acid
  Variant (175)..(179): Xaa in position 175 to 179 is any amino acid
  Variant (184)..(184): Xaa in position 184 is any amino acid
  Variant (187)..(188): Xaa in position 187 to 188 is any amino acid
  Variant (191)..(191): Xaa in position 191 is any amino acid
  Variant (197)..(197): Xaa in position 197 is any amino acid
  Variant (199)..(199): Xaa in position 199 is any amino acid
  Variant (202)..(203): Xaa in position 202 to 203 is any amino acid
  Variant (206)..(209): Xaa in position 206 to 209 is any amino acid
  Variant (211)..(223): Xaa in position 211 to 223 is any amino acid
  Variant (224)..(231): Xaa in position 224 to 231 is any or no amino acid
  Variant (233)..(234): Xaa in position 233 to 234 is any amino acid
  Variant (238)..(238): Xaa in position 238 is any amino acid
  Variant (241)..(241): Xaa in position 241 is any amino acid
  Variant (244)..(244): Xaa in position 244 is any amino acid
  Variant (246)..(248): Xaa in position 246 to 248 is any amino acid
  Variant (250)..(252): Xaa in position 250 to 252 is any amino acid
  Variant (262)..(268): Xaa in position 262 to 268 is any amino acid
  Variant (270)..(272): Xaa in position 270 to 272 is any amino acid
  Variant (274)..(274): Xaa in position 274 is any amino acid
  Variant (276)..(294): Xaa in position 276 to 294 is any amino acid
  Variant (295)..(306): Xaa in position 295 to 306 is any or no amino acid
  Variant (308)..(310): Xaa in position 308 to 310 is any amino acid
  Variant (312)..(321): Xaa in position 312 to 321 is any amino acid
  Variant (322)..(323): Xaa in position 322 to 323 is any or no amino acid
  Variant (326)..(331): Xaa in position 326 to 331 is any amino acid
  Variant (332)..(332): Xaa in position 332 is any or no amino acid
  Variant (336)..(336): Xaa in position 336 is any amino acid
  Variant (338)..(338): Xaa in position 338 is any amino acid
  Variant (340)..(341): Xaa in position 340 to 341 is any amino acid
  Variant (343)..(344): Xaa in position 343 to 344 is any amino acid
  Variant (346)..(348): Xaa in position 346 to 348 is any amino acid
  Variant (350)..(354): Xaa in position 350 to 354 is any amino acid
  Variant (357)..(357): Xaa in position 357 is any amino acid
  Variant (360)..(362): Xaa in position 360 to 362 is any amino acid
  Variant (365)..(370): Xaa in position 365 to 370 is any amino acid
  Variant (372)..(376): Xaa in position 372 to 376 is any amino acid
  Variant (379)..(380): Xaa in position 379 to 380 is any amino acid
  Variant (382)..(384): Xaa in position 382 to 384 is any amino acid
  Variant (386)..(387): Xaa in position 386 to 387 is any amino acid
  Variant (390)..(395): Xaa in position 390 to 395 is any amino acid
  Variant (396)..(396): Xaa in position 396 is any or no amino acid
  Variant (399)..(404): Xaa in position 399 to 404 is any amino acid
  Variant (407)..(416): Xaa in position 407 to 416 is any amino acid
  Variant (418)..(431): Xaa in position 418 to 431 is any amino acid
  Variant (432)..(435): Xaa in position 432 to 435 is any or no amino acid
  Variant (437)..(438): Xaa in position 437 to 438 is any amino acid
  Variant (440)..(445): Xaa in position 440 to 445 is any amino acid
  Variant (447)..(457): Xaa in position 447 to 457 is any amino acid
  Variant (459)..(459): Xaa in position 459 is any amino acid
  Variant (461)..(462): Xaa in position 461 to 462 is any amino acid
  Variant (464)..(464): Xaa in position 464 is any amino acid
  Variant (467)..(468): Xaa in position 467 to 468 is any amino acid
  Variant (471)..(472): Xaa in position 471 to 472 is any amino acid
  Variant (476)..(477): Xaa in position 476 to 477 is any amino acid
  Variant (480)..(490): Xaa in position 480 to 490 is any amino acid
  Variant (492)..(492): Xaa in position 492 is any amino acid
  Variant (495)..(497): Xaa in position 495 to 497 is any amino acid
  Variant (498)..(499): Xaa in position 498 to 499 is any or no amino acid
  Variant (503)..(508): Xaa in position 503 to 508 is any amino acid
  Variant (511)..(511): Xaa in position 511 is any amino acid
  Variant (513)..(519): Xaa in position 513 to 519 is any amino acid
  Variant (521)..(524): Xaa in position 521 to 524 is any amino acid
  Variant (528)..(529): Xaa in position 528 to 529 is any amino acid
  Variant (533)..(534): Xaa in position 533 to 534 is any amino acid
  Variant (536)..(538): Xaa in position 536 to 538 is any amino acid
  Variant (541)..(545): Xaa in position 541 to 545 is any amino acid
  Variant (550)..(551): Xaa in position 550 to 551 is any amino acid
  Variant (553)..(553): Xaa in position 553 is any amino acid
AXXXXXXEXXMXLXXXXXXXYPKAXXWSXXXSXXXXXEGYDXXXXXXXXAXPXFXXKXGXXXXXXXXXXXXXXGXXXXXXXXXXXXXWQXXLXXXXXXGXIXGLXXXGXXXXXXGXRXTXXXXLXXXXXXXFXXXXXXXXXXXXXGXXLXGXXXXXXXXXXXXXXXXXPWGXFQXXXXXYASEXCPXXLRXYLTTYXNXCWXXGQXXXXGXXXXXXXXXXXXXXXXXXXXXYXXPFAXQWXWPXPXXXGXXXAPESPWWLVXXXXXXXAXXXLXRXXXXXXXXXXXXXXXXXXXXXXXXXXXXXXXTXXXEXXXXXXXXXXXXDCXXXXXXXRRTXIXCXXWXXQXXXGXXXXXYSXYFXXXAGXXXXXXFXXXXXQYXXGXXXTXXSWXXXXXXXGRXXXXXXGLXXXXXXXXXXGXXXXXXXXXXXXXXXXXXGXXLXXXXXXYXXXXXXXXXXXVXEXXSXRLXXKTXXLARXXYNXXXXXXXXXXXYXLNXXXXXWNWXXXXXXFWXGXXXXXXXWXXXXLPEXXGRTXXEXXXLFXXXXXARKFXXTXV

SEQ ID NO: 4124 - protein, 41 aa, Artificial sequence
  protein pattern
  Variant (2)..(4): Xaa in position 2 to 4 is any or no amino acid
  Variant (8)..(8): Xaa in position 8 is any amino acid
  Variant (10)..(10): Xaa in position 10 is Ala or Gln
  Variant (11)..(11): Xaa in position 11 is Cys, Gly, Ser or Thr
  Variant (12)..(14): Xaa in position 12 to 14 is any amino acid
  Variant (15)..(15): Xaa in position 15 is Ala, Ser or Thr
  Variant (18)..(18): Xaa in position 18 is Ala or Ser
  Variant (19)..(19): Xaa in position 19 is Asp or Glu
  Variant (20)..(20): Xaa in position 20 is Ile, Leu or Val
  Variant (21)..(21): Xaa in position 21 is Ala, Cys or Thr
  Variant (23)..(24): Xaa in position 23 to 24 is any amino acid
  Variant (25)..(25): Xaa in position 25 is Leu or Pro
  Variant (27)..(27): Xaa in position 27 is any amino acid
  Variant (28)..(28): Xaa in position 28 is Phe or Tyr
  Variant (29)..(29): Xaa in position 29 is Leu or Met
  Variant (31)..(31): Xaa in position 31 is Ala, Cys, Ser or Thr
  Variant (32)..(32): Xaa in position 32 is Phe, Trp or Tyr
  Variant (33)..(33): Xaa in position 33 is any amino acid
  Variant (35)..(35): Xaa in position 35 is any amino acid
  Variant (38)..(39): Xaa in position 38 to 39 is any amino acid
  Variant (41)..(41): Xaa in position 41 is Gly or Gln
LXXXPWGXFXXXXXXYAXXXXPXXXRXXXTXXXNXCWXXGX

SEQ ID NO: 4125 - protein, 27 aa, Artificial sequence
  protein pattern
  Variant (3)..(4): Xaa in position 3 to 4 is any amino acid
  Variant (5)..(5): Xaa in position 5 is Asp, Gly or Asn
  Variant (6)..(6): Xaa in position 6 is Lys or Arg
  Variant (7)..(7): Xaa in position 7 is Ser or Thr
  Variant (8)..(8): Xaa in position 8 is Phe or Tyr
  Variant (9)..(9): Xaa in position 9 is any amino acid
  Variant (10)..(10): Xaa in position 10 is Glu or Thr
  Variant (11)..(11): Xaa in position 11 is Ile or Leu
  Variant (12)..(12): Xaa in position 12 is Asp, Gly or Asn
  Variant (13)..(13): Xaa in position 13 is any amino acid
  Variant (14)..(14): Xaa in position 14 is Leu or Met
  Variant (16)..(19): Xaa in position 16 to 19 is any amino acid
  Variant (20)..(20): Xaa in position 20 is Pro or Ser
  Variant (25)..(26): Xaa in position 25 to 26 is any amino acid
PEXXXXXXXXXXXXFXXXXXARKFXXT

SEQ ID NO: 4126 - protein, 38 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is any amino acid
  Variant (6)..(6): Xaa in position 6 is Ala, Pro or Ser
  Variant (8)..(9): Xaa in position 8 to 9 is any amino acid
  Variant (11)..(12): Xaa in position 11 to 12 is any amino acid
  Variant (14)..(14): Xaa in position 14 is Ser or Thr
  Variant (15)..(15): Xaa in position 15 is Ile or Val
  Variant (16)..(17): Xaa in position 16 to 17 is any amino acid
  Variant (18)..(18): Xaa in position 18 is Ala, Gly or Ser
  Variant (20)..(21): Xaa in position 20 to 21 is any amino acid
  Variant (23)..(23): Xaa in position 23 is Gly or Asn
  Variant (24)..(26): Xaa in position 24 to 26 is any amino acid
  Variant (27)..(27): Xaa in position 27 is Phe, Ile, Leu or Val
  Variant (28)..(28): Xaa in position 28 is Phe, Ile, Met or Val
  Variant (29)..(29): Xaa in position 29 is any amino acid
  Variant (30)..(30): Xaa in position 30 is Ala, Gly, Asn, Ser or Thr
  Variant (31)..(31): Xaa in position 31 is any amino acid
  Variant (32)..(32): Xaa in position 32 is Ile, Leu, Met or Val
  Variant (33)..(36): Xaa in position 33 to 36 is any amino acid
  Variant (37)..(37): Xaa in position 37 is Ile or Leu
  Variant (38)..(38): Xaa in position 38 is Gly, Asn or Ser
VXXEXXSXXLXXKXXXXXRXXYXXXXXXXXXXXXXXXX

SEQ ID NO: 4127 - protein, 19 aa, Artificial sequence
  protein pattern
  Variant (5)..(5): Xaa in position 5 is Trp or Tyr
  Variant (7)..(7): Xaa in position 7 is any amino acid
  Variant (8)..(8): Xaa in position 8 is Lys or Arg
  Variant (9)..(9): Xaa in position 9 is any amino acid
  Variant (10)..(10): Xaa in position 10 is Asp, Glu, Gly, Asn or Ser
  Variant (11)..(11): Xaa in position 11 is Lys or Arg
  Variant (12)..(12): Xaa in position 12 is any amino acid
  Variant (13)..(13): Xaa in position 13 is Ala, Asp, Glu, Gln or Ser
  Variant (14)..(14): Xaa in position 14 is Asp, Glu or Gln
  Variant (16)..(17): Xaa in position 16 to 17 is any amino acid
  Variant (18)..(18): Xaa in position 18 is Ala, Ser or Val
  Variant (19)..(19): Xaa in position 19 is Ile, Leu or Val
ESPWXLXXXXXXXXAXXXX

SEQ ID NO: 4128 - protein, 43 aa, Artificial sequence
  protein pattern
  Variant (4)..(6): Xaa in position 4 to 6 is any or no amino acid
  Variant (8)..(9): Xaa in position 8 to 9 is any amino acid
  Variant (11)..(12): Xaa in position 11 to 12 is any amino acid
  Variant (14)..(15): Xaa in position 14 to 15 is any amino acid
  Variant (16)..(16): Xaa in position 16 is Ala, Cys, Ser or Thr
  Variant (18)..(19): Xaa in position 18 to 19 is any amino acid
  Variant (20)..(20): Xaa in position 20 is Phe, Ile or Leu
  Variant (21)..(21): Xaa in position 21 is any amino acid
  Variant (22)..(22): Xaa in position 22 is Gly, Asn or Ser
  Variant (23)..(26): Xaa in position 23 to 26 is any amino acid
  Variant (28)..(30): Xaa in position 28 to 30 is any amino acid
  Variant (33)..(33): Xaa in position 33 is Phe, Leu, Met or Val
  Variant (34)..(34): Xaa in position 34 is Ala, Asp, Gly, Pro, Ser or Thr
  Variant (35)..(37): Xaa in position 35 to 37 is any amino acid
  Variant (38)..(38): Xaa in position 38 is Ala, Pro or Ser
  Variant (39)..(39): Xaa in position 39 is Phe or Tyr
  Variant (40)..(40): Xaa in position 40 is any amino acid
  Variant (41)..(41): Xaa in position 41 is Phe, Ile, Leu or Met
  Variant (42)..(42): Xaa in position 42 is Ala, Gly, Asn, Ser or Thr
  Variant (43)..(43): Xaa in position 43 is Ile, Leu, Met or Val
RRTXXXCXXWXXQXXXGXXXXXXXXXFXXXAGXXXXXXXXXXX

SEQ ID NO: 4129 - protein, 39 aa, Artificial sequence
  protein pattern
  Variant (2)..(2): Xaa in position 2 is any amino acid
  Variant (5)..(6): Xaa in position 5 to 6 is any amino acid
  Variant (7)..(7): Xaa in position 7 is Phe or Trp
  Variant (8)..(8): Xaa in position 8 is Ala or Ser
  Variant (9)..(9): Xaa in position 9 is Phe, Ile, Leu, Met or Val
  Variant (10)..(10): Xaa in position 10 is any amino acid
  Variant (11)..(11): Xaa in position 11 is Phe, Ile, Leu or Val
  Variant (13)..(13): Xaa in position 13 is any amino acid
  Variant (14)..(14): Xaa in position 14 is Ala, Cys, Ser or Thr
  Variant (15)..(15): Xaa in position 15 is any amino acid
  Variant (16)..(16): Xaa in position 16 is Ala, Ile or Val
  Variant (17)..(17): Xaa in position 17 is any amino acid
  Variant (20)..(20): Xaa in position 20 is Phe or Tyr
  Variant (22)..(22): Xaa in position 22 is any amino acid
  Variant (23)..(23): Xaa in position 23 is Ala, Gly, Ser, Thr or Val
  Variant (24)..(24): Xaa in position 24 is Ile or Leu
  Variant (25)..(25): Xaa in position 25 is Ile, Leu, Met or Val
  Variant (26)..(26): Xaa in position 26 is Gly, Asn, Gln, Ser or Thr
  Variant (27)..(27): Xaa in position 27 is Ala, Asn or Ser
  Variant (28)..(28): Xaa in position 28 is Phe, Ile, Leu or Met
  Variant (29)..(29): Xaa in position 29 is any amino acid
  Variant (30)..(30): Xaa in position 30 is Ala, Gly or Asn
  Variant (31)..(31): Xaa in position 31 is any amino acid
  Variant (32)..(32): Xaa in position 32 is Asp, Glu, Pro or Thr
  Variant (33)..(33): Xaa in position 33 is any amino acid
  Variant (34)..(34): Xaa in position 34 is Phe, Trp or Tyr
  Variant (35)..(36): Xaa in position 35 to 36 is any amino acid
  Variant (37)..(37): Xaa in position 37 is Lys or Arg
  Variant (38)..(38): Xaa in position 38 is Phe or Tyr
YXKAXXXXXXXSXXXXXEGXDXXXXXXXXXXXXXXXXXG

SEQ ID NO: 4130 - protein, 21 aa, Artificial sequence
  protein pattern
  Variant (3)..(3): Xaa in position 3 is any amino acid
  Variant (4)..(4): Xaa in position 4 is Asp, Gln, Ser or Thr
  Variant (5)..(5): Xaa in position 5 is Ile or Leu
  Variant (6)..(8): Xaa in position 6 to 8 is any amino acid
  Variant (11)..(16): Xaa in position 11 to 16 is any amino acid
  Variant (17)..(17): Xaa in position 17 is Phe or Leu
  Variant (18)..(20): Xaa in position 18 to 20 is any amino acid
GRXXXXXXGLXXXXXXXXXXG

SEQ ID NO: 4131 - DNA, 741 bp, Saccharomyces cerevisiae
  CDS (1)..(741)
atggcagaattttcagctgatctatgtctttttgacctagatggtaccatagtgagtacaacagtggccgcagagaaagcatggaccaagttgtgttacgaatacggtgttgatccttccgagttatttaagcattctcatggtgcaagaacacaagaggttttgagaaggtttttccctaaattggatgatacagacaataaaggtgttcttgctctagaaaaagatattgcccatagttacttggacacagtaagccttattcctggtgcagagaacttactgttatcgttagatgtagatactgagactcaaaaaaagttacctgaaaggaaatgggctatcgttacctctggttctccatatttggcattttcatggttcgagacaatattgaaaaatgttggaaagcccaaagttttcattactgggtttgacgtgaagaacggtaagcctgatcccgagggttattcaagagctcgtgatttattgcgtcaagatttgcaattaactggtaaacaggatctgaagtatgttgtcttcgaagatgcacccgtgggcataaaggccggcaaagcaatgggcgccattactgtgggtataacatcctcgtatgacaagagcgttttatttgacgcaggagcagattatgtagtctgtgatttgacacaggtttccgtggttaagaacaatgaaaacggtattgtcatccaggtaaacaaccctttgacaagggcctga

SEQ ID NO: 4132 - protein, 246 aa, Saccharomyces cerevisiae
MAEFSADLCLFDLDGTIVSTTVAAEKAWTKLCYEYGVDPSELFKHSHGARTQEVLRRFFPKLDDTDNKGVLALEKDIAHSYLDTVSLIPGAENLLLSLDVDTETQKKLPERKWAIVTSGSPYLAFSWFETILKNVGKPKVFITGFDVKNGKPDPEGYSRARDLLRQDLQLTGKQDLKYVVFEDAPVGIKAGKAMGAITVGITSSYDKSVLFDAGADYVVCDLTQVSVVKNNENGIVIQVNNPLTRA

SEQ ID NO: 4133 - DNA, 687 bp, Agrobacterium tumefaciens str. C58
  CDS (1)..(687): transl_table=11
atgcacagcaaagtcccgccgcagacccagatattttcgcaagagttcgcggccttcctgttcgacatggacggaacgctggtcaattcgattgccgttgtcgagcgcgtctggcgggagtgggccgttgcaaacggtatcgagccgaacgcatttctgcaacgtatccatggcatgcgggcttccgaggtaatacgccgcgaggcggttcccggcctggacgtggatgccgaggccgacatgatcttgcgcgccgagatggatgacgtggagggcatcattccgataccgggcgccgcagactttcttgcgtctttgcccgcgggaaaatgggctatcgtcacctccgccgtgcgtgaactggcggaaaaacggctcgcggcggccggcatcacaccgccacccgtgatgatctgcgccgacgatgtggtcaacggcaagcccgatcccgaaggttaccggaaggccgccgaaaggctcggcgttgcgccggaaagctgcgtcgtcttcgaagatgcgcccgcgggcatccaggccggcgaacgcatgggggctgcggtggtggtcatcaacgtgacccattcccacccgatcgagacgccgcatcttgccatcggcagttacggtgaactggatgtggtgatcgacgggaatggtggcctgaagctgaccagcagcaaagcctaa

SEQ ID NO: 4134 - protein, 228 aa, Agrobacterium tumefaciens str. C58
MHSKVPPQTQIFSQEFAAFLFDMDGTLVNSIAVVERVWREWAVANGIEPNAFLQRIHGMRASEVIRREAVPGLDVDAEADMILRAEMDDVEGIIPIPGAADFLASLPAGKWAIVTSAVRELAEKRLAAAGITPPPVMICADDVVNGKPDPEGYRKAAERLGVAPESCVVFEDAPAGIQAGERMGAAVVVINVTHSHPIETPHLAIGSYGELDVVIDGNGGLKLTSSKA

SEQ ID NO: 4135 - DNA, 663 bp, Yersinia pestis CO92
  CDS (1)..(663): transl_table=11
gtgcttgtggagtgtaaaggttttctttttgatttagatgggacgttggttgattcactacctgttgttgaacgtgcctggattggctgggcgcaacgtcgaggcgttaatccatcagaagttctggattttattcatggtaaacaagcgattacctctttgcgtcattttatgccgggtgccagtgaagctgaaattcaggacgagtttctggcattagagcaaattgaagccaatgatacggagggggtaactgcgctaccaggggcggtggcactgttgacccggttgaatgaactggctattccgtgggcgatagtgacttcaggttcgatacctgttgcctcagctcgccgggcggcaggttgtttgccagagccgaaagtgtttgtgaccgccgaattggtgaagcagggtaaacctgcgcccgatgcctatttattaggggccgaacgtttaggccttgcccctgcggattgtattgtggtggaagatgcccccgccgggatcctttcggggctagcggccggttgtcaggtgatcgcggttaatgcaccaacagataccccaaaactcgatcaggttgatctggtgcttcactcactggagcaattggtggtagacgccacttctcatggtgcggtggttcggttactgccttaa

SEQ ID NO: 4136 - protein, 220 aa, Yersinia pestis CO92
MLVECKGFLFDLDGTLVDSLPVVERAWIGWAQRRGVNPSEVLDFIHGKQAITSLRHFMPGASEAEIQDEFLALEQIEANDTEGVTALPGAVALLTRLNELAIPWAIVTSGSIPVASARRAAGCLPEPKVFVTAELVKQGKPAPDAYLLGAERLGLAPADCIVVEDAPAGILSGLAAGCQVIAVNAPTDTPKLDQVDLVLHSLEQLVVDATSHGAVVRLLP

SEQ ID NO: 4137 - DNA, 723 bp, Sinorhizobium meliloti 1021
  CDS (1)..(723): transl_table=11
ttgtgccgacctgcaaagcatgtgaactcgaaatccaagggacccggtttggacacgtcctcttccgcaatcttcacgaagaatttcgccgccctccttttcgacatggacggcacgctactcaactcgatggcagtcgttgaaagggtctggggatcctgggcactccgcaacggaatagatcccgtggcgctcatgaagatcgtccatggcgtgcgagccgtcgacacgatccgcgccctgggcctgccggtcgatccggaacaggaggcgcgtattcttgccgaggcggagattgccgatgtcgagggaattgtcgaaattccgggcgccgtctccttcctgaagacattgccgccggaaaggtgggcgatcgttacgtcggcgccgctcgaactcgccgcgcgccggctcgaggcggccggtattccggtgccgcgccacatggtgaccggtgaggatgtctcggtcgggaagcccgacccgcagggctatctgctcgcggcccagagactcggggtgcgtgccgaagattgcctcgtcttcgaggacgcgcctgcaggcgtgctcgcgggcaaatccgcgggcgccgaggtcgccgtcatcaccggggcgcatgccgcggcggccgagatgccgcatatcatgctgtcgcattacagcgacgtcgaggctcgcctcgtcgaggacgggtggctttcgctgcatcgccgccgcggctag

SEQ ID NO: 4138 - protein, 240 aa, Sinorhizobium meliloti 1021
MCRPAKHVNSKSKGPGLDTSSSAIFTKNFAALLFDMDGTLLNSMAVVERVWGSWALRNGIDPVALMKIVHGVRAVDTIRALGLPVDPEQEARILAEAEIADVEGIVEIPGAVSFLKTLPPERWAIVTSAPLELAARRLEAAGIPVPRHMVTGEDVSVGKPDPQGYLLAAQRLGVRAEDCLVFEDAPAGVLAGKSAGAEVAVITGAHAAAAEMPHIMLSHYSDVEARLVEDGWLSLHRRRG

SEQ ID NO: 4139 - DNA, 678 bp, Salmonella enterica subsp. enterica serovar Typhi str. CT18
  CDS (1)..(678): transl_table=11
atgcctgaggaggctcacgtgcagtgtaaaggttttctgtttgatctggatggaacgttggttgactcattacctgccgtcgaacgcgcgtggtgtagctgggccgatcgttttaaccttgctcatgatgaggtgctgggctttattcatggcaaacaggcgatcacctcgttgcggcattttatggcgggtaaatcggaggcggaaattgccgctgagtttacgcgcctggagcaaatagaagccactgaaaccgcagggatcaccgcgttgccgggggcagtcgatttactcaatcacctgaataaagcgggcattccgtgggctatcgtcacctccggttcaatgccggtcgcgcgtgcgcgccatcaggtcgcgggccttccagcgccagaggtgtttgtcaccgccgaacgagtcaaacgcggcaaaccggagccggatgcgtatttgctgggcgcacaactgcttggcctggcccctcaggagtgcgtcgtagtagaagatgccccggctggcgtgctgtccggactggctgcgggctgccacgtcattgcggtcaatgcgccggccgacacgccgcgtctggcggatgttgattttgcgttggatagcctgacgcaattatcggtcgctaaacaaccaaacggcgatgtggtggtgttaagaaagacctga

SEQ ID NO: 4140 - protein, 225 aa, Salmonella enterica subsp. enterica serovar Typhi str. CT18
MPEEAHVQCKGFLFDLDGTLVDSLPAVERAWCSWADRFNLAHDEVLGFIHGKQAITSLRHFMAGKSEAEIAAEFTRLEQIEATETAGITALPGAVDLLNHLNKAGIPWAIVTSGSMPVARARHQVAGLPAPEVFVTAERVKRGKPEPDAYLLGAQLLGLAPQECVVVEDAPAGVLSGLAAGCHVIAVNAPADTPRLADVDFALDSLTQLSVAKQPNGDVVVLRKT

SEQ ID NO: 4141 - DNA, 678 bp, Salmonella typhimurium LT2
  CDS (1)..(678): transl_table=11
atgcctgaggaggctcgcgtgcagtgtaaaggttttctgtttgatctggatggaacgttggttgactcattacctgccgttgaacgcgcgtggtgtagctgggccgatcgttttaaccttgctcatgatgaggtgctgggctttattcatggcaaacaggcgatcacctcgttgcggcattttatggcgggtaaatcggaggcggaaattgccgctgagtttacgcgcctggagcaaatagaagccactgaaaccgcagggatcaccgcgctgccgggggcagtcgatttactcaatcacctgaataaagtgggcattccgtgggctatcgtcacctccggttcaatgccggtcgcgcgtgcgcgccatcaggtcgcgggccttccagcgccagaggtgtttgtcaccgccgaacgagtcaaacgcggcaaaccggagccggatgcgtatttgctgggcgcacaactgcttggcctggcccctcaggagtgcgtcgtagtagaagatgccccggctggcgtgctgtccgggctggctgcgggctgccacgtcattgcggtcaatgcgccggccgacacgccgcgtctggcggatgttgattttgcgttggatagcctgacgcaattatcggtcgctaaacaaccaaacggcgatgtggtggtgttaagaaagacctga

SEQ ID NO: 4142 - protein, 225 aa, Salmonella typhimurium LT2
MPEEARVQCKGFLFDLDGTLVDSLPAVERAWCSWADRFNLAHDEVLGFIHGKQAITSLRHFMAGKSEAEIAAEFTRLEQIEATETAGITALPGAVDLLNHLNKVGIPWAIVTSGSMPVARARHQVAGLPAPEVFVTAERVKRGKPEPDAYLLGAQLLGLAPQECVVVEDAPAGVLSGLAAGCHVIAVNAPADTPRLADVDFALDSLTQLSVAKQPNGDVVVLRKT

SEQ ID NO: 4143 - DNA, 735 bp, Arabidopsis thaliana
  CDS (1)..(735)
atgaatggcttctctgatcttaatccttctgagagcaaaccttctctgtcacaactagctccattagaagccattctgtttgatgttgatggaacactctgtgactcagatcccatccaccttattgccttccaagaactgcttcaagagattggttttaacaatggtgtcccaatcgatgagaaattctttgttgagaacattgctggaaaacacaattctgaaattgctctacttctgttccctgatgatgtttcaagagggttaaaattctgtgatgaaaaggaagctctttaccgcaaaattgttgcagagaagataaagccacttgatgggcttataaaactgaccaaatggatcgaagatcgtggattgaaacgagctgcggtaacaaacgctccaaaagaaaacgcagagctcatgatatcgaaacttggtctgactgatttctttcaagcagtgattcttggctctgaatgtgaatttcccaaaccacaccctggaccttacttgaaggctcttgaagtgcttaacgtgtcaaaggagcacacgctagttttcgaagactcgatctctgggataaaagctggagttgcagctggaatgccagtgattggactgactacagggaatccagcaagcctgcttatgcaagcaaaacccgcttttctcatcgagaactatgcggatccaaaactgtgggctgtgttggaagaacttgataacaagtcttaa

SEQ ID NO: 4144 - protein, 244 aa, Arabidopsis thaliana
MNGFSDLNPSESKPSLSQLAPLEAILFDVDGTLCDSDPIHLIAFQELLQEIGFNNGVPIDEKFFVENIAGKHNSEIALLLFPDDVSRGLKFCDEKEALYRKIVAEKIKPLDGLIKLTKWIEDRGLKRAAVTNAPKENAELMISKLGLTDFFQAVILGSECEFPKPHPGPYLKALEVLNVSKEHTLVFEDSISGIKAGVAAGMPVIGLTTGNPASLLMQAKPAFLIENYADPKLWAVLEELDNKS

SEQ ID NO: 4145 - DNA, 651 bp, Streptomyces coelicolor A3(2)
  CDS (1)..(651): transl_table=11
atgaagctccacgcacaagccctcctgttcgacaacgacggcaccctcgtctcctccctggaatccgtccgccgctgctggacgcgctgggccgtcgagtacgggatcaccgccgagcagttcgggcaggtggaactgcacggacggccggccgccgagatagccgccgacctgctgcccaccgcgagggtcgccgaggcggtcgcgcggatcgaacagctggaggtcgaggacgtgccgggcgggggcgtgcgcctgctgcccggcacccgcgacttcctcgacgcgctcccggccgaccgctgggccgtcgtcacctccgccacccgccgcctggccgaggcccgcctcgacgccgtcggcatcctgcccaagaccctcgtggccgccgatgacatcacccgcggcaagcccgaccccgagccctatctgctcggcgcccgcgccctgggcgtcgacccggccgactgcgtcgtcttcgaggacgcccccgccgggctccaggccggccgggccgccgggatgcggaccgtggcgttggccacaacacaccgagccgacgaactcaacgccgacctcgtcgtcaccgacctctcggccttgtcggcactggccaccgagggcggagtcgagatcaccgtccggggctga

SEQ ID NO: 4146 - protein, 216 aa, Streptomyces coelicolor A3(2)
MKLHAQALLFDNDGTLVSSLESVRRCWTRWAVEYGITAEQFGQVELHGRPAAEIAADLLPTARVAEAVARIEQLEVEDVPGGGVRLLPGTRDFLDALPADRWAVVTSATRRLAEARLDAVGILPKTLVAADDITRGKPDPEPYLLGARALGVDPADCVVFEDAPAGLQAGRAAGMRTVALATTHRADELNADLVVTDLSALSALATEGGVEITVRG

SEQ ID NO: 4147 - DNA, 666 bp, Streptomyces coelicolor A3(2)
  CDS (1)..(666): transl_table=11
atgacggccaccgccagcaccgttctgcccgcccgcgccctgctgctcgacatggacggcaccctcgtcaactcggacgccgccgtggaccgcgtctggcggcgctgggccgaccggcacggactggacggcgacgaggtcatgaaggtcgtccacggacggcagggctacgcctcgatggcgctgctgctgccggaccggcccatggagcacaaccacgccgacaacgcgcgcatgctcgccgaggagaccgccgacaccgagggcgtcgtcgcgatccccggcgccgcggagttcctcgcctcgctgcgcgggctgccgcacgccctggtgacctcggccgacgtggccctgtccaccgcgcggatggccgccgccgggctcgcgcagccggacgtccgggtcaccgccgagtcggtcggcgcgagcaagcccgacccggagggcttcctcaagggcgccgccgaactgggcatcgcccccgccgactgcgtcgtcttcgaggactccggcgccggcatcgcggccgggcgcgccgccgggatgcgggtcgtcggggtaggaccgcgcgccgggttccacgggccggacgtggtcgtggaggacctgacgcgggtgcgtgtcgaggcagacgcggacggcgggctgcgcctgcacatcggctga

SEQ ID NO: 4148 - protein, 221 aa, Streptomyces coelicolor A3(2)
MTATASTVLPARALLLDMDGTLVNSDAAVDRVWRRWADRHGLDGDEVMKVVHGRQGYASMALLLPDRPMEHNHADNARMLAEETADTEGVVAIPGAAEFLASLRGLPHALVTSADVALSTARMAAAGLAQPDVRVTAESVGASKPDPEGFLKGAAELGIAPADCVVFEDSGAGIAAGRAAGMRVVGVGPRAGFHGPDVVVEDLTRVRVEADADGGLRLHIG

SEQ ID NO: 4149 - DNA, 684 bp, Brucella suis 1330
  CDS (1)..(684): transl_table=11
gtgacctccttttcccctttcggcaaatccttcgatgcatttcttttcgatatggacggcacgatattgagttccatcgcagcgacggagcgcgtatggagcgaatgggcaaggcgccatggtatcgatcccgtgacattcctgccgaccattcatggcgtgcgcgccgttgaaaccgtgcgccgccttgcgcttccgggcgttgacccaatccgggaagctgaaattctgctggaagccgaaatggccgatctggatggcattgcaccgatcgagggggcctatgaatttctgcattcgctaccggaaaaccgctgggccatcgtgacttcggctccgctcgaacttgcgcgccgccgcatcaaggccgccgggttgcccatgccgaaaacaatcgtttccgccgaagacgtggaacgcggcaagccaagccccgaatgtttcgagctgggcgcaaaacggctgggctttgcgccgcgtgattgccttgttttcgaggatgcaccggcaggcatcgtggcaggagaaaccgcgggcgcaagcgtggttgtcgtcacagccacgcatccgcattcaccccggacctcgcatttgagcatagaaagctatcgctatcttcaactcaccatcgaagaaagcggaaaactcagcctgagcccgacagtgccagcatcagttggctaa

SEQ ID NO: 4150 - protein, 227 aa, Brucella suis 1330
MTSFSPFGKSFDAFLFDMDGTILSSIAATERVWSEWARRHGIDPVTFLPTIHGVRAVETVRRLALPGVDPIREAEILLEAEMADLDGIAPIEGAYEFLHSLPENRWAIVTSAPLELARRRIKAAGLPMPKTIVSAEDVERGKPSPECFELGAKRLGFAPRDCLVFEDAPAGIVAGETAGASVVVVTATHPHSPRTSHLSIESYRYLQLTIEESGKLSLSPTVPASVG

SEQ ID NO: 4151 - DNA, 663 bp, Streptomyces avermitilis MA-4680
  CDS (1)..(663): transl_table=11
atgccggccgccgccaccgttctgaccgcccgggcccttctgctggacatggacggcaccctcgtcaactccgacgcggtcgtggagcgttgctggcgccgctgggccgaccggcacgggctggacgccgacgaggtgatgaaggtcgtgcacgggcggcaggggtacgcctccatggcggtgctgctgccggaccggcccatggagcagaacttcgccgacaatgcgcgcatgctcgccgaggagaccgccgacatggacggcgtggtcgagatcccgggtgccttcgcgttcctcgcctccctcgccgggctgccgcacgccctcgtgacctcggcggacgtgggactgtccacggcccggatggcggcggccgggctggagctgcccgacgtacgggtcacggccgagtccgtcggggccagcaagccggaccccgagggctttctgaagggcgccgccgaactgggcgtcgcgcccgaggactgtgtcgtcttcgaggactccggggcgggaatcgaggcggggcgctccgcggggatgcgggtcgtgggggtcgggccacgggcggccgcgcaccggccggatgtggtggtgcgggacctgacacaggtgcgggtcgaaagcgcgacggacgggacgatccggctgcacgtgggctga

SEQ ID NO: 4152 - protein, 220 aa, Streptomyces avermitilis MA-4680
MPAAATVLTARALLLDMDGTLVNSDAVVERCWRRWADRHGLDADEVMKVVHGRQGYASMAVLLPDRPMEQNFADNARMLAEETADMDGVVEIPGAFAFLASLAGLPHALVTSADVGLSTARMAAAGLELPDVRVTAESVGASKPDPEGFLKGAAELGVAPEDCVVFEDSGAGIEAGRSAGMRVVGVGPRAAAHRPDVVVRDLTQVRVESATDGTIRLHVG

SEQ ID NO: 4153 - DNA, 651 bp, Shigella flexneri 2a str. 2457T
  CDS (1)..(651): transl_table=11
gtgcggtgcaaaggttttctgtttgatcttgatggaacgctggtggattccctgcctgcggtagaacgggcgtggagcaactgggccagacgtcatgggttagcgccggaagaggtgctggctttcattcacggtaaacaggcgatcacctctttgcgccattttatggcgggcaaatccgaggctgatattgccgccgagtttacgcgtctggagcaaatcgaggccacggaaaccgaaggtattaccgcgcttcctggggcaatcgccttactcaatcatttgaataaagcaggtattccgtgggccattgtgacttctggctccatgccggtagcgcgagcgcgccataaaatagcggggcttcccgcaccagaggtgtttgtaaccgctgagcgagtgaagcgcggaaaaccagaacctgatgcgtatctgttaggtgcgcagctgctggggcttgcgccgcaggagtgtgtggtggtggaagatgctcccgctggcgtgctttctggcctggcggcgggttgccatgtcattgcggttaacgctccggcagataccccgcgcctgaatgaggtcgatttggtcctccacagtctggagcaaattactgtgaccaaacagccaaatggcgatgttattattcagtga

SEQ ID NO: 4154 - protein, 216 aa, Shigella flexneri 2a str. 2457T
MRCKGFLFDLDGTLVDSLPAVERAWSNWARRHGLAPEEVLAFIHGKQAITSLRHFMAGKSEADIAAEFTRLEQIEATETEGITALPGAIALLNHLNKAGIPWAIVTSGSMPVARARHKIAGLPAPEVFVTAERVKRGKPEPDAYLLGAQLLGLAPQECVVVEDAPAGVLSGLAAGCHVIAVNAPADTPRLNEVDLVLHSLEQITVTKQPNGDVIIQ

SEQ ID NO: 4155 - DNA, 735 bp, Magnaporthe grisea 70-15
  CDS (1)..(735)
atgggaagcatacaagtacccgagggcacctttaccgccccgccgcagcaggtttccctcgacggctttctcttcgacatggacggcaccatcatagactcgactagggccattgagatgcactgggcatcggttggcaaagagatcggagtggacccggagctcatcttgaagacctcacacgggcgtcgtagcatcgacacgctcaagatatattgcccagaaaaggcaaccattgagtacgcctcggagatggagggccgcctacccaagctctacagcaaagaggcagaggagatccccggcgcccgctcgctcctcgactccataatcgccgccaaggccgccccctgggccatcgtgacgtcgggaacaaagccgctggtcaacggctggctcgaggctctgaacctgccgcggcccgcgcacatgatcacggccgagtcggtcgagaacggcaagcccgatcccacctgctacctcatgggcctcgacgggctcggcctccgcgatcgcgccgctgacgtcctcgtgctcgaggacagccccgccgggatcctggccggcaaggcggccgggtgcaaagtgctcgggctggtcaccagccacaccgtcgagcaggtggtgggcgccggcccggactgggtggtcagggatttgtcgtctgtgaggctcgtcggcgctgagggtggaagggttactttggagattgtggatgcattggagtccaagtag

SEQ ID NO: 4156 - protein, 244 aa, Magnaporthe grisea 70-15
MGSIQVPEGTFTAPPQQVSLDGFLFDMDGTIIDSTRAIEMHWASVGKEIGVDPELILKTSHGRRSIDTLKIYCPEKATIEYASEMEGRLPKLYSKEAEEIPGARSLLDSIIAAKAAPWAIVTSGTKPLVNGWLEALNLPRPAHMITAESVENGKPDPTCYLMGLDGLGLRDRAADVLVLEDSPAGILAGKAAGCKVLGLVTSHTVEQVVGAGPDWVVRDLSSVRLVGAEGGRVTLEIVDALESK

SEQ ID NO: 4157 - DNA, 723 bp, Gibberella zeae PH-1
  CDS (1)..(723)
atgggatcgacaccagagtacatccagcctccacaggaactcacctttgatgggttcctgttcgacatggatggcaccattattgactccacggaagcagtggtcaagcattgggaaacaattggcaacgagataggcgttgcacccgaagttattcttgaaacttcccatggacgacgaagcattgatatcctcaagattcttgcacctaaaaaggccaattgggactatgtacgtgacatggagggacgtcttcccaagtaccacggccacgaggccgtcgagataccaggcgcccgttccatgctagaagctctcatcgccagatctagcccctgggcgatcgtcacgtcgggcactgtacctctcgtgactggatggttgcgtgctcgagacctgcctacaccgctgccggagcacctcgtcactgcagagtcggttgagaatggcaaacccgaccccgcctgctatcgccttggccgtgagcgtctcggcctacaagcggaggatgcccagattctggtccttgaagacagcccagcagggattcgtgcaggaaaggcagctgggtgcaaggtcctcggtctggtgacaagccataccgtcgagcaggtcgtcgccgcagagccagattgggttgttcgagacctctcctcagtcgaggtgcttcggagcgagggcggcaaggtgaccatcaaaatttccaatgccctgcgactatga

SEQ ID NO: 4158 - protein, 240 aa, Gibberella zeae PH-1
MGSTPEYIQPPQELTFDGFLFDMDGTIIDSTEAVVKHWETIGNEIGVAPEVILETSHGRRSIDILKILAPKKANWDYVRDMEGRLPKYHGHEAVEIPGARSMLEALIARSSPWAIVTSGTVPLVTGWLRARDLPTPLPEHLVTAESVENGKPDPACYRLGRERLGLQAEDAQILVLEDSPAGIRAGKAAGCKVLGLVTSHTVEQVVAAEPDWVVRDLSSVEVLRSEGGKVTIKISNALRL

SEQ ID NO: 4159 - DNA, 756 bp, Candida glabrata CBS 138
  CDS (1)..(756)
atgacagtcaagaaggacaaccagttcagtgtagatgtgtgtctgtttgatctagacggcactatcgtaagtaccacagtggcagctgagtctgcatggaggatgctatgtgcgaaagaaggagttgatcccgaggagctattcaaattctctcatggtgtcagaacatctgaggtgcttgctaagtttttcccaaacatcgacaacacagacaataagatgactagagagctggagttgtctatggcaaacaatttcttggatacggtgagcttgattcccggtgccaaagaccttctgttgacccttgacaaggatacagcacgccaaggagccaagttcaacgaaaggaagtgggcaattgtcacttcgggttccccagatttggccttttcttggttcaagaccatcttgaaagaggttggtaagccagacgtgtttattactgcttttgatgtgacaaaaggtaagcccgacccagaagggtacgccaaggccaagaagcttctgtgtgaaagactgcaatacgagagcgctagtgcgacatcagtggtctttgaagatgcaccagctggtataaaagcaggtaaggcaatgggcgcaataactgtagggattacgtctacttacgatctgcaaacgttgattgatgctggtgctgactatgtggttaaggacttgactcaagttgaagttttgaagaatacagaaggtgatcaaattacattagagattgaaaatcctctaaatcaatga

SEQ ID NO: 4160 - protein, 251 aa, Candida glabrata CBS 138
MTVKKDNQFSVDVCLFDLDGTIVSTTVAAESAWRMLCAKEGVDPEELFKFSHGVRTSEVLAKFFPNIDNTDNKMTRELELSMANNFLDTVSLIPGAKDLLLTLDKDTARQGAKFNERKWAIVTSGSPDLAFSWFKTILKEVGKPDVFITAFDVTKGKPDPEGYAKAKKLLCERLQYESASATSVVFEDAPAGIKAGKAMGAITVGITSTYDLQTLIDAGADYVVKDLTQVEVLKNTEGDQITLEIENPLNQ

SEQ ID NO: 4161 - DNA, 744 bp, Candida glabrata CBS 138
  CDS (1)..(744)
atgccagaaccaattactttgagagttaacgctgctcttttcgatgtcgatggtaccatcatcatttcccagccagctctagctgcattctggagagattttggtaaggataagccatacttcgatgctgagcatgtgatccatgtttcccatggttggagaacttacgatgctattgctaagtttgctccagacttcgccgatgaggaaaccgtcacaaagctggaaggtgaaatccctgataagtacggtaaggaagccatcgaggtcgctggtgccgtgaagctatgtaacagctttaacgagttgccaaaggaaaagtgggccgtggctacttccggtacaagagagatggcttccaagtggttcgctgttctaggcatcaagaagccaacatacttcatcactgctaacgatgtgaagaagggtaagcctaaccctgaaccatacctaaagggtagagaaggtctaggctacccaatcaacacacattaccctgagaagtctaaggttgtcgtctttgaagatgctccagctggtattgccgccggtaaagctgctggttgtaagatcatcggtatcgctaccactttctctgcctcttcgctgagagagaagggctgtgatatagtcattaaggatcacagatccgtcagggttgctggttacgacaaagagaccgacgaagtcatcctcgtattcgacgactatctatacgttagagatgatatccaaaagtggtag

SEQ ID NO: 4162 - protein, 247 aa, Candida glabrata CBS 138
MPEPITLRVNAALFDVDGTIIISQPALAAFWRDFGKDKPYFDAEHVIHVSHGWRTYDAIAKFAPDFADEETVTKLEGEIPDKYGKEAIEVAGAVKLCNSFNELPKEKWAVATSGTREMASKWFAVLGIKKPTYFITANDVKKGKPNPEPYLKGREGLGYPINTHYPEKSKVVVFEDAPAGIAAGKAAGCKIIGIATTFSASSLREKGCDIVIKDHRSVRVAGYDKETDEVILVFDDYLYVRDDIQKW

SEQ ID NO: 4163 - DNA, 747 bp, Candida glabrata CBS 138
  CDS (1)..(747)
atgtccacttctccagtttctttgaaagttaacgccgctctgttcgatgttgatggtactatcatcatctctcaaccagccattgctgctttctggagagatttcggtaaggataagccatacttcgatgctgaacatgttatccacatttctcatggttggagaacttacgatgccatcgccaagtttgctccagactatgctgatgaagaatacgttaacaagctagaaggtgaaattccagagaagtacggtgaacattccatcgaggttccaggtgccgtcaagctttgtacagatttgaacaagttgccaaaggaaaaatgggctgttgccacatctggtactagagatatggctcaaaaatggttcaagatcttgaacattgaaagaccagaatacttcattactgctaatgatgttaagcaaggtaagccattcccagaaccatacctaaagggtagagaaggtctaggtttcccaatcaacaaagaagatccatcaaagtccaaggtagttgtcttcgaagatgctcctgctggtatcgccgctggtaaggccgctggctgtaagatcatcggtattgccaccacttttgatgttgacttcttgaaggagaagggttgtgatatcattgttaagaaccacgaatctatcagagttggtggttacaacccagaaaccgatgaagtcgaattcattttcgatgactacctatacgccaaggatgacttattggaatggtaa

SEQ ID NO: 4164 - protein, 248 aa, Candida glabrata CBS 138
MSTSPVSLKVNAALFDVDGTIIISQPAIAAFWRDFGKDKPYFDAEHVIHISHGWRTYDAIAKFAPDYADEEYVNKLEGEIPEKYGEHSIEVPGAVKLCTDLNKLPKEKWAVATSGTRDMAQKWFKILNIERPEYFITANDVKQGKPFPEPYLKGREGLGFPINKEDPSKSKVVVFEDAPAGIAAGKAAGCKIIGIATTFDVDFLKEKGCDIIVKNHESIRVGGYNPETDEVEFIFDDYLYAKDDLLEW

SEQ ID NO: 4165 - DNA, 750 bp, Candida glabrata CBS 138
  CDS (1)..(750)
atgtctctagctaagccagtttctttgaaggttaacgccgctctattcgatgtcgatggtactatcatcatctctcaaccagctatcgctgctttctggagagatttcggtaaggacaagccatacttcgacgccgaacacgttatccacatctctcacggttggagaacttacgatgccatcgctaagttcgctccagactacgccgatgaagaatacgtcaacaagctagaaggtgaaatcccagaaaagtacggtgaacactccatcgaggtcccaggtgccgtcaagctatgtactgacctaaacaagttgccaaaggagaagtgggctgttgccacctccggtaccagagacatggcccaaaagtggttcaagttcttgaacatcgacagaccagaatacttcatcaccgctaacgatgtcaagcaaggtaagccattcccagaaccatacatcaagggtagagaaggtctaggttacccaatcaacaaggaagacccatctaagtccaaggttgttgtcttcgaagacgccccagctggtatcgctgctggtcaagctgccggttgtaagatcatcggtatcgccactaccttcgacgtcgacttcctaaaggaaaagggttgtgacatcatcgtcaagaaccacgaatccatcagagttggcggttacaacccagaaaccgatgaagtcgaattcatcttcgatgactacttgtacgccaaggatgacttgttgaagtggtaa

SEQ ID NO: 4166 - protein, 249 aa, Candida glabrata CBS 138
MSLAKPVSLKVNAALFDVDGTIIISQPAIAAFWRDFGKDKPYFDAEHVIHISHGWRTYDAIAKFAPDYADEEYVNKLEGEIPEKYGEHSIEVPGAVKLCTDLNKLPKEKWAVATSGTRDMAQKWFKFLNIDRPEYFITANDVKQGKPFPEPYIKGREGLGYPINKEDPSKSKVVVFEDAPAGIAAGQAAGCKIIGIATTFDVDFLKEKGCDIIVKNHESIRVGGYNPETDEVEFIFDDYLYAKDDLLKW

SEQ ID NO: 4167 - DNA, 741 bp, Candida glabrata CBS 138
  CDS (1)..(741)
atgtcaaaccagtttactgtagacctctgcctctttgacctcgatggaaccattgtcagcaccaccagagctgtcgagatgacctggaagaagctttgcgcagagcatgacgttgatccagaagagctattccgtttctcccacggtactagaactggtgaagtatttgctaaattcttcccagacattgacaacactggtaacagggcagctgtggcattcgagttgtcaatagccgatgatctaagtcttatctcgttgattccaggtgcccaagaactactgttgaaattagacaagaacacgacagatggctctgcagttggtgagcgcaaatgggcaatagtcacatcaggatcaccagaattgacactgtcgtggtttgataatgtcttaaaggaagtcggaagaccacccgtgttcatttctggtgccgatgtagcaaagggcaagcccgatccagaaggatactacactggacggaatctactatgtcagaaactaggtcttgacgcttctcatgcgaggacagtggtatttgaggatgctcccgtaggtatcatggctggtaaagctattggtgccattacagtgggaatcgcaggtacatatgacaaggacttattgtattcagcaggtgctgactatgtagtttcagaccttaaccaggtgaaagtaattgaaaacacaaaaggtggccccatcaaactggaaattgtagaaccactaggtaagatatag

SEQ ID NO: 4168 - protein, 246 aa, Candida glabrata CBS 138
MSNQFTVDLCLFDLDGTIVSTTRAVEMTWKKLCAEHDVDPEELFRFSHGTRTGEVFAKFFPDIDNTGNRAAVAFELSIADDLSLISLIPGAQELLLKLDKNTTDGSAVGERKWAIVTSGSPELTLSWFDNVLKEVGRPPVFISGADVAKGKPDPEGYYTGRNLLCQKLGLDASHARTVVFEDAPVGIMAGKAIGAITVGIAGTYDKDLLYSAGADYVVSDLNQVKVIENTKGGPIKLEIVEPLGKI

SEQ ID NO: 4169 - DNA, 771 bp, Kluyveromyces lactis NRRL Y-1140
  CDS (1)..(771)
atgtctgctgctaccgcctctaacactgctcaacaacctatctctctaagagtcaacgctgctttgttcgacgttgatggtactttgatcatctctcaaccagctattgctgaattctggagagatttcggtaaggacaagccttacttcgactcccaacatgtcatcgatatctctcacggatggagaacatacgatgttatcaagcagttcgctccagattacgccaacgaagaatatgtcaccaagttggaaggtgaaatcccagaaaaattcggtcaacacgctatcgaagttccaggtgccagtaaattgtgtggtgaattgaacaagcttccaaaggaaaaatgggctgtcgccacctccggtacttacgaaatggctcacaaatggtttgacatcttgggaatcaagagaccttctaactttatcaccgctaacgatgtcaagaacggtaagcctcatccagaaccttatttaaagggcagaaacggtttgtcttacccaatcaacaaagaaaacccagccgcttcaaaggttattgtctttgaagatgctccagcaggtatcttggccggtaaagctgctggctgtaagatcgttggtattgccactactttcgacaaggaattcttgatcgaaaagggttgcgatatcgtcatcaaggaccacaccaagttgagagttgctgcctaccaccctgaaaccgatgaagttgaattcatctttgacgaatacttatatgccaaggatgatctacttgaatggtaa

SEQ ID NO: 4170 - protein, 256 aa, Kluyveromyces lactis NRRL Y-1140
MSAATASNTAQQPISLRVNAALFDVDGTLIISQPAIAEFWRDFGKDKPYFDSQHVIDISHGWRTYDVIKQFAPDYANEEYVTKLEGEIPEKFGQHAIEVPGASKLCGELNKLPKEKWAVATSGTYEMAHKWFDILGIKRPSNFITANDVKNGKPHPEPYLKGRNGLSYPINKENPAASKVIVFEDAPAGILAGKAAGCKIVGIATTFDKEFLIEKGCDIVIKDHTKLRVAAYHPETDEVEFIFDEYLYAKDDLLEW

SEQ ID NO: 4171 - DNA, 807 bp, Kluyveromyces lactis NRRL Y-1140
  CDS (1)..(807)
atgccttctattgctgttgactacgttcttttcgacttagatggcacattggtgagttccaccgatgcggctgaagaggcttggaataagctctgtgacaagtatggtgttgattattcaacactttctaaggtctcacatggttccagaactgcggagatcttagcgaagttctttcctaacgttgacaacactaataatcaggcagtcaaggaatttgaactttctattgccaatgattacatggatatcgtttgtttgattccaggttctatagatttactgatctcgttggatagaccaactggggcacaccctggtgaagttttccatcatagaaagtgggctgtagttaccagtggatcgccttgggttgctcatgcatggtttgacaacttgttaaaatccattaagaaaccagaggtattcattactgcttttgatgtttcaaagggtaaacctgacccagccggtttcgctctggccactaaacgtttgaaggaaatatggcaagatgacagaaaggaggtaagaacggtggttttcgaggatgcgcctgttggagttcaagctggtaaggccaatggctcaattgtagttgccttaaccagtacttatgataaggagttattatttgcagcgggcgcggattatgtggttgaagatttatcacaagtttgcttgcagtccaataataaagatgagactgttctaaccatcactgatccaatacctagaggtgaagaagcagaatatggtgatgacgatgatgacgatgatgacgatgatgataatgataacgaataa

SEQ ID NO: 4172 - protein, 268 aa, Kluyveromyces lactis NRRL Y-1140
MPSIAVDYVLFDLDGTLVSSTDAAEEAWNKLCDKYGVDYSTLSKVSHGSRTAEILAKFFPNVDNTNNQAVKEFELSIANDYMDIVCLIPGSIDLLISLDRPTGAHPGEVFHHRKWAVVTSGSPWVAHAWFDNLLKSIKKPEVFITAFDVSKGKPDPAGFALATKRLKEIWQDDRKEVRTVVFEDAPVGVQAGKANGSIVVALTSTYDKELLFAAGADYVVEDLSQVCLQSNNKDETVLTITDPIPRGEEAEYGDDDDDDDDDDDNDNE

SEQ ID NO: 4173 - DNA, 762 bp, Debaryomyces hansenii CBS767
  CDS (1)..(762)
atgacaattcaaaaacaaccagctgtcttctacgttaacgctgctttattcgactgtgacggaacgttagtcaattctaccggagctatttcagaattctggagagatttcggaaagactagacctcacgtcaacccagatgaaatcatcagcacctcgcacggatgtcgtacattcgatgtgattgcaaaatggtcaccagaagatgctattgaagaacaagtcaccgaatgggaaggatctattccagattcttttggtcaattcgctaagccaattcctggtgcagttgaattagtcaagtcttttgacaagttctccaagagcgaaactgaaaatggtaaacaaagatgggctattgtgacatctggtactttaccattggccaccaagtggttgaagttgttgaccatcgaaaaaccagactgtttcatcaccgctgaaaaggtcaccaagggtaagccacatccacaaggataccaatctgctagagagaccttaggttacaagggtgctcacaacaaggttgttgtcttcgaagatgctcctgctggtatcactgctggtaagggtgctggtgctttcattgttggtatctgttccacctacgacccagaaaaggttagaaaggctggtgctgacattgttgttgacgacttgacctcgttcagaatcgactcctacaacaaggaaaccgatgaattcaaggttattgtggatgactaccattacgccaacgacgaattcttgcaatccgtctaa

SEQ ID NO: 4174 - protein, 253 aa, Debaryomyces hansenii CBS767
MTIQKQPAVFYVNAALFDCDGTLVNSTGAISEFWRDFGKTRPHVNPDEIISTSHGCRTFDVIAKWSPEDAIEEQVTEWEGSIPDSFGQFAKPIPGAVELVKSFDKFSKSETENGKQRWAIVTSGTLPLATKWLKLLTIEKPDCFITAEKVTKGKPHPQGYQSARETLGYKGAHNKVVVFEDAPAGITAGKGAGAFIVGICSTYDPEKVRKAGADIVVDDLTSFRIDSYNKETDEFKVIVDDYHYANDEFLQSV

SEQ ID NO: 4175 - DNA, 726 bp, Debaryomyces hansenii CBS767
  CDS (1)..(726)
atgtctcataaaagtattatagctgatttcctattgttcgacttagatggtactcttgtaaattcaacacttgctgtagaaaagacatggattgaacaatgcaataatcataattcaacaaatgaagtacctatcgatgctgagattttattaaattcagcacatggaacaagaacggctgaaacaatcaaaagatggtttccttatttacaaaacgacaaagagtctattaatctttttgaaaaagccattgttacaaattatgggcatttagcggaagaggtcaagggtgcaacacatttgatcgatagtataaataagtttggaagtaatcagtgggctataataacttctggtactaaagatttagcatatgggtggtttgaaaaattatttgtaaattctggcaagccaaaggttttcattactgcaaatgatgtttcgcaaggtaagccgaatcccgaaggctacttggaggcatttagtcaattaaaagagacaaacaaactagttggtcatgaattttctgctgttgttttcgaagacgccccggtgggtattcaagcgggtattgctgcagggtttcatgttattgggattgcaactacttttgataaggatactttaataaacgcaggatcatcatttgtagtcgaagatttgtcaaaaatacacattacgaaaactacttcaacatcattccaattagatttggatatattataa

SEQ ID NO: 4176 - protein, 241 aa, Debaryomyces hansenii CBS767
MSHKSIIADFLLFDLDGTLVNSTLAVEKTWIEQCNNHNSTNEVPIDAEILLNSAHGTRTAETIKRWFPYLQNDKESINLFEKAIVTNYGHLAEEVKGATHLIDSINKFGSNQWAIITSGTKDLAYGWFEKLFVNSGKPKVFITANDVSQGKPNPEGYLEAFSQLKETNKLVGHEFSAVVFEDAPVGIQAGIAAGFHVIGIATTFDKDTLINAGSSFVVEDLSKIHITKTTSTSFQLDLDIL

SEQ ID NO: 4177 - DNA, 795 bp, Debaryomyces hansenii CBS767
  CDS (1)..(795)
atgtctttgaaaccagctaataaaattccagcagtattttatgttaatgcagcattatttgactgcgatggtacattagtcaactctacaggagcaatttctgagttttggagggggtttgcagaaaccagaccgcatgttgatgctgatgagatcataaaaacatcacatggttgtagaaccttcgatgtcattgctaagtggtcaccagacgatgcagtagaaaaacaagttacggaatgggaagcgtcgattcctgaatcattcggtcaatatgcaaagccgattccaggggctgttgagctagttaaaagattcgatgagatatcacgaacccaaactgataataagcatcaaagatgggcgattattacctctggtactttgccattggcttctaaatggttgaaattattaacaattgagaagcctgattgttttatcacagctgaaaaagtggcgcaaggaaaacctcatccacaagggtaccaatcggcgagagaaaatctaggatatgatgcaccccataagaaggttgtcgtttttgaagatgcccctgcaggtatcaaggctggtaaaggtgcaggagctatgattgttggtatatgttcaacctatgaccctgaaaaggtttgggaatcgggtgcagatatagtggtgaaagatttatcgtcatttgaaatagatcattataatcctgagactgacgaatttagagtggttgttaacgaatattattatgccaacgagcaatatactattcgtcgtaagtcacttgttggcttagaggtttag

SEQ ID NO: 4178 - protein, 264 aa, Debaryomyces hansenii CBS767
MSLKPANKIPAVFYVNAALFDCDGTLVNSTGAISEFWRGFAETRPHVDADEIIKTSHGCRTFDVIAKWSPDDAVEKQVTEWEASIPESFGQYAKPIPGAVELVKRFDEISRTQTDNKHQRWAIITSGTLPLASKWLKLLTIEKPDCFITAEKVAQGKPHPQGYQSARENLGYDAPHKKVVVFEDAPAGIKAGKGAGAMIVGICSTYDPEKVWESGADIVVKDLSSFEIDHYNPETDEFRVVVNEYYYANEQYTIRRKSLVGLEV

SEQ ID NO: 4179 - DNA, 711 bp, Aspergillus nidulans FGSC A4
  CDS (1)..(711)
atggctgccacgggctcattctctgcccctccacaagtactcacatttgatggtcttctatccgactttgatggcaccatcgttgattcgacggatgctatcgtaaagcactggcataaaatcggtgctgaactcggtgtcgacccgaagacaattttggctacatctcacggccgccgaagtattgatactctacagctgtatgaccccgcaaaagccaactgggaatacgtcagctacatcgagggactcatccccaaagagtacggttctgacgctattgaaatccccggcgcgcggtccatccttgctgccctcgaagagaccggcgcaacctggggcgttgtgacgtcggggacgcgcgcgctcattgacggctggctgggtgttctcaagctcacacatccagatgtcctcgttgttgcggaggatgtagaactcgggaagccagatccgcgatgctacctgcttggacgaaagaaaatgggtctagaacattcctcctcgatagtggtgctggaggatgcgccgtcaggcataaaggctggcaaggcagccggtttcactgtcattgctttgaccaccactcacactttggagcagcttcaagcggctggggcggacgtgatagtggaggatttgaggagtattagcgtaaagggtgttgttgacgggcgtgttcagttggaggttcggaatgccttccaatag

SEQ ID NO: 4180 - protein, 236 aa, Aspergillus nidulans FGSC A4
MAATGSFSAPPQVLTFDGLLSDFDGTIVDSTDAIVKHWHKIGAELGVDPKTILATSHGRRSIDTLQLYDPAKANWEYVSYIEGLIPKEYGSDAIEIPGARSILAALEETGATWGVVTSGTRALIDGWLGVLKLTHPDVLVVAEDVELGKPDPRCYLLGRKKMGLEHSSSIVVLEDAPSGIKAGKAAGFTVIALTTTHTLEQLQAAGADVIVEDLRSISVKGVVDGRVQLEVRNAFQ

SEQ ID NO: 4181 - DNA, 723 bp, Candida albicans SC5314
  CDS (1)..(723): transl_table=12
atgacagaaatcgtcactattaacacaagcgtccttttattcgatcttgacggtacattggtcgattccactgctgctgttgaaaagacttgggaaaaccaagtgaatcaacacaatcaagagtttccagacaaatttattgatttacctacattgttgaatgtctcccatggatcacgtactgttgaaacatttgctgcttatttcccggaattaaaaactgacagagattctgtgtatgcatgggaaatgggtattgtgcaaaattatggacatttgggtaaagcaatcaatggttcagtacaaactttaatcacattgaatgaaaaaaataatccatgggctattgttacatcagccaaccctaaattagctgggttttggttggacaagttgtttcatggtgtcaagaaacccgatgtttttataactgcaagtgatgtaagtaaaggcaaaccagaccctgaaggatattgtacagcatttgaaagattgaaaaaagtttataatttgaatggttctgctaagggagttgtatttgaggatgcacctgctggtattaaagctggtgttaatggtggtttcacagttgtgggcatagctagcacttttccaaaagaagtcttgttacaagccggcgccacttatgttgttgaagattttaccaaagttaaaatcgagcaatcaggggaagcagttaaactagttttagaaattctttag

SEQ ID NO: 4182 - protein, 240 aa, Candida albicans SC5314
MTEIVTINTSVLLFDLDGTLVDSTAAVEKTWENQVNQHNQEFPDKFIDLPTLLNVSHGSRTVETFAAYFPELKTDRDSVYAWEMGIVQNYGHLGKAINGSVQTLITLNEKNNPWAIVTSANPKLAGFWLDKLFHGVKKPDVFITASDVSKGKPDPEGYCTAFERLKKVYNLNGSAKGVVFEDAPAGIKAGVNGGFTVVGIASTFPKEVLLQAGATYVVEDFTKVKIEQSGEAVKLVLEIL

SEQ ID NO: 4183 - DNA, 765 bp, Candida albicans SC5314
  CDS (1)..(765): transl_table=12
atgacaaagactcaacaaccagctgttttttacgttcacgccgctttatttgactgtgatggtactttggttaactccactggtgctatttctgaattctggagagatttcggaaaaactagacctcatgttgatccagaagaaattatcagaacttcccatggttgccgtacatttgatgtcattgccaaatggtcaccagaagatgcaattgaagaacaagtcactgcatgggaaggtgctattcctgacacttttggccaccacgccaagccaattccaggttccgttgaattggtaaaatcattcgataaactttctaaagaagctactgaaaatggtaaacaaagatgggctgttgtcacttctggtactttgccattagccaccaaatggttgaaattattgtctattgaaaggccagactgttttataaccgctgaaaaagtgactaaaggtaaaccacatccacaaggttaccaagctgctagagatactttgggataccatgacgcccactacaaagttgttgtgtttgaagacgctccagctggtataaccgcaggtaaaggtgctggcgccatggttgtcggtatttgctcaacttacgatcctgaaaaagttagaaaatcaggtgctaacattgttgtcaaagatttatccagctttagaatcgactcatacaacaaggaaactgacgaattcaaggttgttgttgatgattatttctacgctgatgagcaatttttacaagaatctgcttaa

SEQ ID NO: 4184 - protein, 254 aa, Candida albicans SC5314
MTKTQQPAVFYVHAALFDCDGTLVNSTGAISEFWRDFGKTRPHVDPEEIIRTSHGCRTFDVIAKWSPEDAIEEQVTAWEGAIPDTFGHHAKPIPGSVELVKSFDKLSKEATENGKQRWAVVTSGTLPLATKWLKLLSIERPDCFITAEKVTKGKPHPQGYQAARDTLGYHDAHYKVVVFEDAPAGITAGKGAGAMVVGICSTYDPEKVRKSGANIVVKDLSSFRIDSYNKETDEFKVVVDDYFYADEQFLQESA

SEQ ID NO: 4185 - DNA, 849 bp, Ustilago maydis 521
  CDS (1)..(849)
atggtcaagacagtcagcgtcgaggtcgacaccatcctgtttgacatggatggcacgttgatcgattccacccctgctgtaaatgccacatgggcttcatttgcgcagcaatacaatctcgacctgtcctttgtcatgcaaacgtgccacggctaccgaacggttgagaatcttcgacgattcatcccatcgatctcggatgctgagttgcccaaagaagtggaacggttcgagtccaacattttggttgttgcaaagcagaatgcggcgaaagggcaaggtggatcgattgttgctatgcctggagccaaggagttgctggatcagatcaattcgggacgtccggatgctgcggtagagaaaggcaactacggctgggctatagttaccagtgcaaccaaggcgtacgcacaacaaggttttgcaagtgccggtgtgagcagtccgcccgaggtattcattacctcggacctttgcacaaaaggcaagcctgatccacaaccataccttatgggcgccgagaagaccggccaagatatcagtcgctgtcttgtcgtagaagatgcgccaccgggcgtacgtgcaggcaagcgtgcaggcgccaaaaccctcgcattgagaaccacccatgacggcgaaaaaatgcaacaagaaggcgccgactacatcgtcgaagatctacgaagcgtacaggccaagtggaaacacgatggaagcggactcgtcttaacaatccaagcagagcaacccgagaaaggcgaggcaaaaggtatctccgagttggcgaaacagattcagttgcagaacgatcccacctcaaacacccacgccgtcaacggtcagccgtag

SEQ ID NO: 4186 - protein, 282 aa, Ustilago maydis 521
MVKTVSVEVDTILFDMDGTLIDSTPAVNATWASFAQQYNLDLSFVMQTCHGYRTVENLRRFIPSISDAELPKEVERFESNILVVAKQNAAKGQGGSIVAMPGAKELLDQINSGRPDAAVEKGNYGWAIVTSATKAYAQQGFASAGVSSPPEVFITSDLCTKGKPDPQPYLMGAEKTGQDISRCLVVEDAPPGVRAGKRAGAKTLALRTTHDGEKMQQEGADYIVEDLRSVQAKWKHDGSGLVLTIQAEQPEKGEAKGISELAKQIQLQNDPTSNTHAVNGQP

SEQ ID NO: 4187 - DNA, 714 bp, Cryptococcus neoformans var. neoformans B-3501A
  CDS (1)..(714)
atgtccaagaccaccaccactaccacccgggccatgctcttcgacatggacggtactcttctcgactctactcccgccgtgttggccacttgggagtattttgccaaggagtatgatcttgaccttcaccaggttttgcgtacttcccacggagtgagaactattgacaacatgaggaaatggtgcggaatcgaggaccctatccaactgagggatgcaaccgagacctttgagagcatgattgtcaccgaggccaagcaactgcaggctgctggcaaggaaggccttatcgcccttcctaatgtccttccccttctcaacaagctcaacgcctcccccatccctgtctgggctattgtcacctctgcaaccactgtctatgcctctgctgccttgccaacagctggtatccccgaaacgcccaaattgattactggtgatgatgttcgtaatggaaagcctgacccagagccttatttggcgggcgccaaagctctcgatgtggatgtcaaagattgtgttgtcgtagaagacgccccttcaggtatcaagtctggtgttgctagtggcgcaagggtcttggccgtctgcacatcccacaccagagaacaattagaaaatatcggtgccacctggatcgtgactgacctatctcgagtaacattcgagattgaaggcggacgagtgaagttgaccatcgacgagaccccttag

SEQ ID NO: 4188 - protein, 237 aa, Cryptococcus neoformans var. neoformans B-3501A
MSKTTTTTTRAMLFDMDGTLLDSTPAVLATWEYFAKEYDLDLHQVLRTSHGVRTIDNMRKWCGIEDPIQLRDATETFESMIVTEAKQLQAAGKEGLIALPNVLPLLNKLNASPIPVWAIVTSATTVYASAALPTAGIPETPKLITGDDVRNGKPDPEPYLAGAKALDVDVKDCVVVEDAPSGIKSGVASGARVLAVCTSHTREQLENIGATWIVTDLSRVTFEIEGGRVKLTIDETP

SEQ ID NO: 4189 - DNA, 753 bp, Cryptococcus neoformans var. neoformans B-3501A
  CDS (1)..(753)
atggccccaattaccatcaaggcaagaggtatcctcttcgatctcgacggtactttgatcagctcgacaacgatatgcgagtctgtatggcataagtgggcggaagtgtaccccgtcgatcttacagaggtgttcaagagttctcacggtatcaggaccagagaactgctgcgccactggctcaacatcactgatccggtggagcttgagacagccactgagaagtttgagaccgacgtactcaaagaggcccaacggcttgcgtcgattggtaaaggtggaattactttactccccggggttgagaagctcttactagccctcaatgcagcctctaaggatgctgcgagatgggctattgtcacttctgcgaccaatgcgtatgccaccaatgccatcaccactctttctctccccaggacttctcatcttatcaccgcagatgaggtttcacaaggcaagccccaccccgagccatacatcatgggtgctgcagcccttggattgaagccaacagactgtatcgtctttgaggatgccccatcaggagtgaaagcaggagttgcgagtggcgcacgagtggttgcggtttgcaccagtcacaaaaggtcagctttggagggattaggtgcgcatttgatcgttgagaacctttcagacatcaatcttgacactgaaggggacgagggttatcagtgggatcatctgaattactgcttccatcgttcggtatgctacattttgcatcagtga

SEQ ID NO: 4190 - protein, 250 aa, Cryptococcus neoformans var. neoformans B-3501A
MAPITIKARGILFDLDGTLISSTTICESVWHKWAEVYPVDLTEVFKSSHGIRTRELLRHWLNITDPVELETATEKFETDVLKEAQRLASIGKGGITLLPGVEKLLLALNAASKDAARWAIVTSATNAYATNAITTLSLPRTSHLITADEVSQGKPHPEPYIMGAAALGLKPTDCIVFEDAPSGVKAGVASGARVVAVCTSHKRSALEGLGAHLIVENLSDINLDTEGDEGYQWDHLNYCFHRSVCYILHQ

SEQ ID NO: 4191 - DNA, 675 bp, Erwinia carotovora subsp. atroseptica SCRI1043
  CDS (1)..(675): transl_table=11
atgaaaaaggggctttctgtggagtgtaaaggttttctgttcgacctcgatggtacgctagttgattcactgcctgctgtagaacgcgcgtggattaactgggcaaaagatcacgatattgaaccacaggaagtgctcgactttattcatggtaagcaggcaattacgtccttgcgtcactttcttcaggggcagagcgaagaaacgattcaacaggagtttgatgcgctggagaaaacagaggcttctgatacgcaaggtattgttgccatgcctggagcgaaggcgctgttggaacgtttagatgcgctggatatcccctgggcaattgtgacatctggcacggtgccaattgccagcgcacgtcatcaacgcggagaactacccgcacctcgcgcctttattacggcggagcaagtcgccaaaggcaagccgaatcctgatgcttatttacttggcgcacagcagttagggctgaagccggaagagtgtgtggtcgttgaggatgcgccagcgggcgtgctatcgggtctggcggctggctgcaaagtcatcgcggtgaaagcgccagcggatacgccgaaactggatcaggtcgatctgattcttgattcgctggagcagatagaaatagaacaattaccgaacggcgctaaggtgcttctgcgccagtag

SEQ ID NO: 4192 - protein, 224 aa, Erwinia carotovora subsp. atroseptica SCRI1043
MKKGLSVECKGFLFDLDGTLVDSLPAVERAWINWAKDHDIEPQEVLDFIHGKQAITSLRHFLQGQSEETIQQEFDALEKTEASDTQGIVAMPGAKALLERLDALDIPWAIVTSGTVPIASARHQRGELPAPRAFITAEQVAKGKPNPDAYLLGAQQLGLKPEECVVVEDAPAGVLSGLAAGCKVIAVKAPADTPKLDQVDLILDSLEQIEIEQLPNGAKVLLRQ

SEQ ID NO: 4193 - DNA, 714 bp, Leifsonia xyli subsp. xyli str. CTCB07
  CDS (1)..(714): transl_table=11
atgcagcagctgaccgcggccggattcctcttcgatatggacggcactctcgtcgactccacccccgtcgtggaggcggtgtggaccgagttcagccgggcgaacggcctcgaccccgccgaggttctcgggtacgcgcacggccgtcaggcgatcgacaccctggcacgcttcctcccgcagcgttcccctgccgagcgcggcgaactcctctccgcccttgtcgccgaggaggtcgcccgcaccgagggcatcgtggaggtgcccggggccggggcgctcctgaccgcgctgatcggcgccggcgcccccgtcgccgtggtcaccagcgcaccgcgcgagctggccgttgcccggatgacggcggcgggtgtcccggtcccgcctgtcctggtggcggcggaggacgtcgagcgcggcaagcccgacccgcaggcctacctgctggctgccgagagactgggcgttcccgctgcgtcctgcttcgccttcgaggacgcgccggccgggctggccgccgctgtcgcctccggtgcgtgtgtggtcgtcgtcggcgtgtacgagtccgccgtgagcgaggggctcggacgggtcctcgactacgtgggtgagctctcggtcaccgaggccggaggagagtggagcaccggccttgtcgccgcatccacgacaccggctgcgcgcacggcggcaggccagccctcggcgcggtag

SEQ ID NO: 4194 - protein, 237 aa, Leifsonia xyli subsp. xyli str. CTCB07
MQQLTAAGFLFDMDGTLVDSTPVVEAVWTEFSRANGLDPAEVLGYAHGRQAIDTLARFLPQRSPAERGELLSALVAEEVARTEGIVEVPGAGALLTALIGAGAPVAVVTSAPRELAVARMTAAGVPVPPVLVAAEDVERGKPDPQAYLLAAERLGVPAASCFAFEDAPAGLAAAVASGACVVVVGVYESAVSEGLGRVLDYVGELSVTEAGGEWSTGLVAASTTPAARTAAGQPSAR

SEQ ID NO: 4195 - DNA, 663 bp, Yersinia pseudotuberculosis IP 32953
  CDS (1)..(663): transl_table=11
gtgcttgtggagtgtaaaggttttctttttgatttagatgggacgttggttgattcactacctgttgttgaacgtgcctggattggctgggcgcaacgtcgaggcgttaatccatcaaaagttctggattttattcatggtaaacaagcgattacctctttgcgtcattttatgccgggtgccagtgaagctgaaattcaggacgagtttctggcattagagcaaattgaagccaatgatacggagggggtaactgcgctaccaggggcggtggcactgttgacccggttgaatgaactggctattccgtgggcgatagtgacttcaggttcgatacctgttgcctcagctcgccgggcggcaggttgtttgccagagccgaaagtgtttgtgaccgccgaattggtgaagcagggtaaacctgcgcccgatgcctatttattaggggccgaacgtttaggccttgcccctgcggattgtattgtggtggaagatgcccccgccgggatcctttcggggctagcggccggttgtcaggtgatcgcggttaatgcaccaacagataccccaaaactcgatcaggttgatctggtgcttcactcactggagcaattggtggtagacgccactgctcatggtgcggtggttcggttactgccttaa

SEQ ID NO: 4196 - protein, 220 aa, Yersinia pseudotuberculosis IP 32953
MLVECKGFLFDLDGTLVDSLPVVERAWIGWAQRRGVNPSKVLDFIHGKQAITSLRHFMPGASEAEIQDEFLALEQIEANDTEGVTALPGAVALLTRLNELAIPWAIVTSGSIPVASARRAAGCLPEPKVFVTAELVKQGKPAPDAYLLGAERLGLAPADCIVVEDAPAGILSGLAAGCQVIAVNAPTDTPKLDQVDLVLHSLEQLVVDATAHGAVVRLLP

SEQ ID NO: 4197 - DNA, 714 bp, Thermobifida fusca YX
  CDS (1)..(714): transl_table=11
atgggcttgaggacaaccgagagcgagtgggcgacgccgcgcgcggccctgttcgacctcgacggaactctcatcaacagcgaaccgcggagtgtggcggtgtgggccagggtgctccaggaccgcggggtcgaaccggacgaggcgctgctgtgcaagttcatggggcggcgcggcgaagacgtgatcaacgagctcgcccacctgttcccgggcgagtccgtggaggacatcttcgctgaccgctggcgctacggccaggatccggacctgcccccggtggagcagctgcccgagtccgtggcgtttctgaagtacctacacgcccagggagtgccgtttgcgttggtgacctcggccgggcggcagtgggcagaaagcaccctggaatggctgggggtccgcgacatgttccgcgggatcatctctgcggacgatgtcacggtcggcaaaccgcaccctgaggggtatctcagcggagccgagcttgtcggctacggccccgagcacatcgtggtgttcgaggacaccccggcggggatcatggcggggcgcaacgcggggatgcgggtcgtcggagtcacgacgacgcatccgccgcaggcgctggcccacgcccatctcgtcgtggagcatctgggacaggtgggctggccgcagttggttttgcgggatccggagccgccccagactgctctggcaggtcaagggtga

SEQ ID NO: 4198 - protein, 237 aa, Thermobifida fusca YX
MGLRTTESEWATPRAALFDLDGTLINSEPRSVAVWARVLQDRGVEPDEALLCKFMGRRGEDVINELAHLFPGESVEDIFADRWRYGQDPDLPPVEQLPESVAFLKYLHAQGVPFALVTSAGRQWAESTLEWLGVRDMFRGIISADDVTVGKPHPEGYLSGAELVGYGPEHIVVFEDTPAGIMAGRNAGMRVVGVTTTHPPQALAHAHLVVEHLGQVGWPQLVLRDPEPPQTALAGQG

SEQ ID NO: 4199 - DNA, 675 bp, Acidobacteria bacterium Ellin345
  CDS (1)..(675): transl_table=11
gtgatggagaaaattcgctgcgctgcagttctgtttgatttagatggcgttctggttgactccacacccgcggtcacgcgggtgtgggcacgttgggccgccgtacacggcttcgatgccgacgaggtagtgcataacgcgcatgggcgccccagcatcgagaccttgcgcgagtacctgcccaacgccgatcacgaaaaagaaaatcgcgaactcgaacgccaggagatcgaagacgttgagggcgtgatcctccttcccggcgcccagcaacttctggctactttgccgcccgagcgctggacgattgcgacttccgccacccgagccttggccaaggtacgaattgaagtggcgggtctgccggttccgccgcgaatgattacggcttcagagatcacacgtggcaagccgaaccccgagccgtatttgaaagcagcagctctgctgggatttccggcaagcgaatgtgtggtatttgaagatgtacctgccggcatccgcgctggcaaagccgcgggcgcgacggtgatcgccctacgcaccacggttccggataaggaattgcgcgcggcgggagcagatttcgtgctcaacagttgcgccgatgtcacggtagagtcgttttcaagcgaaggcattgtgctcgcgttaaacgacggagagaaaaaatga

SEQ ID NO: 4200 - protein, 224 aa, Acidobacteria bacterium Ellin345
MMEKIRCAAVLFDLDGVLVDSTPAVTRVWARWAAVHGFDADEVVHNAHGRPSIETLREYLPNADHEKENRELERQEIEDVEGVILLPGAQQLLATLPPERWTIATSATRALAKVRIEVAGLPVPPRMITASEITRGKPNPEPYLKAAALLGFPASECVVFEDVPAGIRAGKAAGATVIALRTTVPDKELRAAGADFVLNSCADVTVESFSSEGIVLALNDGEKK

SEQ ID NO: 4201 - DNA, 669 bp, Rhizobium leguminosarum bv. viciae 3841
  CDS (1)..(669): transl_table=11
gtgcccgctctccatgatatcctcgacaggtcctacgacgctttccttttcgacatggacggaacgctgctgaattccattgccgtcgtcgaacgcgtctggagcgaatgggcaagacgtcacggcttcgagccggaagtcttcctgaagacgatccatggcatccgcgcctccgacgttatccgcgggctcggactgcccggcgtcgatccggcccatgaggcggatctgctgctcgccgaggagatggaggatgtctccggcatcgtcgagatccccggcgccgtccgcttcctctccgctatcgctgagggcagatgggcaatcgtcacctcggcgccgatcgagctcgccaggcgccgcatggccgccgccggcatcccgatgccgaaggtcatcgtcagcggccaagaggtcaaatcaggcaagcccagccccgaaggttatctactcggtgcaagccgcctcggcgtcgacccgaaaaaatgcctcgtcttcgaagatgccgtcgccggcattctcgccggcgaagctgccggcgcgggcgtcaccgtcatcaccgaaacccacgccacgcccttcgaaacaccgcatttttcgatcgccaactaccaggcatggcagccccgccagaccgccgaaggccggctgaagctcgcggcgatctga

SEQ ID NO: 4202 - protein, 222 aa, Rhizobium leguminosarum bv. viciae 3841
MPALHDILDRSYDAFLFDMDGTLLNSIAVVERVWSEWARRHGFEPEVFLKTIHGIRASDVIRGLGLPGVDPAHEADLLLAEEMEDVSGIVEIPGAVRFLSAIAEGRWAIVTSAPIELARRRMAAAGIPMPKVIVSGQEVKSGKPSPEGYLLGASRLGVDPKKCLVFEDAVAGILAGEAAGAGVTVITETHATPFETPHFSIANYQAWQPRQTAEGRLKLAAI

SEQ ID NO: 4203 - DNA, 723 bp, Candida albicans
  CDS (1)..(723): transl_table=12
atgacagaaattgtcactattaacacaagcgtccttttattcgatcttgacggtacattggtcgattccactgctgctgttgaaaagacttgggaaaaccaagtgaatcaacataatcaagagtttccagacaaatttattgatttacctacattgttgaatgtctcccatggatcacgtactgttgaaacatttgctgcttatttcccggaattaaaaactgacagagattctgtgtatgcatgggaaatgggtattgtgcaaaattatggacatttgggtaaagcaatcaatggttcagtacaaactttaatcacattgaatgaaaaaaatattccatgggctattgttacatcagccaaccctaaattagctgggttttggttggataagttgtttcatggtgtcaagaaaccagatgtttttattactgcaagtgatgtaagtaaaggcaaaccagaccctgaaggatattgtacagcatttgaaagattgaaaaaagtttataatttgaatgggtctgctaagggagttgtatttgaggatgcacctgctggtattaaagctggtgttaatggtggtttcacagttgtgggcatagctagcacttttccaaaagaagtcttgttacaagccggcgccacttatgttgttgaagattttaccaaagttaaaatcgaccaatcaggggaagcagttaaactagttttagaaattctttag

SEQ ID NO: 4204 - protein, 240 aa, Candida albicans
MTEIVTINTSVLLFDLDGTLVDSTAAVEKTWENQVNQHNQEFPDKFIDLPTLLNVSHGSRTVETFAAYFPELKTDRDSVYAWEMGIVQNYGHLGKAINGSVQTLITLNEKNIPWAIVTSANPKLAGFWLDKLFHGVKKPDVFITASDVSKGKPDPEGYCTAFERLKKVYNLNGSAKGVVFEDAPAGIKAGVNGGFTVVGIASTFPKEVLLQAGATYVVEDFTKVKIDQSGEAVKLVLEIL

SEQ ID NO: 4205 - DNA, 741 bp, Saccharomyces cerevisiae
  CDS (1)..(741)
atgccacaattttcagtagatctttgtctttttgacctagatgggactattgtcagcacaacaactgcagcggaaagtgcctggaaaaaattatgccgtcagcatggggttgatcctgttgagttattcaagcattcccatggtgcaagatcacaagaaatgatgaagaaattttttccaaaattggacaataccgataataaaggtgttcttgcgttagaaaaggatatggcagataattatttggacacagtaagccttatccctggtgcagagaatttattgttatcgttagatgtagatactgagactcaaaaaaagttacctgaaaggaaatgggctatcgttacctctggttctccatatttggcattttcatggttcgagacaatattgaaaaatgttggaaagcccaaagttttcattactggatttgacgtgaagaacggtaagcctgatcccgagggttactcaagagctcgtgatttattgcgtcaagatttgcaattaactggtaaacaggatctgaagtatgttgtctttgaagatgcacccgtgggcataaaggccggcaaagcaatgggcgcaattactgtgggtataacatcctcgtatgataagagcgttttatttgacgcaggtgcagattatgtggtctgtgatttgacacaggtttccgtggttaagaacaatgagaacggtatcgttatccaggtaaacaaccctttgacgagagattaa

SEQ ID NO: 4206 - protein, 246 aa, Saccharomyces cerevisiae
MPQFSVDLCLFDLDGTIVSTTTAAESAWKKLCRQHGVDPVELFKHSHGARSQEMMKKFFPKLDNTDNKGVLALEKDMADNYLDTVSLIPGAENLLLSLDVDTETQKKLPERKWAIVTSGSPYLAFSWFETILKNVGKPKVFITGFDVKNGKPDPEGYSRARDLLRQDLQLTGKQDLKYVVFEDAPVGIKAGKAMGAITVGITSSYDKSVLFDAGADYVVCDLTQVSVVKNNENGIVIQVNNPLTRD

SEQ ID NO: 4207 - DNA, 816 bp, Saccharomyces cerevisiae
  CDS (64)..(816)
atgaaacgtttcaatgttttaaaatatatcagaacaacaaaagcaaatatacaaaccatcgcaatgcctttgaccacaaaacctttatctttgaaaatcaacgccgctctattcgatgttgacggtaccatcatcatctctcaaccagccattgctgctttctggagagatttcggtaaagacaagccttacttcgatgccgaacacgttattcacatctctcacggttggagaacttacgatgccattgccaagttcgctccagactttgctgatgaagaatacgttaacaagctagaaggtgaaatcccagaaaagtacggtgaacactccatcgaagttccaggtgctgtcaagttgtgtaatgctttgaacgccttgccaaaggaaaaatgggctgtcgccacctctggtacccgtgacatggccaagaaatggttcgacattttgaagatcaagagaccagaatacttcatcaccgccaatgatgtcaagcaaggtaagcctcacccagaaccatacttaaagggtagaaacggtttgggtttcccaattaatgaacaagacccatccaaatctaaggttgttgtctttgaagacgcaccagctggtattgctgctggtaaggctgctggctgtaaaatcgttggtattgctaccactttcgatttggacttcttgaaggaaaagggttgtgacatcattgtcaagaaccacgaatctatcagagtcggtgaatacaacgctgaaaccgatgaagtcgaattgatctttgatgactacttatacgctaaggatgacttgttgaaatggtaa

SEQ ID NO: 4208 - protein, 250 aa, Saccharomyces cerevisiae
MPLTTKPLSLKINAALFDVDGTIIISQPAIAAFWRDFGKDKPYFDAEHVIHISHGWRTYDAIAKFAPDFADEEYVNKLEGEIPEKYGEHSIEVPGAVKLCNALNALPKEKWAVATSGTRDMAKKWFDILKIKRPEYFITANDVKQGKPHPEPYLKGRNGLGFPINEQDPSKSKVVVFEDAPAGIAAGKAAGCKIVGIATTFDLDFLKEKGCDIIVKNHESIRVGEYNAETDEVELIFDDYLYAKDDLLKW

SEQ ID NO: 4209 - DNA, 753 bp, Saccharomyces cerevisiae
  CDS (1)..(753)
atgggattgactactaaacctctatctttgaaagttaacgccgctttgttcgacgtcgacggtaccattatcatctctcaaccagccattgctgcattctggagggatttcggtaaggacaaaccttatttcgatgctgaacacgttatccaagtctcgcatggttggagaacgtttgatgccattgctaagttcgctccagactttgccaatgaagagtatgttaacaaattagaagctgaaattccggtcaagtacggtgaaaaatccattgaagtcccaggtgcagttaagctgtgcaacgctttgaacgctctaccaaaagagaaatgggctgtggcaacttccggtacccgtgatatggcacaaaaatggttcgagcatctgggaatcaggagaccaaagtacttcattaccgctaatgatgtcaaacagggtaagcctcatccagaaccatatctgaagggcaggaatggcttaggatatccgatcaatgagcaagacccttccaaatctaaggtagtagtatttgaagacgctccagcaggtattgccgccggaaaagccgccggttgtaagatcattggtattgccactactttcgacttggacttcctaaaggaaaaaggctgtgacatcattgtcaaaaaccacgaatccatcagagttggcggctacaatgccgaaacagacgaagttgaattcatttttgacgactacttatatgctaaggacgatctgttgaaatggtaa

SEQ ID NO: 4210 - protein, 250 aa, Saccharomyces cerevisiae
MGLTTKPLSLKVNAALFDVDGTIIISQPAIAAFWRDFGKDKPYFDAEHVIQVSHGWRTFDAIAKFAPDFANEEYVNKLEAEIPVKYGEKSIEVPGAVKLCNALNALPKEKWAVATSGTRDMAQKWFEHLGIRRPKYFITANDVKQGKPHPEPYLKGRNGLGYPINEQDPSKSKVVVFEDAPAGIAAGKAAGCKIIGIATTFDLDFLKEKGCDIIVKNHESIRVGGYNAETDEVEFIFDDYLYAKDDLLKW

SEQ ID NO: 4211 - DNA, 25 bp, Artificial sequence
  primer
atggcagaattttcagctgatctat

SEQ ID NO: 4212 - DNA, 23 bp, Artificial sequence
  primer
tcaggcccttgtcaaagggttgt

SEQ ID NO: 4213 - protein, 204 aa, Artificial sequence
  consensus sequence
  Variant (4)..(4): Xaa in position 4 is any amino acid
  Variant (8)..(10): Xaa in position 8 to 10 is any amino acid
  Variant (12)..(18): Xaa in position 12 to 18 is any amino acid
  Variant (20)..(37): Xaa in position 20 to 37 is any amino acid
  Variant (38)..(44): Xaa in position 38 to 44 is any or no amino acid
  Variant (47)..(83): Xaa in position 47 to 83 is any amino acid
  Variant (84)..(95): Xaa in position 84 to 95 is any or no amino acid
  Variant (98)..(109): Xaa in position 98 to 109 is any amino acid
  Variant (110)..(121): Xaa in position 110 to 121 is any or no amino acid
  Variant (124)..(125): Xaa in position 124 to 125 is any amino acid
  Variant (128)..(132): Xaa in position 128 to 132 is any amino acid
  Variant (134)..(149): Xaa in position 134 to 149 is any amino acid
  Variant (150)..(152): Xaa in position 150 to 152 is any or no amino acid
  Variant (154)..(155): Xaa in position 154 to 155 is any amino acid
  Variant (157)..(158): Xaa in position 157 to 158 is any amino acid
  Variant (162)..(162): Xaa in position 162 is any amino acid
  Variant (164)..(165): Xaa in position 164 to 165 is any amino acid
  Variant (167)..(172): Xaa in position 167 to 172 is any amino acid
  Variant (174)..(181): Xaa in position 174 to 181 is any amino acid
  Variant (182)..(188): Xaa in position 182 to 188 is any or no amino acid
  Variant (190)..(190): Xaa in position 190 is any amino acid
  Variant (195)..(195): Xaa in position 195 is any amino acid
  Variant (197)..(198): Xaa in position 197 to 198 is any amino acid
  Variant (201)..(203): Xaa in position 201 to 203 is any amino acid
LFDXDGTXXXSXXXXXXXWXXXXXXXXXXXXXXXXXXXXXXXXXHGXXXXXXXXXXXXXXXXXXXXXXXXXXXXXXXXXXXXXXXXXXXXXXXXXPGXXXXXXXXXXXXXXXXXXXXXXXXWAXXTSXXXXXAXXXXXXXXXXXXXXXXXXXAXXVXXGKPXPXXYXXXXXXLXXXXXXXXXXXXXXXVXEDAPXGXXAGXXXG

SEQ ID NO: 4214 - protein, 27 aa, Artificial sequence
  protein pattern
  Variant (2)..(2): Xaa in position 2 is any amino acid
  Variant (3)..(4): Xaa in position 3 to 4 is any or no amino acid
  Variant (8)..(8): Xaa in position 8 is Pro or Val
  Variant (9)..(9): Xaa in position 9 is any amino acid
  Variant (11)..(11): Xaa in position 11 is Ile, Leu or Val
  Variant (12)..(12): Xaa in position 12 is any amino acid
  Variant (13)..(13): Xaa in position 13 is Ala or Ser
  Variant (15)..(17): Xaa in position 15 to 17 is any amino acid
  Variant (19)..(22): Xaa in position 19 to 22 is any amino acid
  Variant (23)..(23): Xaa in position 23 is Ala, Gly or Val
  Variant (24)..(24): Xaa in position 24 is Ile, Leu or Val
  Variant (25)..(26): Xaa in position 25 to 26 is any amino acid
  Variant (27)..(27): Xaa in position 27 is Ala, Pro, Ser or Thr
VXXXEDAXXGXXXGXXXGXXXXXXXXX

SEQ ID NO: 4215 - protein, 29 aa, Artificial sequence
  protein pattern
  Variant (2)..(4): Xaa in position 2 to 4 is any amino acid
  Variant (5)..(5): Xaa in position 5 is Ile or Val
  Variant (6)..(6): Xaa in position 6 is Ala, Cys, Ser or Thr
  Variant (7)..(7): Xaa in position 7 is Ala or Gly
  Variant (8)..(9): Xaa in position 8 to 9 is any amino acid
  Variant (11)..(12): Xaa in position 11 to 12 is any or no amino acid
  Variant (14)..(15): Xaa in position 14 to 15 is any or no amino acid
  Variant (18)..(18): Xaa in position 18 is any amino acid
  Variant (20)..(20): Xaa in position 20 is Ala, Asp, Glu, Gln or Thr
  Variant (21)..(21): Xaa in position 21 is Ala, Cys, Gly or Pro
  Variant (22)..(22): Xaa in position 22 is Phe or Tyr
  Variant (23)..(24): Xaa in position 23 to 24 is any amino acid
  Variant (25)..(25): Xaa in position 25 is Ala or Gly
  Variant (26)..(28): Xaa in position 26 to 28 is any amino acid
PXXXXXXXXVXXGXXKPXPXXXXXXXXXL

SEQ ID NO: 4216 - protein, 12 aa, Artificial sequence
  protein pattern
  Variant (3)..(3): Xaa in position 3 is Ile or Val
  Variant (4)..(4): Xaa in position 4 is Ala, Ile or Val
  Variant (7)..(7): Xaa in position 7 is Ala or Gly
  Variant (8)..(8): Xaa in position 8 is Asn, Pro, Ser or Thr
  Variant (9)..(11): Xaa in position 9 to 11 is any amino acid
  Variant (12)..(12): Xaa in position 12 is Ala, Thr or Val
WAXXTSXXXXXX

SEQ ID NO: 4217 - DNA, 2196 bp, Saccharomyces cerevisiae
  CDS (1)..(2196)
atgacagaattttattctgacacaatcggtctaccaaagacagatccacgtctttggagactgagaactgatgagctaggccgagaaagctgggaatatttaacccctcagcaagccgcaaacgacccaccatccactttcacgcagtggcttcttcaagatcccaaatttcctcaacctcatccagaaagaaataagcattcaccagatttttcagccttcgatgcgtgtcataatggtgcatcttttttcaaactgcttcaagagcctgactcaggtatttttccgtgtcaatataaaggacccatgttcatgacaatcggttacgtagccgtaaactatatcgccggtattgaaattcctgagcatgagagaatagaattaattagatacatcgtcaatacagcacatccggttgatggtggctggggtctacattctgttgacaaatccaccgtgtttggtacagtattgaactatgtaatcttacgtttattgggtctacccaaggaccacccggtttgcgccaaggcaagaagcacattgttaaggttaggcggtgctattggatcccctcactggggaaaaatttggctaagtgcactaaacttgtataaatgggaaggtgtgaaccctgcccctcctgaaacttggttacttccatattcactgcccatgcatccggggagatggtgggttcatactagaggtgtttacattccggtcagttacctgtcattggtcaaattttcttgcccaatgactcctcttcttgaagaactgaggaatgaaatttacactaaaccgtttgacaagattaacttctccaagaacaggaataccgtatgtggagtagacctatattacccccattctactactttgaatattgcgaacagccttgtagtattttacgaaaaatacctaagaaaccggttcatttactctctatccaagaagaaggtttatgatctaatcaaaacggagttacagaatactgattccttgtgtatagcacctgttaaccaggcgttttgcgcacttgtcactcttattgaagaaggggtagactcggaagcgttccagcgtctccaatataggttcaaggatgcattgttccatggtccacagggtatgaccattatgggaacaaatggtgtgcaaacctgggattgtgcgtttgccattcaatactttttcgtcgcaggcctcgcagaaagacctgaattctataacacaattgtctctgcctataaattcttgtgtcatgctcaatttgacaccgagtgcgttccaggtagttatagggataagagaaagggggcttggggcttctcaacaaaaacacagggctatacagtggcagattgcactgcagaagcaattaaagccatcatcatggtgaaaaactctcccgtctttagtgaagtacaccatatgattagcagtgaacgtttatttgaaggcattgatgtgttattgaacctacaaaacatcggatcttttgaatatggttcctttgcaacctatgaaaaaatcaaggccccactagcaatggaaaccttgaatcctgctgaagtttttggtgacataatggtagaatacccatacgtggaatgtactgattcatccgttctggggttgacatattttcacaagtacttcgactataggaaagaggaaatacgtacacgcatcagaatcgccatcgaattcataaaaaaatctcaattaccagatggaagttggtatggaagctggggtatttgttttacatatgccggtatgtttgcattggaggcattacacaccgtgggggagacctatgagaattcctcaacggtaagaaaaggttgcgacttcttggtcagtaaacagatgaaggatggcggttggggggaatcaatgaagtccagtgaattacatagttatgtggatagtgaaaaatcgctagtcgttcaaaccgcatgggcgctaattgcacttcttttcgctgaatatcctaataaagaagtcatcgaccgcggtattgaccttttaaaaaatagacaagaagaatccggggaatggaaatttgaaagtgtagaaggtgttttcaaccactcttgtgcaattgaatacccaagttatcgattcttattccctattaaggcattaggtatgtacagcagggcatatgaaacacatacgctttaa

SEQ ID NO: 4218 - protein, 731 aa, Saccharomyces cerevisiae
MTEFYSDTIGLPKTDPRLWRLRTDELGRESWEYLTPQQAANDPPSTFTQWLLQDPKFPQPHPERNKHSPDFSAFDACHNGASFFKLLQEPDSGIFPCQYKGPMFMTIGYVAVNYIAGIEIPEHERIELIRYIVNTAHPVDGGWGLHSVDKSTVFGTVLNYVILRLLGLPKDHPVCAKARSTLLRLGGAIGSPHWGKIWLSALNLYKWEGVNPAPPETWLLPYSLPMHPGRWWVHTRGVYIPVSYLSLVKFSCPMTPLLEELRNEIYTKPFDKINFSKNRNTVCGVDLYYPHSTTLNIANSLVVFYEKYLRNRFIYSLSKKKVYDLIKTELQNTDSLCIAPVNQAFCALVTLIEEGVDSEAFQRLQYRFKDALFHGPQGMTIMGTNGVQTWDCAFAIQYFFVAGLAERPEFYNTIVSAYKFLCHAQFDTECVPGSYRDKRKGAWGFSTKTQGYTVADCTAEAIKAIIMVKNSPVFSEVHHMISSERLFEGIDVLLNLQNIGSFEYGSFATYEKIKAPLAMETLNPAEVFGDIMVEYPYVECTDSSVLGLTYFHKYFDYRKEEIRTRIRIAIEFIKKSQLPDGSWYGSWGICFTYAGMFALEALHTVGETYENSSTVRKGCDFLVSKQMKDGGWGESMKSSELHSYVDSEKSLVVQTAWALIALLFAEYPNKEVIDRGIDLLKNRQEESGEWKFESVEGVFNHSCAIEYPSYRFLFPIKALGMYSRAYETHTL

SEQ ID NO: 4219 - DNA, 2578 bp, Oryza sativa
  CDS (103)..(2382)
gggtgtgttggagatgctttgaccctctataaaattaagttgataccggagcatatatacgcaccttagctattagaccaccaccttcttccggactcgtacatgtggaggctgaaggtgtcggagggcggcagcccatggctgcggtcggtaaacaatctcctcggccggcaagtgtgggagttcgaccctgacctcggcacgccagaggagcgcgccgatgtggagaaggcgcgccgcgagttcgccgagcaccgcttcgagcgcaagcattctagcgacctcctcatgcggatgcagttcgctaaagaaaactgtcaaaagctggaccttctcgctgtcaagcgtggagagcacgaagacgtcatgggggaagctgtgtggagctctttgaaacgggccataagccgcgtttgtaatttgcaggcacatgatggacactggcccggggattatgcaggacttatgttctttttgcctggcttgattataacattgcatgtcagtggagttctgaacactgttttatcatcggaacatcagaaggagatgcgccggtacatctataatcaccagaatgaagatggagggtgggggttgcacattgagggccacagcaccatgcttggctcatccctgaactatgttgctttgagattgcttggggagggtccaaatggtggagatggatgcatagagaatggtcgaaactggattttagatcatggaggagccacatttacgacatcatgggggaagttctggctctcggtacttggagtatttgattggtccggtaataacccagtgccaccagagttattactattgccgtatcaactgccgtttcacccaggtcgaatgtcgagctatatccgaatggtgtttatacccatgtcttacatttatggaaaaaggtttgttggcccagtaacaccagttgtgctagagctaagaagtgaactatacaatgacccctatgatgagattgactggaacaaagctcgtactcagtgtgcaaaggaagatatgtactatccacgttcatccaaactggatatgttttggtcctttctccacaagtttattgaaccagttttgttgcgctggcctgggagaaaactgagggagaaagctctggccacttccatgaggaatgttcactatgaagatgagtgcactcgatacatctgtttcggtggtgtacccaaggcattaaatatccttgcttgctggattgaagatccaagctcagaggcattcaaatgccatattgcacgcgtatatgattatttatggatcgctgaagacggcatgaagatgcagatttacgatggcagccaggtgtgggacgcaggtttgacagttgaggcccttgtggctactgaccttgtcaaagagcttggaccaactcttaaacgagcgcattccttccttaagaattcgcagttgcttgacaattgcccccgagatttcaaccgctggtatcgccatatatccaaaggtggatggacatttacaacagctgatgatggctggcaagtttcagattgcacggcgacagcactgaaggcatgtctattgttatcaaggatatctcctgaaatcgttggtgaaccactggaaattgatgcacaatacgatgctgttaattgtctgatgtctttgatgaatgataatggtggcttttcagcatttgaactcgtaaggtctaatacatggctggagcatattaatcctacagaggcatttgggcgtgtaatgattgaatatccgtatgtcgaatgtacatcatcatcaattcagtgtctagcattattcaaaaaacttcacccagggcaccgcaaggaagaggtggaaaattgtatcagcaaaggtgctaatttcattgagagttctcagagaagcgatggttcatggtatggttcttgggggatttgtttcacctatgccacatggtttgcagtgacaggattagtttctgcaggcaggacacttgggaatagcgctacagttagaaaggcatgtgactttctcttgtcaaaacagcttccttcgggtggctggggcgagagctatttgtcatgtcatgacgaggtttacacaaatcttaaaggcaaccgacctcacggtacgcacactgcgtgggccatgattgcactaattgatgcagggcaggctgaaagagatccagtgcctctgcatcgagcagccaaggctttgctcaacttgcaattagaggatggagaatttccacagcaagaaattgttggagtctttctccagactgccatgatcagttattcccagtacaggaacatcttccctataatggctctcacagggtatcgccgccgagtactgcttgcaggcaacatataggagcatgattttaagttatgccagctcttggcatgttggtttgccaataaagttacatttcacctcccctagcagcagtactctctactgttctagcgtttgtattttgtattttctaagaaaaaaatgttttaccgcatttacttagttccctttgtttgtaataaaacatggaacatactgcttccttgtagtt

SEQ ID NO: 4220 - protein, 759 aa, Oryza sativa
MWRLKVSEGGSPWLRSVNNLLGRQVWEFDPDLGTPEERADVEKARREFAEHRFERKHSSDLLMRMQFAKENCQKLDLLAVKRGEHEDVMGEAVWSSLKRAISRVCNLQAHDGHWPGDYAGLMFFLPGLIITLHVSGVLNTVLSSEHQKEMRRYIYNHQNEDGGWGLHIEGHSTMLGSSLNYVALRLLGEGPNGGDGCIENGRNWILDHGGATFTTSWGKFWLSVLGVFDWSGNNPVPPELLLLPYQLPFHPGRMSSYIRMVFIPMSYIYGKRFVGPVTPVVLELRSELYNDPYDEIDWNKARTQCAKEDMYYPRSSKLDMFWSFLHKFIEPVLLRWPGRKLREKALATSMRNVHYEDECTRYICFGGVPKALNILACWIEDPSSEAFKCHIARVYDYLWIAEDGMKMQIYDGSQVWDAGLTVEALVATDLVKELGPTLKRAHSFLKNSQLLDNCPRDFNRWYRHISKGGWTFTTADDGWQVSDCTATALKACLLLSRISPEIVGEPLEIDAQYDAVNCLMSLMNDNGGFSAFELVRSNTWLEHINPTEAFGRVMIEYPYVECTSSSIQCLALFKKLHPGHRKEEVENCISKGANFIESSQRSDGSWYGSWGICFTYATWFAVTGLVSAGRTLGNSATVRKACDFLLSKQLPSGGWGESYLSCHDEVYTNLKGNRPHGTHTAWAMIALIDAGQAERDPVPLHRAAKALLNLQLEDGEFPQQEIVGVFLQTAMISYSQYRNIFPIMALTGYRRRVLLAGNI

SEQ ID NO: 4221 - DNA, 2602 bp, Oryza sativa
  CDS (64)..(2352)
gcttgtctccttgtccggtacgttggttggctctagcttagctggtgctcgatcgcgaacatcatgtggaggctgaaggtggcccagggcggcggcgctttgttgcggtcgacgaacggcttcgccgggcgagcggtgtgggagttcgaccccgaccacggcacgccggaggaccgagccaacgtcgagagggtgcgccgcgacttcaccgaccaccgcctccgccgcccggagtccgccgatctcctcatgcgcatgcagtttgcaagagaaaacaatcaccaacgccgtggtgatcgtattccaccggccgtcaataagcttggcgagaaggagcaggtgactgaagaaactgtgatggcttccttgaggcgagctctcgatgagttctcctctctgcaagcagatgatggccactggcctggcgacctcagtggtgctatattcatcatgcctgtcttgatattttctttgtatgccactggatcactggacactgtcatatcatcagaacaccggagggagatatgtcgctacatctataaccatcagaacgaggacgggggatggggcatgctaatcttgggatcaagcacgatgtttgccacatgcttaaactatgtcaccctgagacttatcggcgaggagccaagcaatgagcaattagctagaggacacgcctggatcatatcacatggtggcgccacccttgttccgcaatggggaaagatatgtctgtcgataattggagtgtatgagtggtcaggaaacaaccccatcttccccgagttatggcttgctccacaattccttccgtttcatccaggcaaattctggggcccgacccgcgtggtgtacgtgccgatggcctatctgtacggcaagaagttcgtggggcccatcacgccaaccatactggcgctgcgagaggagatatacacggacccctaccacaccattgactgggcccaagcctgcaacgcatgctccaaggaggatttggtctgcccgcgcacgctgctgcagaatgtggtgtggacttcgctctacaagtgggtggagccggtgctaggcagcaggccgatgaacaagctgagggagagagctttggatagactcatggagcatatccattacgaagatgaaaactcacagtacctctgcctatgtcctgtcaacaaggctcttaacatggtctgctgctgggtggaagatccaaattcagattcattcaagcggcatcttgcaaggatacctgatttcctgtggctttcagaagatggcatgaaggcacagatatatgatggttgccagagctgggaaacagcatttataattcaagcgttttgtgctactgatcttgtaaatgagtatggttcaactgttaggagagcccacgagttcatgaaaaattcacagattatgaggaatcatcctggtgaccaaagttactggcatcgccatagatcaaagggttcatggactctttcgtcagcagacaatggatgggctgtgtctgacactacagcagaagcgctgaaggctgtactgttactggaaaagatctctagcaacgtggtcggggatccaattgaaatagaaaggctgcatgatgctgttgattgcctcctatctttcgtggacaaagatggtaccctttctacatatgaatgtaaaagaacttatacttggatagaggttctcagtccttgtgagagttttccaaacatagtggttgattatccatttccagaatgcacctcctctgtgcttcaagctctggtgctgttcaaacaactacaccctagttaccgtattaaagagatagaaaaatgtgtcagaaacgcagcgatgtttattgagagcacacaaggcgaagatggttcatggctaggcacttggggtgtgtgtttcacctatggggcctttctttcagtaaaagggttaattgctgctggaagaacatatgagaatagttcttccatcaggaaagcatgcgactttatattatcaaagcagctcgatactggtgggtggggagaaagttatgtctctaatattactaaggtttacgtaaacattaaagatgatcaagctcatgcagtgaatactgcctgggcaatgttagctttaatttgtgcaggacagatggagcgggatccagcaccactgcatcgtgctgcaaaagaattaatcaatatgcagttggaaacaggagagttcccccaacaagaacatgttggagccttcaatgcatgcctcttctttaattaccccaactaccgcaacttattccctatctgggctcttggagagtactgtcgtcatcttcactccacgaggcgtgcatgagcatggcatatggtgataaatgaaggggtcgatgggcgatggcatggctggaatatcttatatagtgtgtgtatgcaatccaacctgatgttgtattgtcaagactggcaatcataattccttagggaaagtatatgaagagagtgtaacttaaacatgttattgttattgtatttgtgtccatgaagatgaactctcttaaataaatttatcggggaaaaaaaaggagatatgccttcagaaggtgggc

SEQ ID NO: 4222 - protein, 762 aa, Oryza sativa
MWRLKVAQGGGALLRSTNGFAGRAVWEFDPDHGTPEDRANVERVRRDFTDHRLRRPESADLLMRMQFARENNHQRRGDRIPPAVNKLGEKEQVTEETVMASLRRALDEFSSLQADDGHWPGDLSGAIFIMPVLIFSLYATGSLDTVISSEHRREICRYIYNHQNEDGGWGMLILGSSTMFATCLNYVTLRLIGEEPSNEQLARGHAWIISHGGATLVPQWGKICLSIIGVYEWSGNNPIFPELWLAPQFLPFHPGKFWGPTRVVYVPMAYLYGKKFVGPITPTILALREEIYTDPYHTIDWAQACNACSKEDLVCPRTLLQNVVWTSLYKWVEPVLGSRPMNKLRERALDRLMEHIHYEDENSQYLCLCPVNKALNMVCCWVEDPNSDSFKRHLARIPDFLWLSEDGMKAQIYDGCQSWETAFIIQAFCATDLVNEYGSTVRRAHEFMKNSQIMRNHPGDQSYWHRHRSKGSWTLSSADNGWAVSDTTAEALKAVLLLEKISSNVVGDPIEIERLHDAVDCLLSFVDKDGTLSTYECKRTYTWIEVLSPCESFPNIVVDYPFPECTSSVLQALVLFKQLHPSYRIKEIEKCVRNAAMFIESTQGEDGSWLGTWGVCFTYGAFLSVKGLIAAGRTYENSSSIRKACDFILSKQLDTGGWGESYVSNITKVYVNIKDDQAHAVNTAWAMLALICAGQMERDPAPLHRAAKELINMQLETGEFPQQEHVGAFNACLFFNYPNYRNLFPIWALGEYCRHLHSTRRA

SEQ ID NO: 4223 - DNA, 2669 bp, Glycine max
  CDS (40)..(2328)
atttgggctcgagttggtgtgagtgaatagggatcagggatgtggaggctgaagatagcagatggaggaaatgatccatacatattcagcacaaacaatttcgttgggaggcagacatgggagtttgatcctgaagcaggcagtccagaggaacgggcccaggttgaagcagctcgtcagcatttctaccacaaccgcttcaaggtcaagccctgcgctgacctcctttggcgttttcaggttctcagagaaaataacttcaaacaaacaattcctcgtgtgactatagaagatggagaggaaatcacataccaaaaagtcacaagcgccgtcagaaggggcgcacaccaccttgcggcactgcagacctctgatggccattggcctgctcaaattgcaggtcctctcttctttcttcctcctttggttttttgtatgtatattacaggaaatcttgaatcagtatttccagaagaacatcgcaaagaaattcttcgttacacatattatcaccagaatgaagacggaggatggggactacacatagagggtcatagcactatgttttgtactgcactgaactatatatgcatgcgaatgcttggagaaggacctaatggaggtcatgacaatgcttgtgctagagcaagaaagtggattcgagatcatggtggtgtaacacatataccttcatggggaaaaacttggctttcgatactcggtgtatttgattggtgcggaagcaacccaatgcccccagagttttggatccttccatcttttcttcctatgcatccagctaagatgtggtgttactgtcgattggtatacatgcctatgtcttacttatatgggaagaggtttgtgggtccaatcacaccactcatcttacaattaagagaagagttgtttactcaaccttatgaaaaagttaattggaagaaagcgcgtcaccaatgtgcaaaggaagatctttactatccccatcctttgatacaagacctaatatgggatagtttatacatattcactgaaccgctacttactcgttggcctttcaacaagttgattagagaaaaggcccttcaagtaactatgaaacatattcattatgaagatgagactagtcgatacataaccattggttgtgtggaaaaggttttatgtatgcttgcttgttgggtggaagatccaaacggagatgctttcaagaagcatcttgcaagggtcccagattacttatgggtttctgaagatggaatgaccatgcagagttttggtagccaagaatgggatgctggctttgctgttcaagctttgcttgccactaacataattgaagaaattggtcctacgtttgcaaaaggacatgatttcatcaagaagtctcaggtgaaggataatccttttggagattttaaaagtatgcatcgtcatatttctaaagggtcttggacattctctgatcaagaccatggatggcaagtttctgattgcactgcagaaggtttaaagtgttgtctacttctatcaatgttgccaccagagattgtgggagaaaagatggaacctgaaagattatacgattcagtcaatgtcttgttgtcgcttcagagtaaaaaaggtggtttagcagcatgggagcctgcaggagctcaagagtggttagaattactcaatcccacagaattttttgcggacattgtagttgaacatgaatatgttgagtgcactggatctgcaatccaagctttagttttgttcaagaagctatatccaggacataggaggaaagagatagaaaatttcattaccaatgcagttcgattccttgaagatacacaaacagctgatggttcatggtatggaaattggggagtttgcttcacttatggctcttggtttgcacttggaggtctagcagctgctggtaagacttacaccaattgtgctgccattcgcaaagccgttaaatttctacttacaacacaaagagaggacggtggatggggagagagttatctttcaagcccaaaaaagatatatgtacctctagaaggaagccgatcaaatgttgtacatacagcatgggctcttatgggactaattcatgctggacaggcggatagagaccccatgcctcttcaccgtgctgcaaagttgctcattaattctcagttggaagagggtgattggccccaacaggaaatcacgggagtattcatgaaaaattgcatgttgcattatccaatgtacagagatatttatccaatgtgggctctagctgaatatcgaaggcgggttccattgccttccactgaagtttaatttagaatggtttgagcacgaaaaggcaaaggcattttcattaagattgaggcaaataaagcaaataagttgtgtgtaatcaagcttaatcaattttttcatattcctatgtttatttcctacatatattggtagaaaaattatttcatgtcggcttgtatagatgttcttaatgttcgtgttacgatacaaagataagtctagtaaaatactacgcacgtaacattagagggctgtgaagaagataaaaatgttaccaagaaaattaattagtttctcagtgatactcaatacacagggtcgtgcctatggtaaatagggatccccaagaaataacaagc

SEQ ID NO: 4224 - protein, 762 aa, Glycine max
MWRLKIADGGNDPYIFSTNNFVGRQTWEFDPEAGSPEERAQVEAARQHFYHNRFKVKPCADLLWRFQVLRENNFKQTIPRVTIEDGEEITYQKVTSAVRRGAHHLAALQTSDGHWPAQIAGPLFFLPPLVFCMYITGNLESVFPEEHRKEILRYTYYHQNEDGGWGLHIEGHSTMFCTALNYICMRMLGEGPNGGHDNACARARKWIRDHGGVTHIPSWGKTWLSILGVFDWCGSNPMPPEFWILPSFLPMHPAKMWCYCRLVYMPMSYLYGKRFVGPITPLILQLREELFTQPYEKVNWKKARHQCAKEDLYYPHPLIQDLIWDSLYIFTEPLLTRWPFNKLIREKALQVTMKHIHYEDETSRYITIGCVEKVLCMLACWVEDPNGDAFKKHLARVPDYLWVSEDGMTMQSFGSQEWDAGFAVQALLATNIIEEIGPTFAKGHDFIKKSQVKDNPFGDFKSMHRHISKGSWTFSDQDHGWQVSDCTAEGLKCCLLLSMLPPEIVGEKMEPERLYDSVNVLLSLQSKKGGLAAWEPAGAQEWLELLNPTEFFADIVVEHEYVECTGSAIQALVLFKKLYPGHRRKEIENFITNAVRFLEDTQTADGSWYGNWGVCFTYGSWFALGGLAAAGKTYTNCAAIRKAVKFLLTTQREDGGWGESYLSSPKKIYVPLEGSRSNVVHTAWALMGLIHAGQADRDPMPLHRAAKLLINSQLEEGDWPQQEITGVFMKNCMLHYPMYRDIYPMWALAEYRRRVPLPSTEV

SEQ ID NO: 4225 - DNA, 2355 bp, Oryza sativa
  CDS (1)..(2355)
atgtggcggctgagggtggcggagggcgggggggacccgtggctgcgcacgaagaacggccacgtggggcgccaggtctgggagttcgaccccgccgcgggcgaccccgacgagctcgccgccgtcgaggccgcccgccgcggtttcgccgcccgccgccacgagctcaagcacagctccgacctcctcatgcgcatgcagtggccggtgggcaaatcaaactgggttagcatgtttttagcctcttatgaggactgtaggatgcagagaactcagtttgctaaagcaaatcctcttaagctggacattccagctatcaagctagaggagcatgaagctgttacaggcgaagctgtattatcctctctaaaaagggcaattgctcgttattctacttttcaagcacatgatggacactggcctggggattatggtggtcccatgttccttatgccaggcttgattataacattatatgtgagcggagcgctgaacactgctttgtcatctgaacatcagaaggagatacggcggtatctctacaatcatcagaatgaagatggaggatggggtttgcacattgagggccacagcaccatgtttggctcagcgttgacatatgtttctttgagattgcttggggaggggccagatagcggcgatggagctatggagaaaggacgaaaatggattttagaccatgggggagcaacttatattacatcatggggcaagttttggctttcggtgcttggtgtatttgactggtctggcaacaacccagtgccaccagaaatatggttgttgccatatttcctgccgattcatccagggcgaatgtggtgtcattgccggatggtttatttgcctatgtgttacatttatggaaagaggtttgtgggcccagttacaccaattatattggaattaagaaaggaactctacgaagtaccctacaatgaagttgattgggacaaggctcgcaatctatgtgctaaggaagatctgtactatccacatccattcgtgcaggatgtattatgggccactctccacaaatttgttgaaccagctatgttgcgttggcctgggaacaaattgagggagaaagctttggacactgtcatgcagcatattcattatgaagatgagaacacccgatatatttgcattggtccagtaaacaaggtattaaatatgcttgcttgctggattgaagatccaaactcagaggcattcaaactccacattccaagagtccacgattacctatggattgcagaagatggcatgaaaatgcagggttataatggaagccagctgtgggacacagctttcacagttcaagctatagtggctactggcctcattgaagaatttggtcctactcttaaactagcacatggctacataaagaaaacgcaggttatcgatgactgccctggagatcttagtcagtggtaccgccacatatctaaaggtgcatggcccttttctactgctgatcatggttggcctatatcagattgcactgcagaaggacttaaggcggcattattgctatcgaagatttctccagatattgttggcgaagcagtggaagttaatagactgtatgattctgtcaattgtttgatgtcatacatgaatgataatggtggatttgcaacatatgaactcacaaggtcttatgcctggctggagcttatcaatcctgctgagacctttggggacattgtgattgattatccttatgtggaatgcacttcagcagcaattcaggccctgacagcatttaaaaagctctaccctggacaccgcaagagtgaaatagacaactgtataagcaaagctgctagctttattgagggtattcaaaaaagcgatggttcatggtatggttcttgggctgtttgttttacctatggcacatggtttggtgtaaagggattagttgctgctggtaggacattcaaaaacagtcctgcaatcagaaaggcatgtgactttttgttgtcaaaagagcttccttctggaggctggggagaaagctatttgtcatcccaagatcaggtttataccaatctcgaagggaagcgacctcatgcggtgaacactggttgggccatgctagccctaatcgatgcagggcaggctgagagagatccaattcctttgcatcgagcagcgaaggttttgatcaacttacaatcggaagatggtgaatttccccagcaagagatcattggagtcttcaacaaaaactgcatgatcagctactccgagtatagaaacatcttccctatttgggcccttggggagtaccgtcgccgcgtcttggccgcagacaagtag

SEQ ID NO: 4226 - protein, 784 aa, Oryza sativa
MWRLRVAEGGGDPWLRTKNGHVGRQVWEFDPAAGDPDELAAVEAARRGFAARRHELKHSSDLLMRMQWPVGKSNWVSMFLASYEDCRMQRTQFAKANPLKLDIPAIKLEEHEAVTGEAVLSSLKRAIARYSTFQAHDGHWPGDYGGPMFLMPGLIITLYVSGALNTALSSEHQKEIRRYLYNHQNEDGGWGLHIEGHSTMFGSALTYVSLRLLGEGPDSGDGAMEKGRKWILDHGGATYITSWGKFWLSVLGVFDWSGNNPVPPEIWLLPYFLPIHPGRMWCHCRMVYLPMCYIYGKRFVGPVTPIILELRKELYEVPYNEVDWDKARNLCAKEDLYYPHPFVQDVLWATLHKFVEPAMLRWPGNKLREKALDTVMQHIHYEDENTRYICIGPVNKVLNMLACWIEDPNSEAFKLHIPRVHDYLWIAEDGMKMQGYNGSQLWDTAFTVQAIVATGLIEEFGPTLKLAHGYIKKTQVIDDCPGDLSQWYRHISKGAWPFSTADHGWPISDCTAEGLKAALLLSKISPDIVGEAVEVNRLYDSVNCLMSYMNDNGGFATYELTRSYAWLELINPAETFGDIVIDYPYVECTSAAIQALTAFKKLYPGHRKSEIDNCISKAASFIEGIQKSDGSWYGSWAVCFTYGTWFGVKGLVAAGRTFKNSPAIRKACDFLLSKELPSGGWGESYLSSQDQVYTNLEGKRPHAVNTGWAMLALIDAGQAERDPIPLHRAAKVLINLQSEDGEFPQQEIIGVFNKNCMISYSEYRNIFPIWALGEYRRRVLAADK

SEQ ID NO: 4227 - DNA, 2526 bp, Zea mays
  CDS (28)..(2298)
tccttcaccatcctaagctagccaagcatgtggaggctaaagatcggcgagaggccaagcaacccgctgcttcgctcgcccaatggcttccttgggagagaggtgtgggagttcgaccccgccgcaggcacgccggaggagcgcgccgaggtcgataggctgcgccaggagtacacccgcaaccgcttcacgcgacggcaatgcagtgaccttctcatgcgcatgcagtatgcaaaacagaaccttcataatacaaaccttccggctatcaagattgaccaggattcagacgtcacagaagaaactatactaattacattgaggcgtgctcttaatcaatattcttctttgcaaggacctgctgggcattggcctggggattacggcgggatttcgttcattttaccactcatgatatttgcattacatgtcacacgatcaatggatgaagttttgtcaatagagcatatacgtgagatatgtcgctacatttataacatgcagaatgaggatggaggctggggaacacataccttgggaccaagctccatgtttggcacatgtgtaaactatgcaaccttaaggattctaggagaggtgcttgatggagaaaatgatgcattatccaaagggcgttcttggattttgtctcatggaagtgcaactgcagcaccacaatgggcaaagatatatctctcgatgataggtgtatacgattgggctgggaacaatgcaatcattcctgagttatggatgcttccacattttctcccaattcatcctggaaggttttggtgcttttgtcggatggtttacatgccaatggcttacatttatggaaaaaagtttgttgggcctatcactacaactattttagaaataagagatgagctctacatatggccaattgttaagatcaactggaacaaggcttgcaattcttgtgccaaggaagaccttatctatgagccttcatggttgcaaagtattgcaatggcttatttgaataagtttatagaaccattatcaaatctttggccaatgaataagctacgagaaagagctatgagtgacctcatggaacatatccactatgaagatgaaaccagcaactatgttggcttatgccctataaacaaggcattaaatatgatatgttgttggatagaaaaaccaaactcaaatgaatttagacaacatctcccaaggattcatgatttcctatggcttggagaagacggaatgaagtcaaaggtgtatgttggttgccatagttgggaaactgcgctcatagttcaggctttttgctcaacagggctcaccgaggagttttgttcgactcttcaaaaagctcatcagttcttaaaaaatgcacaggttatcgaaaacattcctgattacaagagctactaccgtgaaagaactaaaggttcttggactctatccaatggagaaaacttttggcctattgctgatacaactgctgaggcacttaaggcaatactgttgctgtctaacattccttcagaacttgtcggggatccaataaaacaagaacgactatatgatgccgttgattgcctcctttctttcgtgaacaaagatggtacattatcatcagctgaatgtaaacgaacaacttcatgggtggagtttatcaatccttctgagagttttcgtaatatcatcgtcgactatccatatcctgaatgcacatcatcattaattcaagctttagtgctgtttagaggcaagcatccaatatatcgtcgtgatgagatagacaaaattatcaaaagtggtgcatcattcattgagaaagtacaacgaaaggatgggtcctggtatggttcttgggctgtgtgtttcacttatgcaacattctttgctataaaaggattagttgctgcaggaagaacataccggaatagtttggctattaggaaagcatgcaacttcttgttgtcaaagcaactaggaaccggtggatggggagaaaactatcttggttgtcaaattgaggagtatgttgacagtggcagtccacatggagtcaacactgcacaggcgatgctagctttactctacgctgggcaggtcgaacaagacccagcgccactataccgtgctgcaaaagaattaattaacatgcagatggagaacggagaatttccccaacaagaaattgttggcaacttcaactcctcacttttcttcaattacccgaactaccgaaacttatttcccatctgggctttaggagaatttcgccgccgacttgttgcaaaaaaaggttaagatgggtatcttaagctatttctaataattgtatttgggatacaagtatccatgtatattttatttttcgtgatgatgggaatgtaacacaaaataaaatttatatttagtacgtatatgttaatatttgtaagattatcacaaacaagttgataatcatcagtgatctggttcctcaaattcaataacaaggatgcaaaatgtttggtagcaataaaaaaaaaaaaa

SEQ ID NO: 4228 - protein, 756 aa, Zea mays
MWRLKIGERPSNPLLRSPNGFLGREVWEFDPAAGTPEERAEVDRLRQEYTRNRFTRRQCSDLLMRMQYAKQNLHNTNLPAIKIDQDSDVTEETILITLRRALNQYSSLQGPAGHWPGDYGGISFILPLMIFALHVTRSMDEVLSIEHIREICRYIYNMQNEDGGWGTHTLGPSSMFGTCVNYATLRILGEVLDGENDALSKGRSWILSHGSATAAPQWAKIYLSMIGVYDWAGNNAIIPELWMLPHFLPIHPGRFWCFCRMVYMPMAYIYGKKFVGPITTTILEIRDELYIWPIVKINWNKACNSCAKEDLIYEPSWLQSIAMAYLNKFIEPLSNLWPMNKLRERAMSDLMEHIHYEDETSNYVGLCPINKALNMICCWIEKPNSNEFRQHLPRIHDFLWLGEDGMKSKVYVGCHSWETALIVQAFCSTGLTEEFCSTLQKAHQFLKNAQVIENIPDYKSYYRERTKGSWTLSNGENFWPIADTTAEALKAILLLSNIPSELVGDPIKQERLYDAVDCLLSFVNKDGTLSSAECKRTTSWVEFINPSESFRNIIVDYPYPECTSSLIQALVLFRGKHPIYRRDEIDKIIKSGASFIEKVQRKDGSWYGSWAVCFTYATFFAIKGLVAAGRTYRNSLAIRKACNFLLSKQLGTGGWGENYLGCQIEEYVDSGSPHGVNTAQAMLALLYAGQVEQDPAPLYRAAKELINMQMENGEFPQQEIVGNFNSSLFFNYPNYRNLFPIWALGEFRRRLVAKKG

SEQ ID NO: 4229 - DNA, 2620 bp, Zea mays
  CDS (93)..(2381)
cccacgcgcccgcccgcgcgtctggccgtcgttgacaccagctagtagcagccagcactagtcgctactagctagatagccatatcaccagcatgtggaggctgacggtggccgagggcggcggcccgtggctgcgctcgacgaacggcttcgtggggcgggcggtgtgggagttcgaccctgacctcggtacgccggaggagcgcgacgaggtagagagggtacgccaggagttctccgaccaccgcttccagaggagagagtcggccgacctcctcatgcgcatgcagtgcgcaaagcagaacagatctcaacgtcgtgatctgccacgcatcaagcttggggaggatgagcacgtcactgaagaaattgtactgagctccttgaggtcggctctggaccagttctcttcactgcaagccagcgatgggcactggcctggtgatttcagcgggattatgttcatcatgcctggtttgatatttgccttgtatgtcactggatcactgaatgttgtcatatcaccagaacatcggcatgagatttgccgctacatctacaaccaccagaacgaagatggtggatggggcacacttatcttgggttcgagcaccatgtttggcacatgctcaaactacatcaccttgaggcttctcggtgaggagccatacgccaacaacagtgtgttggctaaagggcgtgcttggattctatcccatggtggtgcaaccttgattcctcagtggggaaaaatatggctttcggtacttggattgtttgattggtcaggaaataatccaattttccctgaactatggtccattccccagtttcttccatttcatccagggaaattctggtgctttgcccgtatggtatatctaccaatggcttatctttatggcaagaaatttgttggaccaattacaccaactatattggcactaagagaggaaatctatgacactccttatggaaagattgactggagtgatgctcgtagtaaatgcgcaaaggaggacctcatctgtccacgcacactgttgcagaatgttatttggacttcactttataggtgtgtggaaccagtattgagcagttggcctatcaacaagctgagagagagagctctgggaaacatcatggagcatatccattatgaagatgagaacacacaatacctatgcatatgtcctgtgaataaggctctaaacatggtctgctgctgggtagaagatccaaattcagatgcattcaagcgtcaccttgcaaggataccagacttcttgtggatttcagaagatggcatgaaggcacaagtatatgatggctgccagagctgggagacatcattcataattcaagcattttgcgctacagatcttgttaatgactatggttcaactcttcagagagcctatgagtttatgaaaaattcacaggtcatgaggaaccatcctggtgaccaacgttattggcatcgccatagatcgaagggttcatggacactttcatctgcagacaatggatgggctgtatctgacactacaggagaagcacttaaggctgtactgttgctgtcaaagatctcaaacaaaaacaaccttgttggggatccaatagaaagagaaaggttgcatgacgctattgattgccttctatcttttgcgaacaaagatggcaccttttctacatatgagtgcaaaagaacttattcttggttagagattctaagtccttgtgagactttcccaaacattgttgtcgattatccttacccagaatgcacttcatcagtgctccaagctctgatattgttcaaagacttatatcctggttaccgcacagaagagatagaagcattagttagaagtgcagcaacgtttattgagaccaaacaacaagaagacggttcatggttaggtaattggggtatatgtttcacctacggggccttcttttcgattaaaggtttagtcgcttctggaagaacgtacaagaacagcccttgcatacggaaagcatgccacttcatattgtcgaagcagctcagtactggtggatggggagaaagccatatcgctattgaaactcaggtgtatgtaaatctcaaaggtgaccgtgctcacgctgtgaataccgcctgggcaatgctcgctttaatttatgctggacagtttgaacgagatccaacgccattacatcgtgctgcaaaggaattgatcaacatgcaactggagacaggagagtttcctcagcaagagcatgtaggatgcttcaactgcagcctctacttcaattacccaagctaccgcaacttgttccccatctgggctctcggtgagtaccatcgtggccttcgtgcaaagaaagacaagtgagtccgtgtgtctatatatatatatatatagagagagagagagtacgtatagcattgtgaggaataaaacaggttgcgtcggtggtgagtgcgcagaaacaagatgtgcttttatgtaggcgtaccacagtgtacaatgttggtcgttgttagactgtaaggctatcatgacgttgtatattgtaatatatatatagtgttccatatgtttcaaattatataagacgttttatcttctct

SEQ ID NO: 4230 - protein, 762 aa, Zea mays
MWRLTVAEGGGPWLRSTNGFVGRAVWEFDPDLGTPEERDEVERVRQEFSDHRFQRRESADLLMRMQCAKQNRSQRRDLPRIKLGEDEHVTEEIVLSSLRSALDQFSSLQASDGHWPGDFSGIMFIMPGLIFALYVTGSLNVVISPEHRHEICRYIYNHQNEDGGWGTLILGSSTMFGTCSNYITLRLLGEEPYANNSVLAKGRAWILSHGGATLIPQWGKIWLSVLGLFDWSGNNPIFPELWSIPQFLPFHPGKFWCFARMVYLPMAYLYGKKFVGPITPTILALREEIYDTPYGKIDWSDARSKCAKEDLICPRTLLQNVIWTSLYRCVEPVLSSWPINKLRERALGNIMEHIHYEDENTQYLCICPVNKALNMVCCWVEDPNSDAFKRHLARIPDFLWISEDGMKAQVYDGCQSWETSFIIQAFCATDLVNDYGSTLQRAYEFMKNSQVMRNHPGDQRYWHRHRSKGSWTLSSADNGWAVSDTTGEALKAVLLLSKISNKNNLVGDPIERERLHDAIDCLLSFANKDGTFSTYECKRTYSWLEILSPCETFPNIVVDYPYPECTSSVLQALILFKDLYPGYRTEEIEALVRSAATFIETKQQEDGSWLGNWGICFTYGAFFSIKGLVASGRTYKNSPCIRKACHFILSKQLSTGGWGESHIAIETQVYVNLKGDRAHAVNTAWAMLALIYAGQFERDPTPLHRAAKELINMQLETGEFPQQEHVGCFNCSLYFNYPSYRNLFPIWALGEYHRGLRAKKDK

SEQ ID NO: 4231 - DNA, 2713 bp, Zea mays
  CDS (198)..(2477)
  misc_feature (2703)..(2703): n is a, g, c or t
ctccactcaaatcccaaatcaaatcaactccccagcctgaactgtcctctcctggactaccctcgccatccatcaacgcccgccacagagggggatcccggcctcccggtgccgggagccaagccaagccacgcaccggccggccgcggcggatcggaacctcccccaccgctcgcccgccgcatttgaggagggcgatgtggcgcctgcggatcgcggaggggggcggggacccctggctacgcacgaagaacgcccacgtcggccgccaggtgtgggagttcgacgccgccgccgaccccgaccccgccgtcgacgccgcgcgccgcgccttcgtcgccaccaggggccacctcaagcacagcgccgacctcctcatgcgcatccagttcgccaaagaaaactcgattgagcttcaccttccaggcatcaagctcggtgagcatgaagatgtgaccgaggaagctgtgttgactacattgaaaagggcaatcagccgtttctctactctccaggcacatgatggacactggcctggggattatggtggtcctatgttccttatgccaggcttgatcataacattgtatgtgactggagcactaaacactgtcttgtcattggaacaccagaaggagatccgccggtatctttataatcaccagaatgaagatggcggctggggcttgcacattgagggtccaagcaccatgttcggctcagcactgacctatgttattttgagattgcttggagagggaccagatagtggagatggagccatggagaaaggtcggaactggatattagaccatggtggagcaacatatataacatcgtgggggaagttttggctttcggtactaggtgtatttgaatggtctggtaacaacccggtgccaccagaagtatggctactgccatatctcctcccatttcacccagggaggatgtggtgtcattgtcgaatggtgtatttgccaatgtgctacatttatgggaagaggtttgttggccgaatcacaccacttctgttggaattaaggaaggaacttttcaaagacccttacagcaagattgattgggacaaggcccgcaacctatgtgccaaggaagatctgtactacccacacccattcgttcaagatgtgttatgggccactctccataaattcgttgaaccagttatgatgcattggcctggcagcaaattgagggagaaagctctggaaacagtcatgcaacatgttcattatgaagatgagaacactcgttatatttgcattggtcctgtaaacaaggtattgaatatgcttgcttgctggattgaagatccaaactcggaggccttcaaacttcatatcccacgagtctatgattacttgtggcttgctgaagatggcatgaagatgcagggttataatggcagccaactttgggatacagctttcacagttcaagccattgtggctaccaaccttattgaagagtttggtcctacccttaaactagcacacaactatatcaagaattcacaggttcttgatgactgccctggtgatctgaatgactggtaccgccacacatctaaaggtgcatggccattctcaactgctgatcatggttggcctatatctgattgcactgctgaaggactaaaggcctcattattgttatcaaggatctctcccaaaattgttggtgaaccgatggaagctaatagattttatgatgctgtcagttgtctgatgtcttatatgaatgataatggcggcttcgcgacatatgaactcacaagatcttatccctggttggagctgatcaatcctgctgagacctttggggatattgtgattgattacccgtatgttgaatgtacatcagcagcaattcaggccctgacatcattcaaaaaactataccctgggcaccgcaggaaagaggtggataactgtatcagcaaagcttccaatttcatcgagagtattcagaaaagcgatggttcatggtatggctcttgggccgtttgtttcacatacggcacttggtttggtgtgaagggactaattgctgctggtagaacatttgagaacagtcctgcaattagaaaggcatgcgactttctgttgtcaaaagaacttccttccggtggttggggagaaagctatttgtcatctcaagaccaggtttacaccaatctcaaaggcaaccggcctcatgcagtgaacactagttgggccatgctggcgctgattgatgcaggccaggccgagagagatccaacgcctctacaccgagcagcaaaggttttgatcaacttgcaatcacatgatggagaatttcctcagcaagagatcataggagtgttcaacaagaactgcatgataagctactcccagtacaggaacatcttcccgatttgggctctgggtgagtaccggtgccgagtcttgggggctggcaagtcttggcggtgaacgggaggtgtgcgtgtgtgtgtgtcatggatcggcttttgtgagtagccatgtggaagttggaataatatagctacgttacgttcagggggttgcgctactagtggtcctagtaataatagtgatggtgatagcaatgtactcctcattattacaatctcaaagtggttcatgccattgccatgcacttctcataaaaactcgagaaaaaaaaaaaaaaaaaacncgaggggggg

SEQ ID NO: 4232 - protein, 759 aa, Zea mays
MWRLRIAEGGGDPWLRTKNAHVGRQVWEFDAAADPDPAVDAARRAFVATRGHLKHSADLLMRIQFAKENSIELHLPGIKLGEHEDVTEEAVLTTLKRAISRFSTLQAHDGHWPGDYGGPMFLMPGLIITLYVTGALNTVLSLEHQKEIRRYLYNHQNEDGGWGLHIEGPSTMFGSALTYVILRLLGEGPDSGDGAMEKGRNWILDHGGATYITSWGKFWLSVLGVFEWSGNNPVPPEVWLLPYLLPFHPGRMWCHCRMVYLPMCYIYGKRFVGRITPLLLELRKELFKDPYSKIDWDKARNLCAKEDLYYPHPFVQDVLWATLHKFVEPVMMHWPGSKLREKALETVMQHVHYEDENTRYICIGPVNKVLNMLACWIEDPNSEAFKLHIPRVYDYLWLAEDGMKMQGYNGSQLWDTAFTVQAIVATNLIEEFGPTLKLAHNYIKNSQVLDDCPGDLNDWYRHTSKGAWPFSTADHGWPISDCTAEGLKASLLLSRISPKIVGEPMEANRFYDAVSCLMSYMNDNGGFATYELTRSYPWLELINPAETFGDIVIDYPYVECTSAAIQALTSFKKLYPGHRRKEVDNCISKASNFIESIQKSDGSWYGSWAVCFTYGTWFGVKGLIAAGRTFENSPAIRKACDFLLSKELPSGGWGESYLSSQDQVYTNLKGNRPHAVNTSWAMLALIDAGQAERDPTPLHRAAKVLINLQSHDGEFPQQEIIGVFNKNCMISYSQYRNIFPIWALGEYRCRVLGAGKSWR

SEQ ID NO: 4233 - DNA, 2776 bp, Zea mays
  CDS (202)..(2475)
ccagtggccctatagaagagacgggatcccgccaggcctcccgggaccgggagccacgccacgcaggcacgcacgcggaggggagcgccggccgtccgcggcggattgggatctccctcgcccgcccgcccgtccactcgagactcgacggcacccgccgcatttgagctgagctgaggaggcgtgggggacggcgcggggatgtggcgcctgcggatcgcggaggggggcggggacccctggctccgcacgaagaacgcccacgtcggccgccaggtctgggagttcgacgcctccgccgaccccgaccccgccgtcgacgccgcgcgccgcgccttcgccggcagcaggggccacctcaagcacagcgccgacctcctcatgcgcatccagttcgccaaagaaaatcctcttgagcttgaccttccagcgatcaagctcggtgagcacgaagacgtaaccgaggaagccgtgtctactactttgagaagggcaatcagccgtctttctactctccaggcacatgatggacactggcctggggattatggtggccctatgttccttatgccaggcttgatcataacattgtatgtgactggagcactaaacactgtcttgtcatcagaacaccagaaggagatccgtcggtatctttataatcatcagaatgaagatggtggctggggcttgcacattgagggtccaagcaccatgtttggctcagcactgacctacgttactttgagattgcttggagagggaccagatagtggagatggagcaatggagaaaggccgaaactggatcttagaccatggcggagcaacatatataacatcttgggggaagttttggctctcggtacttggtgtatttgaatggtctggtaacaacccggtaccaccagaagtatggctactgccatatctcctgccatttcacccagggaggatgtggtgtcattgtcgaatggtgtatttgccaatgtgctacatctatgggaagaggtttgttggtcgaatcacaccactcgtgttggaattaagaaaggaacttttcaaagacccttacagcaagattgattgggacaaggcccgcaatctatgtgctaaggaagatctgtactatccacatccatttgttcaagatgtcttatgggccactctccataaatttgttgaaccagttatgatgagttggcctggcagtaaattgagggagaaagctctggagacagccatgcaacatgttcactatgaggatgagaacactcggtacatttgcattggtcctgtaaacaaggtattaaatatgcttgcttgctggattgaagatccaaactcagaggccttcaaactccacatcccacgagtctatgactacttgtggcttgctgaagatggcatgaagatgcagggctataatggtagccaactttgggatacagctttcatagttcaagccattgtggctaccaaccttaccgaagagtttggtcccacccttaaactagcacacaactatatcaagaaatcacaggttcttgacgactgccctggtgatctgaatgactggtaccgccacacatctaaaggcgcatggccattctcaaccgcggatcatggttggcctatatctgattgcactgctgaaggactaaaggcttcattattgttatcaaagatttctcctgaaattgttggtggaccgatagaagctaatagattttatgatgctgtcagttgtctgatgtcttatatgaatgataatggtggttttgcgacttatgaactcacaagatcctatgcctggctggagctgatcaatcctgctgagacctttggggatattgtgattgattacccgtatgttgaatgtacatcagcagcaatccaggccctgacatcattcagaaaactataccctgggcaccgcaggaaagaggtggacaactgtatcagcaaagctgctaatttcattgagagcattcagaaaagtgacggttcatggtatggctcttgggctgtttgtttcacgtacggcacttggtttggtgtgaagggactaattgctgctggtagaacatttgagagcagtcctgcaatcagaaaggcatgcggctttctgttatcaaaagagcttccttccggtggctggggagaaagctatttatcgtctcaagaccaggtttacaccaatctcaaaggcaaccgagctcatgcagcgaacactggttgggccatgctggcgctgattgatgcaggacaggcccagagagatcccgcgcctctacaccgagcagcaagggttttgataaacttgcagtcagaggacggagaatttccccagcaagagatcataggagtgttcaacaagaactgcatgatcagttactcccagtacaggaacaccttcccgatctgggctctgggagagtaccggtgccgagtcctgggagctggcaagcggtagtgacccggcctggccccgtcaacttgactgaaaggcgctttgttgtctttgttgtcttggtgttcttggtgttctatcttggcacgccgagggctgtcttgccggccgcctagctgtctcatgaatcaatcagcttttttgtgagtagctagctatgtgcggtggttggaataatgcagctatgcttttttttagggttgcgctcctagttctaataatgtactacgtatattggaagcagaataaatgttagattgaactaatggtgccattaaagatgacaatagaactcttccgaagc

SEQ ID NO: 4234 - protein, 757 aa, Zea mays
MWRLRIAEGGGDPWLRTKNAHVGRQVWEFDASADPDPAVDAARRAFAGSRGHLKHSADLLMRIQFAKENPLELDLPAIKLGEHEDVTEEAVSTTLRRAISRLSTLQAHDGHWPGDYGGPMFLMPGLIITLYVTGALNTVLSSEHQKEIRRYLYNHQNEDGGWGLHIEGPSTMFGSALTYVTLRLLGEGPDSGDGAMEKGRNWILDHGGATYITSWGKFWLSVLGVFEWSGNNPVPPEVWLLPYLLPFHPGRMWCHCRMVYLPMCYIYGKRFVGRITPLVLELRKELFKDPYSKIDWDKARNLCAKEDLYYPHPFVQDVLWATLHKFVEPVMMSWPGSKLREKALETAMQHVHYEDENTRYICIGPVNKVLNMLACWIEDPNSEAFKLHIPRVYDYLWLAEDGMKMQGYNGSQLWDTAFIVQAIVATNLTEEFGPTLKLAHNYIKKSQVLDDCPGDLNDWYRHTSKGAWPFSTADHGWPISDCTAEGLKASLLLSKISPEIVGGPIEANRFYDAVSCLMSYMNDNGGFATYELTRSYAWLELINPAETFGDIVIDYPYVECTSAAIQALTSFRKLYPGHRRKEVDNCISKAANFIESIQKSDGSWYGSWAVCFTYGTWFGVKGLIAAGRTFESSPAIRKACGFLLSKELPSGGWGESYLSSQDQVYTNLKGNRAHAANTGWAMLALIDAGQAQRDPAPLHRAARVLINLQSEDGEFPQQEIIGVFNKNCMISYSQYRNTFPIWALGEYRCRVLGAGKR

SEQ ID NO: 4235 - DNA, 2545 bp, Zea mays subsp. mays
  CDS (70)..(2358)
gcacgagaccattacctagaacatcctaatcgaaaaagtcgctactagctagatagccatatcaccagcatgtggaggctgacggtggccgagggcggcggcccgtggctgcgctcgacgaacggcttcgtggggcgggcggtgtgggagttcgaccctgacctcggtacgccggaggagcgcgacgaggtagagagggtacgccaggagttctccgaccaccgcttccagaggagagagtcggccgacctcctcatgcgcatgcagtgcgcaaagcagaacagatctcaacgtcgtgatctgccacgcatcaagcttggggaggatgagcacgtcactgaagaaattgtactgagctccttgaggtcggctctggaccagttctcttcactgcaagccagcgatgggcactggcctggtgatttcagcgggattatgttcatcatgcctggtttgatatttgccttgtatgtcactggatcactgaatgttgtcatatcaccagaacatcggcatgagatttgccgctacatctacaaccaccagaacgaagatggtggatgtggcacacttatcttgggttcgagcaccatgtttggcacatgctcaaactacatcaccttgaggcttctcggtgaggagccatacgccaacaacagtgtgttggctaaagggcgtgcttggattctatcccatggtggtgcaaccttgattcctcagtggggaaaaatatggctttcggtacttggattgtttgattggtcaggaaataatccaattttccctgaactatggtccattccccagtttcttccatttcatccagggaaattctggtgctttgcccgtatggtatatctaccaatggcttatctttatggcaagaaatttgttggaccaattacaccaactatattggcactaagagaggaaatctatgacactccttatggaaagattgactggagtgatgctcgtagtaaatgcgcaaaggaggacctcatctgtccacgcacactgttgcagaatgttatttggacttcactttataggtgtgtggaaccagtattgagcagttggcctatcaacaagctgagagagagagctctgggaaacatcatggagcatatccattatgaagatgagaacacacaatacctatgcatatgtcctgtgaataaggctctaaacatggtctgctgctgggtagaagatccaaattcagatgcattcaagcgtcaccttgcaaggataccagacttcttgtggatttcagaagatggcatgaaggcacaagtatatgatggctgccagagctgggagacatcattcataattcaagcattttgcgctacagatcttgttaatgactatggttcaactcttcagagagcctatgagtttatgaaaaattcacaggtcatgaggaaccatcctggtgaccaacgttattggcatcgccatagatcgaagggttcatggacactttcatctgcagacaatggatgggctgtatctgacactacaggagaagcacttaaggctgtactgttgctgtcaaagatctcaaacaaaaacaaccttgttggggatccaatagaaagagaaaggttgcatgacgctattgattgccttctatcttttgcgaacaaagatggcaccttttctacatatgagtgcaaaagaacttattcttggttagagattctaagtccttgtgagactttcccaaacattgttgtcgattatccttacccagaatgcacttcatcagtgctccaagctctgatattgttcaaagacttatatcctggttaccgcacagaagagatagaagcattagttagaagtgcagcaacgtttattgagaccaaacaacaagaagacggttcatggttaggtaattggggtatatgtttcacctacggggccttcttttcgattaaaggtttagtcgcttctggaagaacgtacaagaacagcccttgcatacggaaagcatgccacttcatattgtcgaagcagctcagtactggtggatggggagaaagccatatcgctattgaaactcaggtgtatgtaaatctcaaaggtgaccgtgctcacgctgtgaataccgcctgggcaatgctcgctttaatttatgctggacagtttgaacgagatccaacgccattacattgtgctgcaaaggaattgatcaacatgcaactggagacaggagagtttcctcagcaagagcatgtaggatgcttcaactgcagcctctacttcaattacccaagctaccgcaacttgttccccatctgggctctcggtgagtaccatcgtggccttcgtgcaaagaaagacaattgagtccgtgtgtgtatatatatagtacgtatagcattgtgaggaataaaacaggttgcgtcggtggtgagtgcgcaaaaacaagatgtacttttatgtaggtgtaccacagtgtacaatgttggtcgttgttagactgtaaggctatcatgacgtgtatattgtaatatatatactacgtgattggtgc

SEQ ID NO: 4236 - protein, 762 aa, Zea mays subsp. mays
MWRLTVAEGGGPWLRSTNGFVGRAVWEFDPDLGTPEERDEVERVRQEFSDHRFQRRESADLLMRMQCAKQNRSQRRDLPRIKLGEDEHVTEEIVLSSLRSALDQFSSLQASDGHWPGDFSGIMFIMPGLIFALYVTGSLNVVISPEHRHEICRYIYNHQNEDGGCGTLILGSSTMFGTCSNYITLRLLGEEPYANNSVLAKGRAWILSHGGATLIPQWGKIWLSVLGLFDWSGNNPIFPELWSIPQFLPFHPGKFWCFARMVYLPMAYLYGKKFVGPITPTILALREEIYDTPYGKIDWSDARSKCAKEDLICPRTLLQNVIWTSLYRCVEPVLSSWPINKLRERALGNIMEHIHYEDENTQYLCICPVNKALNMVCCWVEDPNSDAFKRHLARIPDFLWISEDGMKAQVYDGCQSWETSFIIQAFCATDLVNDYGSTLQRAYEFMKNSQVMRNHPGDQRYWHRHRSKGSWTLSSADNGWAVSDTTGEALKAVLLLSKISNKNNLVGDPIERERLHDAIDCLLSFANKDGTFSTYECKRTYSWLEILSPCETFPNIVVDYPYPECTSSVLQALILFKDLYPGYRTEEIEALVRSAATFIETKQQEDGSWLGNWGICFTYGAFFSIKGLVASGRTYKNSPCIRKACHFILSKQLSTGGWGESHIAIETQVYVNLKGDRAHAVNTAWAMLALIYAGQFERDPTPLHCAAKELINMQLETGEFPQQEHVGCFNCSLYFNYPSYRNLFPIWALGEYHRGLRAKKDN

SEQ ID NO: 4237 - DNA, 2620 bp, Glycine max
  CDS (91)..(2382)
cttaaatcaacacgttggacgagtttttttctgtctgtagctgtcggaagtttgaaacatacatattcttcttaattttgggtcagtagtatgtggaagttgaagatagcagaaggaggagatgggttaatctctgtgaacaatttcattggacgtcaacactgggagtttgatcctaatgctggaactccacaagaacgtgctcaagttgaaagggtacgagaggaatacaaaaagaaccggttttgcattaagcaaagcggtgacctactcatgagaatgcagctcacaaaggagaacacgtgtgggcccattctagcaagagtgaacgtgaaagacacggaaaacgtaacggaggaagcattgatcactacaatgagaaaggctatcaatttctattcctctattcaagcccatgatggccactggccagcagaatctgctggccctttgtttttccttcaacctttggtaatggcactctatattacagggtccctaaatgatgttttaggaccagaacaccagaaggaaattattcgttatttgtataatcatcagaacgaagatggaggttggggattgcatatagagagtcacagcacaatgtttgggtcagcgttgagctacattgccttgagaattcttggagaagggcctgaagatggtgaagacagggcaatggctagaggcagaaaatggatcctcgaccacggtggtttggaagctattccatcctggggaaagttctgggtcacggtacttggagtttatgagtggtcaggctgcaacccacttccaccagagatatggcttttgcccaagtacgcccccattcatccagggaaaatgttatgctactgtcgcttagtttacatgcccatgtcatacttatttgggaagagatttgtgggtccaattaccgggttaatcatatctctaagagaagaaatgtacaaccagccttatgatcaaatcgattggaataacgcccgaagcacagttgccaaggaggatctctattacccacatcctctgattcaagatatgttatgggcatctcttcatcacgtggcagagcctcttctgaattgctggcccttttccatgctgagagagaaggcactagaagtcgcaattgatcatattcgttatgaggacgagaacagtggatacctttgtattggtagtgtagagaaggtgttgtgtttgattgcacgttgggtcgaagatccaaactcagaggcatacaagcttcatttagccagaatccctgattacttttggcttgcagaagatggattgaaaatccagagtttgggttctcaactgtgggatgctacattagctatacaagcaataatatcatgtgatttgagtgaagagtatggacctacacttcgtaaagcacaccactttgtcaaggcttcccaggtgcttgaaaatccatcaggtaatttcaaagcaatgcatcgacacatatccaaaggagcatggacattctcaatgcaggatcagggttggcaagtctctgactgcacagcagaaggattaaaggctgcacttctattgtcacaaatgtctcctgacctaataggcgagaaaatggaagatgagaggttctatgatgctgttgatgtgattttatctcttcagagcggcaatggcggcttccctgcttgggagcctcaaagagcgtaccgttggttagagaagttcaatccaacggaaatcttcaaagacactctcattgagatggagtatgtggagtgcacatcatcggcattgcagggcctggctttgtttagaaagttatatccaaaacacagaagaaaggaagtcgatctctgtatttctaaagcaatccgttacattgaaaaaacacaaaatcctgatggatcatggtttggctgttggggaatttgctatacctatggtacattgttttctgtaaaagggttaacagactgtggaaaaaactaccgtaatagtcctgccttgcgtaaagcttgcaaatttttgttgtcaaagcagcttcctaatggaggatggggtgagagttacttgtcaagccaaaacaaggtttacacaaatctaaaaggcaacagggcaaacttagttcaaacttcatgggctttgatgtccctcattgatgcagggcaggttgagatagatccaacacccgtagagcgtggaataaggttattaataaattctcaaatggaagatggagactttccacaacaggagatcactggagtattcatgaggaattgtacgctgaactattcttcatatcgaaacatttttctcatatgggctctgggagagtatcgtcgccgtgtctttacgcataaaagtcaaatacttagctccacctaactccaatccaactcattttgttgcctcaatgcacccattattatacttagcaactaagcgcagtgcaatttttgcggagccacccttcgcccttgtaaacacagcacatgttgcaagggtatctgccatgatgcttgttcactttagttcttatcattttttataggtcttatctcatgttacattatatttaaaaactttaatggtagagagagagagaccgacacgcagcggccgc

SEQ ID NO: 4238 - protein, 763 aa, Glycine max
MWKLKIAEGGDGLISVNNFIGRQHWEFDPNAGTPQERAQVERVREEYKKNRFCIKQSGDLLMRMQLTKENTCGPILARVNVKDTENVTEEALITTMRKAINFYSSIQAHDGHWPAESAGPLFFLQPLVMALYITGSLNDVLGPEHQKEIIRYLYNHQNEDGGWGLHIESHSTMFGSALSYIALRILGEGPEDGEDRAMARGRKWILDHGGLEAIPSWGKFWVTVLGVYEWSGCNPLPPEIWLLPKYAPIHPGKMLCYCRLVYMPMSYLFGKRFVGPITGLIISLREEMYNQPYDQIDWNNARSTVAKEDLYYPHPLIQDMLWASLHHVAEPLLNCWPFSMLREKALEVAIDHIRYEDENSGYLCIGSVEKVLCLIARWVEDPNSEAYKLHLARIPDYFWLAEDGLKIQSLGSQLWDATLAIQAIISCDLSEEYGPTLRKAHHFVKASQVLENPSGNFKAMHRHISKGAWTFSMQDQGWQVSDCTAEGLKAALLLSQMSPDLIGEKMEDERFYDAVDVILSLQSGNGGFPAWEPQRAYRWLEKFNPTEIFKDTLIEMEYVECTSSALQGLALFRKLYPKHRRKEVDLCISKAIRYIEKTQNPDGSWFGCWGICYTYGTLFSVKGLTDCGKNYRNSPALRKACKFLLSKQLPNGGWGESYLSSQNKVYTNLKGNRANLVQTSWALMSLIDAGQVEIDPTPVERGIRLLINSQMEDGDFPQQEITGVFMRNCTLNYSSYRNIFLIWALGEYRRRVFTHKSQILSST

SEQ ID NO: 4239 - DNA, 2731 bp, Glycine max
  CDS (282)..(2567)
atagattcgaggacagattttaaaagcaacctaagttttgtatttacaaaactgagcttccagaaggaaaaaaaaaatcaatttgctaaagttattttaggataactaactaagcatgtcaagaaatcgagtttattctctaaaaatattttcaacataagaaaaacaatactttttgaatggttagtaaaacatgtctttaatcagttgcttcgtattttcatgcagttaggtgcatcaattgactgtggcattatagcatattaagagaaagcaacaaaatgtggaggctgaagatagcagatggtggaaaagacccatacattttcagcacaaacaattttgtaggaagacagacatgggagtttgatcctgaggcaggaactccagaggaacgagctcaagttgaagcagctcgtcaaaatttttataacaatcgcttcaaggtcaaggcatgtggtgatctcctttggcgttttcagattctgagagaaaaaaacttcaaacaatcaatacctagtgtgaagatagaagatggagaagaaataacatacgaaaaagtcataagcacgttgagaagagccgcacaccacctatcagcattgcagaccagtgatggccattggcctgcacaaattgcaggtcctctgttttttctgcctcctttggttttttgtatgtacattacagggcatcttgatttggtattcccagaagagtatcgaaaagagattctccgttacatatactatcaccagaatgaagatggaggatggggactacacatagagggtcatagcaccatgtttggtactacactaaactatatatgtatgcgaattcttggagaagggcctaatggaggtcatgaaaatgcatgtgctagaggaaaaaagtggattcatgatcatggtggtgtaacacacatcccttcatgggggaaaacttggctttcgatacttggtgtatttgattggtgtggaagcaacccaatgcccccagagttttggattattccttcgtttcttcctatgcatccagctaaaatgtggtgttattgtcgattggtatatatgcctatgtcttatatgggaaaagggtttgtgggtccaatcacaccactcatcttacaattgagagaagagctctttactcagccttatgaaaaagttaattggaaaaaagtgcgtcatcaatgtgcaaaggaagatctttattatcctcattctttgatacaagacctagtatgggacagtctatacatgtttactgagccactacttacttgttggcctttcaacaaactaattagagaaaaggcccttcaagtaacaatgaaccatattcattacgaagatgagaatagtcgatacataactattgggtgtgtggaaaaggttctatgtatgcttgcttgttgggttgaagatccacagggagatgcctttaagaagcatcttgcaagggtctcagattacttatgggtttctgaagatggaatgaccatgcaaagttttggtagtcaagaatgggatgctggttttgcagttcaagctttgcttgcaactaagctaattgacgaaattggccattcacttgcaaaagggcatgatttcatcaagaagtctcaggtgagagacaacccttcaggagattttaagagtatgtatcgtcatattactaaagggtcttggacattctcagatcaagaccatggatggcaagtttctgattgcactgcagaaggtttaaagtgttgtcttcttctatcaaagttgtcaccagagattgtgggagaaaaagtgaaacctgaaagattttatgattcagtcaatatcttgttgtcacttcagagtaaaaaaggtggtatagcagcatgggaaccaataggagctcaagaatggttggaattactcaatcccactgaattttttgaggacattgtaattgagcatgaatatgttgagtgcactggatctgcaattcaagctttagttttgttccagaagctatatccagagcataggaagacagagattaagaatttcattgtcaatgcagttcaattccttgaagatacacaaacaaccaatggttcatggtatggatgttggggagtttgctacacttatggctcttggtttgcacttggtggtctagcagctgccggtaagacttacactaattgtaatgccattcgcaaggctgtgaaatttctacttacaacacagagagaggatggtgggtggggagagagttatctttcaagcccaaaaaagatatacatacctcttgaaggaagtcgatcaaacgttgtacaaacagcatgggctcttatgggtctaatttatgctggacagtcagagagagaccttactcctcttcatcgagctgcaaagttgctcattaattcccagttggaagaaggtgattggccccaacaggaaatcactggagtattcttgaaaaactgcatgatgcattacccaatgtatagaaatatttttccaatgtgggctctagctgaatatcgtaggcgagttccattgccatccactgaaggttaattttgaaaaggtgtgtgcataaaagggcaaagacatatcaatgaggaatggggcaagaagcacccattgtctcttacttggactctattgatctgtaattttgaagcttgctttttattataaaataaaaaattatttacgcacaaaaaaaaaaaaaaaaaaaa

SEQ ID NO: 4240 - protein, 761 aa, Glycine max
MWRLKIADGGKDPYIFSTNNFVGRQTWEFDPEAGTPEERAQVEAARQNFYNNRFKVKACGDLLWRFQILREKNFKQSIPSVKIEDGEEITYEKVISTLRRAAHHLSALQTSDGHWPAQIAGPLFFLPPLVFCMYITGHLDLVFPEEYRKEILRYIYYHQNEDGGWGLHIEGHSTMFGTTLNYICMRILGEGPNGGHENACARGKKWIHDHGGVTHIPSWGKTWLSILGVFDWCGSNPMPPEFWIIPSFLPMHPAKMWCYCRLVYMPMSYMGKGFVGPITPLILQLREELFTQPYEKVNWKKVRHQCAKEDLYYPHSLIQDLVWDSLYMFTEPLLTCWPFNKLIREKALQVTMNHIHYEDENSRYITIGCVEKVLCMLACWVEDPQGDAFKKHLARVSDYLWVSEDGMTMQSFGSQEWDAGFAVQALLATKLIDEIGHSLAKGHDFIKKSQVRDNPSGDFKSMYRHITKGSWTFSDQDHGWQVSDCTAEGLKCCLLLSKLSPEIVGEKVKPERFYDSVNILLSLQSKKGGIAAWEPIGAQEWLELLNPTEFFEDIVIEHEYVECTGSAIQALVLFQKLYPEHRKTEIKNFIVNAVQFLEDTQTTNGSWYGCWGVCYTYGSWFALGGLAAAGKTYTNCNAIRKAVKFLLTTQREDGGWGESYLSSPKKIYIPLEGSRSNVVQTAWALMGLIYAGQSERDLTPLHRAAKLLINSQLEEGDWPQQEITGVFLKNCMMHYPMYRNIFPMWALAEYRRRVPLPSTEG

SEQ ID NO: 4241 - DNA, 2478 bp, Glycine max
  CDS (34)..(2322)
ggtttgtttggtgtgagtgaatagggatcagggatgtggaggctgaagatagcagatggaggaaatgatccatacatattcagcacaaacaatttcgttgggaggcagacatgggagtttgatcctgaagcaggcagtccagaggaacgggcccaggttgaagcagctcgtcagcatttctaccacaaccgcttcaaggtcaagccctgcgctgacctcctttggcgttttcaggttctcagagaaaataacttcaaacaaacaattcctcgtgtgactatagaagatggagaggaaatcacataccaaaaagtcacaagcgccgtcagaaggggcgcacaccaccttgcggcactgcagacctctgatggccattggcctgctcaaattgcaggtcctctcttctttcttcctcccttggttttttgtatgtatattacaggaaatcttgaatcagtatttccagaagaacatcgcaaagaaattcttcgttacacatattatcaccagaatgaagacggaggatggggactacacatagagggtcatagcactatgttttgtactgcactgaactatatatgcatgcgaatgcttggagaaggacctaatggaggtcatgacaatgcttgtgctagagcaagaaagtggattcgagatcatggtggtgtaacacatataccttcatggggaaaaacttggctttcgatactcggtgtatttgattggtgcggaagcaacccaatgcccccagagttttggatccttccatcttttcttcctatgcatccagctaagatgtggtgttactgtcgattggtatacatgcctatgtcttacttatatgggaagaggtttgtgggtccaatcacaccactcatcttacaattaagagaagagttgtttactcaaccttatgaaaaagttaattggaagaaagcgcgtcaccaatgtgcaaaggaagatctttactatccccatcctttgatacaagacctaatatgggatagtttatacatattcactgaaccgctacttactcgttggcctttcaacaagttgattagagaaaaggcccttcaagtaactatgaaacatattcattatgaagatgagactagtcgatacataaccattggttgtgtggaaaaggttttatgtatgcttgcttgttgggtggaagatccaaacggagatgctttcaagaagcatcttgcaagggtcccagattacttatgggtttctgaagatggaatgaccatgcagagttttggtagccaagaatgggatgctggctttgctgttcaagctttgcttgccactaacataattgaagaaattggtcctacgtttgcaaaaggacatgatttcatcaagaagtctcaggtgaaggataatccttttggagattttaaaagtatgcatcgtcatatttctaaagggtcttggacattctctgatcaagaccatggatggcaagtttctgattgcactgcagaaggtttaaagtgttgtctacttctatcaatgttgccaccagagattgtgggagaaaagatggaacctgaaagattatacgattcagtcaatgtcttgttgtcgcttcagagtaaaaaaggtggtttagcagcatgggagcctgcaggagctcaagagtggttagaattactcaatcccacagaattttttgcggacattgtagttgaacatgaatatgttgagtgcactggatctgcaatccaagctttagttttgttcaagaagctatatccaggacataggaagaaagagatagaaaatttcattaccaatgcagttcgattccttgaagatacacaaacagctgatggttcatggtatggaaattggggagtttgcttcacttatggctcttggtttgcacttggaggtctagcagctgctggtaagacttacaccaattgtgctgccattcgcaaagccgttaaatttctacttacaacacaaagagaggacggtggatggggagagagttatctttcaagcccaaaaaagatatatgtacctctagaaggaagccgatcaaatgttgtacatacagcatgggctcttatgggactaattcatgctggacaggcggatagagaccccatgcctcttcaccgtgctgcaaagttgctcattaattctcagttggaagagggtgattggccccaacaggaaatcacgggagtattcatgaaaaattgcatgttgcattatccaatgtacagagatatttatccaatgtgggctctagctgaatatcgaaggcgggttccattgccttccactgaagtttaatttagaatggtttgagcacgaaaaggcaaaggcattttcattaagattgaggcaaataagttgtgtgtaatcaagcttaatcaattttttcatattcctatgtttatttcctacatatattggtagaaaaattatttcaaaaaaaaaaaaaaaaaa

SEQ ID NO: 4242 - protein, 762 aa, Glycine max
MWRLKIADGGNDPYIFSTNNFVGRQTWEFDPEAGSPEERAQVEAARQHFYHNRFKVKPCADLLWRFQVLRENNFKQTIPRVTIEDGEEITYQKVTSAVRRGAHHLAALQTSDGHWPAQIAGPLFFLPPLVFCMYITGNLESVFPEEHRKEILRYTYYHQNEDGGWGLHIEGHSTMFCTALNYICMRMLGEGPNGGHDNACARARKWIRDHGGVTHIPSWGKTWLSILGVFDWCGSNPMPPEFWILPSFLPMHPAKMWCYCRLVYMPMSYLYGKRFVGPITPLILQLREELFTQPYEKVNWKKARHQCAKEDLYYPHPLIQDLIWDSLYIFTEPLLTRWPFNKLIREKALQVTMKHIHYEDETSRYITIGCVEKVLCMLACWVEDPNGDAFKKHLARVPDYLWVSEDGMTMQSFGSQEWDAGFAVQALLATNIIEEIGPTFAKGHDFIKKSQVKDNPFGDFKSMHRHISKGSWTFSDQDHGWQVSDCTAEGLKCCLLLSMLPPEIVGEKMEPERLYDSVNVLLSLQSKKGGLAAWEPAGAQEWLELLNPTEFFADIVVEHEYVECTGSAIQALVLFKKLYPGHRKKEIENFITNAVRFLEDTQTADGSWYGNWGVCFTYGSWFALGGLAAAGKTYTNCAAIRKAVKFLLTTQREDGGWGESYLSSPKKIYVPLEGSRSNVVHTAWALMGLIHAGQADRDPMPLHRAAKLLINSQLEEGDWPQQEITGVFMKNCMLHYPMYRDIYPMWALAEYRRRVPLPSTEV

SEQ ID NO: 4243 - DNA, 2538 bp, Triticum aestivum
  CDS (69)..(2324)
gtttggggtcagcgatagtgatcgggcatttcgtgagctagctgagctaaccacctgttcagagagagatgtggaggctcaaggtgtccgagggtggcggcccgtggctgcggtcggtgaacaacttcctcggcagggcagtgtgggagttcgaccccgactacggcacaccggaggagcgcgccgaggtgaagagggtgcgccgggagttcaccgaccgccgtttcgagaaaaaggagtcgcaggatcttctcatgcgcatgcagtatgcaaaagaaaagcatcttcaggtggaccttccagccatcaagcttgcagacagtgcacaagtcacagaagagactttactaacatcattgaggcgatgccttagccaacattctgctctacaagcacacgatgggcattgggctggggacttcagtggaattttgttcattatgcccatcttgatatttgctctacatgttactggatcactcaatactgtcctatcaacagaacatcgatgtgagatttgtcgctatatttacaaccatcagaatgaagatggtggttggggcacgcaagtgttgggtccgagcaccatgtttggatcatgcttaaactatgttaccttaaggcttcttggcgaggtggaaaatgatgccttaaccaagggacgtgcttggattctattgcgtggaagtgcaactgcaataccacaatggggaaagatatggctctcggtggttggtttatatgaatggtctggaaataattcgatcattcctgagttatggcttgtcccgtattttcttccgattcatccaggacgattctggtgcttttgccggttggtttatatgccaatgtcttatctttacggcaaaaagtttgttggcccaattacaccaacaatagtggcaataagagaggagctctatagtgtatcatacagcgagattgattggaacaaagcacgtgatacttgtgctaaggaagaccttcgctatccacggtcgttgctgcaaaatgttatttggacttgccttaataaatttgtagaaccagtgttgaattgttggccaatcaataagttgagagatacagcgctgaagaacctcatgaaacatatacattatgaagacgaaagcactaaatacattggcgtatgtccgattaacaaggcactagatatgatttgttgttggagcgaggatccaaattcagatgcactgaagttgcatcttccaaggatctatgactatttatggcttgcagaagatggcatgaaagcacaggtttatgatggttgtcaaagctgggagcttgcttttattgttcaagcatattgctcgacagaccttgttaatgagtttggtccaacacttcggaaagcccatgagttcattaaaagttcacaggttcttgagaaccatcctaacagtgaaacttattaccgccataggtcaaaaggttcatggacactttcaacagcggataatgggtggtctgtatcagattgtactgcagaagcacttaaggcattgttgttgttgtcgaagatctctcctaatcttgtgggggatcccgtaaaaggagaaaggttgcatgatgcagtcgattgcttactttcttttatgaataaagatggcacattttctacatatgagtgtaagagaactacatctctattagaggttctcaacccttctgaaagttttctgaacattattgtcgactatccatctgtcgaatgtacatcatctgtgcttcaggccctaattatgttcaaagagctttaccctgggtaccgcaaagaagagataggaaaatgtattaaaaatgcttccaagttcattgaggacaagcaacgaaaggatggctcatggtttggcacttggggtatatgtttcacttatgggacgttctttggtgtaaaaggattgattgcttctggaagaacttacgaaaatagttcttccataaggaaagcatgcaattttctgttgtcaaagcaactaagtacaggtggatggggagagtcttatctttctagtgaaactgaggcttatgtggaggccactagtcctcatgcagtgaacactgcttgggcaatgttggctttaatttatgctgggcaggttgaacgagatcctactccactatatcatgctgcaaaagagttgatcaatatgcaactagagacaggagagtttccccagcaagaacacgttggatgcttcaactgctccatatactttaattacggcaactatcgcaacttataccccatttgggctcttggggagtttcgtcgtcgactgcttgcgaagaactgaaactgatgacgatgatatgtcgcttcactgctcttaggtttaggtgtggtcgtgcctgtgacgaaaaggatgaccttagccaaactatattatatatgtgtgtgtaacacatactgcaataacacttacaaccaaagtgactaatgcaaacataatagcgcctgtttggtttgtaaaaaaaaaaaaaaaaaaaaaaaaaaaaaaaaaaaaaaaa

SEQ ID NO: 4244 - protein, 751 aa, Triticum aestivum
MWRLKVSEGGGPWLRSVNNFLGRAVWEFDPDYGTPEERAEVKRVRREFTDRRFEKKESQDLLMRMQYAKEKHLQVDLPAIKLADSAQVTEETLLTSLRRCLSQHSALQAHDGHWAGDFSGILFIMPILIFALHVTGSLNTVLSTEHRCEICRYIYNHQNEDGGWGTQVLGPSTMFGSCLNYVTLRLLGEVENDALTKGRAWILLRGSATAIPQWGKIWLSVVGLYEWSGNNSIIPELWLVPYFLPIHPGRFWCFCRLVYMPMSYLYGKKFVGPITPTIVAIREELYSVSYSEIDWNKARDTCAKEDLRYPRSLLQNVIWTCLNKFVEPVLNCWPINKLRDTALKNLMKHIHYEDESTKYIGVCPINKALDMICCWSEDPNSDALKLHLPRIYDYLWLAEDGMKAQVYDGCQSWELAFIVQAYCSTDLVNEFGPTLRKAHEFIKSSQVLENHPNSETYYRHRSKGSWTLSTADNGWSVSDCTAEALKALLLLSKISPNLVGDPVKGERLHDAVDCLLSFMNKDGTFSTYECKRTTSLLEVLNPSESFLNIIVDYPSVECTSSVLQALIMFKELYPGYRKEEIGKCIKNASKFIEDKQRKDGSWFGTWGICFTYGTFFGVKGLIASGRTYENSSSIRKACNFLLSKQLSTGGWGESYLSSETEAYVEATSPHAVNTAWAMLALIYAGQVERDPTPLYHAAKELINMQLETGEFPQQEHVGCFNCSIYFNYGNYRNLYPIWALGEFRRRLLAKN

SEQ ID NO: 4245 - DNA, 2292 bp, Arabidopsis thaliana (mouse-ear cress)
  CDS (1)..(2292)
atgtggaggttaaaggtaggagaaggaaaaggaaaagatccttatttattcagcagcaacaacttcgtgggacgtcaaacatgggagtttgaccccaaagccggcacacgggaggaacgaaccgcagtcgaagaagctcgccggagtttcttcgacaaccgttctcgtgttaaaccttccagtgatctattgtggaaaatgcaatttctaaaagaggcaaaatttgagcaagtgattccgccggtaaaaattgacggtggggaagccataacttatgaaaaagcgacaaatgcattacggcgaggagttgctttcttatcagctttgcaagcctccgacggccactggccgggagagttcaccggaccgctctgcatgcttccgccattggtattttgtttgtacattactggacacttggaagaggtattcgatgcagagcatcgcaaagagatgcttcgatatatctattgtcaccagaacgaagatggtggatggggattccacattgagagcaaaagcattatgttcactaccacgctgaattacatatgcttgcgtatacttggagtaggtcccgatggaggactagaaaacgcatgcaaacgggccaggcaatggattcttagccatggcggtgtgatttatattccttgttggggaaaagtttggctctcggtacttggaatctatgattggtctggagtcaacccgatgcctcccgagatttggttgctaccttatttcctaccaattcacctagggaaagcttttagctatacccggataacatatatgcccatctcttatctatatggcaaaaaattcgtgggtcaaattacacctcttattatgcaactacgtgaagaactacacttacaaccttatgaagaaatcaactggaacaaagcgcgacatctatgcgcaaaggaagacaagtactatccccatcctctagttcaagatttgatatgggatgctctccacaccttcgtggagcctttgcttgcaagttggccgataaacaaacttgtaaggaaaaaggctcttcaggtggcaatgaaacacatacattacgaggacgaaaacagtcactatatcaccattggatgtattgaaaagaatttgtgcatgcttgcttgctggattgacaacccggacgggaatcactttaaaaagcatctctctagaattccggacatgatgtgggtagctgaagatggaatgaaaatgcagtgctttggaagtcaactttggatgacgggatttgcagttcaggctttactagcaagtgatccacgcgatgaaacctatgacgtgctcaggagagcacacgattacataaagaaatcacaggttagagacaacccatcaggtgacttcaagagcatgtaccgccacatctccaaaggaggatggactctttctgatcgagatcatggatggcaagtttcagattgtacagctgaagctgctaagtgttgcatgttgctttccacaatgccaactgatatcactggagagaaaatcaatcttgaacaactatacgattctgttaatctcatgttatctctacaaagtgaaaatggaggttttactgcatgggaacctgttcgcgcctataaatggatggaattgatgaatcccacagatttgtttgctaatgctatgaccgagcgtgaatatacagaatgtacctcagctgtgttacaagctttggttatattcaatcaactatatccggatcataggacaaaagagatcactaagtcgattgagaaagcagtgcaattcatagaaagcaaacaattgcgagatggttcatggtacggaagctggggtatttgtttcacttatgggacatggtttgctctttgcggcctagcagcgattggtaagacatacaacaattgtctatctatgcgcgacggtgtacatttccttcttaatatacaaaatgaagatgggggttggggtgaaagctatatgtcatgccctgaacagagatacataccattagaggggaatagatcaaacgtagtgcaaaccgcgtgggctatgatggctctgattcacgctggacaggctaagagagatcttatacctctacatagtgctgcaaaatttattatcacgtcgcaactggaaaacggagattttcctcaacaggaactattaggagcgtctatgagtacatgcatgctacactattctacatacaaagacatcttcccaccatgggcacttgcagagtaccggaaagctgcgttcatacatcacgcagatctatag

SEQ ID NO: 4246 - protein, 763 aa, Arabidopsis thaliana (mouse-ear cress)
MWRLKVGEGKGKDPYLFSSNNFVGRQTWEFDPKAGTREERTAVEEARRSFFDNRSRVKPSSDLLWKMQFLKEAKFEQVIPPVKIDGGEAITYEKATNALRRGVAFLSALQASDGHWPGEFTGPLCMLPPLVFCLYITGHLEEVFDAEHRKEMLRYIYCHQNEDGGWGFHIESKSIMFTTTLNYICLRILGVGPDGGLENACKRARQWILSHGGVIYIPCWGKVWLSVLGIYDWSGVNPMPPEIWLLPYFLPIHLGKAFSYTRITYMPISYLYGKKFVGQITPLIMQLREELHLQPYEEINWNKARHLCAKEDKYYPHPLVQDLIWDALHTFVEPLLASWPINKLVRKKALQVAMKHIHYEDENSHYITIGCIEKNLCMLACWIDNPDGNHFKKHLSRIPDMMWVAEDGMKMQCFGSQLWMTGFAVQALLASDPRDETYDVLRRAHDYIKKSQVRDNPSGDFKSMYRHISKGGWTLSDRDHGWQVSDCTAEAAKCCMLLSTMPTDITGEKINLEQLYDSVNLMLSLQSENGGFTAWEPVRAYKWMELMNPTDLFANAMTEREYTECTSAVLQALVIFNQLYPDHRTKEITKSIEKAVQFIESKQLRDGSWYGSWGICFTYGTWFALCGLAAIGKTYNNCLSMRDGVHFLLNIQNEDGGWGESYMSCPEQRYIPLEGNRSNVVQTAWAMMALIHAGQAKRDLIPLHSAAKFIITSQLENGDFPQQELLGASMSTCMLHYSTYKDIFPPWALAEYRKAAFIHHADL

SEQ ID NO: 4247 - DNA, 2304 bp, Arabidopsis thaliana (mouse-ear cress)
  CDS (1)..(2304)
atgtggaggctgaagatcggggctaagggcggagatgagactcacttattcaccaccaacaactacaccggaaggcagacttgggagtttgatgccgatgcatgctctccagaggaactcgctgaggtcgatgaagctcgtcagaatttctccataaaccgatcacgtttcaagatcagtgctgatctcctttggcgaatgcagttcctgagggagaagaagttcgagcagaagattccgagagtggagataggagatgcggaaaatataacgtacaaagacgcaaagacggcactgagaagagggatactctatttcaaggcattgcaagctgaggatggacattggcctgctgaaaactctggttgcttgttcttcgaagctccctttgtcatatgcttgtacatcactggacatttggagaaaatcttgactttggaacatcgcaaagaactattgcgttacatgtacaaccatcagaacgaagatggtgggtggggaatacacgtggaaggccaaagcgctatgttctgcacagtcatcaactacatttgcctacggattctgggagtagaagcagatcttgatgatattaaaggaagtggttgtgcaagggctcgtaagtggatcctcgatcacggtggtgctacttatacgcccttgatcggaaaagcttggttatcgattcttggagtgtatgattggtcaggttgcaaaccaataccgcctgaggtgtggatgctccctactttttcgcccttcaacggaggtactctatggatttatttccgggacatttttatgggagtgtcatacttgtatggtaagaaatttgtagctacaccaacacctctcattttacagcttcgggaagagctttatcctcaaccttatgacaaaatcttatggagtcaagctcgcaatcagtgcgcaaaggaagatctctactatccacagtcatttttacaagaaatgttttggaaatgtgttcatatattgtcagagaatatcctgaatcgatggccttgcaacaagcttatcaggcaaaaagctcttcgaaccacaatggaacttcttcattatcaagatgaagccagccgttactttaccggtggatgtgtgcctaagccgtttcatatgcttgcttgttgggtagaagaccccgacggtgattattttaagaaacatcttgctcgagtcccggattacatatggattggggaggatggtctgaaaatccaatcttttggtagccaactgtgggatacagcattctcacttcaagtcatgttagcttatcaagatgttgatgacgatgatgatgagattagatcaacgttaatcaaaggatacagtttcttgaataaatctcagcttacacaaaatcctcctggtgaccatagaaaaatgttgaaagacattgcgaaaggaggatggacattttcggaccaagaccaaggatggcctgtttcggattgtactgctgagagtttagagtgttgccttgtctttggaagcatgccatcggagttgattggcgagaaaatggatgtagagaggctctatgatgccgttaatttacttctctattttcagagcaaaaatggaggtataacagtgtgggaggcagctcgtggaagaacatggttagagtggcttagtccagtggagtttatggaagacacaatcgtcgagcatgagtatgtagaatgtacggggtcagcgatagtggcattggctcggttcttgaaggagtttccggagcacagaagggaagaggttgaaaagtttatcaagaatgctgtcaaatacatagaaagctttcaaatgcccgatggttcgtggtacggaaactggggtgtgtgtttcatgtatggaacctttttcgcggtaaggggtctagtggctgcaggcaagacgtaccagaactgtgagccgattcgtaaagcggttcagttcattctggagacacaaaacgttgaaggcggttggggtgagagttatctctcttgccccaacaagaaatatacacttctagagggaaacagaaccaatgtggtgaatactggacaagcattgatggttcttattatgggtggtcagatggagagagaccctttgcctgttcatcgcgcagctaaagtgttgatcaattctcagttggataatggcgattttccgcaagaggaaataatgggagtgttcaagatgaacgtgatggtccattatgcaacctatagaaacattttcactctttgggcactcacatactacacaaaggcgctgcgcgtgcccctctgttga

SEQ ID NO: 4248 - protein, 767 aa, Arabidopsis thaliana (mouse-ear cress)
MWRLKIGAKGGDETHLFTTNNYTGRQTWEFDADACSPEELAEVDEARQNFSINRSRFKISADLLWRMQFLREKKFEQKIPRVEIGDAENITYKDAKTALRRGILYFKALQAEDGHWPAENSGCLFFEAPFVICLYITGHLEKILTLEHRKELLRYMYNHQNEDGGWGIHVEGQSAMFCTVINYICLRILGVEADLDDIKGSGCARARKWILDHGGATYTPLIGKAWLSILGVYDWSGCKPIPPEVWMLPTFSPFNGGTLWIYFRDIFMGVSYLYGKKFVATPTPLILQLREELYPQPYDKILWSQARNQCAKEDLYYPQSFLQEMFWKCVHILSENILNRWPCNKLIRQKALRTTMELLHYQDEASRYFTGGCVPKPFHMLACWVEDPDGDYFKKHLARVPDYIWIGEDGLKIQSFGSQLWDTAFSLQVMLAYQDVDDDDDEIRSTLIKGYSFLNKSQLTQNPPGDHRKMLKDIAKGGWTFSDQDQGWPVSDCTAESLECCLVFGSMPSELIGEKMDVERLYDAVNLLLYFQSKNGGITVWEAARGRTWLEWLSPVEFMEDTIVEHEYVECTGSAIVALARFLKEFPEHRREEVEKFIKNAVKYIESFQMPDGSWYGNWGVCFMYGTFFAVRGLVAAGKTYQNCEPIRKAVQFILETQNVEGGWGESYLSCPNKKYTLLEGNRTNVVNTGQALMVLIMGGQMERDPLPVHRAAKVLINSQLDNGDFPQEEIMGVFKMNVMVHYATYRNIFTLWALTYYTKALRVPLC

SEQ ID NO: 4249 - DNA, 2280 bp, Arabidopsis thaliana (mouse-ear cress)
  CDS (1)..(2280)
atgtggaaactgaagatcgcggaaggaggtagtccatggcttagaaccaccaataatcacgtcggaagacagttttgggagttcgatccgaatctcggtactcctgaggatctcgccgccgtcgaagaagctaggaagtctttttcggataatcgattcgtgcagaaacatagcgccgatctgcttatgcgccttcagttttcaagagaaaatttgattagcccagttttacctcaagtcaaaatcgaagacactgatgatgttacagaggagatggtggaaaccacgttaaagaggggtctagatttctattcaactatacaggcacacgacgggcactggccaggtgattatggtggtcctatgtttcttctcccaggactgataattacactctccataactggagcactgaatacagtattgtcggaacaacataaacaagaaatgcgccgttatctctataatcaccagaatgaggacggaggttggggtttacatattgagggccctagcaccatgtttgggtctgtgttgaactatgttactctaaggttgcttggagaaggacctaacgatggagatggagatatggagaaaggacgagactggatactaaatcatggtggtgctaccaatattacatcttgggggaaaatgtggctatcggtacttggagcttttgaatggtccggaaataacccactgccacctgagatatggcttctcccatatttcctgccaatacatccaggaaggatgtggtgccattgtcgaatggtgtacttgccgatgtcgtatttgtatggaaaaaggtttgtgggtcccataacgtccactgttttatcactgagaaaggagcttttcacagtaccatatcatgaagtcaactggaatgaagcacgcaacctttgcgcaaaggaggatttatactacccacatccacttgtgcaagatattctttgggcatcacttcataagattgttgagcctgttctgatgcgatggcctggtgcaaatttgagagaaaaggctataagaaccgcaatagaacatattcattatgaagatgagaatactaggtacatctgcataggtcccgtgaacaaggtattaaatatgctttgctgttgggtagaagacccaaactcagaggctttcaagttgcacctaccaagaatccatgactttctctggttagctgaagatggaatgaagatgcagggttataacggaagccagctatgggatacaggttttgctattcaagcgattttggcaactaacctcgtcgaagaatatgggcccgttttggaaaaagcacattcatttgtcaagaattcccaggtgttagaagactgccctggagatctgaattactggtatcgccacatttctaaaggggcttggcctttctcaactgcagatcacggttggcccatctctgactgcaccgcagaaggactgaaagctgctcttttgctatccaaagttcccaaggcgattgttggtgaaccaatagatgcaaaacggttatatgaagctgttaatgttatcatttctttacagaatgcagatggaggcctcgcaacatatgagctcaccaggtcatacccttggttagagctaatcaacccagcagaaacctttggcgatattgttattgattatccttacgtggaatgtacatcagctgctatccaagctttgatatcatttcgaaagctgtatcctggtcatcgaaagaaggaagtagatgagtgcattgagaaggcggttaagttcattgaatccattcaagcagcagatggctcatggtatggatcatgggctgtttgcttcacgtatggtacgtggtttggagtgaaagggctggtagctgttggaaaaacattgaaaaactctccacatgttgctaaagcttgtgaatttctattgtcgaaacaacaaccttcgggcggctggggagaaagctatctttcatgtcaagacaaggtctattcaaaccttgatggcaacagatctcacgtcgtgaatacagcatgggctatgctcgcactcattggtgctgggcaagctgaggtagaccggaaaccactacaccgggctgcaagatacttgattaatgctcaaatggagaatggtgattttccacaacaggaaataatgggagtcttcaataggaactgcatgataacatatgccgcgtatcgaaacatttttccgatatgggctttgggggagtaccgttgtcaggtattattgcaacaaggagaatga

SEQ ID NO: 4250 - protein, 759 aa, Arabidopsis thaliana (mouse-ear cress)
MWKLKIAEGGSPWLRTTNNHVGRQFWEFDPNLGTPEDLAAVEEARKSFSDNRFVQKHSADLLMRLQFSRENLISPVLPQVKIEDTDDVTEEMVETTLKRGLDFYSTIQAHDGHWPGDYGGPMFLLPGLIITLSITGALNTVLSEQHKQEMRRYLYNHQNEDGGWGLHIEGPSTMFGSVLNYVTLRLLGEGPNDGDGDMEKGRDWILNHGGATNITSWGKMWLSVLGAFEWSGNNPLPPEIWLLPYFLPIHPGRMWCHCRMVYLPMSYLYGKRFVGPITSTVLSLRKELFTVPYHEVNWNEARNLCAKEDLYYPHPLVQDILWASLHKIVEPVLMRWPGANLREKAIRTAIEHIHYEDENTRYICIGPVNKVLNMLCCWVEDPNSEAFKLHLPRIHDFLWLAEDGMKMQGYNGSQLWDTGFAIQAILATNLVEEYGPVLEKAHSFVKNSQVLEDCPGDLNYWYRHISKGAWPFSTADHGWPISDCTAEGLKAALLLSKVPKAIVGEPIDAKRLYEAVNVIISLQNADGGLATYELTRSYPWLELINPAETFGDIVIDYPYVECTSAAIQALISFRKLYPGHRKKEVDECIEKAVKFIESIQAADGSWYGSWAVCFTYGTWFGVKGLVAVGKTLKNSPHVAKACEFLLSKQQPSGGWGESYLSCQDKVYSNLDGNRSHVVNTAWAMLALIGAGQAEVDRKPLHRAARYLINAQMENGDFPQQEIMGVFNRNCMITYAAYRNIFPIWALGEYRCQVLLQQGE

SEQ ID NO: 4251 - DNA, 2637 bp, Homo sapiens (man)
  CDS (19)..(2217)
gagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatctttcccatctgggccctcggccgcttctcccagctgtaccctgagagagcccttgctggccacccctgagaacatgcctacctgctgggtgccgtctgtgcgttccatggccttcaagtcacaggacgcagcgattcccattccctgccctcttcggtgttattacacaggcaggacttcagtgtcagtatccctgccttcagtcttctttagaaatcacatctgtgttcaatccattgtttagagggagtgtatttttcctgttccacgaagaggactttttgttcacaattggatcacaatgcagaggagtctgttcctcccccgtcggcttctcggtgctgggagggtgacctgtcccagatgactcatcaccctgacatgctcttgacaaaggacaccaccaagaggagatggcagctgtaccggtgcagcctctgtctgagggggatatttgcctcagtgtgattaaaaatcagtcatgaaaga

SEQ ID NO: 4252 - protein, 732 aa, Homo sapiens (man)
MTEGTCLRRRGGPYKTEPATDLGRWRLNCERGRQTWTYLQDERAGREQTGLEAYALGLDTKNYFKDLPKAHTAFEGALNGMTFYVGLQAEDGHWTGDYGGPLFLLPGLLITCHVARIPLPAGYREEIVRYLRSVQLPDGGWGLHIEDKSTVFGTALNYVSLRILGVGPDDPDLVRARNILHKKGGAVAIPSWGKFWLAVLNVYSWEGLNTLFPEMWLFPDWAPAHPSTLWCHCRQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRETLTQGLEFCRRQQRADGSWEGSWGVCFTYGTWFGLEAFACMGQTYRDGTACAEVSRACDFLLSRQMADGGWGEDFESCEERRYLQSAQSQIHNTCWAMMGLMAVRHPDIEAQERGVRCLLEKQLPNGDWPQENIAGVFNKSCAISYTSYRNIFPIWALGRFSQLYPERALAGHP

SEQ ID NO: 4253 - DNA, 2284 bp, Schizosaccharomyces pombe
  CDS (105)..(2270)
ccttttttgattattttgttgcatttacaattaacatagagtaaagacgagtctaatcaccttttctggaactgcttgatagataggatttttttgcgaaaaaaatggaggcttgcagagtccgtcctgaattatctaaaacggttgaacaaatcgataaaagcttgtggcgcttgaatatcgattcagctggtggagagacatgggagtatgttacaaaagaagaggctgaaaagcgtccactcaccattgcggagaagtatttcctaggttttgatttagatctacctaaacgacctccagcgaaaactccattagagagtgctgagtatggttatgaattttttcgtcgcttgcagctaccagacggtcactgggcttctccttatgaagggccgatgtttctcatttgcggtgccgtttttgctttttatatttcgcaaacaccatttcctaaaggttgggctccagaaattatccaatacttaattaatcacacaaatgacgatggtggatggggtattcacacagaaggagtttctactgtattcggaacctccatgaattatgtagttcttcgaattttgggtatggatgcgggacatccagttgctacacgagctcgtaacagattacatgaacttggaggagctattggatgcccgcattggggaaaattttggctcgctacacttaactgttacgactgggatggtgttaaccctatccccccagaactatggttattacctgactggattccatttcatcctggaaaatggtggtgtcacgttcgtttagtatacttgcctatgggatatatgtatggagagaggctgaaatgccctaaggattcgttaataatgcaattgcgaaaggagttgtacgtagaaaactatgacagcattaattttgcggatcatagaaatacgattagtgatgtggacctctattttcctcatactcaaatattagatcgtttgaattggatattggaaaaatattttacttatctaagaccctcttggcttaaaaaactgggtactcgacgggcatacgaacttataaaaatagaagatcagaataccgattactcttgtattggcccagtaaatgcagcaatgaacactgtttgcgtttactttcatgaaggaccttctagtaaagctttccaaaagcacattcaacgtttgcatgatttcatgtgggtccaaccagaaggaatgcttatgcgtggtactaatggtttgcaagtttgggaaacttccttcacattgcaagcgctcgtagaatcaggtctttacgaaaaagaggccttcaaaccagatatcgccaaagctctggagtttttggatcgacaacagattcgaacgcaatatgaagggagtggatataggtacaattctttgggggcatggccatttagtaatataactcaaggttatacggtgtcagatactacatctgaagctctgcgtgctgtattgcttgtccaatcattgccagattttgaaaaactggttgatatacctaggctaaggttatcggttgatgtgatattgggaatgcaaaatgagaaccttgggtttgcttcatatgagcctgcgcgaacaggtgaatggatggagttgttaaatcctgccgaagtttttggaaatattatggtcgaatactcttatcccgagtgcaccacatctgtcatattggcactccgggcttttacaaagtatgatcctggatatcgtcgtgatgaaattgaaaatactattgaaaatgctttggaatacgttgtaaagatgcaacgaccagacggaagctggtatggaagttgggctatttgttttacgtatgcagccatgtttgcgacaggttctttggcatcagccggtcgatattacgaaaactgcccagtccagaagaaggcgtgcgaatttttactgtcgaagcaaagaccagatggtggatggagtgagagttacatggcttgtgttactggagtttacacagaaacagaatcaagtttggtaacacaaactggttgggctttggacgcactgattaatgcaaagtaccctgatagaaaaccgatagaaaagggaattaaatttttgatggcgtctcaaaagagcgatgggagctggcagcaaaaatcgatggaagggatctttaacaagaatgttgccattgcatatcccaactacaagttgtacttttccatatacacattgggaaagtttgcaaagcaatacggcaattacctgaccatttagtttagtttagtatg

SEQ ID NO: 4254 - protein, 721 aa, Schizosaccharomyces pombe
MEACRVRPELSKTVEQIDKSLWRLNIDSAGGETWEYVTKEEAEKRPLTIAEKYFLGFDLDLPKRPPAKTPLESAEYGYEFFRRLQLPDGHWASPYEGPMFLICGAVFAFYISQTPFPKGWAPEIIQYLINHTNDDGGWGIHTEGVSTVFGTSMNYVVLRILGMDAGHPVATRARNRLHELGGAIGCPHWGKFWLATLNCYDWDGVNPIPPELWLLPDWIPFHPGKWWCHVRLVYLPMGYMYGERLKCPKDSLIMQLRKELYVENYDSINFADHRNTISDVDLYFPHTQILDRLNWILEKYFTYLRPSWLKKLGTRRAYELIKIEDQNTDYSCIGPVNAAMNTVCVYFHEGPSSKAFQKHIQRLHDFMWVQPEGMLMRGTNGLQVWETSFTLQALVESGLYEKEAFKPDIAKALEFLDRQQIRTQYEGSGYRYNSLGAWPFSNITQGYTVSDTTSEALRAVLLVQSLPDFEKLVDIPRLRLSVDVILGMQNENLGFASYEPARTGEWMELLNPAEVFGNIMVEYSYPECTTSVILALRAFTKYDPGYRRDEIENTIENALEYVVKMQRPDGSWYGSWAICFTYAAMFATGSLASAGRYYENCPVQKKACEFLLSKQRPDGGWSESYMACVTGVYTETESSLVTQTGWALDALINAKYPDRKPIEKGIKFLMASQKSDGSWQQKSMEGIFNKNVAIAYPNYKLYFSIYTLGKFAKQYGNYLTI

SEQ ID NO: 4255 - DNA, 2677 bp, Pisum sativum (garden pea)
  CDS (116)..(2386)
gaaaaatcacgctacacacatacacacagttttgttactcctcatgattaatcctcactttatttaatcctcattttttattgaacccccaccgcaatacagtttgtttagaaaaatgtggaagctcaaggttgcggaaggaggtactccatggcttcggacattgaacaaccacgtcggaagacaggtatgggagttcgatcctcattccggatcgccacaagatctcgacgatatcgaaaccgctcgccgcaatttccacgataatcgcttcactcacaaacacagtgatgatctacttatgcgccttcagtttgcgaaagagaaccctatgaacgaagttttacctaaagtgaaagtcaaagatgtcgaggatgtaacggaagaggctgttgcaacgacattaagaaggggattgaatttctattcaactatccagagtcatgatggacactggccaggagattatggaggtcccatgtttcttatgcctggattggttattactctgtctgtcaccggggctttgaatgcagtcttaacagacgagcatagaaaggaaatgcgtcgttacctttataatcatcagaacaaggatggtgggtggggtttgcatattgagggtccaagcacaatgtttggctctgtcttgtgttatgttactctaagattgctaggggagggacctaatgatggagaaggggatatggagagggggcgtgattggattcttgagcatggtggtgctacttatataacatcctgggggaaaatgtggctatcagtacttggagtgtttgagtggtctggaaataatcccatgcctcctgaaatatggctccttccatacgcgcttcctgttcatccaggaaggatgtggtgtcactgccggatggtctatttgccaatgtcctacttgtatggcaagaggtttgttggtccaatcacaccaacagtattatctttgagaaaagagctttttaccgttccataccatgatatagactggaaccaggctcgcaatttgtgtgcaaaggaagacttatattatcctcatccgcttgtgcaagatattctttgggcaactctacacaagtttgttgagcctgttttcatgaattggcctggcaaaaagttgagagaaaaggctatcaagactgcaattgagcatatacattatgaagatgagaacactcgttatatttgcataggtcctgtaaataaggtgttaaatatgctttgctgctgggtagaagatccaaattcagaggctttcaagttgcatcttcccaggatctatgattatctatgggttgctgaagatggcatgaaaatgcagggctacaatggaagtcaactatgggatactgcatttgctgcacaagcaattatttcaactaacctaattgacgaatttggtccaactctaaaaaaggctcatgcattcattaagaattcacaggtttcggaagattgtccgggggatcttagtaaatggtaccgtcacatttcaaaaggtgcttggcctttttcaactgcagaccatggatggccaatatctgactgcacggcagaaggactgaaagctgttctattgctatctaaaattgcacctgagattgttggtgaaccattggactcaaagagattatatgatgctgtaaatgttattctctcattacagaatgaaaatggtggccttgcaacatatgagctcacacgatcttatacctggttggagataatcaatcctgctgaaacatttggtgacattgttattgattgtccttacgtggaatgtacctcagcagcaattcaagctttagcaacatttgggaaactatatcccgggcatcgtcgagaagaaatacaatgttgtatagaaaaagctgttgcctttattgaaaaaattcaagcttcagatggttcatggtatggttcttggggagtttgctttacatatggcacttggtttgggataaaagggctgattgctgctggaaagaatttcagtaattgtttaagcatccgtaaagcttgtgagtttctgctgtctaagcagctcccatctggtggttgggcagaaagttatctgtcatgtcaaaacaaggtgtattcaaatttggaaggcaacaggtcccatgtagtaaacactgggtgggctatgctggctctcattgaggctgaacaggcaaagagagatccaacaccactgcaccgtgcagctgtatgcttgataaattcccaattggagaatggtgactttccgcaagaggaaataatgggagtcttcaacaagaattgcatgatcacttatgctgcatacagatgcatattccccatatgggcgttaggagaataccgccgtgtattgcaggcctgctaatatcgctttatttaggccaccattcaaattatttcgaccttttattaggctccacggttttattctaaaaaaggtttatagcttatgagtttggcatcctgctaaacctagtgaaactaaatttacaggaatttgttgtgttgccctttttgtagcacaaggagcacggttgtgcgtttttagtcatgttcaaatagtttgagttcattccaattgggaagagattttaacgtggttggtatatgtaagaagaacgtaagaaaaaataaagttaatttgggactattatat

SEQ ID NO: 4256 - protein, 756 aa, Pisum sativum (garden pea)
MWKLKVAEGGTPWLRTLNNHVGRQVWEFDPHSGSPQDLDDIETARRNFHDNRFTHKHSDDLLMRLQFAKENPMNEVLPKVKVKDVEDVTEEAVATTLRRGLNFYSTIQSHDGHWPGDYGGPMFLMPGLVITLSVTGALNAVLTDEHRKEMRRYLYNHQNKDGGWGLHIEGPSTMFGSVLCYVTLRLLGEGPNDGEGDMERGRDWILEHGGATYITSWGKMWLSVLGVFEWSGNNPMPPEIWLLPYALPVHPGRMWCHCRMVYLPMSYLYGKRFVGPITPTVLSLRKELFTVPYHDIDWNQARNLCAKEDLYYPHPLVQDILWATLHKFVEPVFMNWPGKKLREKAIKTAIEHIHYEDENTRYICIGPVNKVLNMLCCWVEDPNSEAFKLHLPRIYDYLWVAEDGMKMQGYNGSQLWDTAFAAQAIISTNLIDEFGPTLKKAHAFIKNSQVSEDCPGDLSKWYRHISKGAWPFSTADHGWPISDCTAEGLKAVLLLSKIAPEIVGEPLDSKRLYDAVNVILSLQNENGGLATYELTRSYTWLEIINPAETFGDIVIDCPYVECTSAAIQALATFGKLYPGHRREEIQCCIEKAVAFIEKIQASDGSWYGSWGVCFTYGTWFGIKGLIAAGKNFSNCLSIRKACEFLLSKQLPSGGWAESYLSCQNKVYSNLEGNRSHVVNTGWAMLALIEAEQAKRDPTPLHRAAVCLINSQLENGDFPQEEIMGVFNKNCMITYAAYRCIFPIWALGEYRRVLQAC

SEQ ID NO: 4257 - DNA, 3769 bp, Candida albicans
  CDS (186)..(2372)
aagcttataatatgcaggattcacgtgaatgaaattatgcacgaccacacacacactcacaaaaaaaaataataacagaattggctgttctacgcgatcgtttaaaatctgggcaacgtcaaatcaaacatcagtaggttcttgttattggcattccataattaaacaccctggaacattgacaaatgtattattcagaggaaattggtcttcccaaaactgatatttcaagatggaggttacgaagtgacgctcttggtagggaaacatggcattatctatcacaatctgaatgtgaaagtgaaccacaatcaacatttgtccaatggcttttagagtcgccagattttccatctccgccatcgtcagatattcatacttcaggcgaggcagcaagaaagggagctgattttttgaaactattgcaattggataatggtatcttcccctgccagtacaaaggtccaatgtttatgacaattggctatgtaactgctaattattatagcaagactgagatacctgagccgtatagagttgagatgatacgttatattgtcaacactgcacacccagtcgatggtggttggggacttcattctgttgataaatctacttgttttgggacaaccatgaattatgtatgtctccggttattaggaatggaaaaggatcatccagttttggttaaggcgagaaaaacattacatcgtttgggtggtgccattaagaatccacattggggtaaggcttggctatctattttgaatttatatgaatgggagggtgtgaacccagctccaccagaactttggagattaccgtactggttaccaattcatccagcgaaatggtgggtacatactagggctatctatttgccattgggatatacgtctgcaaacagagttcaatgtgagcttgatccacttttaaaagagatcagaaatgaaatttacgttccaagtcaattaccttatgagtcaatcaaatttggtaaccagagaaataatgtttgtggtgtcgatttatattacccacatacaaagattcttgattttgcaaattctatattgagtaaatgggaagctgttagacctaagtggttattgaattgggttaacaagaaagtttatgatttaattgtaaaggagtatcagaatacagagtacttgtgtattgctcctgtgagttttgccttcaatatggttgtgacgtgtcattatgagggctctgaatcagaaaactttaagaaactccaaaacagaatgaacgatgttttgtttcatggacctcagggaatgactgttatggggacaaatggtgtacaagtttgggatgccgcctttatggtacagtactttttcatgacaggcttagttgatgacccaaaatatcacgatatgatcagaaagagttatttatttttagtgagatctcaatttacagaaaattgtgtcgatggaagtttcagagatagacgtaaaggtgcttggccatttagtactaaggaacaaggatatactgttagtgactgtactgcagaagcaatgaaggctattattatggttaggaatcatgcaagttttgctgacatcagggacgaaataaaagatgaaaacttgtttgatgctgttgaagttttgttgcaaattcaaaatgtgggagaatgggaatatggctcattctcgacttatgaaggtataaaagcccctttgttgctagaaaaattgaatcctgccgaggtttttaataatattatggtggagtatccatacgtggaatgtacagactcttccgttttagggcttacttactttgccaaatattaccctgactacaagcccgaattgattcagaaaactatttcctctgccattcaatatattcttgattcacaagataacattgatggctcttggtatggttgttggggaatttgttatacttatgcgtcgatgtttgcattagaagctttgcatacagttggtcttgattatgaatcctcatcagctgtgaaaaaaggatgtgattttcttatttcaaaacaacttccagacggtggatggtcagaatcaatgaaaggttgtgaaacacactcttatgtcaatggtgaaaactctcttgttgttcaatcggcttgggctttgatagggttgatattgggaaattatcctgatgaagagccaatcaaaagaggaattcaatttttgatgaaacgacaattaccgactggtgagtggaagtatgaagatattgaaggtgtatttaatcacagttgtgcaatagaatatccttcatataggtttttatttccaattaaggcattaggtttatataaaaacaagtatggtgataaagtgttagtttaagtagtcgtgcatgttttcaaaaaaagagaaaatgttgcaaaataaacacaaacttcttttttttttgcttcaaaattttctacaaaatctcctcaataatataaatcaattattgaaacaaccgtaatttcccccctaaaattatgtattaagtatagaacacaataattaatgattataaatattaaagaaattattaaaaaaaaatagaaaaatgaaagaaatccaaataaaccgttttccagctctcaacctttgctatttctcttgttttgcctcacttcctggcaatggaatcacaggaagtgtaaagtaagagttctgttttgttgccaataaggcgaaagtatcataaagtgcagcaacaactgcaattacaccaaaggcaccagcagctttggttaatgcaaccgaaccaacaaaatatgatgccgacaacaatgaaaaaagtgcagtaagacaaaggaaaaacccacttaataaaaccgtactcttgaaagtaagcaacataaagataaaactaagaattgcccaggcaatcaaataaaatgccaaggcactggaaagttgtgtcatatccttttgataggctgcgagaataccaaaagtagggatgtttatagcagcaaaggataaccagaatgctccatacgatgtcaaagcagtaaaaactaataacaatttggttagtaagctaatttgttttataaattgatttccaattttgatatatacatactcaaggtatctccagaaaagaaaacccaaataccagctattgtttgaacgacaccaccgtagaaggtagccaatgaaactgcaacattgatggttttgatgccacgagcttgtaataaatacaaacttaaaaccaaagtagttatagcaaaagcacacaaacctaatggtgttgagcttgcaaatttgctgctcagtgattgtgcattatgggcaaggacagacattatctcatgtctataatacttcttgtttcctaaaataacaaactcaccaccatcaccagaaatctcaactttggtgacgttgttgccattggggctgccgacagaatcaacgtctttagactcagctgtagatgcagataccattacttataatttgattttataacttttttggtcaagtatttctcttgcaaatggaacattcaaaaaatactgattaccaaacctatttataactgagctgtaaagtacttttacttatgatgtataattgaactagatttgatgcattattaagcagtttgcaattgtaactagagaaaaggtttaaaatcaggtaagatattattaaaatataaagagtgatactttcttgtcactgtaattaaagcaatattataacaagctaggtgtggatattataactctaga

SEQ ID NO: 4258 - protein, 728 aa, Candida albicans
MYYSEEIGLPKTDISRWRLRSDALGRETWHYLSQSECESEPQSTFVQWLLESPDFPSPPSSDIHTSGEAARKGADFLKLLQLDNGIFPCQYKGPMFMTIGYVTANYYSKTEIPEPYRVEMIRYIVNTAHPVDGGWGLHSVDKSTCFGTTMNYVCLRLLGMEKDHPVLVKARKTLHRLGGAIKNPHWGKAWLSILNLYEWEGVNPAPPELWRLPYWLPIHPAKWWVHTRAIYLPLGYTSANRVQCELDPLLKEIRNEIYVPSQLPYESIKFGNQRNNVCGVDLYYPHTKILDFANSILSKWEAVRPKWLLNWVNKKVYDLIVKEYQNTEYLCIAPVSFAFNMVVTCHYEGSESENFKKLQNRMNDVLFHGPQGMTVMGTNGVQVWDAAFMVQYFFMTGLVDDPKYHDMIRKSYLFLVRSQFTENCVDGSFRDRRKGAWPFSTKEQGYTVSDCTAEAMKAIIMVRNHASFADIRDEIKDENLFDAVEVLLQIQNVGEWEYGSFSTYEGIKAPLLLEKLNPAEVFNNIMVEYPYVECTDSSVLGLTYFAKYYPDYKPELIQKTISSAIQYILDSQDNIDGSWYGCWGICYTYASMFALEALHTVGLDYESSSAVKKGCDFLISKQLPDGGWSESMKGCETHSYVNGENSLVVQSAWALIGLILGNYPDEEPIKRGIQFLMKRQLPTGEWKYEDIEGVFNHSCAIEYPSYRFLFPIKALGLYKNKYGDKVLV

SEQ ID NO: 4259 - DNA, 2229 bp, Arabidopsis thaliana (mouse-ear cress)
  CDS (1)..(2229)
atgtggaggttaaagttatcggaaggagacgaagagagcgtgaatcaacatgttggaagacagttttgggaatatgataaccaatttggaacctctgaagagagacatcacattaaccatcttcgtagcaactttactctcaatcggttttcttctaagcatagttctgatcttctctaccgttttcagtgttggaaagagaaaggaaaaggaatggagagacttccacaagtgaaagtaaaagagggggaagaaagattgataaatgaagaagtggtgaatgttacattaagaagaagtttgagattctactcaatacttcaatcacaagatggtttttggcctggtgattatggtggccctttgtttctcttgcctgctctggtgatcggcttatatgtgacggaagttttggatggaactttaactgcgcaacatcaaatcgagattcgtcgttatctctataaccatcagaacaaggatggaggatggggactacacgtagaagggaatagcaccatgttttgtacagtgctctcatacgtagcactgagactaatgggggaagaattagacggtggagatggagccatggaatcagctagaagttggattcaccaccacggtggtgccacttttattccctcctggggcaagttctggctctccgttcttggagcttatgagtggagtgggaacaatcctttacctccagagctatggctccttccatatagtcttccttttcatccgggccgaatgtggtgccattgtaggatggtttatcttccaatgtcatatctatatggaagaagatttgtttgtcgtactaatggaactattttatcgcttcgacgagagctctacactattccttatcaccatatcgattgggacaccgcccgtaatcaatgtgccaaggaggacttgtactatccacatccaaagattcaagacgtcctttggagttgtctgaataaatttggagagcctcttcttgaaagatggccattgaataacctcagaaaccatgctcttcagacagtaatgcaacacattcactatgaagaccaaaacagccactatatttgtatcggtcctgtcaacaaagtcttgaatatgctttgttgttgggtcgagtcctcgaattccgaggcatttaaatctcacctctcgcggattaaagactatttgtgggtggctgaggatggaatgaaaatgcagggatacaacggatctcagctgtgggacgtgactttagcggtccaagcaatcttggcgacgaatttggttgatgactatggtttgatgcttaagaaagcccataactacatcaagaacactcaaataaggaaagacacaagtggagatccggggttgtggtaccgacacccgtgcaagggaggatggggtttctccactggagacaatccatggcctgtctctgattgtactgctgaagccttgaaggcggcgttgctattgtcacaaatgccggttaatttagttggagaacccatgcctgaagagcatttagttgatgctaacaagaatgggggatttgcgtcatatgagctaactagatcatatcccgagctagaggttatcaacccatcagagacttttggggatatcatcatagattatcaatacgtagaatgcacgtcagctgccatccaaggtctcgtgttattcacaacgttaaattcgagctacaagaggaaggagatagtaggaagcatcaacaaagcagttgagtttattgaaaaaacacaacttcctgatggttcatggtatggctcgtggggagtgtgtttcacctatgcaacatggtttggtattaaaggcatgttggcttcaggcaaaacatatgagagcagtctttgtattagaaaagcttgtggtttcttgctctccaaacaactttgttgtggtggatggggagagagctacctttcttgccaaaacaaagtatacaccaatcttcctgggaataaatcgcatattgtgaacacatcatgggcactcttggctctcattgaagcgggacaagctagtagagatccgatgccattgcatcgcggggcaaaatcgctgatcaactcgcagatggaagatggagattacccacaacaagtgagtaaaatgttttatattcatagacaggttttgttttcactaacctcattgattatatttgcttcttactttttgttcaggagatactag

SEQ ID NO: 4260 - protein, 742 aa, Arabidopsis thaliana (mouse-ear cress)
MWRLKLSEGDEESVNQHVGRQFWEYDNQFGTSEERHHINHLRSNFTLNRFSSKHSSDLLYRFQCWKEKGKGMERLPQVKVKEGEERLINEEVVNVTLRRSLRFYSILQSQDGFWPGDYGGPLFLLPALVIGLYVTEVLDGTLTAQHQIEIRRYLYNHQNKDGGWGLHVEGNSTMFCTVLSYVALRLMGEELDGGDGAMESARSWIHHHGGATFIPSWGKFWLSVLGAYEWSGNNPLPPELWLLPYSLPFHPGRMWCHCRMVYLPMSYLYGRRFVCRTNGTILSLRRELYTIPYHHIDWDTARNQCAKEDLYYPHPKIQDVLWSCLNKFGEPLLERWPLNNLRNHALQTVMQHIHYEDQNSHYICIGPVNKVLNMLCCWVESSNSEAFKSHLSRIKDYLWVAEDGMKMQGYNGSQLWDVTLAVQAILATNLVDDYGLMLKKAHNYIKNTQIRKDTSGDPGLWYRHPCKGGWGFSTGDNPWPVSDCTAEALKAALLLSQMPVNLVGEPMPEEHLVDANKNGGFASYELTRSYPELEVINPSETFGDIIIDYQYVECTSAAIQGLVLFTTLNSSYKRKEIVGSINKAVEFIEKTQLPDGSWYGSWGVCFTYATWFGIKGMLASGKTYESSLCIRKACGFLLSKQLCCGGWGESYLSCQNKVYTNLPGNKSHIVNTSWALLALIEAGQASRDPMPLHRGAKSLINSQMEDGDYPQQVSKMFYIHRQVLFSLTSLIIFASYFLFRRY

SEQ ID NO: 4261 - DNA, 2280 bp, Oryza sativa (japonica cultivar-group)
  CDS (1)..(2280)
atgtggcggctgagggtggcggagggcgggggggacccgtggctgcgcacgaagaacggccacgtggggcgccaggtctgggagttcgaccccgccgcgggcgaccccgacgagctcgccgccgtcgaggccgcccgccgcggtttcgccgcccgccgccacgagctcaagcacagctccgacctcctcatgcgcatgcagtttgctaaagcaaatcctcttaagctggacattccagctatcaagctagaggagcatgaagctgttacaggcgaagctgtattatcctctctaaaaagggcaattgctcgttattctacttttcaagcacatgatggacactggcctggggattatggtggtcccatgttccttatgccaggcttgattataacattatatgtgagcggagcgctgaacactgctttgtcatctgaacatcagaaggagatacggcggtatctctacaatcatcagaatgaagatggaggatggggtttgcacattgagggccacagcaccatgtttggctcagcgttgacatatgtttctttgagattgcttggggaggggccagatagcggcgatggagctatggagaaaggacgaaaatggattttagaccatgggggagcaacttatattacatcatggggcaagttttggctttcggtgcttggtgtatttgactggtctggcaacaacccagtgccaccagaaatatggttgttgccatatttcctgccgattcatccagggcgaatgtggtgtcattgccggatggtttatttgcctatgtgttacatttatggaaagaggtttgtgggcccagttacaccaattatattggaattaagaaaggaactctacgaagtaccctacaatgaagttgattgggacaaggctcgcaatctatgtgctaaggaagatctgtactatccacatccattcgtgcaggatgtattatgggccactctccacaaatttgttgaaccagctatgttgcgttggcctgggaacaaattgagggagaaagctttggacactgtcatgcagcatattcattatgaagatgagaacacccgatatatttgcattggtccagtaaacaaggtattaaatatgcttgcttgctggattgaagatccaaactcagaggcattcaaactccacattccaagagtccacgattacctatggattgcagaagatggcatgaaaatgcagggttataatggaagccagctgtgggacacagctttcacagttcaagctatagtggctactggcctcattgaagaatttggtcctactcttaaactagcacatggctacataaagaaaacgcaggttatcgatgactgccctggagatcttagtcagtggtaccgccacatatctaaaggtgcatggcccttttctactgctgatcatggttggcctatatcagattgcactgcagaaggacttaaggcggcattattgctatcgaagatttctccagatattgttggcgaagcagtggaagttaatagactgtatgattctgtcaattgtttgatgtcatacatgaatgataatggtggatttgcaacatatgaactcacaaggtcttatgcctggctggagcttatcaatcctgctgagacctttggggacattgtgattgattatccttatgtggaatgcacttcagcagcaattcaggccctgacagcatttaaaaagctctaccctggacaccgcaagagtgaaatagacaactgtataagcaaagctgctagctttattgagggtattcaaaaaagcgatggttcatggtatggttcttgggctgtttgttttacctatggcacatggtttggtgtaaagggattagttgctgctggtaggacattcaaaaacagtcctgcaatcagaaaggcatgtgactttttgttgtcaaaagagcttccttctggaggctggggagaaagctatttgtcatcccaagatcaggtttataccaatctcgaagggaagcgacctcatgcggtgaacactggttgggccatgctagccctaatcgatgcagggcaggctgagagagatccaattcctttgcatcgagcagcgaaggttttgatcaacttacaatcggaagatggtgaatttccccagcaagagatcattggagtcttcaacaaaaactgcatgatcagctactccgagtatagaaacatcttccctatttgggcccttggggagtaccgtcgccgcgtcttggccgcagacaagtag

SEQ ID NO: 4262 - protein, 759 aa, Oryza sativa (japonica cultivar-group)
MWRLRVAEGGGDPWLRTKNGHVGRQVWEFDPAAGDPDELAAVEAARRGFAARRHELKHSSDLLMRMQFAKANPLKLDIPAIKLEEHEAVTGEAVLSSLKRAIARYSTFQAHDGHWPGDYGGPMFLMPGLIITLYVSGALNTALSSEHQKEIRRYLYNHQNEDGGWGLHIEGHSTMFGSALTYVSLRLLGEGPDSGDGAMEKGRKWILDHGGATYITSWGKFWLSVLGVFDWSGNNPVPPEIWLLPYFLPIHPGRMWCHCRMVYLPMCYIYGKRFVGPVTPIILELRKELYEVPYNEVDWDKARNLCAKEDLYYPHPFVQDVLWATLHKFVEPAMLRWPGNKLREKALDTVMQHIHYEDENTRYICIGPVNKVLNMLACWIEDPNSEAFKLHIPRVHDYLWIAEDGMKMQGYNGSQLWDTAFTVQAIVATGLIEEFGPTLKLAHGYIKKTQVIDDCPGDLSQWYRHISKGAWPFSTADHGWPISDCTAEGLKAALLLSKISPDIVGEAVEVNRLYDSVNCLMSYMNDNGGFATYELTRSYAWLELINPAETFGDIVIDYPYVECTSAAIQALTAFKKLYPGHRKSEIDNCISKAASFIEGIQKSDGSWYGSWAVCFTYGTWFGVKGLVAAGRTFKNSPAIRKACDFLLSKELPSGGWGESYLSSQDQVYTNLEGKRPHAVNTGWAMLALIDAGQAERDPIPLHRAAKVLINLQSEDGEFPQQEIIGVFNKNCMISYSEYRNIFPIWALGEYRRRVLAADK

SEQ ID NO: 4263 - DNA, 2283 bp, Oryza sativa (japonica cultivar-group)
  CDS (1)..(2283)
atgtggcggctgaagatcgcggcggagagcggcggcggcagcggcagcagcccgctgctgcacacgggcaacggcttcctaggcagggcagtgtgggagttcgatcccgacgccggcacgccggaggagcgcgccgaggtggcgaggctgcgccgcgacttcacccgccaccgcttccagaggaaggagtcacaggacctcctcatgcggatgcagtatgccaaattagggcatctacaaccagatctttcggctgtcatagttgaagataatcaaaatgttaccgaagaaactatattgtcttcattgcgacgagctcttaatcaatattcgactttgcaagcacatgatgggcattggcctggtgactacagtggaatcttgttcattatgccactcctgatattctccatgcatgttacgggaacgctcgatgtcgtcttgtcattggaacataaacgagagatatgtcgatacatttacaatcatcagaatgaagatggcggctgggggacacaggttcttggccagagtaccatgtttggctcatgcttgaactatgctacattaaagctccttggtgaggccctacataataacgatgcattagcccaagggcgtatgtggattttatctcatggaagcgcaacggcggcacctcaatgggcaaagatatggctctcggtcattggtgtatacgattggtcaggaaacaaagcaataattcctgaattatggatggtgccgcattttcttccaatacatccagcaagattttggtgctttgtccgtatgatttacatgtccatggcatatctttatgggaaaaagtttgtcggcccaatcactccaactatattggaaataagagaggagttgtacaacataccatacagtgagattgactggaagaaggctagagattgctgtgccaaggaagatcttcgatatccttgttcatggatacaagatattgtgtggacatatttaaacaagtatgtggatccaatgtttaatgtctggccatttaataagctgagggagatatcgctgcgcaaccttatgaaacatatctactacgaggatgaaaataccaaatacattggtttgtgcccaataaacaaggcattaaatatgatttgctgttggatagaagacccaaattcagatgcattcaagaggcatcttccaaggatttatgactttctatggcttgctgaagatggcatgaaggctcaggtatatgatggctgtcagacatgggagacagcatttatagttcaagccatttgctctacgggcttagtagatgagttcagtacaactcttgagaaagcctatggtttcctgaaaaattcgcaggttcttcatgacctccctaatggcaaaagtttctatcgccatagatcaaaaggttcatggactctttctacagcagacaatggttggtcagttcctgattgtacaggagaaacacttcaggcattactagggctgtcaaagatttctcctaaacttgttggtgatccaataaaagaaaaaagtttgtatgacgcggtggactgcctgctgtctttttcgaacaaagatggtaccttctcctcgtatgaatgcacaagaacagcttcgtggacagagattctgaacccttcagagagttttcggaacattgtcgttgattatccacatgtcgagtgcacatcatcagcaattcaaggtctaatatcatttacagagttatacccagggtaccgtggtgtagaaattgaaagttgtattaagaatgctgtaatgttcattgagaacaaacaacaaaatgatggctcatggtatgggacatggggtatatgctttacctatggggcattctttgcaataagaggactaattgctgctggcagaaattatgagaacagccaagctatcaggaatggatgcaagttcctattgtcaaagcagcttagtgcaggtggatggggtgagcactacagttcaagtgaaattgaggtctatgttgatagtgggagtcctcatgcagtgaacacctccttggcaatgttagctttactttactctggacagattgaacgagatccaacaccattatatcgtgctgcaaaacaattaattagcatgcaacttgaaacaggagagttcccccaacaagaacatgttggatgcttcaattcttcactttacttcaattacccgaactaccgcaacttatatcccatttgggctctcggagaattctggcaccgacttgttgcaagcaaggactga

SEQ ID NO: 4264 - protein, 760 aa, Oryza sativa (japonica cultivar-group)
MWRLKIAAESGGGSGSSPLLHTGNGFLGRAVWEFDPDAGTPEERAEVARLRRDFTRHRFQRKESQDLLMRMQYAKLGHLQPDLSAVIVEDNQNVTEETILSSLRRALNQYSTLQAHDGHWPGDYSGILFIMPLLIFSMHVTGTLDVVLSLEHKREICRYIYNHQNEDGGWGTQVLGQSTMFGSCLNYATLKLLGEALHNNDALAQGRMWILSHGSATAAPQWAKIWLSVIGVYDWSGNKAIIPELWMVPHFLPIHPARFWCFVRMIYMSMAYLYGKKFVGPITPTILEIREELYNIPYSEIDWKKARDCCAKEDLRYPCSWIQDIVWTYLNKYVDPMFNVWPFNKLREISLRNLMKHIYYEDENTKYIGLCPINKALNMICCWIEDPNSDAFKRHLPRIYDFLWLAEDGMKAQVYDGCQTWETAFIVQAICSTGLVDEFSTTLEKAYGFLKNSQVLHDLPNGKSFYRHRSKGSWTLSTADNGWSVPDCTGETLQALLGLSKISPKLVGDPIKEKSLYDAVDCLLSFSNKDGTFSSYECTRTASWTEILNPSESFRNIVVDYPHVECTSSAIQGLISFTELYPGYRGVEIESCIKNAVMFIENKQQNDGSWYGTWGICFTYGAFFAIRGLIAAGRNYENSQAIRNGCKFLLSKQLSAGGWGEHYSSSEIEVYVDSGSPHAVNTSLAMLALLYSGQIERDPTPLYRAAKQLISMQLETGEFPQQEHVGCFNSSLYFNYPNYRNLYPIWALGEFWHRLVASKD

SEQ ID NO: 4265 - DNA, 2271 bp, Oryza sativa (japonica cultivar-group)
  CDS (1)..(2271)
atgtggaagctaaagtttggtgagggggcaagcaacccactgctccgctccagcaacggcttcctcggccgggagacgtgggagttcgaccccaacggcggctcgccggaggagcacgccgtggtcgagaggctccgccgcgacttcacccgcaaccgcttcacacagagggagtgcagcgacctcctgatgaggatgcagtttgcaaaagagaaccaagtttacagtaaacatgaagtaagcaatcttaaagacagttcagaagtcacagaagaagttctattaacgtctttaagacgtgttcttgatcaatattcctctttgcaagcaccagatgggtattggcctggtggttacagcgggattttgttcattctgccgctcatgatatttgccttacatgtgactaagtcactaaacgatgtcttatcatctgagcatatacgtgagatatgccgctacatctacaacattcagaatgaagatgggggttggagtacacatactttaggcccaagctccatgtttggctcatgtgttaactatgctaccttaaggctcttaggggaggtactggatgaacacaatgatggattatcaaaagggcgtgcctggattctgtctcatggcagtgcaactgtagcaccacaatgggcaaagatatatctctcggtaattggtgtttacgattggtcagggaacaatccaattattccagaactatggttgcttccacattttcttcccattcatccaggaagattttggtgcttttgccggatggtttatatgccaatgtcttatatatatgcaaaaagatttattgggccaataactccaactatactggcactaagagaagagctctatgatgtaccatacaacaagatcaattggaacaatgctcgcatttcttgttgcaaggacgacattatttatcctccttcgtggttccaaaacattgctatggcttctttacataaatttatggaaccactatttaatatgtggccaatgaacaagctaagaaaaagagctttgaccaacctcatggatcatattcactatgaagatgaaaacagcaattatgtgggtttatgcccaattaacaaggtattaaatatgatttgctgctggatagaaaatccgaactccaatgcattcagacgacacgttccaaggattcatgatttcctatggcttgcagaagatggaatgaagtcaaaggtgtacgttggtagccggtgctgggatactgcccttatagttcaggcctactgctcaaccggccttacccaagaatttagtgaaactatcaagaaagctcatgattttataaagaatgcgcaggtaaccaagaattgtcctaattacaaaagatattaccgtgaaaggtcaaaaggttcatggacattatcaaatggagaaaatggatggcctattgcggatactcttgccgaatgccttaaggcggtgttgttgttatcaaagattccaccaacccaagtaggagatccaattcaagaacaaaggttgtatgatgctattgactgcctactttcatatgtgaacaaggatggcactttgtcctctgcagaatctaagagaacaactccatgggtggagttcatcaacccttccgagagtttccggaacataattgtggattacccgtacgtggaatgcacatcatcactaattcaagccttgatactgtttaaaggcgttcatcctggataccgccgtgaagagatagatagaattatcaaaaatggtgtgttgttcatcgagaaaaaacaaaaaaatgatggatcgtggtatggatcttgggctgtctgttttacttatgctaccttctttgctataaaaggactggttgcggcaggaagaacattccaaaacagtttgtctattaggaaggcatgcaacttcttgctgtcaaagcagctaagtactggtggatggggagaggattacctcggttgtcaagttgaggagtatattgacagtgggaggcctcatgtagttcacactgcgtggggaatgttgggcttaatatatgctggacaggttgaattagatccagcaccattataccgtgcggccaaagaattaatcaacatgcagctggagacaggagaatttccacaacaagaaattcttgggagcttcaattcctccctcttcttcaattacacaaactacaggaacttgttcccaatctgggccctaggagagtttcaccgccgacttctagcaaaaagggcttaa

SEQ ID NO: 4266 - protein, 756 aa, Oryza sativa (japonica cultivar-group)
MWKLKFGEGASNPLLRSSNGFLGRETWEFDPNGGSPEEHAVVERLRRDFTRNRFTQRECSDLLMRMQFAKENQVYSKHEVSNLKDSSEVTEEVLLTSLRRVLDQYSSLQAPDGYWPGGYSGILFILPLMIFALHVTKSLNDVLSSEHIREICRYIYNIQNEDGGWSTHTLGPSSMFGSCVNYATLRLLGEVLDEHNDGLSKGRAWILSHGSATVAPQWAKIYLSVIGVYDWSGNNPIIPELWLLPHFLPIHPGRFWCFCRMVYMPMSYIYAKRFIGPITPTILALREELYDVPYNKINWNNARISCCKDDIIYPPSWFQNIAMASLHKFMEPLFNMWPMNKLRKRALTNLMDHIHYEDENSNYVGLCPINKVLNMICCWIENPNSNAFRRHVPRIHDFLWLAEDGMKSKVYVGSRCWDTALIVQAYCSTGLTQEFSETIKKAHDFIKNAQVTKNCPNYKRYYRERSKGSWTLSNGENGWPIADTLAECLKAVLLLSKIPPTQVGDPIQEQRLYDAIDCLLSYVNKDGTLSSAESKRTTPWVEFINPSESFRNIIVDYPYVECTSSLIQALILFKGVHPGYRREEIDRIIKNGVLFIEKKQKNDGSWYGSWAVCFTYATFFAIKGLVAAGRTFQNSLSIRKACNFLLSKQLSTGGWGEDYLGCQVEEYIDSGRPHVVHTAWGMLGLIYAGQVELDPAPLYRAAKELINMQLETGEFPQQEILGSFNSSLFFNYTNYRNLFPIWALGEFHRRLLAKRA

SEQ ID NO: 4267 - DNA, 2289 bp, Oryza sativa (japonica cultivar-group)
  CDS (1)..(2289)
atgtggaggctgaaggtggcccagggcggcggcgctttgttgcggtcgacgaacggcttcgccgggcgagcggtgtgggagttcgaccccgaccacggcacgccggaggaccgagccaacgtcgagagggtgcgccgcgacttcaccgaccaccgcctccgccgcccggagtccgccgatctcctcatgcgcatgcagtttgcaagagaaaacaatcaccaacgccgtggtgatcgtattccaccggccgtcaataagcttggcgagaaggagcaggtgactgaagaaactgtgatggcttccttgaggcgagctctcgatgagttctcctctctgcaagcagatgatggccactggcctggcgacctcagtggtgctatattcatcatgcctgtcttgatattttctttgtatgccactggatcactggacactgtcatatcatcagaacaccggagggagatatgtcgctacatctataaccatcagaacgaggacgggggatggggcatgctaatcttgggatcaagcacgatgtttgccacatgcttaaactatgtcaccctgagacttatcggcgaggagccaagcaatgagcaattagctagaggacacgcctggatcatatcacatggtggcgccacccttgttccgcaatggggaaagatatgtctgtcgataattggagtgtatgagtggtcaggaaacaaccccatcttccccgagttatggcttgctccacaattccttccgtttcatccaggcaaattctggggcccgacccgcgtggtgtacgtgccgatggcctatctgtacggcaagaagttcgtggggcccatcacgccaaccatactggcgctgcgagaggagatatacacggacccctaccacaccattgactgggcccaagcctgcaacgcatgctccaaggaggatttggtctgcccgcgcacgctgctgcagaatgtggtgtggacttcgctctacaagtgggtggagccggtgctaggcagcaggccgatgaacaagctgagggagagagctttggatagactcatggagcatatccattacgaagatgaaaactcacagtacctctgcctatgtcctgtcaacaaggctcttaacatggtctgctgctgggtggaagatccaaattcagattcattcaagcggcatcttgcaaggatacctgatttcctgtggctttcagaagatggcatgaaggcacagatatatgatggttgccagagctgggaaacagcatttataattcaagcgttttgtgctactgatcttgtaaatgagtatggttcaactgttaggagagcccacgagttcatgaaaaattcacagattatgaggaatcatcctggtgaccaaagttactggcatcgccatagatcaaagggttcatggactctttcgtcagcagacaatggatgggctgtgtctgacactacagcagaagcgctgaaggctgtactgttactggaaaagatctctagcaacgtggtcggggatccaattgaaatagaaaggctgcatgatgctgttgattgcctcctatctttcgtgaacaaagatggtaccctttctacatatgaatgtaaaagaacttatacttggatagaggttctcagtccttgtgagagttttccaaacatagtggttgattatccatttccagaatgcacctcctctgtgcttcaagctctggtgctgttcaaacaactacaccctagttaccgtattaaagagatagaaaaatgtgtcagaaacgcagcgatgtttattgagagcacacaaggcgaagatggttcatggctaggcacttggggtgtgtgtttcacctatggggcctttctttcagtaaaagggttaattgctgctggaagaacatatgagaatagttcttccatcaggaaagcatgcgactttatattatcaaagcagctcgatactggtgggtggggagaaagttatgtctctaatattactaaggtttacgtaaacattaaagatgatcaagctcatgcagtgaatactgcctgggcaatgttagctttaatttgtgcaggacagatggagcgggatccagcaccactgcatcgtgctgcaaaagaattaatcaatatgcagttggaaacaggagagttcccccaacaagaacatgttggagccttcaatgcatgcctcttctttaattaccccaactaccgcaacttattccctatctgggctcttggagagtactgtcgtcatcttcactccacgaggcgtgcatga

SEQ ID NO: 4268 - protein, 762 aa, Oryza sativa (japonica cultivar-group)
MWRLKVAQGGGALLRSTNGFAGRAVWEFDPDHGTPEDRANVERVRRDFTDHRLRRPESADLLMRMQFARENNHQRRGDRIPPAVNKLGEKEQVTEETVMASLRRALDEFSSLQADDGHWPGDLSGAIFIMPVLIFSLYATGSLDTVISSEHRREICRYIYNHQNEDGGWGMLILGSSTMFATCLNYVTLRLIGEEPSNEQLARGHAWIISHGGATLVPQWGKICLSIIGVYEWSGNNPIFPELWLAPQFLPFHPGKFWGPTRVVYVPMAYLYGKKFVGPITPTILALREEIYTDPYHTIDWAQACNACSKEDLVCPRTLLQNVVWTSLYKWVEPVLGSRPMNKLRERALDRLMEHIHYEDENSQYLCLCPVNKALNMVCCWVEDPNSDSFKRHLARIPDFLWLSEDGMKAQIYDGCQSWETAFIIQAFCATDLVNEYGSTVRRAHEFMKNSQIMRNHPGDQSYWHRHRSKGSWTLSSADNGWAVSDTTAEALKAVLLLEKISSNVVGDPIEIERLHDAVDCLLSFVNKDGTLSTYECKRTYTWIEVLSPCESFPNIVVDYPFPECTSSVLQALVLFKQLHPSYRIKEIEKCVRNAAMFIESTQGEDGSWLGTWGVCFTYGAFLSVKGLIAAGRTYENSSSIRKACDFILSKQLDTGGWGESYVSNITKVYVNIKDDQAHAVNTAWAMLALICAGQMERDPAPLHRAAKELINMQLETGEFPQQEHVGAFNACLFFNYPNYRNLFPIWALGEYCRHLHSTRRA

SEQ ID NO: 4269 - DNA, 2280 bp, Arabidopsis thaliana
  CDS (1)..(2280)
atgtggaggttgaagataggagaagggaacggagatgatccctacttattcactactaacaacttcgccggacgacaaacatgggagtttgatcctgacggaggctcgccggaggaaagacactccgtcgttgaggctcgccggattttctacgacaatcgttttcatgttaaagcaagcagcgatctcttgtggcgcatgcagtttctgagggagaaaaagtttgagcaacggatagctccggtgaaagttgaagactccgagaaggtaacctttgaaacggcgacgagtgcattacggagaggtattcatttcttctcggcgttgcaggccagcgacggtcactggccggcggaaaatgccggccctttgtttttccttccgccactggtgttttgtctttacataacgggacatcttgatgaagtgttcacttcagaacatcgaaaagagattcttcgatacatctactgtcaccagaaggaagatggtgggtggggattacacattgaaggtcatagcacaatgttctgtaccacgttgaattacatatgtatgcgtatacttggagaaagtcctgatggaggtcatgataatgcgtgtggacgagcccgggaatggatccttagtcatggtggtgtcacctacataccttcttggggtaaaacttggctttcgatacttggtgtatttgactggtctggaagcaacccaatgcctcctgagttttggatcctaccttctttctttcccgtgcatccagcaaaaatgtggagctactgccggatggtttacttgccaatgtcgtatctctacgggaagcggtttgttggcccaataacgtctctgattttgcaactacgcaaagaactgtacttacagccttatgaagaaatcaattggatgaaagtccgccatctttgtgcaaaggaagatacatattatccccgtccactggttcaagagttggtatgggacagtctttacatctttgcggagcctttccttgcacgttggccatttaacaagcttcttagggaaaaggctcttcaattggcaatgaaacacatacactatgaagatgaaaatagtcgttatatcaccattgggtgtgttgaaaaggtactatgcatgctagcttgttgggttgaagacccgaatggggattatttcaagaagcacctctctagaatctccgattacttgtggatggctgaagatgggatgaaaatgcagagctttggaagtcaactatgggatacagggtttgcgatgcaagctttacttgcaagcaatctctccagtgaaatctctgatgtactcaggagaggacatgagttcataaagaattcacaggttggagagaacccttcaggtgattacaaaagcatgtaccgtcatatttcaaaaggagcatggactttttctgaccgagatcacggatggcaagtttcagactgcacagctcatggcttaaagtgctgcctgctgttctcgatgttggcgccggatattgttggcccaaaacaagaccccgagagactacatgattctgttaatatcttgctctctttacagagcaaaaacggaggtatgactgcctgggagcctgctggtgctcccaagtggttggaattgctcaatcccacagaaatgttttccgacattgtgattgagcatgagtacagtgaatgtacatcgtctgcaatccaagcattgagtcttttcaagcaactctaccctgatcacaggacaacagagatcaccgctttcatcaagaaagctgcggaatacctagaaaacatgcaaacacgtgatggttcatggtatgggaactggggcatttgcttcacgtacggtacatggtttgctcttgcaggcttagcagctgcgggtaagacttttaacgactgtgaggcaatacgcaaaggcgttcagtttcttcttgcagctcagaaagacaacggaggctggggagaaagctacctctcttgctccaaaaagatatacatagcacaagtaggggagatatcaaacgtggtgcaaactgcttgggctttaatgggtctcattcactctggacaggcagagagagatccgattcctcttcaccgtgctgcgaaacttatcatcaattcacaactggagagtggagattttcctcaacagcaagcaaccggagtgtttttgaagaattgcacattacactacgctgcatatagaaacattcatccgttgtgggcactcgcagaatatcgcgcgcgagtttcgttgccatga

SEQ ID NO: 4270 - protein, 759 aa, Arabidopsis thaliana
MWRLKIGEGNGDDPYLFTTNNFAGRQTWEFDPDGGSPEERHSVVEARRIFYDNRFHVKASSDLLWRMQFLREKKFEQRIAPVKVEDSEKVTFETATSALRRGIHFFSALQASDGHWPAENAGPLFFLPPLVFCLYITGHLDEVFTSEHRKEILRYIYCHQKEDGGWGLHIEGHSTMFCTTLNYICMRILGESPDGGHDNACGRAREWILSHGGVTYIPSWGKTWLSILGVFDWSGSNPMPPEFWILPSFFPVHPAKMWSYCRMVYLPMSYLYGKRFVGPITSLILQLRKELYLQPYEEINWMKVRHLCAKEDTYYPRPLVQELVWDSLYIFAEPFLARWPFNKLLREKALQLAMKHIHYEDENSRYITIGCVEKVLCMLACWVEDPNGDYFKKHLSRISDYLWMAEDGMKMQSFGSQLWDTGFAMQALLASNLSSEISDVLRRGHEFIKNSQVGENPSGDYKSMYRHISKGAWTFSDRDHGWQVSDCTAHGLKCCLLFSMLAPDIVGPKQDPERLHDSVNILLSLQSKNGGMTAWEPAGAPKWLELLNPTEMFSDIVIEHEYSECTSSAIQALSLFKQLYPDHRTTEITAFIKKAAEYLENMQTRDGSWYGNWGICFTYGTWFALAGLAAAGKTFNDCEAIRKGVQFLLAAQKDNGGWGESYLSCSKKIYIAQVGEISNVVQTAWALMGLIHSGQAERDPIPLHRAAKLIINSQLESGDFPQQQATGVFLKNCTLHYAAYRNIHPLWALAEYRARVSLP

SEQ ID NO: 4271 - DNA, 2292 bp, Arabidopsis thaliana
  CDS (1)..(2292)
atgtggaagttgaagataggagagggaaatggagaagatccttacttgttcagcagcaacaacttcgtcggacgtcaaacatgggagtttgatcccaaagccggcacacctgaggaacgagccgccgtcgaagatgctcgccggaactatttagacaaccgtccccgtgttaaaggttgcagtgatctcttgtggcgaatgcaatttttgaaagaggcgaaattcgagcaagtgatcccgccggtgaagatcgacgacggcgaaggcataacttacaaaaacgcgacggatgcgttacggagagcagtttctttctactcggctttgcagtcctccgatggccactggccggcggaaatcaccggaactctcttcttccttcctccattggtattttgtttctatatcacaggacacctcgagaagatatttgatgcagaacatcgcaaagagatgcttcggcatatctattgccaccagaacgaagacggtggatggggtttacatattgagggaaagagcgttatgttctgcaccgtactgaattacatatgcttgcgtatgctcggagaaggtcccaatggagggcgcaataacgcctgcaaacgggccaggcaatggattcttgaccatggtggtgtgacttatattccttcttggggaaaaatttggctctcgatactcggaatctatgattggtctggaaccaacccaatgcctcccgagatttggttgctgccttctttctttccaatacacttaggaaaaactttgtgttatacccggatggtttatatgcccatgtcttatctatatgggaaacgatttgttggtcctcttacacctcttattatgctattgcgcaaagaactgcacttgcaaccttatgaggaaatcaattggaacaaagcgcgccgtctatgtgcaaaagaagacatgatttatcctcatcctctggttcaagatttgttatgggacactcttcacaattttgtggagcctatccttacaaattggccgttaaaaaaacttgtacgggaaaaggctcttcgagtggcaatggaacacatacattatgaggacgaaaatagccattatattaccatcggatgtgttgagaaggttctgtgcatgcttgcttgctggatcgagaatcctaatggagatcactttaagaaacatctcgctagaattccggacttcatgtgggttgctgaagacggactgaaaatgcagagctttggaagtcaactctgggacacagtttttgcgattcaagctttacttgcttgtgacctttctgacgaaactgatgatgtactcaggaaaggacacagtttcatcaaaaaatcccaggttagagaaaacccttcaggtgactttaagagcatgtatcgccatatttccaaaggagcctggactctgtccgatcgagatcatggatggcaagtctcagattgtacagctgaagctttgaagtgttgcatgctgctctccatgatgccagctgaggtcgttggccagaaaatagatcctgaacaattatatgattctgttaatctcttgctatcgttgcagggtgaaaaaggaggtttgactgcatgggagcctgtccgtgcacaagaatggctggaattgctcaatcccacagatttctttacttgtgttatggctgaacgcgagtatgtagaatgtacctcagctgttatacaagctttggtactgttcaaacaactttatccggatcacaggacaaaagagatcatcaagtcgattgagaaaggggtgcaattcattgaaagcaaacaaacgcctgatggttcatggcatggaaactggggtatctgtttcatctacgctacttggtttgctctgagcggcctagcagccgctggtaaaacttacaaaagttgcctggctgtgcgcaaaggtgtagatttcctgcttgcgatacaggaagaagatggaggttggggcgaaagccatctgtcatgccctgagcagagatacataccattagaagggaacagatcaaacctagtgcaaaccgcatgggctatgatgggtttgattcatgccggacaggccgagagagatcctacacctcttcaccgtgctgcgaaacttatcatcacttcacaacttgaaaatggggactttccgcaacaggaaatattaggagtgttcatgaatacatgcatgctacactatgctacgtacagaaacatcttcccactatgggcactcgcggaatatcggaaagctgccttcgcaactcatcaagatctttag

SEQ ID NO: 4272 - protein, 763 aa, Arabidopsis thaliana
MWKLKIGEGNGEDPYLFSSNNFVGRQTWEFDPKAGTPEERAAVEDARRNYLDNRPRVKGCSDLLWRMQFLKEAKFEQVIPPVKIDDGEGITYKNATDALRRAVSFYSALQSSDGHWPAEITGTLFFLPPLVFCFYITGHLEKIFDAEHRKEMLRHIYCHQNEDGGWGLHIEGKSVMFCTVLNYICLRMLGEGPNGGRNNACKRARQWILDHGGVTYIPSWGKIWLSILGIYDWSGTNPMPPEIWLLPSFFPIHLGKTLCYTRMVYMPMSYLYGKRFVGPLTPLIMLLRKELHLQPYEEINWNKARRLCAKEDMIYPHPLVQDLLWDTLHNFVEPILTNWPLKKLVREKALRVAMEHIHYEDENSHYITIGCVEKVLCMLACWIENPNGDHFKKHLARIPDFMWVAEDGLKMQSFGSQLWDTVFAIQALLACDLSDETDDVLRKGHSFIKKSQVRENPSGDFKSMYRHISKGAWTLSDRDHGWQVSDCTAEALKCCMLLSMMPAEVVGQKIDPEQLYDSVNLLLSLQGEKGGLTAWEPVRAQEWLELLNPTDFFTCVMAEREYVECTSAVIQALVLFKQLYPDHRTKEIIKSIEKGVQFIESKQTPDGSWHGNWGICFIYATWFALSGLAAAGKTYKSCLAVRKGVDFLLAIQEEDGGWGESHLSCPEQRYIPLEGNRSNLVQTAWAMMGLIHAGQAERDPTPLHRAAKLIITSQLENGDFPQQEILGVFMNTCMLHYATYRNIFPLWALAEYRKAAFATHQDL

SEQ ID NO: 4273 - DNA, 2274 bp, Arabidopsis thaliana
  CDS (1)..(2274)
atgtggaagttgaagataggaaagggaaatggagaagatccgcatttattcagcagcaataacttcgtcggacgtcaaacatggaagtttgatcacaaagccggctcaccggaggaacgagctgccgtcgaagaagctcgccggggtttcttggataaccgttttcgtgttaaaggttgcagtgatctattgtggcgaatgcaatttctaagagagaagaaattcgaacaaggcataccacaactaaaagctactaacatagaagaaataacgtatgaaacaacgacaaatgcattacgaagaggcgttcgttacttcacggctttgcaagcctccgacggccattggccgggagaaatcaccggtccgcttttcttccttcctcctctcatattttgtttgtacattaccggacatctggaggaagtattcgatgctgaacatcgcaaagagatgctaagacatatctattgtcaccagaacgaagatggtggatggggattacacatcgaaagcaagagtgttatgttctgcaccgtgttgaattacatatgtttacgtatgcttggagaaaatcctgaacaagacgcatgcaaacgagctagacaatggattcttgaccgcggtggagtgatctttattccttcttgggggaaattttggctctcgatacttggagtctatgattggtctggaactaatccgacgccaccagaactcttgatgctgccttcttttcttccaatacatccagggaaaattttgtgttatagccggatggttagtatacctatgtcgtatctatatgggaagaggtttgttggtccaattacacctcttattttactcttgcgcgaagaactttacttggaaccttatgaagaaatcaattggaaaaaaagtcgacgtctatatgcaaaagaagacatgtattatgctcatcctttggttcaagatttgttatctgacactcttcaaaactttgtggagcctttacttacacgttggccattgaacaagcttgtgagggaaaaagctcttcagcttactatgaaacacatacactatgaagacgaaaatagccattacataaccattggatgtgttgaaaaggtactgtgcatgctagcttgttgggttgaaaatccgaatggagattatttcaagaagcatctggctagaattccagattatatgtgggtcgctgaagatggaatgaaaatgcagagctttggatgtcaactgtgggatactggatttgctattcaagctttgcttgcaagtaatctccctgatgaaactgatgatgcactaaagagaggacataattacataaaggcatctcaggttagagaaaacccttcaggtgattttaggagcatgtaccgccacatttcgaaaggagcatggacattttctgatcgagatcatggatggcaagtttcagattgtacagctgaagctttaaagtgttgcctgctgctttccatgatgtcagctgatatcgtcggccagaaaatagatgatgaacaattatatgactctgttaacctcttgctgtctttacagagcggaaatggaggtgtcaatgcgtgggagccatcccgtgcatataaatggttggaactgctcaatcctacagaattcatggctaataccatggtcgagcgggagtttgtggaatgcacctcatctgttatacaagcacttgatctatttagaaaattgtatccagatcacaggaagaaagagatcaacaggtccatcgaaaaagctgtgcaatttatacaagacaatcaaacaccagacggttcatggtacggaaattggggtgtttgcttcatttacgctacttggtttgctcttggaggcctagcagcagctggtgaaacttacaacgattgtttagctatgcgcaatggtgtccactttttgctcacgacacaaagagatgatggaggttggggtgaaagctatttatcatgctccgaacagagatatataccatcagaaggagaaagatcaaaccttgtgcaaacatcatgggctatgatggctctaattcatacgggacaggctgagagagatttgattcctcttcatcgtgctgccaaacttatcatcaattcacaacttgaaaacggcgattttcctcaacaggaaatagtaggagcgttcatgaatacatgcatgctacactatgctacatacagaaacaccttcccattatgggcactcgcagaataccgaaaagttgtgtttatcgttaattaa

SEQ ID NO: 4274 - protein, 757 aa, Arabidopsis thaliana [sequence omitted]

SEQ ID NO: 4275 - DNA, 2247 bp, Arabidopsis thaliana
  CDS (1)..(2247)
atgtggaggttaaagttatcggaaggagacgaagagagcgtgaatcaacatgttggaagacagttttgggaatatgataaccaatttggaacctctgaagagagacatcacattaaccatcttcgtagcaactttactctcaatcggttttcttctaagcatagttctgatcttctctaccgttttcagtgttggaaagagaaaggaaaaggaatggagagacttccacaagtgaaagtaaaagagggggaagaaagattgataaatgaagaagtggtgaatgttacattaagaagaagtttgagattctactcaatacttcaatcacaagatggtttttggcctggtgattatggtggccctttgtttctcttgcctgctctggtgatcggcttatatgtgacggaagttttggatggaactttaactgcgcaacatcaaatcgagattcgtcgttatctctataaccatcagaacaaggatggaggatggggactacacgtagaagggaatagcaccatgttttgtacagtgctctcatacgtagcactgagactaatgggggaagaattagacggtggagatggagccatggaatcagctagaagttggattcaccaccacggtggtgccacttttattccctcctggggcaagttctggctctccgttcttggagcttatgagtggagtgggaacaatcctttacctccagagctatggctccttccatatagtcttccttttcatccgggccgaatgtggtgccattgtaggatggtttatcttccaatgtcatatctatatggaagaagatttgtttgtcgtactaatggaactattttatcgcttcgacgagagctctacactattccttatcaccatatcgattgggacaccgcccgtaatcaatgtgccaaggaggacttgtactatccacatccaaagattcaagacgtcctttggagttgtctgaataaatttggagagcctcttcttgaaagatggccattgaataacctcagaaaccatgctcttcagacagtaatgcaacacattcactatgaagaccaaaacagccactatatttgtatcggtcctgtcaacaaagtcttgaatatgctttgttgttgggtcgagtcctcgaattccgaggcatttaaatctcacctctcgcggattaaagactatttgtgggtggctgaggatggaatgaaaatgcagggatacaacggatctcagctgtgggacgtgactttagcggtccaagcaatcttggcgacgaatttggttgatgactatggtttgatgcttaagaaagcccataactacatcaagaacactcaaataaggaaagacacaagtggagatccggggttgtggtaccgacacccgtgcaagggaggatggggtttctccactggagacaatccatggcctgtctctgattgtactgctgaagccttgaaggcggcgttgctattgtcacaaatgccggttaatttagttggagaacccatgcctgaagagcatttagttgatgctaacaagaatgggggatttgcgtcatatgagctaactagatcatatcccgagctagaggttatcaacccatcagagacttttggggatatcatcatagattatcaatacgtagaatgcacgtcagctgccatccaaggtctcgtgttattcacaacgttaaattcgagctacaagaggaaggagatagtaggaagcatcaacaaagcagttgagtttattgaaaaaacacaacttcctgatggttcatggtatggctcgtggggagtgtgtttcacctatgcaacatggtttggtattaaaggcatgttggcttcaggcaaaacatatgagagcagtctttgtattagaaaagcttgtggtttcttgctctccaaacaactttgttgtggtggatggggagagagctacctttcttgccaaaacaaagtatacaccaatcttcctgggaataaatcgcatattgtgaacacatcatgggcactcttggctctcattgaagcgggacaagctagtagagatccgatgccattgcatcgcggggcaaaatcgctgatcaactcgcagatggaagatggagattacccacaacaagagatactaggagtctttaatcggaattgtatgatcagttactcagcttatagaaacatattccccatttgggctcttggagaataccgcaaactcatgttgtctttatga

SEQ ID NO: 4276 - protein, 748 aa, Arabidopsis thaliana
MWRLKLSEGDEESVNQHVGRQFWEYDNQFGTSEERHHINHLRSNFTLNRFSSKHSSDLLYRFQCWKEKGKGMERLPQVKVKEGEERLINEEVVNVTLRRSLRFYSILQSQDGFWPGDYGGPLFLLPALVIGLYVTEVLDGTLTAQHQIEIRRYLYNHQNKDGGWGLHVEGNSTMFCTVLSYVALRLMGEELDGGDGAMESARSWIHHHGGATFIPSWGKFWLSVLGAYEWSGNNPLPPELWLLPYSLPFHPGRMWCHCRMVYLPMSYLYGRRFVCRTNGTILSLRRELYTIPYHHIDWDTARNQCAKEDLYYPHPKIQDVLWSCLNKFGEPLLERWPLNNLRNHALQTVMQHIHYEDQNSHYICIGPVNKVLNMLCCWVESSNSEAFKSHLSRIKDYLWVAEDGMKMQGYNGSQLWDVTLAVQAILATNLVDDYGLMLKKAHNYIKNTQIRKDTSGDPGLWYRHPCKGGWGFSTGDNPWPVSDCTAEALKAALLLSQMPVNLVGEPMPEEHLVDANKNGGFASYELTRSYPELEVINPSETFGDIIIDYQYVECTSAAIQGLVLFTTLNSSYKRKEIVGSINKAVEFIEKTQLPDGSWYGSWGVCFTYATWFGIKGMLASGKTYESSLCIRKACGFLLSKQLCCGGWGESYLSCQNKVYTNLPGNKSHIVNTSWALLALIEAGQASRDPMPLHRGAKSLINSQMEDGDYPQQEILGVFNRNCMISYSAYRNIFPIWALGEYRKLMLSL

SEQ ID NO: 4277 - DNA, 2280 bp, Arabidopsis thaliana
  CDS (1)..(2280)
atgtggagactgagaattggtgctaaggccaaagataatactcacttgttcaccaccaataactatgttggtaggcagatttgggagtttgatgccaacgctggctctccggaggaacttgccgaggtcgaggaggctcgtcggaatttctccaacaacaggtcacggttcaaggctagtgccgatctcctatggaggatgcagtttcttagggagaagaagtttgagcagaagattccgcgagtgatagtggaggatgcagaaaaaataacgtatgaagatgcaaagactgcattaagaagaggattactatatttcacggcattgcaagctgatgatggacattggcctgctgaaaacgctggttccatattcttcaatgccccttttgtgatatgtctgtacatcactggacatcttgagaaaatcttcactcacgagcatcgtgtagagttacttcggtacatgtacaaccatcagaacgaagatggtgggtggggattgcacgtagaaagccccagtaatatgttctgctcagtcataaactacatatgtttacggatcttgggagtagaagctggtcatgatgataaaggaagtgcttgtgcaagggctcgtaaatggatcctcgaccatggtggtgctacatactcccccttgatcggaaaagcttggctttcggttcttggggtttatgattggtctggctgcaaacctataccccctgagttctggttccttccttcatttttccctgttaatggagggactctctggatttatttaagggatattttcatggggctgtcatacttgtatggtaaaaactttgtcgctacctcaacacctctcattctccagctccgagaagaaatttatccggagccttacacaaatatcagttggaggcaagcacgaaaccgatgtgcaaaggaagatctctattatccacagtcatttttacaagatttgttttggaaaggtgttcatgtattctcagagaatatcctaaatcgatggcctttcaacaatctcataagacaaagagctcttcgaaccactatggaacttgttcactatcatgatgaagcaaccagatatattacaggcggatctgtaccaaaggtaattgctgtttttcatatgcttgcatgttgggtagaagacccagagagtgattattttaagaaacatcttgctcgagtccctgatttcatatggattggcgaggatggactgaaaattcaatcttttggtagccaagtgtgggatacagccttgtctttacatgtctttatagacggtttcgatgatgatgttgatgaagagattaggtcaacgctccttaaaggatatgattacttggaaaaatctcaagttacagagaaccctcctggcgattacatgaaaatgtttcgtcacatggcgaaaggtggatggacgttttcggaccaagaccaaggatggccagtttcagattgtactgctgagagtttagagtgctgtctgttctttgagagcatgtcgtcagagtttattggcaagaaaatggatgtggagaaactctatgatgcagttgatttccttctctatctgcagagtgataatggaggtataacagcatggcaaccagcggacggaaaacttgtggagtttattgaagacgcggttgttgagcatgagtatgtagaatgtactggatctgcaattgtagcgttggctcaattcaataaacaatttccggggtataaaaaggaagaggttgaacggtttataacaaaaggcgtaaagtacattgaggacttgcaaatggtggatggttcatggtacggaaattggggagtgtgcttcatctatggtaccttctttgctgtaagaggtcttgtggctgctgggaagtgttacaataactgtgaggcaattcgtagagcagttcgtttcattctcgacactcaaaacacggagggtggctggggagagagctatctatcttgtccaagaaagaaatatattccgttgataggaaacaagacaaatgtggtgaatacaggacaagcacttatggttctaattatgggaaatcaaatgaagagagatcctttgccggttcatcgtgctgccaaagtgttgatcaattcacaaatggataacggcgatttcccacaacaggaaataatgggagtgttcaagatgaatgtgatgctccattttccaacctacagaaacatgttcactctttgggctcttacacattacacgaaggctctgcgagggctctga

SEQ ID NO: 4278 - protein, 759 aa, Arabidopsis thaliana
MWRLRIGAKAKDNTHLFTTNNYVGRQIWEFDANAGSPEELAEVEEARRNFSNNRSRFKASADLLWRMQFLREKKFEQKIPRVIVEDAEKITYEDAKTALRRGLLYFTALQADDGHWPAENAGSIFFNAPFVICLYITGHLEKIFTHEHRVELLRYMYNHQNEDGGWGLHVESPSNMFCSVINYICLRILGVEAGHDDKGSACARARKWILDHGGATYSPLIGKAWLSVLGVYDWSGCKPIPPEFWFLPSFFPVNGGTLWIYLRDIFMGLSYLYGKNFVATSTPLILQLREEIYPEPYTNISWRQARNRCAKEDLYYPQSFLQDLFWKGVHVFSENILNRWPFNNLIRQRALRTTMELVHYHDEATRYITGGSVPKVIAVFHMLACWVEDPESDYFKKHLARVPDFIWIGEDGLKIQSFGSQVWDTALSLHVFIDGFDDDVDEEIRSTLLKGYDYLEKSQVTENPPGDYMKMFRHMAKGGWTFSDQDQGWPVSDCTAESLECCLFFESMSSEFIGKKMDVEKLYDAVDFLLYLQSDNGGITAWQPADGKLVEFIEDAVVEHEYVECTGSAIVALAQFNKQFPGYKKEEVERFITKGVKYIEDLQMVDGSWYGNWGVCFIYGTFFAVRGLVAAGKCYNNCEAIRRAVRFILDTQNTEGGWGESYLSCPRKKYIPLIGNKTNVVNTGQALMVLIMGNQMKRDPLPVHRAAKVLINSQMDNGDFPQQEIMGVFKMNVMLHFPTYRNMFTLWALTHYTKALRGL

SEQ ID NO: 4279 - DNA, 2277 bp, Arabidopsis thaliana
  CDS (1)..(2277)
atgtggaggctgagaactggaccgaaggctggagaggatactcacctgttcaccaccaacaactatgcagggaggcagatttgggaatttgatgccaacgcaggctctccacaagaaattgccgaggtagaggatgctcggcacaaattctcagacaacacgtcacgtttcaagactactgccgatctcttatggcgcatgcagtttcttagggagaagaaattcgaacagaagattccacgagtgataatcgaggatgcaagaaagataaagtacgaagatgcaaagacagcattgaaaagagggttactctatttcacagccttgcaggctgatgatggacactggccagctgaaaactctggcccaaatttctatacccctccttttttgatatgcttgtacatcactggacatctggagaaaatcttcactcccgagcatgttaaagagttactacgtcacatctacaacatgcagaacgaagatggtgggtggggtttacacgtagaaagccacagtgttatgttctgtacagtcattaattacgtctgtctacgaattgtgggagaagaagtcggtcatgatgatcaaagaaatggttgtgcaaaggctcataagtggatcatggaccatggtggtgctacctacacgcccttgatcggaaaagcgttgctttcggttcttggagtgtatgattggtctggctgcaatcctatacctccagagttctggttgcttccgtcttcttttcctgttaatggagggactctctggatttatttacgggatactttcatggggttgtcatacttgtatggtaaaaaatttgtggctcccccaacacctctcattctccagctccgagaagagctttatccggagccttatgcaaaaatcaattggacgcaaacacgaaaccgatgtggaaaggaagatctctactatccacgctcatttttacaagatttgttttggaagagtgttcacatgttctcagagagtatcctagatcgatggcctttaaacaagctaataagacaaagagctcttcaatccactatggcactcattcactatcatgacgaatccaccagatatattacaggcggatgcctgccaaaggcctttcatatgcttgcatgttggatagaagaccctaagagtgattattttaaaaaacatcttgctcgagttcgcgaatacatatggattggcgaggatggcctgaaaattcaatcttttggtagccaattatgggatacagccttatcgctacatgcattactagacggaattgatgatcatgatgttgatgatgagattaaaacaacgctcgttaaaggatatgattacttgaagaaatcacaaattacagagaaccctcgcggtgatcacttcaaaatgtttcgtcacaagacaaaaggtggatggacattttcagatcaagatcaaggatggcctgtttcagattgtactgctgaaagcttagagtgttgtctattcttcgagagcatgccgtccgagcttattggaaaaaaaatggatgtggagaaactctatgatgccgttgattatcttctctatctgcagagtgataatggaggcatagcagcatggcaaccagttgaaggaaaagcctggttagagttgttaaatatcatgatttttaggtatgtagaatgtacggggtcagcgattgcagcattgactcagtttaacaaacagtttccagggtataaaaacgtagaggttaaacggtttataacaaaggctgcaaagtacattgaagacatgcaaacggtggatggttcatggtacggaaattggggagtgtgttttatatacgggaccttctttgcggtaagaggtcttgtggccgctgggaagacttacagtaactgtgaagcaattcgtaaagcagttcgttttcttctagacacacaaaatccggagggtggctggggagagagctttctctcttgtccaagcaagaaatatactcctttgaaaggaaacagcacaaatgtggtgcaaacagcacaagcacttatggtgctaattatgggtgatcagatggagagagatcctttaccggttcatcgtgctgctcaagtgttgatcaattcacagttggataatggcgattttccacagcaggaaataatgggaacgttcatgagaactgtgatgctccattttccgacctataggaacacgttctctctttgggctctcacacattacacacatgctctgcgacgtctcctcccttaa

SEQ ID NO: 4280 - protein, 758 aa, Arabidopsis thaliana
MWRLRTGPKAGEDTHLFTTNNYAGRQIWEFDANAGSPQEIAEVEDARHKFSDNTSRFKTTADLLWRMQFLREKKFEQKIPRVIIEDARKIKYEDAKTALKRGLLYFTALQADDGHWPAENSGPNFYTPPFLICLYITGHLEKIFTPEHVKELLRHIYNMQNEDGGWGLHVESHSVMFCTVINYVCLRIVGEEVGHDDQRNGCAKAHKWIMDHGGATYTPLIGKALLSVLGVYDWSGCNPIPPEFWLLPSSFPVNGGTLWIYLRDTFMGLSYLYGKKFVAPPTPLILQLREELYPEPYAKINWTQTRNRCGKEDLYYPRSFLQDLFWKSVHMFSESILDRWPLNKLIRQRALQSTMALIHYHDESTRYITGGCLPKAFHMLACWIEDPKSDYFKKHLARVREYIWIGEDGLKIQSFGSQLWDTALSLHALLDGIDDHDVDDEIKTTLVKGYDYLKKSQITENPRGDHFKMFRHKTKGGWTFSDQDQGWPVSDCTAESLECCLFFESMPSELIGKKMDVEKLYDAVDYLLYLQSDNGGIAAWQPVEGKAWLELLNIMIFRYVECTGSAIAALTQFNKQFPGYKNVEVKRFITKAAKYIEDMQTVDGSWYGNWGVCFIYGTFFAVRGLVAAGKTYSNCEAIRKAVRFLLDTQNPEGGWGESFLSCPSKKYTPLKGNSTNVVQTAQALMVLIMGDQMERDPLPVHRAAQVLINSQLDNGDFPQQEIMGTFMRTVMLHFPTYRNTFSLWALTHYTHALRRLLP

SEQ ID NO: 4281 - DNA, 2310 bp, Arabidopsis thaliana
  CDS (1)..(2310)
atgtggaagttgaagatagcaaatggaaacaaagaagagccctacttgttcagtaccaacaacttcctcggaagacagacatgggagtttgatccggacgccggcacagtggaggaactagctgccgtcgaagaagctcgtcggaaattttatgatgatcgttttcgtgttaaagctagcagcgatctcatatggcgtatgcagtttttaaaggagaagaaattcgagcaagttatacctccggcgaaggttgaagatgccaataatatcacgagcgaaatagctacaaatgcgttaaggaaaggggttaatttcttatcagcattgcaggccagtgatggccattggcctgctgaaaatgctggtcctttattcttccttcctccattggttttctgtctatacgtcactggacatctccatgagattttcactcaagaccatcgtcgagaggtccttagatacatctactgtcaccagaatgaagatggtgggtggggattacacatagaaggaaacagcaccatgttctgcaccacactaaactacatttgcatgcgcatacttggagaaggtccaaatggaggaccaggaaacgcgtgcaaacgggccagggattggattcttgaccatggtggtgcaacatacataccttcttggggcaaaacttggctttcgatacttggtgtctttgattggtcaggaagcaaccccatgcctccagagttttggatcctaccttcctttcttccaatacatccagcgaaaatgtggtgttactgccggttggtttacatgccaatgtcttatctttacgggaagagattcgttggtccaataagtcctcttattctgcaactacgcgaagaaatttacttgcagccttatgcgaaaataaactggaatagagctcgccatctatgtgcaaaggaagatgcgtactgtcctcatccacaaattcaagatgttatatggaactgcctttacatcttcaccgaaccgtttcttgcatgttggccatttaacaagctgctaagggaaaaagctcttggggtggcaatgaaacacatacattatgaagacgaaaatagccgttatattaccattggatgtgttgaaaaggcattatgcatgcttgcgtgttgggttgaagaccctaacggaattcatttcaaaaagcatcttttgaggatttctgattacttgtggattgcagaagatgggatgaaaatgcagagctttggaagtcaattatgggattcggggtttgccctccaagcgttagttgcaagtaatctcgtgaacgaaatcccagatgtactcaggagaggatatgactttttgaaaaattctcaggttagagagaacccttcgggtgactttacaaacatgtaccgtcacatatccaaagggtcgtggactttctctgatcgagatcatggatggcaagcttccgactgcacagccgaaagtttcaagtgttgcctgttgctttcaatgataccacctgacattgttggcccgaaaatggatcccgaacagttatatgaggctgttactatcttactgtctctacagagtaaaaatggaggtgtaactgcttgggagcctgcccgtggacaagaatggttggaattgctaaaccctactgaagtttttgctgacattgtggttgagcacgagtacaatgagtgtacttcatcagcgatccaagctttgattcttttcaagcaactatatccgaatcacaggacagaagagatcaacacttccatcaagaaagccgtgcaatacatagagagcatacaaatgcttgatggttcatggtacggaagctggggagtttgcttcacatacagtacatggtttggtctgggaggccttgcagctgctggaaagacatacaacaactgcttggctatgcgtaaaggcgttcatttccttctcacaactcaaaaagataatggaggttggggtgaaagctacttgtcatgtcctaaaaagagatacattccaagtgaaggagagcggtcaaacttggtgcaaacctcttgggcaatgatgggtttacttcatgctggacaggccgagcgagatccgtctcctcttcaccgtgctgcaaagctcttaatcaactctcaactggagaatggcgattttcctcagcaggagataactggagctttcatgaagaactgcttgttacactacgcagcatacagaaacatcttccccgtgtgggcactcgcagagtataggagacgagttcctttgccgtatgaaaaaccttcaacagagagaagaagttag

SEQ ID NO: 4282 - protein, 769 aa, Arabidopsis thaliana
MWKLKIANGNKEEPYLFSTNNFLGRQTWEFDPDAGTVEELAAVEEARRKFYDDRFRVKASSDLIWRMQFLKEKKFEQVIPPAKVEDANNITSEIATNALRKGVNFLSALQASDGHWPAENAGPLFFLPPLVFCLYVTGHLHEIFTQDHRREVLRYIYCHQNEDGGWGLHIEGNSTMFCTTLNYICMRILGEGPNGGPGNACKRARDWILDHGGATYIPSWGKTWLSILGVFDWSGSNPMPPEFWILPSFLPIHPAKMWCYCRLVYMPMSYLYGKRFVGPISPLILQLREEIYLQPYAKINWNRARHLCAKEDAYCPHPQIQDVIWNCLYIFTEPFLACWPFNKLLREKALGVAMKHIHYEDENSRYITIGCVEKALCMLACWVEDPNGIHFKKHLLRISDYLWIAEDGMKMQSFGSQLWDSGFALQALVASNLVNEIPDVLRRGYDFLKNSQVRENPSGDFTNMYRHISKGSWTFSDRDHGWQASDCTAESFKCCLLLSMIPPDIVGPKMDPEQLYEAVTILLSLQSKNGGVTAWEPARGQEWLELLNPTEVFADIVVEHEYNECTSSAIQALILFKQLYPNHRTEEINTSIKKAVQYIESIQMLDGSWYGSWGVCFTYSTWFGLGGLAAAGKTYNNCLAMRKGVHFLLTTQKDNGGWGESYLSCPKKRYIPSEGERSNLVQTSWAMMGLLHAGQAERDPSPLHRAAKLLINSQLENGDFPQQEITGAFMKNCLLHYAAYRNIFPVWALAEYRRRVPLPYEKPSTERRS

SEQ ID NO: 4283 - DNA, 2259 bp, Gibberella zeae PH-1
  CDS (1)..(2259)
atggtcgccaactctactggacgtgacgctagcgcgctaaagtcacgtaagcgcgctgctgactccgagtctgaaccactattgaaacagggccagccattccccaagcagcctcgcatcggttcagagttggacaagacacgatggaggctcaaggacgacgacagccgccacacatggcactaccttgaggacgacgatgctgcaaaggaatggccccagagttatgctgagaaatggtatttgaaccaatccctggatcttccagatcttccaagtcccgacagtcccttggcggccgccacgaatggcctcgacttcttcgaaaaacttcaactacctagcggtcactggggctgcgaatatggcggtcctatgacgccgatttccccttcgaaagcaacggccatctacaactatatatccgcgcgagcgcaccccgaagatggaggctggggtttgcatatcgaaggcgaaagcagtgttttcgggacattgatgaactatgttgcccttcgtcttgttggagtcgaggccgacgaccctgtattggtcaaggccagaggcactcttcataagatgggaggcgcattgtatgcaccgcactgggcaaagttctggatgggtgtcctgggagtcatggattgggatgtcgtcaatcccgtgccaccagaaatatggctactccctgactgggttccttttgcgccatggcgatggtggattcacattcgaatggtgtttctgccaatgggctggttgtactcaaagcgatggagttgcgaagagacagatgttatccgatcattgaggaaggaggtcttcatcgaagactacgccaagatcaagtggacaagccaccgcaacgacattggtgtcgtcgacaactatcaccccaaatcatggcttctcaacacagccaactggctgattgtcaatatctggaacccttatcttcgacccaatgttctgaaagaaaaggccgaagcctggtcgagtaagcaggttgacatggaagatgccaacaccgactatgcatgcttagcgcccgtcaacgccactatgaacacagtcatgtgctacgctcgcgacggtccggacaattacggcgttcaaagacacatcgagcgacttgaggagtttctctgggttaaggacgagggtatgttggtaaacggcaccaatggtgttcaatgctgggatacagcctttttgatccaagcggtcttcgaagccggccttcacaaggacgagaagtggaagccgatgttgatgaagtcgctgcagtatctggaaagacaacaaattcgagaggattgtgttgaccaggatgtttgctatcgccaaccccgaaagggcggctggccgttcagcaacaaggaccagggatatggtgtcagtgattgtatctccgaagcaatgaaggccatcatccttctgcaaaaggtgggcggcctccccgaagtccttgaggaaaggagactattcgatgccgttgatactcttctgctatatcaaaatagcaacggtggcatgtcgtcttacgagaagcgacgaggaggcgagtggctagaaatgctcaacgccgccgaggttttcggtcgcatcatgatcgagtatgactatcccgaatgcacaacagcctgcgtgacggctctatccttgttcaacaagtactggcctgactaccgtaccaaggaagtcaagactctgattcgaacagccgccgagtggatcaagtctaaccagcgtcccgatggtggttggtatggaagctggggtatttgctttacatacgctggcatgtttgcgctcgagagtatgaagcacatcggtcagacatacgctacaggcgagaactcgcgacgcggctgtgactttttgatctccaagcagagggccgacggcggctggtcagaaagctacaaggcctgcgaaacaatggaatatgtcgagcatccatcaggatcccttgtggttcagacagcttgggctttgatcggcctgatggaggctgattacccccatgtggagcccctgaagagaggcattcagttgatcatggatcgccaacaaccaaacggagagtggctgcaggaggccatagagggtgtctttaacaagtcatgcatgatctcatatcccaactacaagtttacctttaccattaaggcgctaggcatgtttgccaagaggtttcctgaggagaagctggttcctagctgggctttgcagggaaatggtattgagaagtcatag

SEQ ID NO: 4284 - protein, 752 aa, Gibberella zeae PH-1
MVANSTGRDASALKSRKRAADSESEPLLKQGQPFPKQPRIGSELDKTRWRLKDDDSRHTWHYLEDDDAAKEWPQSYAEKWYLNQSLDLPDLPSPDSPLAAATNGLDFFEKLQLPSGHWGCEYGGPMTPISPSKATAIYNYISARAHPEDGGWGLHIEGESSVFGTLMNYVALRLVGVEADDPVLVKARGTLHKMGGALYAPHWAKFWMGVLGVMDWDVVNPVPPEIWLLPDWVPFAPWRWWIHIRMVFLPMGWLYSKRWSCEETDVIRSLRKEVFIEDYAKIKWTSHRNDIGVVDNYHPKSWLLNTANWLIVNIWNPYLRPNVLKEKAEAWSSKQVDMEDANTDYACLAPVNATMNTVMCYARDGPDNYGVQRHIERLEEFLWVKDEGMLVNGTNGVQCWDTAFLIQAVFEAGLHKDEKWKPMLMKSLQYLERQQIREDCVDQDVCYRQPRKGGWPFSNKDQGYGVSDCISEAMKAIILLQKVGGLPEVLEERRLFDAVDTLLLYQNSNGGMSSYEKRRGGEWLEMLNAAEVFGRIMIEYDYPECTTACVTALSLFNKYWPDYRTKEVKTLIRTAAEWIKSNQRPDGGWYGSWGICFTYAGMFALESMKHIGQTYATGENSRRGCDFLISKQRADGGWSESYKACETMEYVEHPSGSLVVQTAWALIGLMEADYPHVEPLKRGIQLIMDRQQPNGEWLQEAIEGVFNKSCMISYPNYKFTFTIKALGMFAKRFPEEKLVPSWALQGNGIEKS

SEQ ID NO: 4285 - DNA, 2151 bp, Aspergillus nidulans FGSC A4
  CDS (1)..(2151)
atggccaccagctatgccgtaaggactaagaatcctttgaacctcaagaatagccatgagcggagcgacgacttccccttctctgtgcggactaccagtcttgatggatggcgcttaaccgtggagaatggccatgaacgtttgagatgggaatatctcaagacggggaaggaacgaacagcccagccacaggatccagcgtcgcgattctacctcaatctcccaacgtctatcccaggttgcgcacgcgccaaaacgccctcggccgccgtgctgaatggtgccctgtatcacagccaggttcaagtgaaagagctcggctgttgggcagccgacctgagctgtatcttcttcgtaacgcctatgcttattattgcctggtatatcacacaagcagtcatcgatgaagcatacgctgttgagctcgtgaactttatattgggagttcagaatgcggacggtggctggcccacatatagcggcgaaagcactacgcttatggggacgattcttacctatgtcgcattaagattgatgggactgccggcggatgaagatcacttggtcaaggcgcgcctctatcttctcaagatgggtggcgccgtttatctctctggctgggccaagttctggctggctatgttgggcttgtataaatgggaaggcactgacccctatcctgttgagatgtggctacttcctgaatggtttccaatcagtccctggaaatggtacatcattccgcgacaggtttatctggcgatgagctacttgtccgcgaaacgattcactatgcccaccaacccactacttgacgagatccggaaggagatctttgtgcagccatatgagaggatagacttcctcgcctatcgcggtgtcagcctgcagtgctctcgggagctacgcaagccctggccgctaatattgctgaattggatcctacagaatatctggatcccctggctccggccgatatggctcgcggaggaagggcagcgcagagtgtgggacatcatcaaagactcgaatgatttgactaactccacgggcagtgtcagcgtcgacgcattcctcaatatgatcgcattctattgcaaagaaggacccgactcaaaagctcttcgccgcatccaaactgctagccttgagtacctttggatgggaccgcgaggaatgcaggtaatgagtatccacgccgggcatacttgggagacagcctttgtgctgcaagcctatgccgaaggcggattgagcaaggtacctgaaatccaagcagccatagagcgtgcatacaagtatctggtcgagcagcagcatgtggttgactaccctgaagactcgcaatgccacttcttctcccgccttggtggctggccgttctctactcggtaccaaggcaatgtctgctccgattgcactggcgaagcgctcaaatctatcttgatgatagagagggattcccgtttcacccggcttacgacagaacaccaacttcagcttgctgtggacaacctcattatggtccagaacgcaagtggcggctatagcagcttcgagccaactcgaggaagcgagctactagaatatatgaacggtacggagctgtttggtaaaatgatggttgaatatgacttcacggaatgtacctcgtcctgtattacggcactggccctttatcaccagcgcaaccccaactatcgaaccaaggcggtctgtactgccattgaccgaggcatcaaatacatattgaagcagcagcgggcagatgggagctggttgtcatcatggggtatagcgtgcacatatggagccttttttgcgttggaggctctggcaattgggggcctgaattatcagaacagccctgccgctagaaggggctgtgacttcattgtcaagcagcaactagctgacggaggatggggtgagacaatagatgctcagtacccaggccaagagcccattcgcaggggcgtccagctcttgattagtcgacaacgagagaacggcgagtggaggcaagagcgcgcagtgggaagtggaatagttacttgtgagcttctgtaccacagctacatttactcatttcccatccgcgcacttgcgatgtacaaggcgaagtatggcgacgatgcagtcatagattag

SEQ ID NO: 4286 - protein, 716 aa, Aspergillus nidulans FGSC A4
MATSYAVRTKNPLNLKNSHERSDDFPFSVRTTSLDGWRLTVENGHERLRWEYLKTGKERTAQPQDPASRFYLNLPTSIPGCARAKTPSAAVLNGALYHSQVQVKELGCWAADLSCIFFVTPMLIIAWYITQAVIDEAYAVELVNFILGVQNADGGWPTYSGESTTLMGTILTYVALRLMGLPADEDHLVKARLYLLKMGGAVYLSGWAKFWLAMLGLYKWEGTDPYPVEMWLLPEWFPISPWKWYIIPRQVYLAMSYLSAKRFTMPTNPLLDEIRKEIFVQPYERIDFLAYRGVSLQCSRELRKPWPLILLNWILQNIWIPWLRPIWLAEEGQRRVWDIIKDSNDLTNSTGSVSVDAFLNMIAFYCKEGPDSKALRRIQTASLEYLWMGPRGMQVMSIHAGHTWETAFVLQAYAEGGLSKVPEIQAAIERAYKYLVEQQHVVDYPEDSQCHFFSRLGGWPFSTRYQGNVCSDCTGEALKSILMIERDSRFTRLTTEHQLQLAVDNLIMVQNASGGYSSFEPTRGSELLEYMNGTELFGKMMVEYDFTECTSSCITALALYHQRNPNYRTKAVCTAIDRGIKYILKQQRADGSWLSSWGIACTYGAFFALEALAIGGLNYQNSPAARRGCDFIVKQQLADGGWGETIDAQYPGQEPIRRGVQLLISRQRENGEWRQERAVGSGIVTCELLYHSYIYSFPIRALAMYKAKYGDDAVID

SEQ ID NO: 4287 - DNA, 2193 bp, Candida albicans SC5314
  CDS (1)..(2193): transl_table=12
atgtattattcagaggaaattggtcttcccaaaactgatatttcaagatggaggttacgaagtgacgctcttggtagggaaacatggcattatctatcacaatctgaatgtgaaagtgaaagtgaaccacaatcaacatttgtccaatggcttttagagtcgccagattttccatctccgccatcgtcagatattcatactccagacgaggcagcaagaaagggagctgattttttgaaactattgcaattggataatggtatcttcccctgccagtacaaaggtccaatgtttatgacaattggctatgtaactgctaattattatagcaagactgagatacctgagccgtatagagttgagatgatacgttatattgtcaacactgcacacccagtcgatggtggttggggacttcattctgttgataaatctacttgttttgggacaaccatgaattatgtatgtctccggttattaggaatggaaaaggatcatccagttttggttaaggcgagaaaaacattacatcgtttgggtggtgccattaagaatccacattggggtaaggcttggctatctattttgaatttatatgaatgggagggtgtgaacccagctccaccagaactttggagattaccgtactggttaccaattcatccagcgaaatggtgggtacatactagggctatctatttgccattgggatatacgtctgcaaacagagttcaatgtgagcttgatccacttttaaaagagatcagaaatgaaatttacgttccaagtcaattaccttatgagtcaatcaaatttggtaaccagagaaataatgtttgtggtgtcgatttatattacccacatacaaagattcttgattttgcaaattctatattgagtaaatgggaagctgttagacctaagtggttattgaattgggttaacaagaaagtttatgatttaattgtaaaggagtatcagaatacagagtacttgtgtattgctcctgtgagttttgccttcaatatggttgtgacgtgtcattatgagggctctgaatcagaaaactttaagaaactccaaaacagaatgaacgatgttttgtttcatggacctcagggaatgactgttatggggacaaatggtgtacaagtttgggatgccgcctttatggtacagtactttttcatgacaggcttagttgatgacccaaaatatcacgatatgatcagaaagagttatttatttttagtgagatctcaatttacagaaaattgtgtcgatggaagtttcagagatagacgtaaaggtgcttggccatttagtactaaggaacaaggatatactgttagtgactgtactgcagaagcaatgaaggctattattatggttaggaatcatgcaagttttgctgacatcagggacgaaataaaagatgaaaacttgtttgatgctgttgaagttttgttgcaaattcaaaatgtgggagaatgggaatatggctcattctcgacttatgaaggtataaaagcccctttattgctagaaaaattgaatcctgccgaggtttttaataatatcatggtggagtatccatacgtggaatgtacagactcttccgttttagggcttacttactttgccaaatattaccctgactacaagcccgaattgattcagaaaactatttcctctgccattcaatatattcttgattcacaagataacattgatggctcttggtatggatgttggggaatttgttatacttatgcgtcgatgtttgcattagaagctttgcatacagttggtcttgattatgaatcctcatcagctgtgaaaaaaggatgtgattttcttatttcaaaacaacttccagacggtggatggtcagaatcaatgaaaggttgtgaaacacactcttatgtcaatggtgaaaactctcttgttgttcaatcggcttgggctttgatagggttgatattgggaaattatcctgatgaagagccaatcaaaagaggaattcaatttttgatgaaacgacaattaccgactggtgagtggaagtatgaagatattgaaggtgtatttaatcacagttgtgcaatagaatatccttcatataggtttttatttccaattaaggcattaggtttatataaaaacaagtatggtgataaagtgttagtttaa

SEQ ID NO: 4288 - protein, 730 aa, Candida albicans SC5314
MYYSEEIGLPKTDISRWRLRSDALGRETWHYLSQSECESESEPQSTFVQWLLESPDFPSPPSSDIHTPDEAARKGADFLKLLQLDNGIFPCQYKGPMFMTIGYVTANYYSKTEIPEPYRVEMIRYIVNTAHPVDGGWGLHSVDKSTCFGTTMNYVCLRLLGMEKDHPVLVKARKTLHRLGGAIKNPHWGKAWLSILNLYEWEGVNPAPPELWRLPYWLPIHPAKWWVHTRAIYLPLGYTSANRVQCELDPLLKEIRNEIYVPSQLPYESIKFGNQRNNVCGVDLYYPHTKILDFANSILSKWEAVRPKWLLNWVNKKVYDLIVKEYQNTEYLCIAPVSFAFNMVVTCHYEGSESENFKKLQNRMNDVLFHGPQGMTVMGTNGVQVWDAAFMVQYFFMTGLVDDPKYHDMIRKSYLFLVRSQFTENCVDGSFRDRRKGAWPFSTKEQGYTVSDCTAEAMKAIIMVRNHASFADIRDEIKDENLFDAVEVLLQIQNVGEWEYGSFSTYEGIKAPLLLEKLNPAEVFNNIMVEYPYVECTDSSVLGLTYFAKYYPDYKPELIQKTISSAIQYILDSQDNIDGSWYGCWGICYTYASMFALEALHTVGLDYESSSAVKKGCDFLISKQLPDGGWSESMKGCETHSYVNGENSLVVQSAWALIGLILGNYPDEEPIKRGIQFLMKRQLPTGEWKYEDIEGVFNHSCAIEYPSYRFLFPIKALGLYKNKYGDKVLV

SEQ ID NO: 4289 - DNA, 2844 bp, Ustilago maydis 521
  CDS (1)..(2844)
atggctgtcgattccgcaagaaccacccatggagccacgcacgacgggcggctggcgcgctgtgttggtgctgcgcaaagtagtatcacgcacactcacgactcttgtcagtcacagtcacgagtcacgagtttggcagacttggcggcaaatcacgtgaatcacaaaaatgtctacgaacgtatgactctgatcatgaccatgcgtgatgaccatgatcagggcttgtctcatcgctcgctctctttcgtcgacataatgaccaccacaagccctcccctcggcaagaccgatctgtctcgatggaggcttcgagtttcggacggtggtcgccacgtctggcactatcttcgcgatgatgctgaatgcaaggcgtggccgcaatccgtcgaagacaagtactggctcggtctcgccacagatctaccggagcttccaaaggccaaaacaccgctcgatactgccaggaacggtctctcgttctaccgccacctccagtcttccgatggccactgggcaggcgaatacggtggacccatgtttcttctaccaggcatcatcatcggcatgtacgccactaagacgcctatccccgaagaatggaagattgagattgctcgatacctctggaaccgcgccgacaaggcggatggcggctggggtattcacatcgaaggctgttccaccgtctttggtactgctctcaactacaccgtgctgcgtctcatcggcgtgtccgcagaccatccgatgatggtcaaggcgcgcggtacgctgcacaagctcggcggtgcaacaggcatcccttcgtggggtaagctctggttggcgatcctcaactgctatgaatgggagggcatgaaccccatcccacccgagctgtggttgttgcccgattggctgccgatccatccatggaggtggtggatccacactcgaatggtctacatccccatgggctatctgtggggtcgaaagttcaaagccgagatcgatccgttgatcgaatcgttgaggcaagagctgtatgttgaaccgtacgagtcgatcaactggccagcgcagagaggcaacattgcatcggtcgacatcttctacccgcacaccaagacgctcaagacgctcatggcgctcgtcggcgcctacgacaactgtcacatccctccattgaggagagcaggcatcaagcgcgcctacgagctgctcgtgctcgaagacgaaaacacgtcctaccaatgcctcggtccggtcaacaagatgctcaactacgtagcacgctgggaggtcgagggtcacgatagccacgccatgcgaatgcatcgcgaaaagcttaaggatttcatgtggatcggtcccgagggcatgatgatgactggaaccaacggtagtcaactctgggacacatccttcattgcccaggccatggtggattccgggcttgctgcagcccaagagaatcgtcagctcacacaaaagttgctcgactggctcgatgaatgtcagatccgcgacaatcccaagcatttcaaaacatgctatcgtttcgctaccaagggtgcttggcctttctcgacaaaggagcaaggctacgtggtatcggattgcacggctgaaggtttaaaagctgtcatcatgctgcaagaatccgtgccctatctgtcgaaacaagtctctcgagaacgcatgcatgattccattgatttgctgctcaccatgcaaaatccaggaggtggctttgcatcgtacgaaaccatcaacggtcccgcattgctcgaactcatcaatccggccgaagtgtttggcgacattatgatcgagtatgcctatcccgaatgcaccacttccgtggtcactgcgctgctcaaattcaccaagatcgacgactaccgtaaagacgacattagcaagtgcgtcgatagtgctgtcaagtacattctacgtgcgcagagggacgatgggagctggttcggctcgtgggcgatctgcttcacgtatgctaccatgttcgccgtggaaagcttgatgttggccggtcacacgtacgacaacagtgaggcaatcaggaaagcgtgcaagtttctcgagagcaaacagatgcatgatggtggatggggtgagacgtacaagtcgtgcgaaacgggagtatatacacctgcgaacaagtcgcaagtggtgcaaacagcttgggtgatcatcacactgctacacgccaaatatccccaaaaggaccgcatcaggaaagccgtcaaagtcatcatggatcgtcaacttgccgatggttcatgggcgcaagaacagatcgaaggcattttcaacaggaactgtgccatctcgtacccgaactacaaattcagctttaccatctgggcgttgggcaaagctgcgcgcgaactcgattggagtcgtaccagggattctcgagaaatgagggatcaaaatagccaggatgaggtggcctcggcgcgagttgaggatcgagggagggatcgccgatggacactgacggcatgctaccgtgactggacgcgcctcgaccgcctcggaaaccgttctgagctcgccctcgaccccgacctcgtccacgtccgtgtgcaccgctgccgccacgaccgcctcctgctcgatgtgcacggtgccctggatgatgcgaacctcgtcctctggttggttgaccttgtgagttcatcgttggcggctctgatgacctgtgaacaagcgtcgggccagagtcgatcttgcttagctatacctgtgttgaagcgcgcgagattgcaatgcgatgtgatgctgccgcaccgtgcggtctatctgggctatggtgtgttggtgtgtggtgtgagatag

SEQ ID NO: 4290 - protein, 947 aa, Ustilago maydis 521
MAVDSARTTHGATHDGRLARCVGAAQSSITHTHDSCQSQSRVTSLADLAANHVNHKNVYERMTLIMTMRDDHDQGLSHRSLSFVDIMTTTSPPLGKTDLSRWRLRVSDGGRHVWHYLRDDAECKAWPQSVEDKYWLGLATDLPELPKAKTPLDTARNGLSFYRHLQSSDGHWAGEYGGPMFLLPGIIIGMYATKTPIPEEWKIEIARYLWNRADKADGGWGIHIEGCSTVFGTALNYTVLRLIGVSADHPMMVKARGTLHKLGGATGIPSWGKLWLAILNCYEWEGMNPIPPELWLLPDWLPIHPWRWWIHTRMVYIPMGYLWGRKFKAEIDPLIESLRQELYVEPYESINWPAQRGNIASVDIFYPHTKTLKTLMALVGAYDNCHIPPLRRAGIKRAYELLVLEDENTSYQCLGPVNKMLNYVARWEVEGHDSHAMRMHREKLKDFMWIGPEGMMMTGTNGSQLWDTSFIAQAMVDSGLAAAQENRQLTQKLLDWLDECQIRDNPKHFKTCYRFATKGAWPFSTKEQGYVVSDCTAEGLKAVIMLQESVPYLSKQVSRERMHDSIDLLLTMQNPGGGFASYETINGPALLELINPAEVFGDIMIEYAYPECTTSVVTALLKFTKIDDYRKDDISKCVDSAVKYILRAQRDDGSWFGSWAICFTYATMFAVESLMLAGHTYDNSEAIRKACKFLESKQMHDGGWGETYKSCETGVYTPANKSQVVQTAWVIITLLHAKYPQKDRIRKAVKVIMDRQLADGSWAQEQIEGIFNRNCAISYPNYKFSFTIWALGKAARELDWSRTRDSREMRDQNSQDEVASARVEDRGRDRRWTLTACYRDWTRLDRLGNRSELALDPDLVHVRVHRCRHDRLLLDVHGALDDANLVLWLVDLVSSSLAALMTCEQASGQSRSCLAIPVLKRARLQCDVMLPHRAVYLGYGVLVCGVR

SEQ ID NO: 4291 - DNA, 2449 bp, synthetic construct
  CDS (1)..(2292)
atgtggaagttgaagataggagagggaaatggagaagatccttacttgttcagcagcaacaacttcgtcggacgtcaaacatgggagtttgatcccaaagccggcacacctgaggaacgagccgccgtcgaagatgctcgccggaactatttagacaaccgtccccgtgttaaaggttgcagtgatctcttgtggcgaatgcaatttttgaaagaggcgaaattcgagcaagtgatcccgccggtgaaaatcgacgacggcgaaggcataacttacaaaaacgcgacggatgcgttacggagagcagtttctttctactcggctttgcagtcctccgatggccactggccggcggaaatcaccggaactctcttcttccttcctccattggtattttgtttctatatcacaggacacctcgagaagatatttgatgcagaacatcgcaaagagatgcttcggcatatctattgccaccaaaacgaagacggtggatggggtttacatattgagggaaagagcgttatgttctgcaccgtactgaattacatatgcttgcgtatgctcggagaaggtcccaatggagggcgcaataacgcctgcaaacgggccaggcaatggattcttgaccatggtggtgtgacttatattccttcttggggaaaaatttggctctcgatactcggaatctatgattggtctggaaccaacccaatgcctcccgagatttggttgctgccttctttctttccaatacacttaggaaaaactttgtgttatacccggatggtttatatgcccatgtcttatctatatgggaaacgatttgttggtcctcttacacctcttattatgctattgcgcaaagaactgcacttgcaaccttatgaggaaatcaattggaacaaagcgcgccgtctatgtgcaaaagaagacatgatttatcctcatcctctggttcaagatttgttatgggacactcttcacaattttgtggagcctatccttacaaattggccgttaaaaaaacttgtacgggaaaaggctcttcgagtggcaatggaacacatacattatgaggacgaaaatagccattatattaccatcggatgtgttgagaaggttctgtgcatgcttgcttgctggatcgagaatcctaatggagatcactttaagaaacatctcgctagaattccggacttcatgtgggttgctgaagacggactgaaaatgcagagctttggaagtcaactctgggacacagtttttgcgattcaagctttacttgcttgtgacctttctgacgaaactgatgatgtactcaggaaaggacacagtttcatcaaaaaatcccaggttagagaaaacccttcaggtgactttaagagcatgtatcgccatatttccaaaggagcctggactctgtccgatcgagatcatggatggcaagtctcagattgtacagctgaagctttgaagtgttgcatgctgctctccatgatgccagctgaggtcgttggccagaaaatagatcctgaacaatcatatgattctgttaatctcttgctatcgttgcagggtgaaaaaggaggtttgactgcatgggagcctgtccgtccacaagaatggctggaattgctcaatcccacagatttctttacttgtgttatggctgaacgcgagtatgtagaatgtacctcagctgttatacaagctttggtactgttcaaacgactttatccggatcacaggacaaaagagatcatcaagtcgattgagaaaggggtgcaattcattgaaagcaaacaaacgcctgatggttcatggcatggaaactggggtatctgtttcatctacgctacttggtttgctctgagcggcctagcagccgctggtaaaacttacaaaagttgcctggctgtgcgcaaaggtgtagatttcctgcttgcgatacaggaagaagatggaggttggggcgaaagccatctgtcatgccctgggcagaggtacataccattagaaggggacagatcaaacctagtgcaaaccgcatggggtatgatgggtttgattcatgccggacaggccgagagagatcctacacctcttcaccgtgctgcgaaacttgtcatcagttcacaacttgaaaatggggactttccgcgacaggaaatattaggagtgttcatgaaaacatgcatgctacactatgctacgtacagaaacatcttcccactatgggcactcgcggaatatcggaaagctgccttcgcaactcatcaagatctttagctctttcttaatagtcaatctttaaaagagatttggctcttctttaataatattatacacaattctgtagatatgaaagacaaaataatattattaggagacttgatgttcttaatctgagagactggggttgagatttgcgttaagcaaaatgtca

SEQ ID NO: 4292 - protein, 763 aa, synthetic construct
MWKLKIGEGNGEDPYLFSSNNFVGRQTWEFDPKAGTPEERAAVEDARRNYLDNRPRVKGCSDLLWRMQFLKEAKFEQVIPPVKIDDGEGITYKNATDALRRAVSFYSALQSSDGHWPAEITGTLFFLPPLVFCFYITGHLEKIFDAEHRKEMLRHIYCHQNEDGGWGLHIEGKSVMFCTVLNYICLRMLGEGPNGGRNNACKRARQWILDHGGVTYIPSWGKIWLSILGIYDWSGTNPMPPEIWLLPSFFPIHLGKTLCYTRMVYMPMSYLYGKRFVGPLTPLIMLLRKELHLQPYEEINWNKARRLCAKEDMIYPHPLVQDLLWDTLHNFVEPILTNWPLKKLVREKALRVAMEHIHYEDENSHYITIGCVEKVLCMLACWIENPNGDHFKKHLARIPDFMWVAEDGLKMQSFGSQLWDTVFAIQALLACDLSDETDDVLRKGHSFIKKSQVRENPSGDFKSMYRHISKGAWTLSDRDHGWQVSDCTAEALKCCMLLSMMPAEVVGQKIDPEQSYDSVNLLLSLQGEKGGLTAWEPVRPQEWLELLNPTDFFTCVMAEREYVECTSAVIQALVLFKRLYPDHRTKEIIKSIEKGVQFIESKQTPDGSWHGNWGICFIYATWFALSGLAAAGKTYKSCLAVRKGVDFLLAIQEEDGGWGESHLSCPGQRYIPLEGDRSNLVQTAWGMMGLIHAGQAERDPTPLHRAAKLVISSQLENGDFPRQEILGVFMKTCMLHYATYRNIFPLWALAEYRKAAFATHQDL

SEQ ID NO: 4293 - DNA, 2486 bp, Arabidopsis thaliana
  CDS (112)..(2385)
tttcttctttatgtctaatctcatcggacgaaggtatttggcacaccgacacttctctaacttgcagtcgatcaatttttttatttttattcagggtcatcgtacgtcgtcatgtggaagttgaagataggaaagggaaatggagaagatccgcatttattcagcagcaataacttcgtcggacgtcaaacatggaagtttgatcacaaagccggctcaccggaggaacgagctgccgtcgaagaagctcgccggggtttcttggataaccgttttcgtgttaaaggttgcagtgatctattgtggcgaatgcaatttctaagagagaagaaattcgaacaaggcataccacaactaaaagctactaacatagaagaaataacgtatgaaacaacgacaaatgcattacgaagaggcgttcgttacttcacggctttgcaagcctccgacggccattggccgggagaaatcaccggtccgcttttcttccttcctcctctcatattttgtttgtacattaccggacatctggaggaagtattcgatgctgaacatcgcaaagagatgctaagacatatctattgtcaccagaacgaagatggtggatggggattacacatcgaaagcaagagtgttatgttctgcaccgtgttgaattacatatgtttacgtatgcttggagaaaatcctgaacaagacgcatgcaaacgagctagacaatggattcttgaccgcggtggagtgatctttattccttcttgggggaaattttggctctcgatacttggagtctatgattggtctggaactaatccgacgccaccagaactcttgatgctgccttcttttcttccaatacatccagggaaaattttgtgttatagccggatggttagtatacctatgtcgtatctatatgggaagaggtttgttggtccaattacacctcttattttactcttgcgcgaagaactttacttggaaccttatgaagaaatcaattggaaaaaaagtcgacgtctatatgcaaaagaagacatgtattatgctcatcctttggttcaagatttgttatctgacactcttcaaaactttgtggagcctttacttacacgttggccattgaacaagcttgtgagggaaaaagctcttcagcttactatgaaacacatacactatgaagacgaaaatagccattacataaccattggatgtgttgaaaaggtactgtgcatgctagcttgttgggttgaaaatccgaatggagattatttcaagaagcatctggctagaattccagattatatgtgggtcgctgaagatggaatgaaaatgcagagctttggatgtcaactgtgggatactggatttgctattcaagctttgcttgcaagtaatctccctgatgaaactgatgatgcactaaagagaggacataattacataaaggcatctcaggttagagaaaacccttcaggtgattttaggagcatgtaccgccacatttggaaaggagcatggacattttctgatcgagatcatggatggcaagtttcagattgtacagctgaagctttaaagtgttgcctgctgctttccatgatgtcagctgatatcgtcggccagaaaatagatgatgaacaattatatgactctgttaacctcttgctgtctttacagagcggaaatggaggtgtcaatgcgtgggagccatcccgtgcatataaatggttggaactgctcaatcctacagaattcatggctaataccatggtcgagcgggagtttgtggaatgcacctcatctgttatacaagcacttgatctatttagaaaattgtatccagatcacaggaagaaagagatcaacaggtccatcgaaaaagctgtgcaatttatacaagacaatcaaacaccagacggttcatggtacggaaattggggtgtttgcttcatttacgctacttggtttgctcttggaggcctagcagcagctggtgaaacttacaacgattgtttagctatgcgcaatggtgtccactttttgctcacgacacaaagagatgatggaggttggggtgaaagctatttatcatgctccgaacagagatatataccatcagaaggagaaagatcaaaccttgtgcaaacatcatgggctatgatggctctaattcatacgggacaggctgagagagatttgattcctcttcatcgtgctgccaaacttatcatcaattcacaacttgaaaacggcgattttcctcaacaggaaatagtaggagcgttcatgaatacatgcatgctacactatgctacatacagaaacaccttcccattatgggcactcgcagaataccgaaaagttgtgtttatcgttaattaatcatttacttatttatgtaatttttttctttttaaatgagatgaatgtttttccagcgacggaatacaccgaatattaaaagatgaacacaaaaatatttg

SEQ ID NO: 4294 - protein, 757 aa, Arabidopsis thaliana
MWKLKIGKGNGEDPHLFSSNNFVGRQTWKFDHKAGSPEERAAVEEARRGFLDNRFRVKGCSDLLWRMQFLREKKFEQGIPQLKATNIEEITYETTTNALRRGVRYFTALQASDGHWPGEITGPLFFLPPLIFCLYITGHLEEVFDAEHRKEMLRHIYCHQNEDGGWGLHIESKSVMFCTVLNYICLRMLGENPEQDACKRARQWILDRGGVIFIPSWGKFWLSILGVYDWSGTNPTPPELLMLPSFLPIHPGKILCYSRMVSIPMSYLYGKRFVGPITPLILLLREELYLEPYEEINWKKSRRLYAKEDMYYAHPLVQDLLSDTLQNFVEPLLTRWPLNKLVREKALQLTMKHIHYEDENSHYITIGCVEKVLCMLACWVENPNGDYFKKHLARIPDYMWVAEDGMKMQSFGCQLWDTGFAIQALLASNLPDETDDALKRGHNYIKASQVRENPSGDFRSMYRHIWKGAWTFSDRDHGWQVSDCTAEALKCCLLLSMMSADIVGQKIDDEQLYDSVNLLLSLQSGNGGVNAWEPSRAYKWLELLNPTEFMANTMVEREFVECTSSVIQALDLFRKLYPDHRKKEINRSIEKAVQFIQDNQTPDGSWYGNWGVCFIYATWFALGGLAAAGETYNDCLAMRNGVHFLLTTQRDDGGWGESYLSCSEQRYIPSEGERSNLVQTSWAMMALIHTGQAERDLIPLHRAAKLIINSQLENGDFPQQEIVGAFMNTCMLHYATYRNTFPLWALAEYRKVVFIVN

SEQ ID NO: 4295 - DNA, 2388 bp, Arabidopsis thaliana
  CDS (1)..(2388)
atgtggaagttgaagataggagagggaaatggagaagatccttacttgttcagcagcaacaacttcgtcggacgtcaaacatgggagtttgatcccaaagccggcacacctgaggaacgagccgccgtcgaagatgctcgccggaactatttagacaaccgtccccgtgttaaaggttgcagtgatctcttgtggcgaatgcaatttttgaaagaggcgaaattcgagcaagtgatcccgccggtgaagatcgacgacggcgaaggcataacttacaaaaacgcgacggatgcgttacggagagcagtttctttctactcggctttgcagtcctccgatggccactggccggcggaaatcaccggaactctcttcttccttcctccattggtattttgtttctatatcacaggacacctcgagaagatatttgatgcagaacatcgcaaagagatgcttcggcatatctattgccaccagaacgaagacggtggatggggtttacatattgagggaaagagcgttatgttctgcaccgtactgaattacatatgcttgcgtatgctcggagaaggtcccaatggagggcgcaataacgcctgcaaacgggccaggcaatggattcttgaccatggtggtgtgacttatattccttcttggggaaaaatttggctctcgatactcggaatctatgattggtctggaaccaacccaatgcctcccgagatttggttgctgccttctttctttccaatacacttaggaaaaactttgtgttatacccggatggtttatatgcccatgtcttatctatatgggaaacgatttgttggtcctcttacacctcttattatgctattgcgcaaagaactgcacttgcaaccttatgaggaaatcaattggaacaaagcgcgccgtctatgtgcaaaagaagacatgatttatcctcatcctctggttcaagatttgttatgggacactcttcacaattttgtggagcctatccttacaaattggccgttaaaaaaacttgtacgggaaaaggctcttcgagtggcaatggaacacatacattatgaggacgaaaatagccattatattaccatcggatgtgttgagaaggttctgtgcatgcttgcttgctggatcgagaatcctaatggagatcactttaagaaacatctcgctagaattccggacttcatgtgggttgctgaagacggactgaaaatgcagagctttggaagtcaactctgggacacagtttttgcgattcaagctttacttgcttgtgacctttctgacgaaactgatgatgtactcaggaaaggacacagtttcatcaaaaaatcccaggttagagaaaacccttcaggtgactttaagagcatgtatcgccatatttccaaaggagcctggactctgtccgatcgagatcatggatggcaagtctcagattgtacagctgaagctttgaagtgttgcatgctgctctccatgatgccagctgaggtcgttggccagaaaatagatcctgaacaattatatgattctgttaatctcttgctatcgttgcagggtgaaaaaggaggtttgactgcatgggagcctgtccgtgcacaagaatggctggaattgctcaatcccacagatttctttacttgtgttatggctgaacgcgagtatgtagaatgtacctcagctgttatacaagctttggtactgttcaaacaactttatccggatcacaggacaaaagagatcatcaagtcgattgagaaaggggtgcaattcattgaaagcaaacaaacgcctgatggttcatggcatggaaactggggtatctgtttcatctacgctacttggtttgctctgagcggcctagcagccgctggtaaaacttacaaaagttgcctggctgtgcgcaaaggtgtagatttcctgcttgcgatacaggaagaagatggaggttggggcgaaagccatctgtcatgccctgagcagagatacataccattagaagggaacagatcaaacctagtgcaaaccgcatgggctatgatgggtttgattcatgccggacaggttcaaatattttcaatcttggacttgcatttatttcaagtacaacgaaattatcttgaaacccctatcgtttcctctgctgtatctatacaacaggccgagagagatcctacacctcttcaccgtgctgcgaaacttatcatcacttcacaacttgaaaatggggactttccgcaacaggaaatattaggagtgttcatgaatacatgcatgctacactatgctacgtacagaaacatcttcccactatgggcactcgcggaatatcggaaagctgccttcgcaactcatcaagatctttag

SEQ ID NO: 4296 - protein, 795 aa, Arabidopsis thaliana
MWKLKIGEGNGEDPYLFSSNNFVGRQTWEFDPKAGTPEERAAVEDARRNYLDNRPRVKGCSDLLWRMQFLKEAKFEQVIPPVKIDDGEGITYKNATDALRRAVSFYSALQSSDGHWPAEITGTLFFLPPLVFCFYITGHLEKIFDAEHRKEMLRHIYCHQNEDGGWGLHIEGKSVMFCTVLNYICLRMLGEGPNGGRNNACKRARQWILDHGGVTYIPSWGKIWLSILGIYDWSGTNPMPPEIWLLPSFFPIHLGKTLCYTRMVYMPMSYLYGKRFVGPLTPLIMLLRKELHLQPYEEINWNKARRLCAKEDMIYPHPLVQDLLWDTLHNFVEPILTNWPLKKLVREKALRVAMEHIHYEDENSHYITIGCVEKVLCMLACWIENPNGDHFKKHLARIPDFMWVAEDGLKMQSFGSQLWDTVFAIQALLACDLSDETDDVLRKGHSFIKKSQVRENPSGDFKSMYRHISKGAWTLSDRDHGWQVSDCTAEALKCCMLLSMMPAEVVGQKIDPEQLYDSVNLLLSLQGEKGGLTAWEPVRAQEWLELLNPTDFFTCVMAEREYVECTSAVIQALVLFKQLYPDHRTKEIIKSIEKGVQFIESKQTPDGSWHGNWGICFIYATWFALSGLAAAGKTYKSCLAVRKGVDFLLAIQEEDGGWGESHLSCPEQRYIPLEGNRSNLVQTAWAMMGLIHAGQVQIFSILDLHLFQVQRNYLETPIVSSAVSIQQAERDPTPLHRAAKLIITSQLENGDFPQQEILGVFMNTCMLHYATYRNIFPLWALAEYRKAAFATHQDL

SEQ ID NO: 4297 - DNA, 2559 bp, Panax ginseng
  CDS (85)..(2361)
aagacttctctaattctctacctttcacatgcacactcatcttcctctcccctcgttcaaactctttcttcaaattgagtggaaatgtggaagcttaaaattgcagagggaggaaatccatggcttcgaactctgaacgatcacgtcggccggcaaatttgggagttcgatcccaacattggatcgcctgaagagcttgcggaggtcgagaaagttcgtgaaaattttcgcaatcatcgattcgagaaaaagcacagtgccgatctcctcatgcgcattcagtttgcaaatgagaatccaggcagtgtagtcttaccccaagtcaaagtaaatgatggtgaagatatttcggaggataaagtaacagttacattaaaaagagctatgagtttctattcaactcttcaggcacatgatggacattggccaggagattatggtggtcctatgtttctaatgcctggtttggttattacgctatcgataactggggtgctgaatgtagttttgtccaaagaacataaacgtgagatctgccgttatctttacaatcatcagaacagagatggtgggtggggtttacacattgaaggtccaagtactatgtttggtactgtcttgaactatgttactttgaggttgcttggtgaaggtgctaatgatggccaaggggcaatggaaaaagggcgtcaatggattctggatcatggtagtgccactgcaataacatcatgggggaaaatgtggctttcagttcttggtgtatttgaatggtctggaaataatcccctgccccctgagacgtggctgcttccatatattcttccaatccacccaggaaggatgtggtgccaccgtcggatggtttatctgcctatgtcatacttatatgggaagagatttgttggtccaatcacaccgactgtactttctttgagaaaggaggtcttcagtgtcccttatcatgaaatagattggaatcaagctcgtaacctttgtgcgaaggaagatctgtactatccacaccctctcatacaggatatactttgggcatcactggacaaggtctgggaacctattttcatgcattggcctgcgaagaagttgagagagaagtctcttcgcactgtgatggaacacatacattatgaagacgagaatactcgttatatatgtatagggcctgtaaacaaggtgttaaatatgctatgctgttgggttgaagatccgaactccgaggctttcaagttacatctcccaagactccatgattttttgtggcttgctgaggatggtatgaaaatgcaggggtataatggaagtcaattgtgggacactgcttttgccgttcaagcaattatttcgacaaaccttgctgaagaatacggtccaactcttagaaaagcacatacgttcatgaaaaactcgcaggtgctagatgattgccccggggatcttgatgcctggtatcgccatgtttcaaaaggtgcatggccgttctcaactgcagatcacggatggcccatttcagactgtactgccgaaggattcaaggctgtgcttcaattatcaaaattgccatcagaacttgttggtgaaccattagatgccaagcggctgtatgatgctgtcaacgttattctttctttacagaatagtgatggtggctatgcaacatatgaactaacgagatcctatagctggttggagttagtcaaccctgctgagacgttcggtgacattgttattgactacccttatgtagaatgtacatcagctgcaattcaagctttgacagctttcaagaaattatttcctgggcatcgtcgagaagaaatacagcattctattgaaaaagctgctctgttcattgaaaagatacaatcatcagatggctcatggtacggctcttggggagtctgcttcacctatggcacatggtttggtataaaaggtttagtaactgctgggaggaccttctctagttgcgctagcattcgcaaggcttgtgattttctattgtccaaacaagttgcttctggtggttggggagagagttacctttcctgtcaaaacaaggtgtacacaaatcttgagggtaaccgttctcatgttgtcaatactggatgggctatgctggctctcatcgatgctggacaggccgagagagacgcaacaccattgcaccgtgcagccaaattattaattaattctcaaatggaaaatggtgatttcccacaggaggagatcatgggggtcttcgacaagaattgcatgatcacttatgctgcatacagaaacattttccctatttgggctttgggagaatatcgatgtcgagtactccaggggccatcatgaaaatttattttatccaccctttattatgtttttctatattaatgtgttatgctattttgtttcatctttgacaacccaagtagatgagtaggaaaaaagtgattagctcaatggatgaatcttcctttgattattatctttgagtattatgattagttattttgttacaaaaaaaaaaaaaatcgatcgactcgagtc

SEQ ID NO: 4298 - protein, 758 aa, Panax ginseng
MWKLKIAEGGNPWLRTLNDHVGRQIWEFDPNIGSPEELAEVEKVRENFRNHRFEKKHSADLLMRIQFANENPGSVVLPQVKVNDGEDISEDKVTVTLKRAMSFYSTLQAHDGHWPGDYGGPMFLMPGLVITLSITGVLNVVLSKEHKREICRYLYNHQNRDGGWGLHIEGPSTMFGTVLNYVTLRLLGEGANDGQGAMEKGRQWILDHGSATAITSWGKMWLSVLGVFEWSGNNPLPPETWLLPYILPIHPGRMWCHRRMVYLPMSYLYGKRFVGPITPTVLSLRKEVFSVPYHEIDWNQARNLCAKEDLYYPHPLIQDILWASLDKVWEPIFMHWPAKKLREKSLRTVMEHIHYEDENTRYICIGPVNKVLNMLCCWVEDPNSEAFKLHLPRLHDFLWLAEDGMKMQGYNGSQLWDTAFAVQAIISTNLAEEYGPTLRKAHTFMKNSQVLDDCPGDLDAWYRHVSKGAWPFSTADHGWPISDCTAEGFKAVLQLSKLPSELVGEPLDAKRLYDAVNVILSLQNSDGGYATYELTRSYSWLELVNPAETFGDIVIDYPYVECTSAAIQALTAFKKLFPGHRREEIQHSIEKAALFIEKIQSSDGSWYGSWGVCFTYGTWFGIKGLVTAGRTFSSCASIRKACDFLLSKQVASGGWGESYLSCQNKVYTNLEGNRSHVVNTGWAMLALIDAGQAERDATPLHRAAKLLINSQMENGDFPQEEIMGVFDKNCMITYAAYRNIFPIWALGEYRCRVLQGPS

SEQ ID NO: 4299 - DNA, 2589 bp, Panax ginseng
  CDS (111)..(2402)
aaaagatgacatttataacaatctagtggtgtatttacataactgtataaagtcaccggcagaggcagttcagcggcggcaggcggtggtggtggaaataataaaaaatcatgtggaagcttaagatagcggaagggaataagaatgacccgtatttgtacagtaccaataattttgtagggcggcaaacgtgggagttcgacccggattatgtggctagtcccggagagctagaggaggtggagcaagttcgacgtcagttttgggataaccggtatcaggtcaagcctagtggtgatctcctctggcgtatgcagttcctaagagagaagaatttcagacaaacaatcccccaagtgaaggtaggagatgacgaggcagttacttatgaggccgctaccaccacactccgaagggccgtccactttttttcagctttgcaggccagcgacggtcattggcctgcagagaattccggacctctctttttccttccgcccttggtgatgtgtgtatacattacagggcatcttgatacagtgtttcctgcagaacatcgaaaagaaattcttcgctacatatactgtcatcagaatgaagatggcgggtggggactccatattgaggggcatagcaccatgttctgcacaactcttagctacatttgtatgcgtatacttggagaagggcccgatggtggtgtaaacaatgcatgtgccagaggccgaaaatggatccttgaccatggcagtgtaaccgctataccttcatggggcaagacttggctttcgatacttggtgtatatgaatggataggaagcaacccaatgcccccagaattctggattctcccttctttccttcctatgcacccagctaaaatgtggtgttattgccggatggtttacatgccaatgtcatatttatatgggaagaggtttgttggtccaatcactcctcttatcttacaattaagagaagaactttatggtcaaccctacaatgaaatcaattggagaaaaacacgtcgtgtgtgtgccaaggaggacatctactatcctcatcctttaatacaagacctgctctgggatagtctctatgtattaactgaaccacttttaactcgttggccatttaacaagttgagagagaaagctctgcagacaaccatgaaacacattcactatgaagatgagaacagtcgatatattaccattggatgtgtggaaaaggttttgtgtatgcttgtttgttgggttgaggatccaaatggagattatttcaggaaacaccttgcaaggatcccagattatatatgggttgctgaagatggaatgaagatgcagagttttggtagtcaggaatgggatacaggtttcagcattcaagcattgttggatagtgatctaactcatgaaattggacctactctaatgaaaggacacgacttcatcaaaaagtcccaggtcaaggataatccttctggtgactttaaaagcatgtatcgtcacatttcgaaaggatcgtggactttttcagatcaagatcacggatggcaagtttctgattgcactgcagaaggactaaagtgttgccttattttctcaacgatgccagaggaaatagttggcaagaaaataaaaccagaaagactgtatgattctgttaatgtgttgctttctctacagagaaaaaatggtggcttatcagcatgggagcctgcaggagctcaggaatggttggagttgctcaatcctacagaattctttgcagacattgtcatcgagcacgagtatgtagagtgcacttcatcggcaatccaagctctggttctgtttaaaaagttatatcctggacaccgaaagaaggagatagataattttattacgaatgctgtccgttaccttgaagacacacaaatgcctgatggttcatggtatggaaactggggtgtgtgctttacttatggtagctggtttgctcttggggggctagcggcagctggaaagacatactacaattgtgcagctgttcgtaaagctgttgaatttcttctcaaatcacagatggatgatggcggttggggagaaagctacctttcttgtccgaaaaaggtatatgtaccattagaaggaaaccgctcaaatttggtacatacaggatgggccttgatgggactcattcattctgagcaggctgagagagacccaacacctcttcaccgtgcagccaagttattgatcaattctcagatggaagatggtgattttccccaacaggaaataagtggagtttttatgaagaattgcatgttgcactatgcagcttaccggaatatatacccattgtgggctctagcagagtatcggaggcgggtcccattaccgtccctaggcacctaattagagctatatccaactctaggtgattcagtgctaaataaataatttcaataaaaataaaagtttagttggtctgttgcagagccagaggcccctaaccctaaatgatatcaattcatcgaatcttgtttacagtatatagctaaattataatcacacggtactgttgggtgtgactattgttgcc

SEQ ID NO: 4300 - protein, 763 aa, Panax ginseng
MWKLKIAEGNKNDPYLYSTNNFVGRQTWEFDPDYVASPGELEEVEQVRRQFWDNRYQVKPSGDLLWRMQFLREKNFRQTIPQVKVGDDEAVTYEAATTTLRRAVHFFSALQASDGHWPAENSGPLFFLPPLVMCVYITGHLDTVFPAEHRKEILRYIYCHQNEDGGWGLHIEGHSTMFCTTLSYICMRILGEGPDGGVNNACARGRKWILDHGSVTAIPSWGKTWLSILGVYEWIGSNPMPPEFWILPSFLPMHPAKMWCYCRMVYMPMSYLYGKRFVGPITPLILQLREELYGQPYNEINWRKTRRVCAKEDIYYPHPLIQDLLWDSLYVLTEPLLTRWPFNKLREKALQTTMKHIHYEDENSRYITIGCVEKVLCMLVCWVEDPNGDYFRKHLARIPDYIWVAEDGMKMQSFGSQEWDTGFSIQALLDSDLTHEIGPTLMKGHDFIKKSQVKDNPSGDFKSMYRHISKGSWTFSDQDHGWQVSDCTAEGLKCCLIFSTMPEEIVGKKIKPERLYDSVNVLLSLQRKNGGLSAWEPAGAQEWLELLNPTEFFADIVIEHEYVECTSSAIQALVLFKKLYPGHRKKEIDNFITNAVRYLEDTQMPDGSWYGNWGVCFTYGSWFALGGLAAAGKTYYNCAAVRKAVEFLLKSQMDDGGWGESYLSCPKKVYVPLEGNRSNLVHTGWALMGLIHSEQAERDPTPLHRAAKLLINSQMEDGDFPQQEISGVFMKNCMLHYAAYRNIYPLWALAEYRRRVPLPSLGT

SEQ ID NO: 4301 - DNA, 2684 bp, Panax ginseng
  CDS (131)..(2473)
attagctagctgaagaagaattacacataccaagacattctaccagtgcttgtgcttcaacctcagctttccattcatatatataattaattaaggttgatcaaaggtaggtaggtagaagaggggtagcatgtggaagcttatattatctcaaggggatccagggttgaaaagtgtgaataatcatattggcagacagttttgggagtttgatccaaatcttggtacacccgaagaacgagctcacattgacaaacttcgccaacagtttcataacaatcgatttcgagttaaacatagttctgatcttctaatgagatatcaatttgaaagagagaaatccaggaagttaggtgatgatgatgaggtgaaatcaggaagtgaaggagaaataactactagtagtagtggtgtggaaggagtgaaaatggcacttagaagggccttgaaattctactcaactattcaggctgatgatggccactggcccggtgactatggtggcccattgtttcttcttcctggcttggttattgggttgtatgtcatgggagtgatggatacaattttggccaaggaacatcaaagggagatgtgtcgttatatatacaaccaccagaatgtggacggagggtggggattgcatatagaagggtgcagtactatgctgtgtactgctctcaattacatcacactcagattattgatacgaggagatgaggaggaggaaattagagatgaagctgctaatggaggcagcctggagaaagctagaagatggattattgatcatggcggagctacctacattccctcctggggaaaattctggctctcgatactgggagtatatgagtggagcggcaacaaccctctaccaccagagatgtggcttcttccttattttcttccacttcacccaggacgtatgtggaaccattgtcggatggtgtacctgcccatgtcatacctatacgggaggaggtttgtgggaccaatcaattccactgttctatcactaagaagagagctctatacacacccctatcatcaaattaactgggatttggctagaaatcaatgtgctcaggaagatctgtactatccacatccattaatacaagacatgctgtggagttgtttgcataaaggtgtagaacgactaatcatgcaatggcccctgtctaagataaggcagagggctctaactactgcaatgcaacatatccattacgaggatgaaaacaccagctatatatgccttggacccgttaataaggtactaaacatggtctgttgttgggtggaggacccaaattcaatggcaaatatattgcacctctccaggataaaagattatctgtgggtggctgaagatggcatgaaaatgaagggatataacggatcacagctgtgggatgttggttttgctgttcaagcaatactctcaactggcctggttgatgaatacggctcaatgcttaaaaaagcgcatgatttcattaaaatctcacaggttagagaggatagtccgggaaatctcagttcatggaatcgtcacatttccaagggcggatggcccttctctacaccagataatggttggcctgtatcagattgcactgcagaaggtttgaaggctgcactcttgctatcaaatatgccttttgacattgttggagaagcaatatcaccagttcacttatatgatgctgttaactggattctatccctacagaattgcaccggaggttttgcatcatatgagctcacaagatcttatgcctggttagagctactcaatccagctgaaacttttggagatatcgttatagattatcagtatgtagaatgcacttcagcagcgattcaaggccttaaatctttcatgagattatatccaggatataggaggaaggaaattgaagcatgtattgcaaaagcaactaactttattgagagcatacaactgcctgatggctcatggtatggctcttggggaatctgctacacctatgggacatggtttggaattaaggggttggtggctgctgggaggactaaccgaaattgctatagcatcagaagagcttgtgatttcttattatccaaacaacttggttctggtggatggggagagagctatctttcatgccaaaataaggtatatacgagtattgaaggaaacatttcgcatgtagcaaatactggatgggctatgctagccctaatagaagctgggcaggctcagagagatccctccccactccatcgtgctgcaaaggtgttgatgaattcccaaatgaaaaatggcgtctttccacaacaggaaattgtaggagtgttcaacaagaactgcatgataagttattctgcctacagaaacatatttcctatttgggctcttggagaatatctcaatcgcgtattacaaccttcccggaacatcttgaaaaccttaaatgtagtataaattaatatctatgccagtgccattgccattgccattgccattgcctccagttataaaacgaaataaatgcatacattctttatgataatatgagtagggtatgctgctatgtaaatagggtcatggaagatttccaatatacatatgtaattgtatcatgttgcactcatgaaaattgaagacttattcaatcagatcattgcttgacatc

SEQ ID NO: 4302 - protein, 780 aa, Panax ginseng
MWKLILSQGDPGLKSVNNHIGRQFWEFDPNLGTPEERAHIDKLRQQFHNNRFRVKHSSDLLMRYQFEREKSRKLGDDDEVKSGSEGEITTSSSGVEGVKMALRRALKFYSTIQADDGHWPGDYGGPLFLLPGLVIGLYVMGVMDTILAKEHQREMCRYIYNHQNVDGGWGLHIEGCSTMLCTALNYITLRLLIRGDEEEEIRDEAANGGSLEKARRWIIDHGGATYIPSWGKFWLSILGVYEWSGNNPLPPEMWLLPYFLPLHPGRMWNHCRMVYLPMSYLYGRRFVGPINSTVLSLRRELYTHPYHQINWDLARNQCAQEDLYYPHPLIQDMLWSCLHKGVERLIMQWPLSKIRQRALTTAMQHIHYEDENTSYICLGPVNKVLNMVCCWVEDPNSMANILHLSRIKDYLWVAEDGMKMKGYNGSQLWDVGFAVQAILSTGLVDEYGSMLKKAHDFIKISQVREDSPGNLSSWNRHISKGGWPFSTPDNGWPVSDCTAEGLKAALLLSNMPFDIVGEAISPVHLYDAVNWILSLQNCTGGFASYELTRSYAWLELLNPAETFGDIVIDYQYVECTSAAIQGLKSFMRLYPGYRRKEIEACIAKATNFIESIQLPDGSWYGSWGICYTYGTWFGIKGLVAAGRTNRNCYSIRRACDFLLSKQLGSGGWGESYLSCQNKVYTSIEGNISHVANTGWAMLALIEAGQAQRDPSPLHRAAKVLMNSQMKNGVFPQQEIVGVFNKNCMISYSAYRNIFPIWALGEYLNRVLQPSRNILKTLNVV

SEQ ID NO: 4303 - DNA, 2729 bp, Panax ginseng
  CDS (73)..(2358)
attaccagtaacagaagaactacaattttttgtacctcaaaaaaaaaaaaaaattcaaatttttgtttgaagatgtggaggctaatgacagccaagggaggcaacgatccgtatttgtacagtacaaataacttcatagggcggcagacatgggagtttgatcctgactatggaaccccggcggagagggctgaggttgaggaggctcgtctccatttctggaataaccggtatcaggttaagcccagcagcgatgtcctctggcgaatgcagtttctaaaagagaagaatttcaaacaaattattccccaagtgaaggtggaggatggtgaagaaattacctatgaagcagccacaaccacattgagaagagctgtccactacttttccgcattgcaggctgatgatgggcactggcctgccgaaaatgctggcccgttatttttccttccacccttggtcatgtgtctgtatattacagggcatcttaatactgtattccctgcagagcatcgcatagaaattctacgctacatttactgtcatcagaacgatgatggtggctggggattacatatcgagggccacagcaccatgttttgtacagctcttagctacatctgcatgcgtatacttggagaaggacgcgatggtggtgaaaacaatgcctgtgccagagcaagaaaatggatccttgatcatggtagtgtgacagcaataccctcctggggcaagacatggctttcgattcttggcttattcgattggtcaggaagcaacccaatgcccccagagttttggatccttcctcctttccttcctatgcatccagcaaaaatgtggtgctattgccggatggtttacatgcctatgtcatatttgtatgggaagaggtttgtggggccgatcactcctctcattttacaactgagagaagaactttacgcccaagcctatgatgaaattaactggaggaaagtgcgacataactgtgcaaaggaagacctctactatccccatcctttgatacaagatttgatgtgggatagcctctacatatttacggagcctttcttgactcgttggccttttaacaagttgagagagaaagctcttcaaaccactatgaaacatatccattatgaagatgagaacagtagatacatcactataggatgtgtggaaaaggttttgtgtatgcttgcttgttgggttgaggatccaaatggtgattacttcaagcagcacctcgctaggatcccagattatatatgggttgctgaagatggaatgaaaatgcagagttttggcagtcaagagtgggatactggttttgccatacaagcattgttggcgagtgatctcattgatgaaattcgtcctacccttatgaaagggcatgacttcataaaaaagtcccaggtcaaggagaacccttctggcgacttcaaaagcatgcatcgccacatttctaaaggatcctggaccttttcagatcaagatcatggatggcaagtttcggattgtactgcagaagctttgaagtgttgcctactcttttcaaggatgccaacagaaattgttggtgataaaatggaagacaaccaattgtttgatgctgtcaatatgctgctatccctacagagcaaaaatggcggcctagctgcatgggagcctgcaggatcatcagaatggttggagctgctcaatcctacagaattctttgaagacattgtcattgaacatgagtatgtcgaatgcacttcatcagcaattcaggctatggttatgtttaagaagttataccctgggcataggaagaaagagattgaagtttcaatcacaaatgctgtacagtaccttgaagacatacaaatgcctgatggttcatggtacggaaactggggtgtgtgcttcacatatggtacttggtttgctatgggaggtctaaccgcggctggaaagacatacaacaactgccaaactcttcataaagcagtggattttctaataaaatcgcaacgcagtgatggtggttggggagaaagctatctttcttgcccaaacaaggaatatacacctttagaaggaaataggtcaaatttggttcacacttcatgggccatgatgggtctgattcattctaggcaggctgaaagagacccaacacctcttcatcgtgcagccaagttgttgatcaattcccaaatggaaagtggtgattttccccaacaggaaatcactggagttttcatgaagaactgcatgttacactatgcagcgtctagaaacatatatccgttgtgggctttagcagaatatcgaaaaaatgttcgattaccatctaaaagcgtctgaacacttactacagtggtgaaagtgcagcactcatggtttgacggcctgccaatactcaaatgaaatgggaaaagaatagaaaataaaaataattacccataaacctttatttcttgtccttaccacgatcaagttctatacttgacaaaggtttctgcaaaaaacagagggagatgctcgtgagaagttaagaacaagtcaagtttgtgtccgttatttttaacatatcattttccattttttttacaatagttgtaaatcataaattcagttgctgccaacttctttctacattatatgtatcagttgttcataagataatgtaaaaatttatggaggaataaattatatgtagggcacttatttactct

SEQ ID NO: 4304 - protein, 761 aa, Panax ginseng
MWRLMTAKGGNDPYLYSTNNFIGRQTWEFDPDYGTPAERAEVEEARLHFWNNRYQVKPSSDVLWRMQFLKEKNFKQIIPQVKVEDGEEITYEAATTTLRRAVHYFSALQADDGHWPAENAGPLFFLPPLVMCLYITGHLNTVFPAEHRIEILRYIYCHQNDDGGWGLHIEGHSTMFCTALSYICMRILGEGRDGGENNACARARKWILDHGSVTAIPSWGKTWLSILGLFDWSGSNPMPPEFWILPPFLPMHPAKMWCYCRMVYMPMSYLYGKRFVGPITPLILQLREELYAQAYDEINWRKVRHNCAKEDLYYPHPLIQDLMWDSLYIFTEPFLTRWPFNKLREKALQTTMKHIHYEDENSRYITIGCVEKVLCMLACWVEDPNGDYFKQHLARIPDYIWVAEDGMKMQSFGSQEWDTGFAIQALLASDLIDEIRPTLMKGHDFIKKSQVKENPSGDFKSMHRHISKGSWTFSDQDHGWQVSDCTAEALKCCLLFSRMPTEIVGDKMEDNQLFDAVNMLLSLQSKNGGLAAWEPAGSSEWLELLNPTEFFEDIVIEHEYVECTSSAIQAMVMFKKLYPGHRKKEIEVSITNAVQYLEDIQMPDGSWYGNWGVCFTYGTWFAMGGLTAAGKTYNNCQTLHKAVDFLIKSQRSDGGWGESYLSCPNKEYTPLEGNRSNLVHTSWAMMGLIHSRQAERDPTPLHRAAKLLINSQMESGDFPQQEITGVFMKNCMLHYAASRNIYPLWALAEYRKNVRLPSKSV

SEQ ID NO: 4305 - DNA, 2274 bp, Arabidopsis thaliana
  CDS (1)..(2274)
atgtggaagttgaagataggaaagggaaatggagaagatccgcatttattcagcagcaataacttcgtcggacgtcaaacatggaagtttgatcacaaagccggctcaccggaggaacgagctgccgtcgaagaagctcgccggggtttcttggataaccgttttcgtgttaaaggttgcagtgatctattgtggcgaatgcaatttttaagagagaagaaattcgaacaaggcataccacaactaaaagctactaacatagaagaaataacgtatgaaacaacgacaaatgcattacgaagaggcgttcgttacttcacggctttgcaagcctctgacggccattggccgggagaaatcaccggtccgcttttcttccttcctcctctcatattttgtttgtacattaccggacatctggaggaagtattcgatgctgaacatcgcaaagagatgctaagacatatctattgtcaccagaacgaagatggtggatggggattacacatcgaaagcaagagtgttatgttctgcaccgtgttgaattacatatgtttacgtatgcttggagaaaatcctgaacaagacgcatgcaaacgagctagacaatggattcttgaccgtggtggagtgatctttattccttcttgggggaaattttggctctcgatacttggagtctatgattggtctggaactaatccgacgccaccagaactcttgatgctgccttcttttcttccaatacatccagggaaaattttgtgttatagccggatggttagtatacctatgtcgtatctatatgggaagaggtttgttggtccaattacacctcttattttactcttgcgcgaagaactttacttggaaccttatgaagaaatcaattggaaaaaaagtcgacgtctatatgcaaaagaagacatgtattatgctcatcctttggttcaagatttgttatctgacactcttcaaaactttgtggagcctttacttacacgttggccattgaacaagcttgtgagggaaaaagctcttcagcttactatgaaacacatacactatgaagacgaaaatagccattacataaccattggatgtgttgaaaaggtactgtgcatgctagcttgttgggttgaaaatccgaatggagattatttcaagaagcatctggctagaattccagattatatgtgggtcgctgaagatggaatgaaaatgcagagctttggatgtcaactgtgggataccggatttgctattcaagctttgcttgcaagtaatctccctgatgaaactgatgatgcactaaagagaggacataattacataaaggcatctcaggttagagaaaacccttcaggtgattttaggagcatgtaccgccacatttcgaaaggagcatggacattttctgatcgagatcatggatggcaagtttcagattgtacagctgaagctttaaagtgttgcctgctgctttccatgatgtcagctgatatcggcggccagaaaatagatgatgaacaattatatgactctgttaacctcttgctgtctttacagagcggaaatggaggtgtcaatgcgtgggagccatcccgtgcatataaatggttggaactgctcaatcctacagaattcatggctaataccatggtcgagcgggagtttgtggaatgcacctcatctgttatacaagcacttgatctatttagaaaattgtatccagatcacaggaagaaagagatcaacaggtccatcgaaaaagctgtgcaatttatacaagacaatcaaacaccagacggttcatggtacggaaattggggtgtttgcttcatttacgctacttggtttgctcttggaggcctagcagcagctggtgaaacttacaacgattgtttagctatgcgcaatggtgtccactttttgctcacgacacaaagagatgatggaggttggggtgaaagctatttatcatgctccgaacagagatatataccatcagaaggagaaagatcaaaccttgtgcaaacatcatgggctatgatggctctaattcatacgggacaggctgagagagatttgactcctcttcatcgtgctgccaaacttatcatcaattcacaacttgaaaacggcgattttcctcaacaggaaatagtaggagcgttcatgaatacatgcatgctacactatgctacatacagaaacaccttcccattatgggcactcgcagaataccgaaaagttgtgtttatcgttaattaa

SEQ ID NO: 4306 - protein, 757 aa, Arabidopsis thaliana
MWKLKIGKGNGEDPHLFSSNNFVGRQTWKFDHKAGSPEERAAVEEARRGFLDNRFRVKGCSDLLWRMQFLREKKFEQGIPQLKATNIEEITYETTTNALRRGVRYFTALQASDGHWPGEITGPLFFLPPLIFCLYITGHLEEVFDAEHRKEMLRHIYCHQNEDGGWGLHIESKSVMFCTVLNYICLRMLGENPEQDACKRARQWILDRGGVIFIPSWGKFWLSILGVYDWSGTNPTPPELLMLPSFLPIHPGKILCYSRMVSIPMSYLYGKRFVGPITPLILLLREELYLEPYEEINWKKSRRLYAKEDMYYAHPLVQDLLSDTLQNFVEPLLTRWPLNKLVREKALQLTMKHIHYEDENSHYITIGCVEKVLCMLACWVENPNGDYFKKHLARIPDYMWVAEDGMKMQSFGCQLWDTGFAIQALLASNLPDETDDALKRGHNYIKASQVRENPSGDFRSMYRHISKGAWTFSDRDHGWQVSDCTAEALKCCLLLSMMSADIGGQKIDDEQLYDSVNLLLSLQSGNGGVNAWEPSRAYKWLELLNPTEFMANTMVEREFVECTSSVIQALDLFRKLYPDHRKKEINRSIEKAVQFIQDNQTPDGSWYGNWGVCFIYATWFALGGLAAAGETYNDCLAMRNGVHFLLTTQRDDGGWGESYLSCSEQRYIPSEGERSNLVQTSWAMMALIHTGQAERDLTPLHRAAKLIINSQLENGDFPQQEIVGAFMNTCMLHYATYRNTFPLWALAEYRKVVFIVN

SEQ ID NO: 4307 - DNA, 2472 bp, Ostreococcus tauri
  CDS (1)..(2472)
atgcgtacggatgtccgagaatggaatatatccacgcgcgcgccccgcggatcggtcgttctcgacacagatagccttcgggggggtggtatatggacggcgtcgaccggtcgcgtcgaccggcgcggccgacgccgcgcgacgcgtcgacgcgcgacgccggcgatgtgggtcctgcgatgcgcccagggcgaggacggggccgagggcggggacgtgtggacgctgaacgcgcacgcggggcgacagacgtggacgtacgtcgaggatgattcgacggacgctcgagcggtgcgcgcgtttcaagacgacgcgcgggcggcgtacgcgtcgacgcgggcgacggtgcggcactcgggggatgtgttcatgcgagcgcagtacgacgggcgacggaagacacggggggtggagacgtggagggacgtcggggcgagccgggcgctcgacgcgagcgacgccgaggtggacgcggacgtcgtgcgagaggcgatgcgggcgggtatcgagtactatcgggggatacaggacgacgatggacactgggcgagcgattacggggggccgatgtttctcatgcccggattgatcatcgcggcgcacgtcatggggaagacagaggagatcttgggggaacgcaggcgcgcggagatgttgcggtacctggagaatcacctgaacgaggacggtggagtcggattgcacatcgaaggacatagcacgatgtttggcacggtgctgacgtacgtggcgatgcggttgctcggtaaggaggcggacgcgccggagtgcgtcgaggcgcgggagtggatcgtgtcgcgcggcggagcgacgcaagtgccgtcgtgggggaagttttggctcgcagttctcggagtatacgagtggcatggactcaatcctgtgccgccggagtgttggttactcccgtattggcttccgcttcacccgggtcgatactggtgtcactgccgaatggtgtacctcccgatgagttacctgtacggcatccgcgccacgggcaagccgagcgcgttaacggaggcgttgaagaaggaactctacgccgagacgtcgtacgacgcgatcgactggaatagagcgcgaaacgcgtgcgctaaggaggacttgtattatccgcatccgtggatccaggacgttctctgggcgtccatcatgaagttggaaccgttcctgatgaacagtcgattgcgaaaggcggcgtgcgccgacgcgatgcggcagattcattatgaggatgagaacacgcgctatatcgatattggacccgtgaacaaggtattcaacatgctttgctgttggtttgaagatccgaactccgaggcggtgaagaagcacattcctcgcgtcgccgactacctctgggtcgccgaggacgggatgaagatgcaaggatacaatggcagtcagttgtgggactgtgcgttctccgtccaggccatcgtcgcaactggactcgccgatgaatacagcgattgcttgcgcctcgcgcacgactacatcgacaagagtcaagtgcgagacgactgtccagacgtgaagaagtggtatcgtcatatctccaagggtgcatggccgtttagcacgcgtgaccacggatggccgatctcggactgctcgtccgagggtttgaaggcggcacttacgctggcagcgatggatgagaagaagtttggcaaggcgatcccggtggagaggcttgcggactgcgttaacgtcatcttgtcctatcaaaatcgcggcagtggtggatgggcgacgtacgagaacacacgttcttacaagtgggtcgaatggttgaatccggcggagactttcggagacatcatgatcgattacccgtacgtagagtgctcgagtgcgagtctccaggcgctgtgcaaattctctgagcgatacccacacattcgtacgaaggacatcgcgcacgcgaaggcgaccggacgaaaattcttgaagcgcatacagcgcgcggacggcagctggtacgggtcgtgggcggtgtgtttcacctacggcacgtggttcggcgtcctcggcttgatcgccactggatcgacgtacaagacgtgtccggcacttcgcaaagcggtggactttttgctctcgaagcaacaagagagcggcggatggggcgagagttacttgtcgtgcgagaagaaaagctaccatgagcttctcgacgccgagggtaagcccaagccacatcttgtgaacacaagctgggccatgctagcgctcatcgcaagcggtcaagcatcgcgcgacgccaggccgttacaccgcgccgcgcgctcgattctgcgtcaacaatgtgagaatggtgattttccgcaacagagtatcatgggcgtgttcaacgccaactgcatgatctcctacagctgctaccgtagcattttcccgctctgggctttgggcgagtatacatcgaaagttgccgatgcatga

SEQ ID NO: 4308 - protein, 823 aa, Ostreococcus tauri
MRTDVREWNISTRAPRGSVVLDTDSLRGGGIWTASTGRVDRRGRRRATRRRATPAMWVLRCAQGEDGAEGGDVWTLNAHAGRQTWTYVEDDSTDARAVRAFQDDARAAYASTRATVRHSGDVFMRAQYDGRRKTRGVETWRDVGASRALDASDAEVDADVVREAMRAGIEYYRGIQDDDGHWASDYGGPMFLMPGLIIAAHVMGKTEEILGERRRAEMLRYLENHLNEDGGVGLHIEGHSTMFGTVLTYVAMRLLGKEADAPECVEAREWIVSRGGATQVPSWGKFWLAVLGVYEWHGLNPVPPECWLLPYWLPLHPGRYWCHCRMVYLPMSYLYGIRATGKPSALTEALKKELYAETSYDAIDWNRARNACAKEDLYYPHPWIQDVLWASIMKLEPFLMNSRLRKAACADAMRQIHYEDENTRYIDIGPVNKVFNMLCCWFEDPNSEAVKKHIPRVADYLWVAEDGMKMQGYNGSQLWDCAFSVQAIVATGLADEYSDCLRLAHDYIDKSQVRDDCPDVKKWYRHISKGAWPFSTRDHGWPISDCSSEGLKAALTLAAMDEKKFGKAIPVERLADCVNVILSYQNRGSGGWATYENTRSYKWVEWLNPAETFGDIMIDYPYVECSSASLQALCKFSERYPHIRTKDIAHAKATGRKFLKRIQRADGSWYGSWAVCFTYGTWFGVLGLIATGSTYKTCPALRKAVDFLLSKQQESGGWGESYLSCEKKSYHELLDAEGKPKPHLVNTSWAMLALIASGQASRDARPLHRAARSILRQQCENGDFPQQSIMGVFNANCMISYSCYRSIFPLWALGEYTSKVADA

SEQ ID NO: 4309 - DNA, 2286 bp, Kandelia candel
  CDS (1)..(2286)
atgtggaggcttaagattgcagagggcggcgacaacccttacatatacagcacaaacaatttcctgggaaggcaaacatgggagtttgaacctgaagctgggacccccgaagagcgagcacaggttgaagaggctcgccaaaatttctggagggaccgcttccgcatcaagccctgctccgacctcctctggcgattccagtttctgagagagaagaagtttaagcaaataattccacaagggaaggttcaggatggtgaggaaatcacacgggatattgccacaaccgcattgaggaggagcgtccatttgctttctgccttgcaggccagcgatggccattggtgcgcagaaaattctggccccatgttctatgttcctcccatggtttttgctctctatatcacaggtcatcttactactgtattctctgcggagcactgcaaagagattctgagatatatatattgccatcagaatgaggatggtgggtggggattacacatagagggtcacagcaccatgttctgcacagttctgaattacatttgtatgcgtatacttggcgaaggacgcgatggtgggaaagacaatgcttgcgaaagagcgcgaaagtggattcttgatcacggcagtgcaactgcaatcagctcctggggaaaaacatggcttgcgatacttggtgtgtatgaatgggatggttgcaatccaatgcctccagaattttgggtcttccccacttttttcccaatccatcccgcaaaaatgttatgctattgtcggctcacttacatagctatgtcatacttatatggaaagaaatttgtcggtccaatcacacctttaattttacaactgagggaggaaatctacaatgaaccatacgatgaaatcaattggagcagaatgcgccatttgtgtgcaaaagaagataaccactatccccacactctaacacaaatcattctgtgggatgcaatttacttgttgagcgaacctcttctcaagcggtggccatggagcaaattgagaaaaaaggctctaaaaataactatagatcacattcattacgaagatgaaaacagccgatatattaccatcggatgtgtcgaaaagcccttaaacatgcttgcttgctggcatgaagatcccaatggtgatgcttttaagaagcaccttgccagaatatcagattatgtttggcttgccgaagatggaatgaagattcagagttttggcagccaagcgtgggatacaagttttgttctccaagctttgattgctagcaatcttctcagcgaaacagcacctacacttgagaaagggcacaatttcattaaggactctcaggtcaccgagaacccttccggtgacttcagaagaatgtttcgtcatatctcgaaagggtcatggacattctctgacaaagatcatggatggcaagtttctgattgcactgcggaaagcctgaagtgttgtcttcttttctcgatgatgccccctgaacttgttggtaggaagatggaacctcagcgggtgtacgatgccgttaatgtcataatttctcttcagagtaaaaatggtggctgttcagcctgggagcaagcaggagctggctcgtggatggagtggcttaatcctgtggagtttctagaggaccttgtaattgaacatgagtacattgagtgcacttcatcatcggtgcaggcattagttctattcaagaagttgtatcctgagcacaggaggaaagagattgaaaattttatagtaaatgctgtgaggttcattgaagaaattcaaaagcccgatggatcatggtatggaaattggggaatatgcttcttgtttggaacatggtttggacttaaagggctggctactgctggcaagacttactacaattgcactgctgtgcgtaaaggagtcgaattcctactccgaacgcaacgagaggacagtggatggggagagagttacctttcatgcccaaagaaggtctacgtacctcttgagggaaaccaatcaaatttgatacatactgcactggccatgatgggcttaattcttagtggtcaggctgagagagaccctacacctcttcatagagccttaaaattgttgatcaattctcaaacagaacttggtgattttcctcagcaggaaatatcaggttgtttcatgaggaattgcatgttgcactattcagcttacagggatatctttccaatgtgggctctggcagaatactgcaagctttttccattgccttccaaaaatgattga

SEQ ID NO: 4310 - protein, 761 aa, Kandelia candel
MWRLKIAEGGDNPYIYSTNNFLGRQTWEFEPEAGTPEERAQVEEARQNFWRDRFRIKPCSDLLWRFQFLREKKFKQIIPQGKVQDGEEITRDIATTALRRSVHLLSALQASDGHWCAENSGPMFYVPPMVFALYITGHLTTVFSAEHCKEILRYIYCHQNEDGGWGLHIEGHSTMFCTVLNYICMRILGEGRDGGKDNACERARKWILDHGSATAISSWGKTWLAILGVYEWDGCNPMPPEFWVFPTFFPIHPAKMLCYCRLTYIAMSYLYGKKFVGPITPLILQLREEIYNEPYDEINWSRMRHLCAKEDNHYPHTLTQIILWDAIYLLSEPLLKRWPWSKLRKKALKITIDHIHYEDENSRYITIGCVEKPLNMLACWHEDPNGDAFKKHLARISDYVWLAEDGMKIQSFGSQAWDTSFVLQALIASNLLSETAPTLEKGHNFIKDSQVTENPSGDFRRMFRHISKGSWTFSDKDHGWQVSDCTAESLKCCLLFSMMPPELVGRKMEPQRVYDAVNVIISLQSKNGGCSAWEQAGAGSWMEWLNPVEFLEDLVIEHEYIECTSSSVQALVLFKKLYPEHRRKEIENFIVNAVRFIEEIQKPDGSWYGNWGICFLFGTWFGLKGLATAGKTYYNCTAVRKGVEFLLRTQREDSGWGESYLSCPKKVYVPLEGNQSNLIHTALAMMGLILSGQAERDPTPLHRALKLLINSQTELGDFPQQEISGCFMRNCMLHYSAYRDIFPMWALAEYCKLFPLPSKND

SEQ ID NO: 4311 - DNA, 2310 bp, Panax ginseng
  CDS (1)..(2310)
atgtggaagcagaagggtgcccaaggaaatgatccatatttgtatagcactaacaactttgttggcagacaatattgggagtttcagcccgatgctggtactccagaagagagggaagaggttgaaaaagcacgcaaggattatgtaaacaataagaagctacatggaattcatccatgcagtgatatgctgatgcgcaggcagcttattaaagaaagtggaatcgatctcctaagcataccgccgttgagattagatgaaaacgaacaagtgaactacgatgcagttacaaccgctgtgaagaaagctcttcgattgaaccgggcaattcaagcacacgatggtcactggccagctgaaaatgcaggctctttactttatacacctccccttatcattgccctatatatcagcggaacgattgacactattctgacaaaacaacacaagaaggaactgattcgcttcgtttacaaccatcaaaatgaggatggtggatggggatcctatattgaggggcacagcacgatgattgggtcagtacttagctacgtgatgttacgtttgctaggagaaggattagctgaatctgatgatggaaatggtgcagttgagagaggccggaagtggatacttgatcatggaggtgcagccggcataccctcttggggaaagacttatctagcggtgcttggagtatatgagtgggaagggtgcaacccgctgcccccagaattctggcttttcccttcaagttttccttttcatccagcaaaaatgtggatctactgccggtgcacttacatgccaatgtcgtatttgtatgggaagagatatcatggaccaataaccgatcttgttttatctttgaggcaagaaatttacaacattccttatgagcagataaagtggaatcaacagcgccataactgttgcaaggaggatctctactaccctcatacccttgtacaagacctggtttgggatggtcttcactactttagtgaaccattcctcaaacgttggcccttcaacaaactgcgaaaaagaggtctaaaaagagttgttgaactaatgcgctatggtgccaccgagaccagattcataaccacaggaaatggggaaaaagctttacaaataatgagttggtgggcagaagatcccaatggtgatgagtttaaacatcaccttgctagaattcctgatttcttatggattgctgaggatggaatgacagtacagagttttggtagtcaactatgggactgtattcttgctactcaagcaattatcgccaccaatatggttgaagaatacggagattctcttaagaaggcgcatttcttcatcaaagaatcgcagataaaagaaaatccaagaggagacttcctaaaaatgtgtcgacagtttaccaaaggtgcgtggactttctctgatcaagatcatggttgcgttgtctcggactgcacagctgaagcgctaaagtgcctactgttactttcacaaatgccacaggatattgtcggagaaaaacctgaggttgagcgattatatgaggctgtgaatgttcttctctatttgcagagtcgtgtaagtggtggtttcgcagtttgggagcctccagttccaaaaccatatttggagatgttgaatccttcagaaatttttgcagacattgttgttgagagagagcacattgaatgcactgcatctgtaatcaaaggtctgatggcatttaaatgcttgcatcctgggcatcgtcagaaagagatagaggattctgtggcgaaagccatccgttatcttgaaagaaaccaaatgcctgatggttcatggtatggcttttggggaatttgtttcctctatgggacattttttaccctatctgggtttgcttctgctgggaggacttatgacaacagtgaagcagttcgtaagggtgttaaatttttcctttcaacacaaaatgaagaaggtggttggggggagagtcttgaatcatgcccaagcgaaaaatttacaccactcaagggaaacagaacaaatctagtacaaacatcatgggctatgctaggtcttatgtttggtggacaggccgagagagatccgacacctctgcatagagcagcaaagttgttgatcaatgcgcaaatggataatggagatttccctcaacaggaaattactggagtatactgtaaaaatagtatgttacattatgcggagtacagaaatatatttcctctttgggcactcggagaatatcggaaacgtgtttggttgcctaagcaccagcagctcaaaatttaa

SEQ ID NO: 4312 - protein, 769 aa, Panax ginseng
MWKQKGAQGNDPYLYSTNNFVGRQYWEFQPDAGTPEEREEVEKARKDYVNNKKLHGIHPCSDMLMRRQLIKESGIDLLSIPPLRLDENEQVNYDAVTTAVKKALRLNRAIQAHDGHWPAENAGSLLYTPPLIIALYISGTIDTILTKQHKKELIRFVYNHQNEDGGWGSYIEGHSTMIGSVLSYVMLRLLGEGLAESDDGNGAVERGRKWILDHGGAAGIPSWGKTYLAVLGVYEWEGCNPLPPEFWLFPSSFPFHPAKMWIYCRCTYMPMSYLYGKRYHGPITDLVLSLRQEIYNIPYEQIKWNQQRHNCCKEDLYYPHTLVQDLVWDGLHYFSEPFLKRWPFNKLRKRGLKRVVELMRYGATETRFITTGNGEKALQIMSWWAEDPNGDEFKHHLARIPDFLWIAEDGMTVQSFGSQLWDCILATQAIIATNMVEEYGDSLKKAHFFIKESQIKENPRGDFLKMCRQFTKGAWTFSDQDHGCVVSDCTAEALKCLLLLSQMPQDIVGEKPEVERLYEAVNVLLYLQSRVSGGFAVWEPPVPKPYLEMLNPSEIFADIVVEREHIECTASVIKGLMAFKCLHPGHRQKEIEDSVAKAIRYLERNQMPDGSWYGFWGICFLYGTFFTLSGFASAGRTYDNSEAVRKGVKFFLSTQNEEGGWGESLESCPSEKFTPLKGNRTNLVQTSWAMLGLMFGGQAERDPTPLHRAAKLLINAQMDNGDFPQQEITGVYCKNSMLHYAEYRNIFPLWALGEYRKRVWLPKHQQLKI

SEQ ID NO: 4313 - DNA, 2301 bp, Arabidopsis thaliana
  CDS (1)..(2301)
  misc_feature (642)..(642): k is g or t
atgtggagactaagaattggagctaaggccggaaatgatactcacttgttcacgaccaacaactatgttgggaggcagatttgggagtttgatgccaacgcaggctcccctcaagaacttgccgaggtcgaggaggctcgtcggaatttctctaacaataggtcacattacaaggccagtgctgatctcttatggaggatgcagtttcttagggaaaaaggttttgaacagaagattccacgtgtgagagtagaggatgcagcgaaaataaggtatgaagatgcaaaaaccgcattgaaaagaggattacattattttacggccttgcaggcagatgatggacactggcctgcagataactctggtccaaatttcttcatcgctcctttagttatatgcttgtacattactggacatctggagaaaatctttacagtcgagcatcgtatagagttaatacgttacatgtataaccatcagaacgaagatggtgggtggggattatatgtagaaagccctagtattatgttttgtacagtcatcaactacatttgtttacgaatcgtgggagtagaagccggtcatgatgatgatcaaggaagtacttgtacaaaggctcgtaagtggatactcgaccacggkggtgctacctacacacccttgatcggaaaagcttgcctatcagttcttggagtgtatgattggtctggctgcaaacctatgccgccagagttctggttccttccttcttcttttcctattaatggaggaactctatggatttatttacgggatattttcatggggttgtcatacttgtatggtaaaaaatttgttgcaactccaacacctctcatcctccagctccaagaagagctttatccagagccttacaccaaaatcaattggaggcttaccagaaaccgatgtgcaaaggaagatctctgttatccatcctcatttttacaagatttgttttggaaaggtgttcatatcttctcagagagtattctaaatcgatggcctttcaacaagctcataagacaagcagctcttcgaaccactatgaaactccttcactatcaagatgaagccaatagatacattacaggcggatcagtgccaaaggcctttcatatgcttgcatgttgggtagaagacccagagggtgaatattttaaaaagcatcttgctcgagtctctgatttcatatggattggcgaggatggcctcaaaattcagtcttttggcagccaattgtgggatacagtcatgtcgctacatttcctgttagacggtgttgaggatgatgtcgatgatgaaattagatccacgctcgttaaaggatacgattacttgaagaaatctcaagttacagagaatcctcctagtgatcacataaaaatgttccgccatatttcgaaaggtggatggacgttttcggacaaagatcaaggatggcctgtttcagactgcactgctgagggtttaaaatgctgtctattatttgagaggatgccgtcggagtttgttggccagaaaatggatgtggagaaactctttgatgccgttgattttcttctctacttgcagagtgataacggaggtataacagcttgggaacccgcggatgggaaaacctggttagagtggtttagtccggtggaatttgttcaagacacggtcatcgagcatgagtatgtggaatgtacagggtcagccattgtagcgttgactcagtttagtaaacaattcccggagtttagaaagaaagaggttgaaaggtttataactaacggagtgaaatacattgaggatttgcaaatgaaggatggttcatggtgcggaaactggggagtgtgctttatctatgggaccttatttgccgtaagaggtcttgtggctgcaggaaagactttccataactgtgaacccattcgtcgagcagttcgtttccttctcgacacgcaaaaccaggagggtggttggggagagagctatctctcttgcctaaggaagaaatatactcctttagcaggaaacaagacaaatatagtgagtacaggacaagcgcttatggttctaattatgggtggtcagatggagagagatcctttgccggttcatcgtgctgccaaagtagtgatcaatttacagttggataacggtgatttcccgcaacaggaagtaatgggagtattcaatatgaatgtgctgctccattatccaacatataggaacatttattctctttgggccctcacactatacacgcaagctctacggcggcttcagccttga

SEQ ID NO: 4314 - protein, 766 aa, Arabidopsis thaliana
MWRLRIGAKAGNDTHLFTTNNYVGRQIWEFDANAGSPQELAEVEEARRNFSNNRSHYKASADLLWRMQFLREKGFEQKIPRVRVEDAAKIRYEDAKTALKRGLHYFTALQADDGHWPADNSGPNFFIAPLVICLYITGHLEKIFTVEHRIELIRYMYNHQNEDGGWGLYVESPSIMFCTVINYICLRIVGVEAGHDDDQGSTCTKARKWILDHGGATYTPLIGKACLSVLGVYDWSGCKPMPPEFWFLPSSFPINGGTLWIYLRDIFMGLSYLYGKKFVATPTPLILQLQEELYPEPYTKINWRLTRNRCAKEDLCYPSSFLQDLFWKGVHIFSESILNRWPFNKLIRQAALRTTMKLLHYQDEANRYITGGSVPKAFHMLACWVEDPEGEYFKKHLARVSDFIWIGEDGLKIQSFGSQLWDTVMSLHFLLDGVEDDVDDEIRSTLVKGYDYLKKSQVTENPPSDHIKMFRHISKGGWTFSDKDQGWPVSDCTAEGLKCCLLFERMPSEFVGQKMDVEKLFDAVDFLLYLQSDNGGITAWEPADGKTWLEWFSPVEFVQDTVIEHEYVECTGSAIVALTQFSKQFPEFRKKEVERFITNGVKYIEDLQMKDGSWCGNWGVCFIYGTLFAVRGLVAAGKTFHNCEPIRRAVRFLLDTQNQEGGWGESYLSCLRKKYTPLAGNKTNIVSTGQALMVLIMGGQMERDPLPVHRAAKVVINLQLDNGDFPQQEVMGVFNMNVLLHYPTYRNIYSLWALTLYTQALRRLQP

SEQ ID NO: 4315 - DNA, 2301 bp, Arabidopsis thaliana
  CDS (1)..(2301)
atgtggaggctgagaactggaccgaaggctggagaggatactcgcctgttcaccaccaacaactatgcagggaggcagatttgggaatttgatgccaacgcaggctctccacaagaaattgccgaggtagaggatgctcggcacaaattctcagacaacacgtcacgtttcaagactactgccgatctcttatggcgcatgcagtttcttagggagaagaaattcgaacagaagattccacgagtgataatcgaggatgcaagaaagataaagtacgaagatgcaaagacagcattgaaaagagggttactctatttcacagccttgcaggctgatgatggacactggccagctgaaaactctggcccaaatttctatacccctccttttttgatatgcttgtacatcactggacatctggagaaaatcttcactcccgagcatgttaaagagttactacgtcacatctacaacatgcagaacgaagatggtgggtggggtttacacgtagaaagccacagtgttatgttctgtacagtcattaattacgtctgtctacgaattgtgggagaagaagtcggtcatgatgatcaaagaaatggttgtgcaaaggctcataagtggatcatggaccatggtggtgctacctacacgcccttgatcggaaaagcgttgctttcggttcttggagtgtatgattggtctggctgcaatcctatacctccagagttctggttgcttccgtcttcttttcctgttaatggagggactctctggatttatttacgggatactttcatggggttgtcatacttgtatggtaaaaaatttgtggctcccccaacacctctcattctccagctccgagaagagctttatccggagccttatgcaaaaatcaattggacgcaaacacgaaaccgatgtggaaaggaagatctctactatccacgctcatttttacaagatttgttttggaagagtgttcacatgttctcagagagtatcctagatcgatggcctttaaacaagctaataagacaaagagctcttcaatccactatggcactcattcactatcatgacgaatccaccagatatattacaggcggatgcctgccaaaggcctttcatatgcttgcatgttggatagaagaccctaagagtgattattttaaaaaacatcttgctcgagttcgcgaatacatatggattggcgaggatggcctgaaaattcaatcttttggtagccaattatgggatacagccttatcgctacatgcattactagacggaattgatgatcatgatgttgatgatgagattaaaacaacgctcgttaaaggatatgattacttgaagaaatcacaaattacagagaaccctcgcggtgatcacttcaaaatgtttcgtcacaagacaaaaggtggatggacattttcagatcaagatcaaggatggcctgtttcagattgtactgctgaaagcttagagtgttgtctattcttcgagagcatgccgtccgagcttattggaaaaaaaatggatgtggagaaactctatgatgccgttgattatcttctctatctgcagagtgataatggaggcatagcagcatggcaaccagttgaaggaaaagcctggttagagtggcttagtccagtggagttccttgaagacacaatcgtggagtatgagtatgtagaatgtacggggtcagcgattgcagcattgactcagtttaacaaacagtttccagggtataaaaacgtagaggttaaacggtttataacaaaggctgcaaagtacattgaagacatgcaaacggtggatggttcatggtacggaaattggggagtgtgttttatatacgggaccttctttgcggtaagaggtcttgtggccgctgggaagacttacagtaactgtgaagcaattcgtaaagcagttcgttttcttctagacacacaaaatccggagggtggctggggagagagctttctctcttgtccaagcaagaaatatactcctttgaaaggaaacagcacaaatgtggtgcaaacagcacaagcacttatggtgctaattatgggtgatcagatggagagagatcctttaccggttcatcgtgctgctcaagtgttgatcaattcacagttggataatggcgattttccacagcaggaaataatgggaacgttcatgagaactgtgatgctccattttccgacctataggaacacgttctctctttgggctctcgcacattacacacatgctctgcgacgtctcctcccttaa

SEQ ID NO: 4316 - protein, 766 aa, Arabidopsis thaliana
MWRLRTGPKAGEDTRLFTTNNYAGRQIWEFDANAGSPQEIAEVEDARHKFSDNTSRFKTTADLLWRMQFLREKKFEQKIPRVIIEDARKIKYEDAKTALKRGLLYFTALQADDGHWPAENSGPNFYTPPFLICLYITGHLEKIFTPEHVKELLRHIYNMQNEDGGWGLHVESHSVMFCTVINYVCLRIVGEEVGHDDQRNGCAKAHKWIMDHGGATYTPLIGKALLSVLGVYDWSGCNPIPPEFWLLPSSFPVNGGTLWIYLRDTFMGLSYLYGKKFVAPPTPLILQLREELYPEPYAKINWTQTRNRCGKEDLYYPRSFLQDLFWKSVHMFSESILDRWPLNKLIRQRALQSTMALIHYHDESTRYITGGCLPKAFHMLACWIEDPKSDYFKKHLARVREYIWIGEDGLKIQSFGSQLWDTALSLHALLDGIDDHDVDDEIKTTLVKGYDYLKKSQITENPRGDHFKMFRHKTKGGWTFSDQDQGWPVSDCTAESLECCLFFESMPSELIGKKMDVEKLYDAVDYLLYLQSDNGGIAAWQPVEGKAWLEWLSPVEFLEDTIVEYEYVECTGSAIAALTQFNKQFPGYKNVEVKRFITKAAKYIEDMQTVDGSWYGNWGVCFIYGTFFAVRGLVAAGKTYSNCEAIRKAVRFLLDTQNPEGGWGESFLSCPSKKYTPLKGNSTNVVQTAQALMVLIMGDQMERDPLPVHRAAQVLINSQLDNGDFPQQEIMGTFMRTVMLHFPTYRNTFSLWALAHYTHALRRLLP

SEQ ID NO: 4317 - DNA, 2304 bp, Lotus japonicus
  CDS (1)..(2304)
atgtggaagctaaggatttcagagagcaaagaggatgagttgattagaagtgtgaataaccatgttggaagacagttctgggagtttgatcctgatcttggaactgaacaagaacgagctcaagtggaacaagctcgcaaagaatttaaccaaaaccgcttcaaaactaagaatagttctgatctcttaatgagactccagtttgagagggaaaatggagtaaacatgaaggttaagaatgtgaacattcaaaaggaggaagatataactgaggaagttgtggaagacacactgaaaagagccttgagatgttactcaaccctgcaggctcaggatggtttctggcctggtgactatgctggcgctatgtttatgctccccggattggtgattggattatcggtgactggggccctcaatgcagccttgtcacctgagcatcaaagcgagatgaagcggtatgtgttaaaccaccaaaatgaagatggcgggtggggattgcacatagaaggccccaccacaatgtttgggacggtcctcaactatgttgccatgagattacttggagaagacattgacggtggagatggcgccatgaagaaagcaaggaagtggattcttgaccgtggaggcgcaacttctattccctcatggggcaaattctggctttcagtgcttggcgtatatgaatggcgagggatcaacccaatgcctccagagctttggctgctcccatactctcttccttcgcatccaggaaggatgtggtgtcacacacggcttgtatatctttcgatgtcatatttatatggtagacgatttgtgggtcctttcaatgcacttgtgttatccctaagaaaggagctctatactcttccctatcatctcctcgattggaatgaggctagaaatctatgtgccaaggaagatttgagtcatccacgcccaggaatccaaaacattttatggggtttgcttcaccatgttggggaacctcttctcacacacaagctcttctccaggctaaggcagaaagcgctccatcatgtaatggaacatatacacaacgaggatgaagcatcaaactacatttgcattggccccgttaataaggtattaaacatgatatgttgctggttggaggaccccaattcccaggcatttaagtatcacatttcaagaatcaaagactatctctgggtggctgaggatggaatgaaaatgcagggatatggcggttctcaactttgggatgttgctttttctgttcaagctatcttggctaccaaccttgatgatgagtatggttcaatgcttaaaagagcaaatgagttcattaaatgctcacagattacaacaaacagctctagtaaccctagtgcctggtatcgccacatttcgaaaggtagttggggtttctcaactccagacaatggttggcctgtatcagattgcactgcagaaggcttgaaggcagccattttgctatcaaactttccatctgaaactgttgggaaagctatggaaacagaaaaattatatgatgctgttagttgggttttatctatgcagaatgaaaacggtggatttgcatcctatgagctcacaagatcttatgcatggctagagaaaataaacccagttgaaacatttagagatatcatgattgattatcagtatgtagaatgcacatcagcagcaattcaaggtcttgccttattcacacaacgatatccagagtacaggagaagggaaatagactcttgtatcgctaaggcggcacgctatatcgaaagcacacaattagctgatggctcatggtatggatcatggggaatctgttatacatatgcaacatggtttggaataaaggggctcatagctgcaagtaagagctaccaagaaagcaaaagcattagaagagcatgtgaatttttgctttccaaacagctactttcaggtggctggggagagagttatctttcatgcgagctcaaggtatatacaaatctagaaggaaataagtctcatctagtgaacacagcttgggctatgctagcgcttattgaaggaggccaggcagaaagagacccaaccccattgcatcgtgcggccaaggtgttgatcaattcacaaatggaaaatggggagtttccccaacaggaaatcatgggagtttataaccagactggtgttgtcaactactctgcatacagaaacattttcccaatatgggcccttggagaataccgaaatcgtgtattgctttgtccaggaaaagtgtcaaaaaataaaagcaactag

SEQ ID NO: 4318 - protein, 767 aa, Lotus japonicus
MWKLRISESKEDELIRSVNNHVGRQFWEFDPDLGTEQERAQVEQARKEFNQNRFKTKNSSDLLMRLQFERENGVNMKVKNVNIQKEEDITEEVVEDTLKRALRCYSTLQAQDGFWPGDYAGAMFMLPGLVIGLSVTGALNAALSPEHQSEMKRYVLNHQNEDGGWGLHIEGPTTMFGTVLNYVAMRLLGEDIDGGDGAMKKARKWILDRGGATSIPSWGKFWLSVLGVYEWRGINPMPPELWLLPYSLPSHPGRMWCHTRLVYLSMSYLYGRRFVGPFNALVLSLRKELYTLPYHLLDWNEARNLCAKEDLSHPRPGIQNILWGLLHHVGEPLLTHKLFSRLRQKALHHVMEHIHNEDEASNYICIGPVNKVLNMICCWLEDPNSQAFKYHISRIKDYLWVAEDGMKMQGYGGSQLWDVAFSVQAILATNLDDEYGSMLKRANEFIKCSQITTNSSSNPSAWYRHISKGSWGFSTPDNGWPVSDCTAEGLKAAILLSNFPSETVGKAMETEKLYDAVSWVLSMQNENGGFASYELTRSYAWLEKINPVETFRDIMIDYQYVECTSAAIQGLALFTQRYPEYRRREIDSCIAKAARYIESTQLADGSWYGSWGICYTYATWFGIKGLIAASKSYQESKSIRRACEFLLSKQLLSGGWGESYLSCELKVYTNLEGNKSHLVNTAWAMLALIEGGQAERDPTPLHRAAKVLINSQMENGEFPQQEIMGVYNQTGVVNYSAYRNIFPIWALGEYRNRVLLCPGKVSKNKSN

SEQ ID NO: 4319 - DNA, 2286 bp, Lotus japonicus
  CDS (1)..(2286)
atgtggaagctgaaggtttcagagagcaaagaggaagagttggtaaaaagtgtgaataaccatgttggaagacaattttgggagttcgatcctaatcttggaactgaacaagagcgagctcaagtggaacaagctcgcaaagaatttaaccagaaccgtttccaaactaagcatagttccgatctcttaatgagattccagtttgagagggaaaatggaataaacatgaagattaagaaagtgaacattcaaaaggtggaagatataagtgaagaagttgtgagagctacgctgaaaagagccttgacatgttactcaaccttgcaaactcaggatggtttctggcctggtgactatggcggccctatgtttcttctacctggtttggtgattggattatcggtgactggaacccttaatacagtgttgtcgcctcagcatcaaagtgagatgaagcggtatgtgttgaatcaccagaacgaagatggagggtggggattgcacatagaaggccccaccacaatgtttggcactgttcttaactatgtaaccatgagattactcggagtaggcatcgaaggtggagatggcgccatgcacaaagcaagaagatggattcttagccgtggaggtgccacttctattccttcctggggaaaattttggctttctgtgctaggtgtatacgaatggagcgggatcaacccaatcaatccagaattatggttgcttccctacttttttcctttgcacccagggaggatgtggtgtcacactagacatgtgtatctaccaatgtcatatttatatagcagaagatttgtgggacctttcaatgcacttgtgttatccctgaggaaggagctctatacccttccttatcatctacttgattgggaccaagctagaaatctatgtgccaaggaagatttgtaccatccacgcccaggaatccaaaaagttttatggggttttcttcaccattttggggaacctcttcttacacactggccattctccaagctaaggaagaaaggtctcaatcatgtaatgcagcatattcactacgagaatcaaaattcaaactacacctgcattggtcccgttaataaggtattaaacctggtttgttgttggttggagaatcccaattctgaggcatttaagtgtcacatttcaagaatcaaagactatctctgggtggctgaggatgggatgaaaatgcagggatatgggggttctcaaatttgggatgttgccttttctgttcaagctatcttggctaccaatcttgttgatgaatatggttcaatgcttaggaaagcaaataatttcttgaagtgctcacaggttacaaagaatagctctggcaatcctagtcactggtatcgccacatttctaaaggcggttggactctctcaacagcagacaatggttgggttgtatcagattgcactgcagaaggcttgaaggtatcccttttgttatcaaacttgccatctgagactgttgggaaagcaatggaaacagaacaattatgtgatgctgttaacttgattttatccctgcagaatagaaatggtggatttgcatcctatgagctcacaagatcttatgcatggctagagaaaataaatccagttgaaacatttgaagagatcatgattgatttccagtatgtagaatgcacatcagcagcaattcaaggtcttgccttattcacagaacgttatccagagcacaggaggatagaaattgaaacttgtattgccaaggcggccaactatatcgaaagcatacaattagctgatggctcatggtatggatcatggggaatttgctacacatatggaacatggtttggaataaaggggctcatagctgccggtaagagctaccaagatagccacagcattagaagagcatgtgaatttttgctttccaaacaacaaatttctggtggctggggagagagctatatctcatgccaacaaaatgtatacacaaatctagagggaaataagtctcatctagtgaacacagcatgggctatgttggcacttattgaagcaggccaggcccaaagagatccagccccattgcatcgtgcagccaaggtgttgatcaattcacaaatggaaaatggggagtttcctcaacaggaaatcatgggaatcttcaacaagacttgtacaataagttactctgcatacaggaacatttttccaatatgggcccttggagtatatcgaagtcatgtattgatctgtggtggaaaagaataa

SEQ ID NO: 4320 - protein, 761 aa, Lotus japonicus
MWKLKVSESKEEELVKSVNNHVGRQFWEFDPNLGTEQERAQVEQARKEFNQNRFQTKHSSDLLMRFQFERENGINMKIKKVNIQKVEDISEEVVRATLKRALTCYSTLQTQDGFWPGDYGGPMFLLPGLVIGLSVTGTLNTVLSPQHQSEMKRYVLNHQNEDGGWGLHIEGPTTMFGTVLNYVTMRLLGVGIEGGDGAMHKARRWILSRGGATSIPSWGKFWLSVLGVYEWSGINPINPELWLLPYFFPLHPGRMWCHTRHVYLPMSYLYSRRFVGPFNALVLSLRKELYTLPYHLLDWDQARNLCAKEDLYHPRPGIQKVLWGFLHHFGEPLLTHWPFSKLRKKGLNHVMQHIHYENQNSNYTCIGPVNKVLNLVCCWLENPNSEAFKCHISRIKDYLWVAEDGMKMQGYGGSQIWDVAFSVQAILATNLVDEYGSMLRKANNFLKCSQVTKNSSGNPSHWYRHISKGGWTLSTADNGWVVSDCTAEGLKVSLLLSNLPSETVGKAMETEQLCDAVNLILSLQNRNGGFASYELTRSYAWLEKINPVETFEEIMIDFQYVECTSAAIQGLALFTERYPEHRRIEIETCIAKAANYIESIQLADGSWYGSWGICYTYGTWFGIKGLIAAGKSYQDSHSIRRACEFLLSKQQISGGWGESYISCQQNVYTNLEGNKSHLVNTAWAMLALIEAGQAQRDPAPLHRAAKVLINSQMENGEFPQQEIMGIFNKTCTISYSAYRNIFPIWALGVYRSHVLICGGKE

SEQ ID NO: 4321 - DNA, 2271 bp, Arabidopsis thaliana
  CDS (1)..(2271)
atgtggaggttaaagttatcggaaggagacgaagagagcgtgaatcaacatgttggaagacagttttgggaatatgataaccaatttggaacctctgaagagagacatcacattaaccatcttcgtagcaactttactctcaatcggttttcttctaagcatagttctgatcttctctaccgttttcagtgttggaaagagaaaggaaaaggaatggagagacttccacaagtgaaagtaaaagagggggaagaaagattgataaatgaagaagtggtgaatgttacattaagaagaagtttgagattctactcaatacttcaatcacaagatggtttttggcctggtgattatggtggccctttgtttctcttgcctgctctggtgatcggcttatatgtgacggaagttttggatggaactttaactgcgcaacatcaaatcgagattcgtcgttatctctataaccatcagaacaaggatggaggatggggactacacgtagaagggaatagcaccatgttttgtacagtgctctcatacgtagcactgagactaatgggggaagaattagacggtggagatggagccatggaatcagctagaagttggattcaccaccacggtggtgccacttttattccctcctggggcaagttctggctctccgttcttggagcttatgagtggagtgggaacaatcctttacctccagagctatggctccttccatatagtcttccttttcatccgggccgaatgtggtgccattgtaggatggtttatcttccaatgtcatatctatatggaagaagatttgtttgtcgtactaatggaactattttatcgcttcgacgagagctctacactattccttatcaccatatcgattgggacaccgcccgtaatcaatgtgccaaggaggacttgtactatccacatccaaagattcaagacgtcctttggagttgtctgaataaatttggagagcctcttcttgaaagatggccattgaataacctcagaaaccatgctcttcagacagtaatgcaacacattcactatgaagaccaaaacagccactatatttgtatcggtcctgtcaacaaagtcttgaatatgctttgttgttgggtcgagtcctcgaattccgaggcatttaaatctcacctctcgcggattaaagactatttgtgggtggctgaggatggaatgaaaatgcagggatacaacggatctcagctgtgggacgtgactttagcggtccaagcaatcttggcgacgaatttggttgatgactatggtttgatgcttaagaaagcccataactacatcaagaacactcaaataaggaaagacacaagtggagatccggggttgtggtaccgacacccgtgcaagggaggatggggtttctccactggagacaatccatggcctgtctctgattgtactgctgaagccttgaaggcggcgttgctattgtcacaaatgccggttaatttagttggagaacccatgcctgaagagcatttagttgatgctgtaaactttatcttatcattacagaacaagaatgggggatttgcgtcatatgagctaactagatcatatcccgagctagaggttatcaacccatcagagacttttggggatatcatcatagattatcaatacgtagaatgcacgtcagctgccatccaaggtctcgtgttattcacaacgttaaattcgagctacaagaggaaggagatagtaggaagcatcaacaaagcagttgagtttattgaaaaaacacaacttcctgatggttcatggtatggctcgtggggagtgtgtttcacctatgcaacatggtttggtattaaaggcatgttggcttcaggcaaaacatatgagagcagtctttgtattagaaaagcttgtggtttcttgctctccaaacaactttgttgtggtggatggggagagagctacctttcttgccaaaacaaagtatacaccaatcttcctgggaataaatcgcatattgtgaacacatcatgggcactcttggctctcattgaagcgggacaagctagtagagatccgatgccattgcatcgcggggcaaaatcgctgatcaactcgcagatggaagatggagattacccacaacaagagatactaggagtctttaatcggaattgtatgatcagttactcagcttatagaaacatattccccatttgggctcttggagaataccgcaaactcatgttgtctttatga

SEQ ID NO: 4322 - protein, 756 aa, Arabidopsis thaliana
MWRLKLSEGDEESVNQHVGRQFWEYDNQFGTSEERHHINHLRSNFTLNRFSSKHSSDLLYRFQCWKEKGKGMERLPQVKVKEGEERLINEEVVNVTLRRSLRFYSILQSQDGFWPGDYGGPLFLLPALVIGLYVTEVLDGTLTAQHQIEIRRYLYNHQNKDGGWGLHVEGNSTMFCTVLSYVALRLMGEELDGGDGAMESARSWIHHHGGATFIPSWGKFWLSVLGAYEWSGNNPLPPELWLLPYSLPFHPGRMWCHCRMVYLPMSYLYGRRFVCRTNGTILSLRRELYTIPYHHIDWDTARNQCAKEDLYYPHPKIQDVLWSCLNKFGEPLLERWPLNNLRNHALQTVMQHIHYEDQNSHYICIGPVNKVLNMLCCWVESSNSEAFKSHLSRIKDYLWVAEDGMKMQGYNGSQLWDVTLAVQAILATNLVDDYGLMLKKAHNYIKNTQIRKDTSGDPGLWYRHPCKGGWGFSTGDNPWPVSDCTAEALKAALLLSQMPVNLVGEPMPEEHLVDAVNFILSLQNKNGGFASYELTRSYPELEVINPSETFGDIIIDYQYVECTSAAIQGLVLFTTLNSSYKRKEIVGSINKAVEFIEKTQLPDGSWYGSWGVCFTYATWFGIKGMLASGKTYESSLCIRKACGFLLSKQLCCGGWGESYLSCQNKVYTNLPGNKSHIVNTSWALLALIEAGQASRDPMPLHRGAKSLINSQMEDGDYPQQEILGVFNRNCMISYSAYRNIFPIWALGEYRKLMLSL

SEQ ID NO: 4323 - DNA, 2256 bp, Medicago truncatula
  CDS (1)..(2256)
atgtggaggctgaagatagctgattgtagaaagggcccaaacatattcagccttaacaactttgtgggaggtagacatgggagtttgatcctgatgctggtactgaggagagagctcaaattacggctcattctgagagaaaataattttaaacaatcaatagcaagtgtaaagattgaagatggtgaagagatatcagaagaaaaagtgacgaccacgttaagaagagccgtacatcacatatcagcacttcaggctagtgatggtcattggccttctctaaatgctggccctctcttttattttcctcccttggtgttatgtatgtacgttacaggacatcttgattcgatgtttcccgaagagtatcgaaaagagattctccgttacatatattgtcatcagaatgaagatggaggatggggactacacgtagagggtcacagtatcatgttttgtaccgtacttaactacatatgcatgcgaatacttggagaaggtccaaatggaggtaaagaaaatgcttgtgctaaagcaagaaaatggattcatgatcatggtggtgtgacatacgtgtcttcatggggaaaaatctggctttcgatacttggtatctttgattggcgtgcaagcaacccaatgcctcctgagttttggatgcttccctcatttcttcttaagcatccagctagaatgttgtgttattgtcgattggtatacatgcctatgtcttacttgtatggaaagaggtttgtcggtccaatcacaccattgatcttaaagttgagagaagaactccttacagaaccttatgaaaaagttaattggcaaaaagtacgtcacctatgtgcaaaggaagatctttactatccccatcctttgatacaagatctattatgggatagtttatacatattcatggagccacttttgactcattggccattaaacaagctggttagagaaaaagctctccaagtagcaatgaaacatatccactatgaagatgagaatagtcgatacataaccattgggtgtgtggaaaaggttttgtgcatgcttgcttgttgggtggaagatccaaatggagatgcattcaagaagcatcttgcaaggctcccagactatttatggatttctgaagatggaatgaccctgcatagttttggtagccaaacatgggatgctagtttcatcattcaagctttgcttgccactaacctagttgaggatattggttcaacacttgcaaaaggacatgaatacatcaagaattctcaggttagggacaacccttcaggagattttgagagcatgtaccgtcatatctccaaagggtcatggacattctctgatcaagatcatggatggcaggtttctgattgcaccgcagaaggtttaaagtgttgtctgcttttatcaatgttgcctccagagattgtgggggaaaaaatggaacctgaaaggttatatgattcagtcaatatcttgttttctcttcaggcaagtactacatactactctctattgggaaaaatccaaggtaaaaagggtggtttaccagcttgggagccgtcaaaagctctagaatggttggaactactcaatccaatagaatttcttgaggaaaatgtagttgagcgtgaatatgttgaatgcacttcatcatcaattcaagctatggttttgtttaaaaaaatatatcccgagcatagaaaggaagaagtagagaatttcattgcaaaagcagttcaattccttgaagataaacaaacaagtgatggttcatggtatggaaattggggaatttgcttcacttatggttcttggtttgctcttggtggtctagcagtcgcgggcaagacttatgagaattgtgttgcaattcgcaaagctgttaaatttctgcttacaatacaaagagaggatggtgggtggggagagagccatctttcatgctcaaaaaagatatatgtacctcttgaaggaagccaatcaaatattgtacagacatcatgggctctaatagctttgattcatgctggccaggcggagagagacgctactcctcttcatcgtgctgtaaaattaatcatcaatctccaacaagaggagggtgattggccccaacaggaactcacagcagtattcatgaaaaactgcatgctgcattacgcaatgtttagagatatattcccaatgtgggctctagctgaatatcgtaaagggattatgttgccttccattgcagtttga

SEQ ID NO: 4324 - protein, 751 aa, Medicago truncatula
MWRLKIADCRKGPNIFSLNNFVGGRHGSLILMLVLRRELKLRLILRENNFKQSIASVKIEDGEEISEEKVTTTLRRAVHHISALQASDGHWPSLNAGPLFYFPPLVLCMYVTGHLDSMFPEEYRKEILRYIYCHQNEDGGWGLHVEGHSIMFCTVLNYICMRILGEGPNGGKENACAKARKWIHDHGGVTYVSSWGKIWLSILGIFDWRASNPMPPEFWMLPSFLLKHPARMLCYCRLVYMPMSYLYGKRFVGPITPLILKLREELLTEPYEKVNWQKVRHLCAKEDLYYPHPLIQDLLWDSLYIFMEPLLTHWPLNKLVREKALQVAMKHIHYEDENSRYITIGCVEKVLCMLACWVEDPNGDAFKKHLARLPDYLWISEDGMTLHSFGSQTWDASFIIQALLATNLVEDIGSTLAKGHEYIKNSQVRDNPSGDFESMYRHISKGSWTFSDQDHGWQVSDCTAEGLKCCLLLSMLPPEIVGEKMEPERLYDSVNILFSLQASTTYYSLLGKIQGKKGGLPAWEPSKALEWLELLNPIEFLEENVVEREYVECTSSSIQAMVLFKKIYPEHRKEEVENFIAKAVQFLEDKQTSDGSWYGNWGICFTYGSWFALGGLAVAGKTYENCVAIRKAVKFLLTIQREDGGWGESHLSCSKKIYVPLEGSQSNIVQTSWALIALIHAGQAERDATPLHRAVKLIINLQQEEGDWPQQELTAVFMKNCMLHYAMFRDIFPMWALAEYRKGIMLPSIAV

SEQ ID NO: 4325 - DNA, 2250 bp, Medicago truncatula
  CDS (1)..(2250)
atgtggaagctgaagattggagagggaaagaatgagccatacttattcagcacaaataattttgtgggaagacaaacatgggagtatgatccagaagcaggtagtgaagaagaaagagcacaagttgaagaagctcgtaagaatttctatgacaacagattcaaggtcaagccctgtggtgacctcctatggcgttttcaggttctaagagaaaataactttatgcaaacaatagatggagtgaagatagaagatggagaagagataacatatgagaaagcaacgacaacgttgagaaggggcacacaccatctagcagcattgcaaaccagtgatggccattggcctgctcaaattgcaggtcctctatttttcatgcctcccttggttttctgtgtctacattactggacatcttgattccgtcttcccacgagaacatcgcaaagagattcttcgttacatttactgtcaccaaaatgaagatggaggatgggggctacacattgagggtcacagcaccatgttttgtactgcacttaactatatatgtatgcgaattctcggagaaggacctgatggcggtcaagacaatgcttgtgctagagccagaaactggattcgggcacacggtggtgtcacatatataccttcatggggaaaaacttggctttcgatacttggtctctttgattggttgggaagcaacccaatgccccctgagttttggatccttccttcatttcttcctatgcatccagctaaaatgtggtgttattgtcgattggtatacatgcctatgtcttacttgtacgggaagagatttgtgggtccgatcacaccactcatcttacagttgagagaagaactccatactcagccttatgaaaaaattaactggacgaaatcacgtcacctatgtgcaaaggaagatatttactatccccatcctttgatacaagatctgatatgggatagcttatacatatttaccgagccgcttctcactcgctggcctttcaacaagctggtcagaaaaagagcccttgaagttacaatgaagcatatccactacgaggatgagaacagtcgatacctaaccattgggtgtgtggaaaaggtattatgtatgcttgcttgttgggtggaagatccaaatggagatgcttacaagaagcatcttgcaagggtccaagattacttgtggatgtcagaagatggaatgaccatgcagagttttggtagccaagaatgggatgctggttttgccgttcaagctttgcttgccgctaacctaaatgatgaaatcgaacctgcacttgccaaaggacatgatttcattaagaaatctcaggttacagagaacccttctggagattttaagagtatgcatcgtcatatttctaaaggctcatggaccttctccgatcaagaccatggatggcaagtttctgattgcaccgctgaaggtttgaagtgttgtctacttttatcaatgttgcctccagagattgtgggggaaaagatggaaccagaaagtaaaaagggtggtttggcagcatgggagcccgcaggagctcaagagtggttagaactactcaatcccactgagttttttgcggacattgttgttgagcatgaatatgttgagtgcactggatcagcaattcaagctttagttttgttcaagaagctatatccagggcataggaagaaagagatagagaatttcatctccgaggcagttcgattcattgaagatatacaaacagccgatggttcatggtatggaaactggggagtttgcttcacttatggttcttggtttgctcttggtggtttagcagctgctggcaagacttataccaattgcgctgctattcgcaaagctgttaaatttcttctcacaacacagagagaggatggtgggtggggggagagctatctttcaagcccaaaaaagatatatgtacctctcgaaggaagccgatccaatgttgtacatactgcatgggctcttatgggtttaattcatgccggccaggcagagagagaccctactcctctccatcgtgctgcaaaattgctcatcaattcccagttggaagaaggcgattggccccaacaggaaatcacaggagtattcatgaaaaattgtatgttgcattacccaatgtatagagatatttaccccttgtgggctctagccgagtatcgtagacgggttccattgccttccactgcagtttaa

SEQ ID NO: 4326 - protein, 749 aa, Medicago truncatula
MWKLKIGEGKNEPYLFSTNNFVGRQTWEYDPEAGSEEERAQVEEARKNFYDNRFKVKPCGDLLWRFQVLRENNFMQTIDGVKIEDGEEITYEKATTTLRRGTHHLAALQTSDGHWPAQIAGPLFFMPPLVFCVYITGHLDSVFPREHRKEILRYIYCHQNEDGGWGLHIEGHSTMFCTALNYICMRILGEGPDGGQDNACARARNWIRAHGGVTYIPSWGKTWLSILGLFDWLGSNPMPPEFWILPSFLPMHPAKMWCYCRLVYMPMSYLYGKRFVGPITPLILQLREELHTQPYEKINWTKSRHLCAKEDIYYPHPLIQDLIWDSLYIFTEPLLTRWPFNKLVRKRALEVTMKHIHYEDENSRYLTIGCVEKVLCMLACWVEDPNGDAYKKHLARVQDYLWMSEDGMTMQSFGSQEWDAGFAVQALLAANLNDEIEPALAKGHDFIKKSQVTENPSGDFKSMHRHISKGSWTFSDQDHGWQVSDCTAEGLKCCLLLSMLPPEIVGEKMEPESKKGGLAAWEPAGAQEWLELLNPTEFFADIVVEHEYVECTGSAIQALVLFKKLYPGHRKKEIENFISEAVRFIEDIQTADGSWYGNWGVCFTYGSWFALGGLAAAGKTYTNCAAIRKAVKFLLTTQREDGGWGESYLSSPKKIYVPLEGSRSNVVHTAWALMGLIHAGQAERDPTPLHRAAKLLINSQLEEGDWPQQEITGVFMKNCMLHYPMYRDIYPLWALAEYRRRVPLPSTAV

SEQ ID NO: 4327 - DNA, 2241 bp, Aspergillus oryzae
  CDS (1)..(2241)
atggcattgtccacttccccaaatacctcaatttgcaacctaatttacaaccctatatatagactgaagccagaagaattgagaatgccaccagaattaccagagaaaaccgattacacacgatggcggctattgaacgaagacggtcgacatacatggcactacctggaagacgacgagtcctctcgaaaatggccccagacgttagccgataaatactatctcggactaccactgaacctccccgatctcccacagccaaaatccccgttagagacggtccagaatggcctaacattcttctctaagctgcaactctccgccggaaactggggctgtgagtacggcggccccatgtttctactcccctgcatcgtcttcgcgtggaccgcaactgcaaccccaatccccgggccctatgcaacggagatcaaaaactatctctttgcacgggccaacccagtcgacggaggctggggcttgcacatcgaaggcgaaagcaccctattcggcacgagcctaaattacaccgtcctccgcctgctcggcgtcccggccgatcacgcaataatgattaaggctcgcaccctgctacacaagcacggtggcgccgtgtacgcgcctcactgggctaagttttggttggcgttactcggcatcgcggactgggacatcgtcaaccctgtcccgcctgaagcgtggctcttgccggactgggtgcctgtcgcaccgtggcggtggtggatacatatccggcaggtgtttctgccgatgtcgtttatttggtcgaggcggtggactatgccagaaacggaggtgatccggtcgttacggaacgagttgtttactcaggactgggggaccattgattggagggggaatagaaactccattgccgagattgacaaccatcatccaaagacttgggtcctcggctccctgaactggttgttgagtgaggtgtggatgccgtttttgaggccacggttcgtggctacttgggctgaggactgggtgagcaagctggtggatatggaggatgagaactcggactatgctgacctggcatctgtgaatgggccgttgaatatggtggtttgttttattcgggacggaggtgacgcgtactccgttaggagacatcgggagcggttggaggatttcctgtgggttaataaagaaggcatgctagtgaatgggacgaacggggtgcagtgctgggatacggcctttctggtgcaggctgctcacgccgctggtttggcggagagtgaggaatggaggcctatgttggtgcgggcgctggaattcttggatcatcagcagatgagggagaattgtaaggatcaggaggtttgttatcgccatccgcggaagggagcttggggtttcagcaataaagatcaggggtatgctgtgtgcgattgcatctcagaagccttgaagtcagttattctgcttcagaagaccccgggatacccgcagctgcttgatgatcgaaggatctttgatgccgttgatacgttgctcacttatcagaacccctccggtggatgctcgtcttatgagcggactagaggcggggagtatctggagatgttcaatgctgcggaggtatttggacggataatggtcgaatatgattatccagaatgtacgactgccgtggtcacggcattgacgttgtttaagaagcactggccggattaccgatcgaatgaaatcgaggtcttcatccagcgtgcgctggggtatatcaagaaagcccaattccctgacggcagttggtacggaagctgggctgtctgcttcacatacggcactatgttcgccttggaaagtttggcatcagtgggagaaacatatcgaaatagcgagtacgtcaagaaggcatgtcacttcctactatctaagcagagagaggatggtggatggtctgaaagctgcgagggctgccgacaaatcaagtacatcgagcatccaagtgggtcccaagtcgtgcaaacagcatatgcggtcatcggcttgctctcggctgagtatccggacatgaaacctattgaaaaagccattcgactcataatggcgagacagcagcccaatggagagtggctccaggaggccattgagggcatgttcaataagacatgtgccatttcctatcctaattataagtttacgtttacgatgctggcgttggggaagtttgctcggatgtatcccgactacagacttgattga

SEQ ID NO: 4328 - protein, 746 aa, Aspergillus oryzae
MALSTSPNTSICNLIYNPIYRLKPEELRMPPELPEKTDYTRWRLLNEDGRHTWHYLEDDESSRKWPQTLADKYYLGLPLNLPDLPQPKSPLETVQNGLTFFSKLQLSAGNWGCEYGGPMFLLPCIVFAWTATATPIPGPYATEIKNYLFARANPVDGGWGLHIEGESTLFGTSLNYTVLRLLGVPADHAIMIKARTLLHKHGGAVYAPHWAKFWLALLGIADWDIVNPVPPEAWLLPDWVPVAPWRWWIHIRQVFLPMSFIWSRRWTMPETEVIRSLRNELFTQDWGTIDWRGNRNSIAEIDNHHPKTWVLGSLNWLLSEVWMPFLRPRFVATWAEDWVSKLVDMEDENSDYADLASVNGPLNMVVCFIRDGGDAYSVRRHRERLEDFLWVNKEGMLVNGTNGVQCWDTAFLVQAAHAAGLAESEEWRPMLVRALEFLDHQQMRENCKDQEVCYRHPRKGAWGFSNKDQGYAVCDCISEALKSVILLQKTPGYPQLLDDRRIFDAVDTLLTYQNPSGGCSSYERTRGGEYLEMFNAAEVFGRIMVEYDYPECTTAVVTALTLFKKHWPDYRSNEIEVFIQRALGYIKKAQFPDGSWYGSWAVCFTYGTMFALESLASVGETYRNSEYVKKACHFLLSKQREDGGWSESCEGCRQIKYIEHPSGSQVVQTAYAVIGLLSAEYPDMKPIEKAIRLIMARQQPNGEWLQEAIEGMFNKTCAISYPNYKFTFTMLALGKFARMYPDYRLD

SEQ ID NO: 4329 - DNA, 2247 bp, Aspergillus oryzae
  CDS (1)..(2247)
atgaatcacaagttcgcgtcatctaacaagcacgccctcaggatcaagaatcacctaaatgcccaagaggatatcgaggatgggaaacccccattctcggcctgcaccactgatcgcgaggcatggcgtctggttgtcgaaaaggaccttggacgtttgaagtggaaatacctgaacactcagaatgaacgagattctagaccacaggatttggtttcacggttctttcttggacttcctctggcaattccagattctgaagcaacaaagagcccatctcaatctatctccaatggtctccgattccatagccgtctccaggtcgctggacgtggttgctgggcggatgacttgaaatgtattgtctttgtaactccgatgctgatcatgtcttggtacatcactggtgctgagattgacgaagcttatgccattgagttagccaattatcttttcacaattcaggacccaacggacggtgggtttcccacgcatataggagggaagaccacgctcatgggcaccatgttgatctatgttgctctgcgcctaatgggcattccctctgatgagaagcatctcatcaaagcaagagcatgcttcttggaaatgggcggtgccgtgtacctacccagctgggcgaagttctggctctctcttcttggcttgtatgggtgggaaggaactgacccctatcccgtcgaactctggcttctccctgaatggacacccatcagtccatggagatggtataacattgtacgccaggtttatttaccaatgtgctacctctccagtaaaaggttcaccatgccatcaaaccctcttctggacgaaatcagaacagaaatattcactgagccatattcgtctatcaaatttgcttctctgcagggatgcgtcctcgagtgtgagcgtcatcagccgcagagccgcgttctacgcacagctagctgggcattgtccaacgtgtggaatccatggctgcgcccgagagttctggctgtaagtgctgagcgaagagctttggaaatcatcaaggcgtcagataatactttcaacggtactggattgatcagtctagactgtttcttgaatatgattgtgttctattgcgaggaagggcccaactctaagaagctgaaacaaagtcaagaaagaactcttgaatatctttggttcagtccacaggggatgcaagtccagagcattcatggtgcacacacttggaatacatctttcgctcttcaaaccctcgtaatatcaggggtttcagaccatcctgacctgagaggttgcacggaagatgcttacaaattcctgctcgagcaacagttccttgatgactggcctgactcacctccgtgccatcgttctagtcgcttaggtggatggccgttcaccacgagatatcatggatcaacttgttcagactgtactggagaagcattgaaggcaattttgctcgttgaaagtcaaacgaacatccctcgccttagcaccgagaaaaacatccggctggcaatcgatcatatgctcatgatccaaaatgcatctggaggatatagctccttcgagcccattcgcagtggccctttcttggaacatctgaatgggaccgagctttttgccaacgtaatgacggaatacgattacaccgaaaccacctcttcatgcatcactgcactgagcctcttcagagaacgtgatagcagctaccgagcagaggaggtggtgaacgccatcgaccgtggtgttcgctttatccatcaaaatcaacagatcgatggaggttggcttgcgtcctgggggattgcttacacttacggtgccttttttgccttggaggcacttcactgtgccaacgaaacatatgaaaaccatgctgttgtcaaacgggggtgcgactttatccttgacaagcaaaaggaggacggcggatggggggaaactattgagtccattatgaagaagacttatatccaggcagaatcttcccacgtggtgcagacggcttggtgttgtatggcactaatctacgccgactatcccgatcctgagccaatcaggcgaggaattcggcttataatgagccgacaaaagccaagtggtgaatgggagcaggaagcaggtgtgggagcaggcattttcacctgtcaactattctattacaactatatctactcttttcctatcagggccattgctctgtatacgcagaaatatggtgacgataagcttctctga

SEQ ID NO: 4330 - protein, 748 aa, Aspergillus oryzae
MNHKFASSNKHALRIKNHLNAQEDIEDGKPPFSACTTDREAWRLVVEKDLGRLKWKYLNTQNERDSRPQDLVSRFFLGLPLAIPDSEATKSPSQSISNGLRFHSRLQVAGRGCWADDLKCIVFVTPMLIMSWYITGAEIDEAYAIELANYLFTIQDPTDGGFPTHIGGKTTLMGTMLIYVALRLMGIPSDEKHLIKARACFLEMGGAVYLPSWAKFWLSLLGLYGWEGTDPYPVELWLLPEWTPISPWRWYNIVRQVYLPMCYLSSKRFTMPSNPLLDEIRTEIFTEPYSSIKFASLQGCVLECERHQPQSRVLRTASWALSNVWNPWLRPRVLAVSAERRALEIIKASDNTFNGTGLISLDCFLNMIVFYCEEGPNSKKLKQSQERTLEYLWFSPQGMQVQSIHGAHTWNTSFALQTLVISGVSDHPDLRGCTEDAYKFLLEQQFLDDWPDSPPCHRSSRLGGWPFTTRYHGSTCSDCTGEALKAILLVESQTNIPRLSTEKNIRLAIDHMLMIQNASGGYSSFEPIRSGPFLEHLNGTELFANVMTEYDYTETTSSCITALSLFRERDSSYRAEEVVNAIDRGVRFIHQNQQIDGGWLASWGIAYTYGAFFALEALHCANETYENHAVVKRGCDFILDKQKEDGGWGETIESIMKKTYIQAESSHVVQTAWCCMALIYADYPDPEPIRRGIRLIMSRQKPSGEWEQEAGVGAGIFTCQLFYYNYIYSFPIRAIALYTQKYGDDKLL

SEQ ID NO: 4331 - DNA, 2205 bp, Aspergillus oryzae
  CDS (1)..(2205)
atggccgatcctatcgctccgtggagaaccgcggcacagggtcatttgaccgccgatgttaatggagatcccaaaacagactactcaaggtggagactgctagacgatgatggtcgtcagacgtggcattacctcgaatccgatgaagagaatgcaaaatggcctcaaacggtggctgacaaatactttttggggctccctacgggccttcctaaactgccacctgcgaagacaccactacagtgtgcagagaatggcctggaattcttctctaaattgcaactccccccaggcaattgggcctgtgagtatggtgggccgatgtttttactgccaggactccttatcacctactatgtaaccaacactccaattcctccggagtacgctactgagatcaagaggtatcttttcgctcgtcagcaccccgaggatgggggctggggtctccacatcgaggcccatagctccgtgtttggtacctgtatgaattatgttgcgctgcgcttaataggtgtcagcgaagacgaccatcgaatgatcaaggcccgtgggctcctacatagatttggtggtgccatttatggaccccattgggcaaaattttggcttagtattcttggagtcatggattgggattgcgtcaaccccgttcctcccgaaatctggattctccccgactgggtcccatttgccccatggcggtggtggattcatattcgtcaggtctttttgcccatgtcttacttgtggtctaagaaattcactcatccactggatccgctaaccaagcagcttcggagcgagctgtataccgagccgtatgactctatcgacttcgcaaagcaccgtaattctattcacaaggctgacaattactatccgaagacgtggctattgaatacgatcaactcagttttagtcaatgtctggaatccctacctgcggctccccgcactcgtgcgccgtgctgaagaatggacctgggagttgatccgcatggaagacgaaaatactgactacgcaggccttggtcctgtgagcaacccaatgaacatggttgcttgttacctccacgacggacctgatagttactcggtccgtcgacatcgagagcgtctgaatgattatatgtgggtaaagaatgaggggatgttgatgaacggcaccaatggtgttcaggtgtgggatacatccttcatcacgcaggccattgtcgttgcaggctttgcggatgatcctaaatggcgacctatgctcacaaaagccctggaattccttgataatcaccaactgcgggagaatgtaccagatcaggagaagtgctaccgtcagcaccgaaagggcgcatggcccttcagcaacaaaactcagggctatacagttagcgactgcacagccgagggcttacgttcaagcattcagcttcaagagatgcacaactatcctaaactgatatccacacagcgcttaaaagatagtgttgactgcttgctgctcatgcaaaatccttctggcggttttacagagtatgagaccacccgtgcgtcgcccaaggtggagtggttgaatgccgccgaggttttcggcgggattatgattggttacgactatcctgaatgcaccactgcctccgtcactgcgctgtctttgttcagcaagttctatcccgattaccgatccgacgagatcagggcggcgaaagaaaaagctgtcaaatacatcaaacgtgtgcagaggtcagatggaagctggtatggatcttggggcatctgcttcacctacgctgctatgtttgccttggaaagtctcgcgagcatcggagagacctatgaaaacagcgactattcccgtcggggttgcgagtttctcatttctaagcagaaggaagatggaggttggggtgaatcctacctcagcagcgagcgacacgtttacacccaacatgagcaatcccaagtgtgtcagactgcttgggcatgccttgccctgatggaggcaggctacccggacaaggagcctcttcgcaaggccatgaaactcatgatgtctcgtcagcaacccaatggggagtggctgcaggaagcaatcgaaggtgttttcaaccaatcatgtatgatttcataccctaactataagttctattggccgattcgcgctttgggactctacagcaggaagtttggcaatgaggagctcctgtaa

SEQ ID NO: 4332 - protein, 734 aa, Aspergillus oryzae
MADPIAPWRTAAQGHLTADVNGDPKTDYSRWRLLDDDGRQTWHYLESDEENAKWPQTVADKYFLGLPTGLPKLPPAKTPLQCAENGLEFFSKLQLPPGNWACEYGGPMFLLPGLLITYYVTNTPIPPEYATEIKRYLFARQHPEDGGWGLHIEAHSSVFGTCMNYVALRLIGVSEDDHRMIKARGLLHRFGGAIYGPHWAKFWLSILGVMDWDCVNPVPPEIWILPDWVPFAPWRWWIHIRQVFLPMSYLWSKKFTHPLDPLTKQLRSELYTEPYDSIDFAKHRNSIHKADNYYPKTWLLNTINSVLVNVWNPYLRLPALVRRAEEWTWELIRMEDENTDYAGLGPVSNPMNMVACYLHDGPDSYSVRRHRERLNDYMWVKNEGMLMNGTNGVQVWDTSFITQAIVVAGFADDPKWRPMLTKALEFLDNHQLRENVPDQEKCYRQHRKGAWPFSNKTQGYTVSDCTAEGLRSSIQLQEMHNYPKLISTQRLKDSVDCLLLMQNPSGGFTEYETTRASPKVEWLNAAEVFGGIMIGYDYPECTTASVTALSLFSKFYPDYRSDEIRAAKEKAVKYIKRVQRSDGSWYGSWGICFTYAAMFALESLASIGETYENSDYSRRGCEFLISKQKEDGGWGESYLSSERHVYTQHEQSQVCQTAWACLALMEAGYPDKEPLRKAMKLMMSRQQPNGEWLQEAIEGVFNQSCMISYPNYKFYWPIRALGLYSRKFGNEELL

SEQ ID NO: 4333 - DNA, 2274 bp, Lotus japonicus
  CDS (1)..(2274)
atgtggaagctcaagattgcagagggagggaatccatggctccgatcaaccaacagtcacgtcggaagacaggtctgggagttcgatcctaagcttggatcgcctcaggatctcgccgagattgaaaccgctcgcaacaatttccacgataatcgcttctcgcacaaacacagctctgatctactcatgcgcattcagttttcgaaagagaatccgataggcgaagtcttaccgaaagtcaaggttaaagatgttgaggatgtgactgaagaggctgtggtaacaacgttaagacgagcgataagtttccattcgactctccagagtcatgatggacactggccaggggattatggaggtccaatgtttcttatgcctgacttggttatcacactgtctattactggggcgctgaatgcagtcttaactgatgaacatagaaaggaaatgtgtcgctacctatataaccatcagaacaaggatggtgggtggggtttgcatattgaaggtccaagcactatgtttggctctgtcttgaattatgttactctcagattgctgggtgaggggcctaatgatggacaaggggacatggagaaggctcgtgactggattctagggcatggtggtgctacttatataacatcgtgggggaagatgtggctttcagtacttggagtgtttgaatggtctggaaataatcccctgcctcctgagatatggctccttccgtatgcgcttccatttcatccaggaagaatgtggtgtcactgccggatggtttatttgccaatgtcctacttatatggtaagaggtttgtgggtccaatcacaccaacaatattatctttgagaaaagagctttttaccataccatatcatgatatagattggaaccaggctcgcaatttgtgcgcaaaggaagacttgtactatcctcacccgctcgtgcaagatattctttgggcatctctgcacaaggtcgttgagcctgttttgatgcagtggcctggcaaaaagttgagagaaaaggctattaattctgtaatggagcatatacattatgaagatgagaatactcgttatatttgtataggtcctgtaaataaggtattaaatatgctttgctgttgggtggaagatccaaattcagaggcattcaaattgcatcttccaaggatctatgattatctatggattgctgaagatggcatgaaaatgcagggctacaatggaagtcaactatgggatactgcatttgctgcccaagcaattatttcaactaaccttattgaagaatatggtccaaccctaagaaaagctcatacattcattaagaattcgcaggttttagaagattgtcccggtgatcttaataaatggtatcgtcacatttcaaaaggtgcttggcctttttccaccgcagatcatggatggccaatttctgactgcacagctgaaggactgaaagctattctatctctatctaaaattgcaccagatattgttggtgagccattggatgcaaagcggttatatgatgctgtaaatgtcattctctcgttacagaatgaagatggtggcttagcgacatatgagctcacacgatcttatagctggttggagctaatcaatcctgctgaaacttttggtgacatcgttattgattatccttatgtggaatgtacctcagcagcaattcaagctttaacatcatttaggaaattatatcctgggcatcgccgagaagaaatacaacacagtattgaaaaagctgctgcctttatcgaaaaaatacaatcttcagatggttcatggtatggttcttggggtgtttgcttcacttatggcacttggtttggggtaaaagggttgatcgctgcaggaaagagtttcagtaattgctcaagcatccgtaaagcttgtgaatttctgctgtctaagcagcttccatctggtggctggggagagagttatctgtcgtgtcaaaacaaggtgtattcaaatctggaaggcaacaggcctcatgcagtaaacactggatgggctatgctggctctcattgaggctgaacaggcaaagagagatccaacgccactgcaccgtgcagctttatacttgataaattcccaaatggagaatggtgactttccacaacaggaaataatgggagtcttcaacaagaattgcatgatcacatatgctgcatacaggagcatattccccatatgggcgttaggagaataccgatgtcgtgtattgcaggcccgttaa

SEQ ID NO: 4334 - protein, 757 aa, Lotus japonicus
MWKLKIAEGGNPWLRSTNSHVGRQVWEFDPKLGSPQDLAEIETARNNFHDNRFSHKHSSDLLMRIQFSKENPIGEVLPKVKVKDVEDVTEEAVVTTLRRAISFHSTLQSHDGHWPGDYGGPMFLMPDLVITLSITGALNAVLTDEHRKEMCRYLYNHQNKDGGWGLHIEGPSTMFGSVLNYVTLRLLGEGPNDGQGDMEKARDWILGHGGATYITSWGKMWLSVLGVFEWSGNNPLPPEIWLLPYALPFHPGRMWCHCRMVYLPMSYLYGKRFVGPITPTILSLRKELFTIPYHDIDWNQARNLCAKEDLYYPHPLVQDILWASLHKVVEPVLMQWPGKKLREKAINSVMEHIHYEDENTRYICIGPVNKVLNMLCCWVEDPNSEAFKLHLPRIYDYLWIAEDGMKMQGYNGSQLWDTAFAAQAIISTNLIEEYGPTLRKAHTFIKNSQVLEDCPGDLNKWYRHISKGAWPFSTADHGWPISDCTAEGLKAILSLSKIAPDIVGEPLDAKRLYDAVNVILSLQNEDGGLATYELTRSYSWLELINPAETFGDIVIDYPYVECTSAAIQALTSFRKLYPGHRREEIQHSIEKAAAFIEKIQSSDGSWYGSWGVCFTYGTWFGVKGLIAAGKSFSNCSSIRKACEFLLSKQLPSGGWGESYLSCQNKVYSNLEGNRPHAVNTGWAMLALIEAEQAKRDPTPLHRAALYLINSQMENGDFPQQEIMGVFNKNCMITYAAYRSIFPIWALGEYRCRVLQAR

SEQ ID NO: 4335 - DNA, 2268 bp, Lotus japonicus
  CDS (1)..(2268)
atgtggaagttgaaggtagcagaaggaggaaaagggttggtttctgtgagcaatttcatcggaaggcaacactgggtgttcgacccaaatgcagggacaccacaagaacatgaggagattgaaaggatgcgccaagaattcaccaaaaatcgattctccatcaaacaaagtgcagacctcttgatgagaatgcagctgagaaaggagaacccttgtgggcccatcccaccagcagttaaattgagagatgtggaaaaggtaactgcagaagcattgatcactacaattagaaggtccatcaccttttattcttcaattcaagcccatgatggccactggcctgctgaatctgcaggcccattattcttcgttcaacctttggtaatggcactgtacattacaggatcccttgatgatgtattaggacctcaacacaagaaggaaattattcgatatttgtataatcatcagaacgaagatgggggttggggattccacatagagggtcatagtaccatgtttggatctgcattgagctacattgcattgagggtacttggacaaagccttgaagatggtgaggacatggcagtggccagaggcagaaaatggatcctcgatcatggcggtttagtagctattccatcatggggaaagttctgggtcacggtgctaggggtttatgagtggtcagggtgcaatccccttccaccagagttctggcttctacccaaaattttccctattcatccagggaaaatgttatgttactgtcgcttagtttacatgcccatgtcatatttatatggaaagaagtttgtaggcccaatcactgccttagtcagatcactaagaaaagaattgtacaatgagccttatgatcgagttgactggaataaggcccgcaacactgttgctaaggaggatctatactatccccatcctctaatccaagacatgttatggggatttcttcatcatgtgggagagcgtgttctgaacacttggccattttcaatgctaagacagaaggcaatagaagttgctattaatcatgtacgttacgaggatgagaccactaggtacctttgcattggaagtgtagagaaggtgttatatttgattgcgcgttgggttgaagaccccaactcagaggcttacaaacttcatttagcccgaatccctgattacttctggcttgcagaagatggcttgaaaatccagagttttggctgccaaatgtgggatgcagcatttgctattcaagcaatactgagtggtaatgtgagtgaagagtatggaccaacattaaagaaagcacaccactttgtgaaggcttcgcaggtacgtgaaaacccatccggtgacttcaaagcaatgtacagacacatttccaaaggggcatggacattctcaatgcatgatcatggatggcaagtctctgattgcacagcagaaggactaaaggttgcactcctactgtcagaaatgtcagatgatctagttggggcaaaaatggaaacagagcaattctatgatgctgttaatgtcatcctctctctacaaagcagcaatggtggtttccctgcttgggagcctcaaagagcctaccaatggttagagaaattcaatccaactgaattctttgaagaaactctgattgagagggagtatgtagagtgcactggttcagcaatgcaagccctggctcttttcagaaagctatacccgaagcataggcgaaaggaaatagatcgctgcatttccaaagcaatccgatacattgaaaacacacaaaatcctgatgggtcttggtatggttgctggggaatttgctacacttatggtacctggtttgcagtggaaggactaacagcttgtgggaagaacttccaaaatagtgttaccttgcgtagagcatgtaaatttttgttgtcaaagcagcttcctaatggagggtggggagaaagttacttgtcaagccaagacaaggtgtacacaaacattgaaggaaaacgtgcaaatttggttcaaagttcatgggctttgttgtcacttatgcgtgctgggcaggctgagatagatccgacaccaattcaccgtggaataaggttactcattaattcacaaatggatgatggagacttcccacaacaggagattacaggagtatttatgaggaactgtaccctaaactactcatcatatcgaaacatctttcctatatgggctcttggagagtaccgtcgcagagtcttatgtgcatga

SEQ ID NO: 4336 - protein, 755 aa, Lotus japonicus
MWKLKVAEGGKGLVSVSNFIGRQHWVFDPNAGTPQEHEEIERMRQEFTKNRFSIKQSADLLMRMQLRKENPCGPIPPAVKLRDVEKVTAEALITTIRRSITFYSSIQAHDGHWPAESAGPLFFVQPLVMALYITGSLDDVLGPQHKKEIIRYLYNHQNEDGGWGFHIEGHSTMFGSALSYIALRVLGQSLEDGEDMAVARGRKWILDHGGLVAIPSWGKFWVTVLGVYEWSGCNPLPPEFWLLPKIFPIHPGKMLCYCRLVYMPMSYLYGKKFVGPITALVRSLRKELYNEPYDRVDWNKARNTVAKEDLYYPHPLIQDMLWGFLHHVGERVLNTWPFSMLRQKAIEVAINHVRYEDETTRYLCIGSVEKVLYLIARWVEDPNSEAYKLHLARIPDYFWLAEDGLKIQSFGCQMWDAAFAIQAILSGNVSEEYGPTLKKAHHFVKASQVRENPSGDFKAMYRHISKGAWTFSMHDHGWQVSDCTAEGLKVALLLSEMSDDLVGAKMETEQFYDAVNVILSLQSSNGGFPAWEPQRAYQWLEKFNPTEFFEETLIEREYVECTGSAMQALALFRKLYPKHRRKEIDRCISKAIRYIENTQNPDGSWYGCWGICYTYGTWFAVEGLTACGKNFQNSVTLRRACKFLLSKQLPNGGWGESYLSSQDKVYTNIEGKRANLVQSSWALLSLMRAGQAEIDPTPIHRGIRLLINSQMDDGDFPQQEITGVFMRNCTLNYSSYRNIFPIWALGEYRRRVLCA

SEQ ID NO: 4337 - DNA, 2289 bp, Lotus japonicus
  CDS (1)..(2289)
atgtggaagctgaaggtagcagatggtgggaaagacccatacatattcagcaccaacaacttcgttgggagacagacttgggagtatgatcctgatgcagggactccagaggaacgagctcaggttgaagaagctcgtcaggatttctataacaaccgctacaaggtgaaaccatgtggtgacctgctttggcggtttcaggtcctgagggaaaataacttcaagcaaacaataccgagtgtgaagatagaagatggggaggagataacatatgaaaaagcaacaaccactctgaaaagggcggcacatcacctagcagcattgcagactagtgatggacattggcctgctcaaattgcaggtcctctgtttttccaacctccattggtcttttgtatgtacataacaggacatcttaattcagtatttccagaagagtatcgcaaagagattcttcgttacatatacgttcaccagaatgaagatggagggtggggactacatatagagggtcatagcaccatgttttgtactgcactcaactacatatgcatgcgaatgcttggagaagggcctgatggaggtcaagacaatgcttgtgctagagcaagaaaatggattcttgatcatggtggtgtaacacacataccttcttgggggaagacatggctttcgatacttggtatatttgattggaagggaagcaaccctatgccccctgagttttggatccttccttcatttcttcctatgcatccagctaaaatgtggtgttattgccggctggtatacatgcctatgtcttacttgtatgggaagaggtttgtgggtccaataacaccactcatcttacaattgagagaagaactatttactcaaccttatgagaaagttaattggaagaaagctcgtcaccaatgtgcaaaggaagatatttactatccccatcctttgatacaagacttgatgtgggatagtttatacctattcactgaaccacttctgactcgttggcctttcaacaagctggtcagagaaaaagcgcttgaagtaacaatgaaacatatccactacgaagatgagaatagtcgatacataaccatcgggtgcgtggaaaaggttttatgcatgcttgcttgttgggtggaagatccgaacggagatgctttcaagaagcatcttgctaggatcccagattacttatgggtttcagaagatggaatgtgcatgcagagttttggtagccaagaatgggatgctggttttgcagttcaagctttgcttgccactaacctagttgacgaacttggtcccacacttgccaaaggacatgatttcatcaagaaatctcaggttagggacaacccttcaggagattttaagaatatgcatcgccatatttccaaagggtcatggaccttttctgatcaagaccatggatggcaagtttctgattgcactgcagaaggtttgaagtgttgtctacttctatcaatgttgcctccagatattgtgggggaaaagatggaacctgaatgtttatttgattctgtcaatctcctgttatcacttcagagtaaaaagggtggtttggcagcatgggagccagcaggagctcaagaatggttggaactactcaaccccaccgaatttttcgcggatattgtagttgagcatgaatatgttgagtgcactggatctgcaattggagccttagttttgttcaagaagctatatccagggcatagaaagaaagaaattgagaatttcatttccgaagcggttcgattcctagaagatacacaaacggccgatggttcttggtatggaaactggggagtttgcttcacttacggttcttggttcgcgcttggtggtcttgcagcagctggcaagacttatgccaattgtgctgccattcgcaaagctgttaaatttctactcactacacaaagaggtgatggcgggtggggagagagctatttgtctagcccaaaaaagatatatgtaccatttgaaggaaaccgatcaaatgttgtacatacagcatgggctcttatgggtttaattcattctggccaggctgagagagaccctactccacttcatcgtgctgcaaaattgctcatcaattctcagcttgaagagggtgattggccccaacaggaaatcactggagtattcatgaaaaattgtatgctgcattatccaatgtacagagatatttatcccatgtgggctctagctgaatatcgtagacgggttccattgccttccactgcagtttaa

SEQ ID NO: 4338 - protein, 762 aa, Lotus japonicus
MWKLKVADGGKDPYIFSTNNFVGRQTWEYDPDAGTPEERAQVEEARQDFYNNRYKVKPCGDLLWRFQVLRENNFKQTIPSVKIEDGEEITYEKATTTLKRAAHHLAALQTSDGHWPAQIAGPLFFQPPLVFCMYITGHLNSVFPEEYRKEILRYIYVHQNEDGGWGLHIEGHSTMFCTALNYICMRMLGEGPDGGQDNACARARKWILDHGGVTHIPSWGKTWLSILGIFDWKGSNPMPPEFWILPSFLPMHPAKMWCYCRLVYMPMSYLYGKRFVGPITPLILQLREELFTQPYEKVNWKKARHQCAKEDIYYPHPLIQDLMWDSLYLFTEPLLTRWPFNKLVREKALEVTMKHIHYEDENSRYITIGCVEKVLCMLACWVEDPNGDAFKKHLARIPDYLWVSEDGMCMQSFGSQEWDAGFAVQALLATNLVDELGPTLAKGHDFIKKSQVRDNPSGDFKNMHRHISKGSWTFSDQDHGWQVSDCTAEGLKCCLLLSMLPPDIVGEKMEPECLFDSVNLLLSLQSKKGGLAAWEPAGAQEWLELLNPTEFFADIVVEHEYVECTGSAIGALVLFKKLYPGHRKKEIENFISEAVRFLEDTQTADGSWYGNWGVCFTYGSWFALGGLAAAGKTYANCAAIRKAVKFLLTTQRGDGGWGESYLSSPKKIYVPFEGNRSNVVHTAWALMGLIHSGQAERDPTPLHRAAKLLINSQLEEGDWPQQEITGVFMKNCMLHYPMYRDIYPMWALAEYRRRVPLPSTAV

SEQ ID NO: 4339 - DNA, 2280 bp, Ricinus communis
  CDS (1)..(2280)
atgtggaagctaaggattgcagaaggaagtggaaatccatggcttagaactacaaacgatcacattgggagacaagtctgggaatttgattcatctaaaatcggatctccagaagagctctcacaaatcgaaaatgctcgtcaaaatttcaccaaaaaccgctttattcacaagcatagttcagatctactcatgcgcattcagttttcgaaggaaaatccaatatgtgaagtgttaccgcaagtaaaagtgaaagaatcagaacaagttaccgaggagaaagtgaaaattacgttaagaagggcattgaattactattcatctattcaagctgatgatggacattggcctggtgattatggcggtcctatgtttctaatgcctggcttgattatagctctgtctatcactggcgcattgaatgcaattttatctgaggaacataagcgcgaaatgtgtcgatatctatacaaccaccagaatagagatggcggttggggcttacacattgagggaccaagcacaatgtttgggagtgtattgtgttatgtttcgttaaggctgcttggtgaaggtcccaatgagggagaaggggcagtcgagagaggccgtaattggattctcaaacatggtggtgctactgcaattacgtcctggggaaaaatgtggctttcagtacttggagcatatgagtggtctggtaataatcccttaccccctgagatgtggcttctcccttacattctcccagtccatccagggaggatgtggtgtcactgccggatggtatatcttcccatgtcatatttatatgggaaaaggtttgttggtccaatcacaccaacagttttgtctttgagaaaggagctgtatactgtcccatatcatgaaatagactggaatcaagcacgcaaccaatgtgcaaaggaagatttgtactatccacatcctatgttgcaagatgtactttgggcaactcttcataagtttgttgaacctattcttatgcattggcctggaaaaaggttgagagaaaaggctattcaaactgcgattgaacacatacactatgaagatgaaaatactcgttacatatgcatagggcctgtaaacaaggtgttaaatatgctttgctgttgggtggaagacccaaactcagaagcttttaagttgcatcttccaagattatatgactacctctggcttgctgaagatgggatgaaaatgcagggttataatggaagtcaactctgggacacagcattcgcagttcaagcaattgtgtcaactaatcttattgaggaatatggtccgactctaaaaaaggcacattcattcattaaaaaaatgcaggttttggaaaattgtccaggagatcttaatttttggtatcgccacatttcaaaaggtgcatggccattttcaactgctgatcatggatggcccatctcagactgcacagcagagggaataaaagctcttatgttgttatcaaagattccttcagagattgttggggaaggattaaatgcaaaccggttatatgatgcagtgaatgttgttctctcattacagaatggtgatggtggctttcctacttatgagctctcaagatcttatagttggttggagtttatcaaccctgctgaaacttttggtgacattgttattgactacccgtacgttgagtgtacttcagctgcaattcaagctttgacatcattccgtaaatcatatcctgaacatcagcgagaagagatagaatgttgtatcaaaaaggcagctaagttcatggaaaaaattcagatatcagatggctcatggtatggctcatggggtgtttgcttcacctatggtacatggtttggcataaaaggtttggtggctgccggaaaaagctttggtaattgttccagtatccgtaaagcctgtgattttctgttgtctaaacagtgtccttctggtggctggggagagagttatctttcatgtcaaaagaaggtttattccaatcttgaaggtgacaggtctcatgtggtaaatactgcttgggctatgttgagtctgattgatgccgggcaggctgagagagacccaacaccattgcatcgtgcagcaagatatttaataaacgctcaaatggagaatggagattttccacagcaggaaatcatgggagtattcaataggaattgcatgataacatatgcggcctacagagacattttcccaatttgggcattgggagaataccgttgccgggttctcaaggcttcataa

SEQ ID NO: 4340 - protein, 759 aa, Ricinus communis
MWKLRIAEGSGNPWLRTTNDHIGRQVWEFDSSKIGSPEELSQIENARQNFTKNRFIHKHSSDLLMRIQFSKENPICEVLPQVKVKESEQVTEEKVKITLRRALNYYSSIQADDGHWPGDYGGPMFLMPGLIIALSITGALNAILSEEHKREMCRYLYNHQNRDGGWGLHIEGPSTMFGSVLCYVSLRLLGEGPNEGEGAVERGRNWILKHGGATAITSWGKMWLSVLGAYEWSGNNPLPPEMWLLPYILPVHPGRMWCHCRMVYLPMSYLYGKRFVGPITPTVLSLRKELYTVPYHEIDWNQARNQCAKEDLYYPHPMLQDVLWATLHKFVEPILMHWPGKRLREKAIQTAIEHIHYEDENTRYICIGPVNKVLNMLCCWVEDPNSEAFKLHLPRLYDYLWLAEDGMKMQGYNGSQLWDTAFAVQAIVSTNLIEEYGPTLKKAHSFIKKMQVLENCPGDLNFWYRHISKGAWPFSTADHGWPISDCTAEGIKALMLLSKIPSEIVGEGLNANRLYDAVNVVLSLQNGDGGFPTYELSRSYSWLEFINPAETFGDIVIDYPYVECTSAAIQALTSFRKSYPEHQREEIECCIKKAAKFMEKIQISDGSWYGSWGVCFTYGTWFGIKGLVAAGKSFGNCSSIRKACDFLLSKQCPSGGWGESYLSCQKKVYSNLEGDRSHVVNTAWAMLSLIDAGQAERDPTPLHRAARYLINAQMENGDFPQQEIMGVFNRNCMITYAAYRDIFPIWALGEYRCRVLKAS

SEQ ID NO: 4341 - DNA, 2310 bp, Ricinus communis
  CDS (1)..(2310)
atgtggcgaattaaaatagctgagggaggaaataacccttatatttatagcacaaacaattttcagggaaggcaaatttgggtatttgatcctaatgctggtactcctgaagaacaagccgaggttgaagaagctcgtcaaaacttctggaaaaatcgatttcaggtcaagcctaactctgatctcctttggcaactccagtttctaagggagaaaaattttaagcaaaaaattccaaaagtaaaggttgaagatggcgaggagatcacaagtgaaatagctgcagccgctttgaggagaagcgtccacttgttttcggccttgcaggcaagcgatggccattggtgtgcagaaaatggaggcctgctgttctttttgcctcccttggtttttgctgtctacattacaggacaccttaatactgtattttctccagagcatcgcaaagaaatcctccgttacatatactgtcatcagaatgaagatggtggatggggaatacacattgaaggtcacagcactatgttttgcacagttcttaattatatatgtatgcgtatacttggtgaagcacgtgatggtggaatagaaaatgcttgtgaaagagggcgaaaatggatactcgatcatggtggtgcaactggtatatcttcttggggaaagacatggctttcgatacttggtgtgtacgagtgggatgggaccaatcccatgcccccagagttttgggcctttccatcttcttttcccttacacccagcaaaaatgttttgttactgtcggatcacttacatgccaatgtcgtacttgtacgggaagaggtttgttggtccaatcacaccactcattctacaaataagagaagaaatctataatgaaccttacaacaaaatcaagtggaatagtgtgcgtcatttatgtgcaaaggaagacaactattttccacatccaacgatacagaaactgttatgggatgctctgtatacatttagcgagcctctattctctcgttggcccttcaacaaattgagagagaaggctctcaagataacaatggatcacattcattatgaagatcacaacagtcggtacatcactattggatgcgttgagaagccgttatgcatgcttgcctgttggattgaagatcctcatggggaagcgtttaagaagcaccttgccagaattgcagattacatatgggttggagaagatggaataaagatgcagagtttcggaagtcaaacatgggacacaagtctagctcttcaggccctgatagctagcgacctctctcatgaaataggacctacactaaaacaaggacacgtcttcacgaagaattctcaggcaactgagaacccttcgggcgacttcagaaaaatgtttcgtcatatctccaaaggagcttggacattctctgataaagatcaaggatggcaagtttctgattgtacagcagaaagcttgaagtgctgcctacttttctcaatgatgcctcccgaaattgttggtgagaaaatggaacctgaaaaggtctatgattcagtcaatgtcatactttctcttcagagccaaaatggtggtttcacagcttgggagccagcaagagcaggatcatggatggagtggctcaaccctgtagagttcatggaggatcttgtcgttgagcacgagtatgtggagtgcacttcatcagcaatccaagcactagttctttttaaaaaattatatccccgacacaggaacaaagagattgaaaattgtatcataaatgctgcgcagttcattgaaaatatacaagaacctgatggttcatggtatggaaattgggggatatgcttctcttatggtacctggtttgcactgaaaggattagctgctgctggaaggacatatgaaaattgttctgctattcgtaaaggtgttgattttctactaaaatcacaaagagatgatggtggatgggcagagagttatctttcatgtccaaagaaggtgtatgttccttttgagggtaatcgatcaaatctagttcaaactgcttgggcaatgatgggtttgatttatggaggacaggccaaaagagaccctatgcctcttcatcgcgctgcaaagttattaattaattctcaaacagatcttggtgattttcctcaacaggaacttacaggagcattcatgaggaattgcatgctgcactatgcactatttaggaatacttttcccatttgggctttggcagaatatcggcgacatgtcttattcccttctgctggatttggttttggattcaccaataatttatga

SEQ ID NO: 4342 - protein, 769 aa, Ricinus communis
MWRIKIAEGGNNPYIYSTNNFQGRQIWVFDPNAGTPEEQAEVEEARQNFWKNRFQVKPNSDLLWQLQFLREKNFKQKIPKVKVEDGEEITSEIAAAALRRSVHLFSALQASDGHWCAENGGLLFFLPPLVFAVYITGHLNTVFSPEHRKEILRYIYCHQNEDGGWGIHIEGHSTMFCTVLNYICMRILGEARDGGIENACERGRKWILDHGGATGISSWGKTWLSILGVYEWDGTNPMPPEFWAFPSSFPLHPAKMFCYCRITYMPMSYLYGKRFVGPITPLILQIREEIYNEPYNKIKWNSVRHLCAKEDNYFPHPTIQKLLWDALYTFSEPLFSRWPFNKLREKALKITMDHIHYEDHNSRYITIGCVEKPLCMLACWIEDPHGEAFKKHLARIADYIWVGEDGIKMQSFGSQTWDTSLALQALIASDLSHEIGPTLKQGHVFTKNSQATENPSGDFRKMFRHISKGAWTFSDKDQGWQVSDCTAESLKCCLLFSMMPPEIVGEKMEPEKVYDSVNVILSLQSQNGGFTAWEPARAGSWMEWLNPVEFMEDLVVEHEYVECTSSAIQALVLFKKLYPRHRNKEIENCIINAAQFIENIQEPDGSWYGNWGICFSYGTWFALKGLAAAGRTYENCSAIRKGVDFLLKSQRDDGGWAESYLSCPKKVYVPFEGNRSNLVQTAWAMMGLIYGGQAKRDPMPLHRAAKLLINSQTDLGDFPQQELTGAFMRNCMLHYALFRNTFPIWALAEYRRHVLFPSAGFGFGFTNNL

SEQ ID NO: 4343 - DNA, 2301 bp, Euphorbia tirucalli
  CDS (1)..(2301)
atgtggaggcttaaaatagctgagcaagggaataatcccaacatttacagtactaacaactttctaggaagacaaatatgggaatacgatgctaatgctggtactcctcaagacatagctgaggttgaagatgctcgtcttcgtttttggaacaatcgatttcacatcaagcctagctctgatcttctttggcaatttcagtttctaagggagaaaaagttcaaacagagaattccagcggtgaggattaaggaagatgaagaagtaacatatgaagcagccacagctgctttgagaaggggtgttcacttgttttcagctttgcaggctaaagatggtcattggcctgctgaaaatgctggccctatgttttttgtacctccaatggtattttgtctttatattacaagtcaacttgataatgtattgtctaaagagcatattatagagattcttcgttacatatactgccatcagaatgaagatggagggtggggattgcacatagaaggtcatagcatgatgttcagtacagttctaaattatatatgtatgagaatacttggtgaaggacccaatggaggattagaaaatgcatgtgaaagagcacgaaaatggattcttgaccatggcagtgcaactgctattagctcttggggaaagacctggttatcaatacttggtgtttatgaatgggaaggaagccatcccatgcctcctgagttttggttcttaccaacaatgtttcccatacatccagcaaaaatgttttgctattgtcggatgacttatatgccaatgtcttacttgtatgggaagaaatttgtaggtccactcacacctcttatcttacaacttagacaagaaatctataatcaaccttatcatactattaactggaaaagcattcgccacttatgtgctaaggaggataattactacccccgtacctggatccaaaaattgatgtgggattccctttatatatttactgagccaattttaaggcgttggcccttcaacaaattgagagaaaaagctctgaaaaaaacaatggatcacattcattatgaagacgaaaacagtcgatacattgtcattggatctgtcgaaaagccgttgaatatgcttgcttgttgggttggagatccaaatggagatgcttttaagaagcatcttgctagaattgtggattatatatgggttggagaggatggattaaaggtccagagttttggcagtcaggtatgggatgcaagttttggcctccaagccttgatagctagcaatctttctgatgaaattggacccattcttaaccatggacacaactttcttaagaattctcaggtgactgagaatccttatggagatcataaaagcatgtttcggcatatatctaaaggagcatggaccttttcggataaagatcatggatggcaagtttctgattgtactgctgaaagtttgaagtgttgtctattgttctcgttgatgccctctgagatagttggtgagaaattagaagctggaaagctgtatgatgccgttaacatcttactttctcttcagagtgaaaatggtggcttatcaggttgggaacctgctagaggaagcccttggttggagtggctaaatcctgtggagttccttgaagaccttgtagttgagcatgagtatgtggaatgcacttcatcatcaatccaagcgttaactttattcaagaaattatatccaggacacagaaccaaagagattgaaaattttatagcaaaagctgtaaagttcattgaagagatacaaaaaccagatggttcatggtatggaaattgggggatatgcttcatttatggcacatggttcggacttggaggattagcagcagctggcaattcttatgaaaattgtattgctattcgtcgtggagttgaatttcttcttaattctcaaagagttgatggtggatgggctgagagttacctttcttgccctaataaggtatatgttggtgttgatggtgatgggagatcaaacttggtacaaactgcgttcgctgtattgggtttgattcatggtggacaggccaagacagaccctacacctttgcatcgtggtgtgaaatttttgatcaattctcaaactcaacttggtgatttcccccaacaggaattgactggagcatttatgaggaattgtatgttgcactatgcattatataggaatatttttcccttgtgggctttggcagaataccgtcgaaatgttcctctatcgccgcagattgctgcagaaacaaaataa

SEQ ID NO: 4344 - protein, 766 aa, Euphorbia tirucalli
MWRLKIAEQGNNPNIYSTNNFLGRQIWEYDANAGTPQDIAEVEDARLRFWNNRFHIKPSSDLLWQFQFLREKKFKQRIPAVRIKEDEEVTYEAATAALRRGVHLFSALQAKDGHWPAENAGPMFFVPPMVFCLYITSQLDNVLSKEHIIEILRYIYCHQNEDGGWGLHIEGHSMMFSTVLNYICMRILGEGPNGGLENACERARKWILDHGSATAISSWGKTWLSILGVYEWEGSHPMPPEFWFLPTMFPIHPAKMFCYCRMTYMPMSYLYGKKFVGPLTPLILQLRQEIYNQPYHTINWKSIRHLCAKEDNYYPRTWIQKLMWDSLYIFTEPILRRWPFNKLREKALKKTMDHIHYEDENSRYIVIGSVEKPLNMLACWVGDPNGDAFKKHLARIVDYIWVGEDGLKVQSFGSQVWDASFGLQALIASNLSDEIGPILNHGHNFLKNSQVTENPYGDHKSMFRHISKGAWTFSDKDHGWQVSDCTAESLKCCLLFSLMPSEIVGEKLEAGKLYDAVNILLSLQSENGGLSGWEPARGSPWLEWLNPVEFLEDLVVEHEYVECTSSSIQALTLFKKLYPGHRTKEIENFIAKAVKFIEEIQKPDGSWYGNWGICFIYGTWFGLGGLAAAGNSYENCIAIRRGVEFLLNSQRVDGGWAESYLSCPNKVYVGVDGDGRSNLVQTAFAVLGLIHGGQAKTDPTPLHRGVKFLINSQTQLGDFPQQELTGAFMRNCMLHYALYRNIFPLWALAEYRRNVPLSPQIAAETK

SEQ ID NO: 4345 - DNA, 2289 bp, Euphorbia tirucalli
  CDS (1)..(2289)
atgtggaagctgaagatagcagaggggggaaatgatgaatatttgtacagtacaaacaattacgtggggagacagacttgggtatttgatccacagcctcctactcctcaagagcttgctcaggttcaacaagctcgtcttaatttctacaataatcgctatcatgtcaagcccagttctgatcttctctggcgtttccagtttctgagagagaagaatttcaagcaaacaataccacaagcgaagattaacgagggagaggacataacatacgaaaaagcaacaacagcattaagaagggcagtccacttcttctcggcgttgcaggctagtgatggacattggcctgctgaaaatgctggccctttgtttttcctcccaccacttgtaatgtgtttgtacataacaggacacttggacactgtgtttcctgctccccatcgccttgaaatccttcgttacatctactgtcatcagaatgaagatggaggatgggggctgcacatagagggacacagcaccatgttctgcactgtgctaagttacatttgtatgcgtcttctgggagaaggtcctaatggcggtcaagacaatgcctgttctagagctcgaaaatggattattgaccatggcggtgccacttacattccctcttggggaaaaacttggctttcgattcttggtgtttatgaatggtccggaagcaaccctatgcctcctgaattttggattcttcctacctttttacctatgcatccagcaaaaatgtggtgttactgtcggatggtttacatgccaatgtcttacctgtatggaaaaagatttgtcggaccaattacacctctcattctccagttgaggcaagaactccatactcagccctaccatcacatcaattggaccaaaactcgtcatctctgtgcccatgaagatgtgtattacccacatcctttgattcaagatttgatgtgggactctctatacatattcacggagcctttacttacacgttggcctttcaacaaaatcataagaaagaaagcacttgaagtcacaatgaagcacattcattatgaagatgaaaacagccgttacattaccattggatgtgttgaaaaggtattgtgtatgcttgcttgttgggctgaagatccaaatggagttcccttcaagaaacatctagccaggatccctgattacatgtgggttgctgaagatggcatgaaaatgcagagctttgggagtcagcagtgggacacaggttttgcgattcaggcactgctagcaagcaatctaacagaagaaataggacaagtactgaagaaaggacatgatttcataaagaaatcacaggtgaaggaaaatccatcaggtgactttaagagcatgcataggcatatatccaaaggatcatggactttctctgatcaggatcatggttggcaagtttctgattgcactgctgaaggattaaagtgctgcctacttttttcaatgatgccaccagaaattgttggtgagaaaatggatgctcaacacttgtacaatgctgtcaacatccttatctctctacagagcaaaaatggaggtttagcagcatgggagcctgctggggctcaacaatggttggaaatgctgaatcccacagaattcttcgcagacatagtgatagaacatgaatatgtagagtgcacagcatctgcaatccatgcattgatcatgtttaagaaattatatccaggccatagaaagaaggagattgagaattttataacgaatgcagtcaaatacctggaagatgtacaaactgcagatgggggatggtatggaaactggggagtttgcttcacgtatgggacatggtttgcggtgggtggactggcagctgctggaaagaattataacaattgtgcagctatgcgcaaagctgttgattttcttctcagaactcaaaaacaagatggaggttggggagaaagctacctttcctgcccccacaagaaatatgtacctctcgaagacaatcgatccaatttagtgcatacttcttgggcattgatgggcctaatttcagctgggcagatggatagagaccctacacctcttcaccgggctgcaaagctattaatcaactcccaattggaagatggtgattttcctcagcaggagataacgggtgtgttcatgaagaattgcatgttacactatgcagcatacagaaacatatacccattatgggctctggctgaataccggaatagagttccattgccttccactactctttaa

SEQ ID NO: 4346 - protein, 762 aa, Euphorbia tirucalli
MWKLKIAEGGNDEYLYSTNNYVGRQTWVFDPQPPTPQELAQVQQARLNFYNNRYHVKPSSDLLWRFQFLREKNFKQTIPQAKINEGEDITYEKATTALRRAVHFFSALQASDGHWPAENAGPLFFLPPLVMCLYITGHLDTVFPAPHRLEILRYIYCHQNEDGGWGLHIEGHSTMFCTVLSYICMRLLGEGPNGGQDNACSRARKWIIDHGGATYIPSWGKTWLSILGVYEWSGSNPMPPEFWILPTFLPMHPAKMWCYCRMVYMPMSYLYGKRFVGPITPLILQLRQELHTQPYHHINWTKTRHLCAHEDVYYPHPLIQDLMWDSLYIFTEPLLTRWPFNKIIRKKALEVTMKHIHYEDENSRYITIGCVEKVLCMLACWAEDPNGVPFKKHLARIPDYMWVAEDGMKMQSFGSQQWDTGFAIQALLASNLTEEIGQVLKKGHDFIKKSQVKENPSGDFKSMHRHISKGSWTFSDQDHGWQVSDCTAEGLKCCLLFSMMPPEIVGEKMDAQHLYNAVNILISLQSKNGGLAAWEPAGAQQWLEMLNPTEFFADIVIEHEYVECTASAIHALIMFKKLYPGHRKKEIENFITNAVKYLEDVQTADGGWYGNWGVCFTYGTWFAVGGLAAAGKNYNNCAAMRKAVDFLLRTQKQDGGWGESYLSCPHKKYVPLEDNRSNLVHTSWALMGLISAGQMDRDPTPLHRAAKLLINSQLEDGDFPQQEITGVFMKNCMLHYAAYRNIYPLWALAEYRNRVPLPSTTL

SEQ ID NO: 4347 - DNA, 2851 bp, Rattus norvegicus
  CDS (42)..(2243)
ggtaaagggctggccggccggtggtccagagctgtgctgtcatgaccgagggcacgtgtctgcggcgtcgtgggggaccctataaaactgagcccgccaccgatctcacccgctggcggctccataatgagttgggtcggcagagatggacttattatcaagcggaggaggaccctggtcgagaacagacggggctagaggcccactctttgggactggacacaacaagttatttcaagaacttacctaaagctcaaacagcccatgagggggccctgaacggagtaaccttttatgccaagctgcaggctgaggatggacactgggctggtgattatggtggtccactcttcctcttgccaggtctcctgattacgtgtcacatagcacacatccccctgccggctggatacagagaggaaatggtacggtacttgcgctcagtgcagcttcccaatggcggctggggcttgcacattgaggacaagtccacggtgtttgggactgccctgagctatgtgtctctcagaatcctgggtattggacctgatgatcctgaccttgtgcgtgctcggaacattcttcacaaaaaaggtggtgcagtggccatcccttcctgggggaagttctggctggctgtcctgaatgtttacagctgggaaggaatcaataccctcttccctgagatgtggctgcttcctgaatggtttcctgcacatccctccactctgtggtgtcactgccggcaggtctatctgcccatgagctactgctacgccactcggctaagtgcctcagaggacccactggttcagagcctccgccaggaactctatgtggaggattatgccagcatcgattggccagcacagaagaacaacgtgtgccccgatgacatgtacacgccacacagctggctgctgcacgtggtatatggactcctcaacctgtatgaacgtttccacagtaccagcctgcggaagtgggccatccagttgctgtatgaacatgtcgcagctgatgatcggttcacgaaatgcatcagcattggcccgatctcaaaaactgtcaacatgcttattcgttggtcagtggacggaccatcctcccctgccttccaggagcacgtctcgaggatcaaagattatctttggctgggccttgacggcatgaaaatgcagggcaccaatggatcacagacctgggacacttcatttgctgtccaagccctgctggaggcaggtgcacaccgaagacctgagtttttgccctgcctgcagaaggctcacgagttcctgcggctttcccaggtcccagacaacaatcctgactaccagaagtattatcgccatatgcacaagggtggtttccccttcagcacactggactgtggctggatcgttgctgactgcacggccgaggctttgaaggctgtgctgctcctgcaggagcggtgtccctcaatcaccgagcatgtcccccgagagcgactctacgatgctgtggctgtgttgttgagcatgaggaattccgatggagggtttgctacctatgagactaagcgtggcgggtatttgctggagctgctgaacccctcagaggtctttggagacatcatgattgactacacgtatgtagagtgtacctccgcagtgatgcaggccctgaggcacttccgcgagtacttcccagaccacagggctacagagatcagggagaccctcaatcaaggcctggacttctgccgaaagaagcagagagcggatggctcgtgggagggctcctggggggtttgcttcacctatggcacctggtttggcttggaagcattcgcttgcatgggacatatctaccaaaataggactgcttgtgcagaagtagctcaggcctgccacttcctcctgtcgcggcagatggcggatgggggctggggggaggactttgagtcctgtgagcagcggcggtacgtgcagagtgccgggtcccaggtccatagtacgtgctgggccctgctgggtttgatggctgtcaggcatcccgacatctctgctcaggagagaggaatcagatgtctgctagggaaacagctccccaacggagactggcctcaggagaacatctctggggtcttcaacaagtcctgtgccatcagctacacaaattacagaaacatcttccccatctgggccctgggccgcttctccagcctgtatcctgacaatacccttgctggccacatttgagcatgtgtgcgcctgtgcggcacctggccagcgtcagcactgtacaggcccaggcagcccggtttctcagctgggtgataagcgtcctcctagcccactttggcatggttctctatttctgtagacatgaggctggggatagggtcagagtcggtgtctagacactgggcagcatgcgctcggttctgacgctagcttcagtgaggaagggaagaagttgagcttgagatccagagaggcacagtgtactccgaggctcctgggtgtcctccttgagggaacaagactgtagagctttcatgatcagtgacttccctgtgagggagcagctggcttcttcacttcctcccttgttgactgtggagtgggccccgtggtgcaggcatgctcagagaaaggctcaatggaggaggcaggccccttgctcattgtgtcctgagcagtgtctgttgtcccaggcacttacccatgactgcatcactgcacgaaataccagttttccagaaaggaagtacaaactcgctctgtactaaaaatgctactaaaagtcgtttgaatgatcaccaactcccttaataaacagacccctgatggcccagtagtaaaca

SEQ ID NO: 4348 - protein, 733 aa, Rattus norvegicus
MTEGTCLRRRGGPYKTEPATDLTRWRLHNELGRQRWTYYQAEEDPGREQTGLEAHSLGLDTTSYFKNLPKAQTAHEGALNGVTFYAKLQAEDGHWAGDYGGPLFLLPGLLITCHIAHIPLPAGYREEMVRYLRSVQLPNGGWGLHIEDKSTVFGTALSYVSLRILGIGPDDPDLVRARNILHKKGGAVAIPSWGKFWLAVLNVYSWEGINTLFPEMWLLPEWFPAHPSTLWCHCRQVYLPMSYCYATRLSASEDPLVQSLRQELYVEDYASIDWPAQKNNVCPDDMYTPHSWLLHVVYGLLNLYERFHSTSLRKWAIQLLYEHVAADDRFTKCISIGPISKTVNMLIRWSVDGPSSPAFQEHVSRIKDYLWLGLDGMKMQGTNGSQTWDTSFAVQALLEAGAHRRPEFLPCLQKAHEFLRLSQVPDNNPDYQKYYRHMHKGGFPFSTLDCGWIVADCTAEALKAVLLLQERCPSITEHVPRERLYDAVAVLLSMRNSDGGFATYETKRGGYLLELLNPSEVFGDIMIDYTYVECTSAVMQALRHFREYFPDHRATEIRETLNQGLDFCRKKQRADGSWEGSWGVCFTYGTWFGLEAFACMGHIYQNRTACAEVAQACHFLLSRQMADGGWGEDFESCEQRRYVQSAGSQVHSTCWALLGLMAVRHPDISAQERGIRCLLGKQLPNGDWPQENISGVFNKSCAISYTNYRNIFPIWALGRFSSLYPDNTLAGHI

SEQ ID NO: 4349 - DNA, 2409 bp, Cucurbita pepo
  CDS (26)..(2305)
aaaaccctccttgctacacacccacatgtggaccctcaaattctccaaaggctgggagaccagcgacaacgctcatttagggcgccagttttgggagttcgacccaaatctccagccctctcttgaagaacaagctcgagttcataatgtctgcaatgatttctatacccaccgctttcaagccaagcacagctctgatctcttaatgagacttcagttgaagaaggcgaatgggagtgaggtgaagctgccaactcaagtgaagcttagaagtgaagaggaaatgagtgaagaagcagtggaaaccacgttgagaagggctatcagattctactcaactatgcagacacaagatggcttctggcctggtgactatgctggccctttgtttcttcttcctggcctggtgattgggttaagcgtaacgaaggctctagataccgtcttgtcgcgccaccatcaacaagagatgcgtcgctacctttacaatcaccaaaatgaagatggagggtggggattgcatatagaagggaacagcacaatgctctgtacagctctatcctacgtgagcttgagattattgggagaggaaatggacggttgcgatggagccttgcgtcaagcaagaagatggattcttgatcgaggtggggccacctcaatcccctcttggggaaaactctggctttccgtccttggagtatacgagtgggaaggaaacaatccacttccaccagagatatggctcttgccttattttcttccattacatccaggacgaatgtggtgtcatagtcgaatggtatatttaccaatgtcatacttgtatggaaagagatttgtgggtccaattagccccataatcacgagcctcaggcaagagctttacacgagtccttatcacatgattgattggaatctttctcgaagcctctgtgctaaggaagatttgtacacgccacattcgaagatacaagacatgttatgggattcaattcacaagcttggtgaaccattattgaagaaatggccactctcaaagctaaggcaaaaggctcttgactttgtgataaaacacatccactatgaagatgaaaacactcactatctttgccttggacctgttagcaaggtggtaaacatggtgtgttgttgggatgaggatccaaactcagaagcctttacaagacacatttcaagaatcaaagactacctctggctagctgaggacggaatgaaaatgcagggatatcacgggtctcaattatgggacgtagcatttgccattcaagccatagttgcaacggatctagtcgaggaatacggttcggtgcttaagaaagcgcacgatttcgtcaaaaactcacaagtgaggagaaatgggtttggagatgatgatccaagtgattggtaccgccacaactcaaagggtggctggcccttctcaactccggacaatgcttggcctgtctctgactgcacttctgaagctttaaaggtagccattatgatgtcacaaatgccaccaacaatggtgggtgagccaatggatattcgtaaattatacgatgcggttgatctgatcctttcacttcagaattccaatggaggatttgcttcatatgaactcacaagatcccatccatggttggagacgttgaatccagctgaaatattcggagatgtgatgatcgactatcaatatgtggagtgcagttcagcagccatagaaaggctcaaagcattcatgaagctccatccaagctaccgcaagaaagagattcaagcttgcatggccaaagcagcagatttcatagaaaccattcagcagcctgatggatcctggtatggctcatgggggatttgctatacatatgggacatggtttggcatcaaagggttagttgcttgtggaagaacctatgagaatagtaaaaccctaaggaaggctactcatttccttctttctaaacaactcaaatccggcggttggggcgagagctacctctccgctcataacaaggtatacactgatctcaaaaatggcaaatcacacatagtcaacacttcttgggccctattggctctcattaaagccggccaggctcaaagagacccatctccgctgcatcaagcagcaacggttctgattaattcgcaactcgacaatggagatttccctcaacaggaaattattggagtattcaacaagagttgtacgatcagttactcggcctatagaaacatatttcctatatgggctcttggagagtatcagttaaaggttctgaaacgtcaagaatagccatacctaaatatttctattgcaagtgtttttattataatataaagaaataaaaattgtaaatattttataagcacaaacattaatataaaaaaaaaaaaaaa

SEQ ID NO: 4350 - protein, 759 aa, Cucurbita pepo
MWTLKFSKGWETSDNAHLGRQFWEFDPNLQPSLEEQARVHNVCNDFYTHRFQAKHSSDLLMRLQLKKANGSEVKLPTQVKLRSEEEMSEEAVETTLRRAIRFYSTMQTQDGFWPGDYAGPLFLLPGLVIGLSVTKALDTVLSRHHQQEMRRYLYNHQNEDGGWGLHIEGNSTMLCTALSYVSLRLLGEEMDGCDGALRQARRWILDRGGATSIPSWGKLWLSVLGVYEWEGNNPLPPEIWLLPYFLPLHPGRMWCHSRMVYLPMSYLYGKRFVGPISPIITSLRQELYTSPYHMIDWNLSRSLCAKEDLYTPHSKIQDMLWDSIHKLGEPLLKKWPLSKLRQKALDFVIKHIHYEDENTHYLCLGPVSKVVNMVCCWDEDPNSEAFTRHISRIKDYLWLAEDGMKMQGYHGSQLWDVAFAIQAIVATDLVEEYGSVLKKAHDFVKNSQVRRNGFGDDDPSDWYRHNSKGGWPFSTPDNAWPVSDCTSEALKVAIMMSQMPPTMVGEPMDIRKLYDAVDLILSLQNSNGGFASYELTRSHPWLETLNPAEIFGDVMIDYQYVECSSAAIERLKAFMKLHPSYRKKEIQACMAKAADFIETIQQPDGSWYGSWGICYTYGTWFGIKGLVACGRTYENSKTLRKATHFLLSKQLKSGGWGESYLSAHNKVYTDLKNGKSHIVNTSWALLALIKAGQAQRDPSPLHQAATVLINSQLDNGDFPQQEIIGVFNKSCTISYSAYRNIFPIWALGEYQLKVLKRQE

SEQ ID NO: 4351 - DNA, 2444 bp, Cucurbita pepo
  CDS (21)..(2315)
gaggaagaaaattagataatatgtggaggctgaaggtgggagcagagagcgttggggaggaggatgagaaatgggtgaagagcgtaagcaatcacttgggccgccaagtttgggagttctgtgccgacgccgccgccgacactcctcaccagttactacaaattcagaatgctcgcaaccacttccatcacaatcgtttccaccggaagcagtcttccgatctctttctggctattcaatatgaaaaggaaatagcaaagggcgcaaaaggtggagcggtgaaagtgaaagaaggggaggaggtggggaaagaggcggtgaagagtacgttagaaagggcactcggtttctactcggccgtgcagacaagagatgggaattgggcctcggatcttggagggcccttgtttttacttccgggtctcgtgattgcccttcatgtcacaggcgtcttgaattcagttttgtccaagcaccaccgcgtagagatgtgcagatatctttacaatcaccagaatgaagatggagggtggggtctacatattgagggcacaagcaccatgtttggttcggcactgaattacgttgcactaaggctgcttggagaagacgccgatggcggagacggtggcgcaatgacaaaagcacgtgcttggatcttggagcgcggcggcgccactgcgatcacttcgtggggaaaattgtggctgtccgtacttggagtgtacgaatggagtggcaacaaccctcttccgcctgagttttggcttctcccttacagcctaccatttcatccaggaagaatgtggtgccattgtcgaatggtttatcttccaatgtcttacttatatgggaagagatttgttgggccaatcactcccaaagttctttctctaaggcaagagctctacacaattccttatcatgaaatagactggaataaatcccgcaatacatgtgcaaaggaggatctgtactatccacatcccaagatgcaagacattctatggggatccatctaccatgtatatgagccattgttcactcgttggcctgggaaacgcctgagggaaaaggctttacaagctgcaatgaaacatattcactatgaagatgaaaatagtcgatatatatgtcttggcccagtcaacaaggtactcaacatgctttgttgttgggttgaagatccctactcagacgccttcaaacttcaccttcaacgcgtccatgactatctctgggttgctgaagatggcatgagaatgcagggctacaatggcagccagttgtgggacactgctttctccatccaagccatcgtagccaccaaacttgtagacagctatgccccaactttaagaaaagcacatgactttgttaaggattctcagatccaggaggactgtcctggggatcctaatgtttggttccgtcatattcataaaggtgcttggccactttcgacacgagatcatggatggctcatctccgactgtacagctgagggattgaaggcttctttgatgttatccaaacttccatccacaatggttggggagccattagaaaagaatcgcctttgtgatgctgttaatgttctcctttctttgcaaaatgataatggtggatttgcatcatacgagttgacgagatcatacccttggttggagttgatcaacccagctgaaacattcggagacattgtcattgactatccgtatgtggagtgcaccgcagcaacaatggaagcactgacgttatttaagaagctacatccaggccataggaccaaagagattgacacagctattggcaaggcagccaacttccttgagaaaatgcagagggcggatggctcttggtacgggtgttggggggtttgttttacgtatgcgggttggtttggcataaagggattggtggctgcaggaagaacatataatagctgccttgccattcgcaaggcttgtgagtttctgctatctaaagagctgcccggcggtggatggggggagagttacctttcatgtcagaataaggtgtacaccaatcttgaggggaacaagccacacttggttaacactgcctgggttttaatggctctcattgaagctggccagggtgagagagacccagcaccattgcaccgtgcagcaaggttgctaatgaattcccaattggagaatggcgatttcgtgcaacaggagatcatgggagtgttcaataagaactgcatgatcacatatgctgcataccgaaacatcttccccatttgggcgcttggagagtattgccatcgggttcttactgaatgatgtgcactgcttcaacattatgatgtataatataatgtatcacatcctttcttcatcttattatcatcgccatcatctatatataataagcaaaccattgttttgccaacgaaaaaaaaaaaaaaaaaa

SEQ ID NO: 4352 - protein, 764 aa, Cucurbita pepo
MWRLKVGAESVGEEDEKWVKSVSNHLGRQVWEFCADAAADTPHQLLQIQNARNHFHHNRFHRKQSSDLFLAIQYEKEIAKGAKGGAVKVKEGEEVGKEAVKSTLERALGFYSAVQTRDGNWASDLGGPLFLLPGLVIALHVTGVLNSVLSKHHRVEMCRYLYNHQNEDGGWGLHIEGTSTMFGSALNYVALRLLGEDADGGDGGAMTKARAWILERGGATAITSWGKLWLSVLGVYEWSGNNPLPPEFWLLPYSLPFHPGRMWCHCRMVYLPMSYLYGKRFVGPITPKVLSLRQELYTIPYHEIDWNKSRNTCAKEDLYYPHPKMQDILWGSIYHVYEPLFTRWPGKRLREKALQAAMKHIHYEDENSRYICLGPVNKVLNMLCCWVEDPYSDAFKLHLQRVHDYLWVAEDGMRMQGYNGSQLWDTAFSIQAIVATKLVDSYAPTLRKAHDFVKDSQIQEDCPGDPNVWFRHIHKGAWPLSTRDHGWLISDCTAEGLKASLMLSKLPSTMVGEPLEKNRLCDAVNVLLSLQNDNGGFASYELTRSYPWLELINPAETFGDIVIDYPYVECTAATMEALTLFKKLHPGHRTKEIDTAIGKAANFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQGERDPAPLHRAARLLMNSQLENGDFVQQEIMGVFNKNCMITYAAYRNIFPIWALGEYCHRVLTE

SEQ ID NO: 4353 - DNA, 2556 bp, Cucurbita pepo
  CDS (123)..(2423)
  misc_feature (548)..(548): w is a or t
gaaacggcatcgaagttgagggagatacaacactgggagtgagtggcttggtgaagcactgaatggattcttcttcataaatagaattcaacaaccaaaattcttttgcaaaccaaaccagaatgtggcagctcaagattggggcagatacagtgccttccgatccttccaatgccggcggatggctttcaactctcaacaaccacgtcggccgccaagtttggcattttcatcccgaactcggctccccggaggatcttcagcaaatacaacaggctcgtcagcacttctccgatcacagattcgagaagaagcatagtgctgatctcctcatgcgaatgcagtttgcgaaggagaattcgtcctttgtgaatctaccgcaagtcaaagttaaagataaagaagacgtgacagaggaagcagtaacgcgcactctaagaagggctatcaatttttattcaacaatccaggcagatgacggtcattggcctggtgattatggcggcccaatgtttctaattcctggtttggtcattactctttccatwactggcgccttgaatgcggtcttatctacagaacaccagcgtgagatttgcagatatctgtacaatcatcagaataaagatgggggttggggtttacatattgagggcccaagcacaatgttcggatctgtgttgaattatgttactttgagattgcttggtgaagaagctgaagatgggcagggtgctgtggacaaagcacggaaatggatcttggaccatggtggtgcagctgcgattacttcttgggggaaaatgtggctttcagtacttggagtatatgaatgggctggaaataatccacttcctccagagctatggctcttgccttatcttctcccttgtcatccaggaaggatgtggtgtcactgtcgaatggtatacttgcctatgtgttatctgtatggcaagagatttgttggtcctataacgcctataattagatctttaaggaaggaactttatcttgttccttatcatgaagttgattggaataaggctcgaaatcaatgtgcaaaggaagatctatattacccacatccgctggttcaggatattctgtgggctacgctgcaccatgtctatgagcctctttttatgcattggcctgcaaaaagattgagggagaaggctttgcagagtgtaatgcagcatatccactatgaagatgaaaatactcggtatatatgcatagggcctgtcaacaaggtgttaaacatgctttgctgttgggcggaagatccacattcagaggcattcaaattgcatattcctagaatctatgactatctgtggattgctgaagatggcatgaaaatgcagggttataatggaagtcaattatgggatactgcatttgctgttcaagccatcatttcaactgagctcgctgaagaatatgagacaactttaagaaaggcgcacaagtatataaaagactcccaggtcttagaagattgtcctggagatttacaaagttggtaccgtcatatttcaaaaggtgcatggccattttcaactgcggatcacggatggcccatctctgactgcactgctgaaggtttgaaggctgttcttttattgtcaaaacttccttcagaaatagtagggaagtcaattgatgaacaacagctatacaacgcagtaaatgtcatcctgtccttacagaatactgatggtggctttgcaacttatgagttgaccaggtcatatcggtggctggagctaatgaaccctgctgaaacttttggcgatattgtcattgactacccatatgtcgagtgttcctcagcagcgattcaagcacttgcagcattcaagaaattatatccaggtcatagaagggatgaaattgataattgtattgctgaagctgcggacttcattgaaagtatacaagcaactgatggatcttggtatggatcttggggagtctgcttcacctatggtggttggttcgggataagggggctggtcgctgctggaaggagatacaataactgttctagccttcgtaaagcttgtgatttcctgttgtccaaagagcttgctgccggtggctggggagaaagttacctttcctgccagaataaggtgtacacaaatattaaagatgacaggccacatattgtcaatactggttgggctatgttatccctcatcgatgctgggcagtctgagagagatccaacaccattacaccgtgcagcaagggtattaattaattctcagatggaagacggagattttcctcaagaggagatcatgggagtctttaacaagaactgcatgattagctattcagcataccgtaacattttccctatatgggcccttggggaataccgtagccgggtactgaaaccccttaaatagtatgtattgctaccattgtgtcagtcattcataacagcatttacagcttgtttcagattcctatggtttcttcaactcttctaaattcaatcagatgaaccaatgtttctttattaaaaaaaaaaaaaaaaaa

SEQ ID NO: 4354 - protein, 766 aa, Cucurbita pepo
MWQLKIGADTVPSDPSNAGGWLSTLNNHVGRQVWHFHPELGSPEDLQQIQQARQHFSDHRFEKKHSADLLMRMQFAKENSSFVNLPQVKVKDKEDVTEEAVTRTLRRAINFYSTIQADDGHWPGDYGGPMFLIPGLVITLSITGALNAVLSTEHQREICRYLYNHQNKDGGWGLHIEGPSTMFGSVLNYVTLRLLGEEAEDGQGAVDKARKWILDHGGAAAITSWGKMWLSVLGVYEWAGNNPLPPELWLLPYLLPCHPGRMWCHCRMVYLPMCYLYGKRFVGPITPIIRSLRKELYLVPYHEVDWNKARNQCAKEDLYYPHPLVQDILWATLHHVYEPLFMHWPAKRLREKALQSVMQHIHYEDENTRYICIGPVNKVLNMLCCWAEDPHSEAFKLHIPRIYDYLWIAEDGMKMQGYNGSQLWDTAFAVQAIISTELAEEYETTLRKAHKYIKDSQVLEDCPGDLQSWYRHISKGAWPFSTADHGWPISDCTAEGLKAVLLLSKLPSEIVGKSIDEQQLYNAVNVILSLQNTDGGFATYELTRSYRWLELMNPAETFGDIVIDYPYVECSSAAIQALAAFKKLYPGHRRDEIDNCIAEAADFIESIQATDGSWYGSWGVCFTYGGWFGIRGLVAAGRRYNNCSSLRKACDFLLSKELAAGGWGESYLSCQNKVYTNIKDDRPHIVNTGWAMLSLIDAGQSERDPTPLHRAARVLINSQMEDGDFPQEEIMGVFNKNCMISYSAYRNIFPIWALGEYRSRVLKPLK

SEQ ID NO: 4355 - DNA, 2190 bp, Debaryomyces hansenii CBS767
  CDS (1)..(2190)
atgtactattctgaagaattgggagtcgagcaaacagatccccatcgttggagacttgtgactgatgaattgggcagagaaacatggcactacttgagtattgaagaaagtgaaaaaaatccccaatcggactatgttaagtatttactagagctagatgacttcccagcgcctgaggagtcggatattaacacgccatttgagtctgcaaagaaaggagctgattttcttgagttattacaggaaccaagcggaatgttcccgtgtcagtaccgtgggcccatgttcatgagcattgggtacatagctgcaaactatttcaccaagaacgagattcctaagccctataggacggaaatgataagatatcttgtgaatacgtcgcatcctgttgatgggggttggggtttgcattcgatagacaaatctacgtgtttcggaacctccatgaactatgtggcattgagattgcttggattgccggccaatcatcctgtgtgtgtgaaagcccgtaagacgttacatagactcggaggagctttaggtaatcctcattggggtaaagcgtggttatcgatcttgagcctttacgaatgggaaggtgttaatccagcaccaccagaaatgtggctcttaccatacaatgtcccaattcatcctggcagatggtgggttcataccagagctatttatttacctcttggctacgtttcttcatacaaagtgaaatgtgacctagatcctttgttgcaggagattagaaatgagatctatttgccaaaacagttgccctatgagaaaatcgacttccagactcacagaaataatgtttgtggagttgacttgtattacccccataccactgtattagactgtcttaactggggtatggtaaagtacgagaaatacatcaggcccaaatggctccttaaaaagtcgaacgatagggtctacgaactaattaaaaaagaatgtgcaaatactgattatctatgcattgctcccgtgagttttgcttttaatatgatcataaccttccttgaagagggacctaagtcatacgcgtttgaacgattcaaatatagaatgaacgatacgttgtttcatgggcctcaaggtatgactattatgggtactaacggtgtccaagtttgggatgtggcctttatggttcaatatttcttcatggctggattatcagaattcccgaaataccaagaaatgatccgtaagggttacaagtttttggtcagatcacagttcactgaggattgtgtcgatggaagtttccgagataaacgtaaaggtggctggccatttagtactaaaacgcaaggctatactgtgagtgattgttctgctgaagctttaaaggccataattatggtaaagaatcatccggcatttactgatatcaaggacgatatcgaagatgaaaacctttataatgcagttgatgttatattgaatattcaaaatgttaatgattttgaatttggttcgttttcttcttatgagactataagagctacgccactattagagaacttgaatcctgctgaagtttttaataagattatggttgaatatccttatgtggaatgcacggattcgtcggtcttaggtttgacttactttgctagattctatccaaattacaaacctgatcaaattaagtttgcaattgaaaatgcaataaactatataataaaggcccaggctaaggatggttcgtggtatggttcttggggtatatgctatacatacgcctctatgtttgcccttgaagcattaaattccgttggatacagttacgttaattccgatactgtaagaaaagggtgtgacttcttagtatcgaaacaattggctgatggtgggtggtctgaatctatgaaatcgtgtgaaaccggtacgtatgtcaatacagagcaatcattagttgttcaaacttcgtgggccttgataggattaatattagcagactacccaaataaagaagctattgaaagaggtcttgcattattaatgagtagacaaaagcggactggtgaatggaaatttgaagacatgaacggtgttttcaatcatagttgtgctattgaatatgattcatataaatttttattccctatcaaagcattgggattatataaaagtaaatatggtgacacacatttgaatatttag

SEQ ID NO: 4356 - protein, 729 aa, Debaryomyces hansenii CBS767
MYYSEELGVEQTDPHRWRLVTDELGRETWHYLSIEESEKNPQSDYVKYLLELDDFPAPEESDINTPFESAKKGADFLELLQEPSGMFPCQYRGPMFMSIGYIAANYFTKNEIPKPYRTEMIRYLVNTSHPVDGGWGLHSIDKSTCFGTSMNYVALRLLGLPANHPVCVKARKTLHRLGGALGNPHWGKAWLSILSLYEWEGVNPAPPEMWLLPYNVPIHPGRWWVHTRAIYLPLGYVSSYKVKCDLDPLLQEIRNEIYLPKQLPYEKIDFQTHRNNVCGVDLYYPHTTVLDCLNWGMVKYEKYIRPKWLLKKSNDRVYELIKKECANTDYLCIAPVSFAFNMIITFLEEGPKSYAFERFKYRMNDTLFHGPQGMTIMGTNGVQVWDVAFMVQYFFMAGLSEFPKYQEMIRKGYKFLVRSQFTEDCVDGSFRDKRKGGWPFSTKTQGYTVSDCSAEALKAIIMVKNHPAFTDIKDDIEDENLYNAVDVILNIQNVNDFEFGSFSSYETIRATPLLENLNPAEVFNKIMVEYPYVECTDSSVLGLTYFARFYPNYKPDQIKFAIENAINYIIKAQAKDGSWYGSWGICYTYASMFALEALNSVGYSYVNSDTVRKGCDFLVSKQLADGGWSESMKSCETGTYVNTEQSLVVQTSWALIGLILADYPNKEAIERGLALLMSRQKRTGEWKFEDMNGVFNHSCAIEYDSYKFLFPIKALGLYKSKYGDTHLNI

SEQ ID NO: 4357 - DNA, 2229 bp, Yarrowia lipolytica CLIB99
  CDS (1)..(2229)
atgggaatccacgaaagtgtgtcgaaacagtttgcgaaaaacggacattccaagtaccgcagcgaccgatacggcttacctaagacggatctgcgacgatggacgttccacgcgtccgatctgggggcgcaatggtggaagtatgacgataccacaccgctggaagagctggaaaagagggctaccgactacgtcaaatactcgctggagctgccgggatacgcgcccgtgactctggactccaagcccgtgaaaaatgcctacgaagcggctctcaaaaactggcatctgtttgcgtcgctgcaagaccccgactccggcgcgtggcagagcgaatacgacggaccgcagttcatgagcatcggctatgtgacggcgtgctactttggcggcaacgagatccccacgccggtcaaaaccgaaatgatcagatacattgtcaacacagcccacccagttgacggaggctggggccttcacaaagaagacaagagcacctgcttcggtaccagcatcaactacgtggtcctgcgactactgggcctgtcacgggaccatccggtctgcgtcaaggcgcgcaaaacgctgctcaccaagtttggcggcgccatcaacaacccccattggggcaagacctggctgtcgattctcaatctctacaaatgggagggtgtgaatccggcccctggcgagctctggctgttgccctactttgttcctgttcatccgggccgatggtgggtccatacccggtggatctaccttgccatgggctatctggaggctgcggaggcccaatgcgaactcactccgttgctggaggagctccgagacgaaatctacaaaaagccctactcggagattgatttctccaaacattgcaactccatctccggagtcgacctctactatccccacaccggccttttgaagtttggcaacgcgcttctccgacgataccgcaagttcagaccgcagtggatcaaagaaaaggtcaaggaggaaatttacaacttgtgccttcgagaggtttccaacacacgacacttgtgtctcgctcccgtcaacaatgccatgacctccattgtcatgtatctccatgaggggcccgattcggcgaattacaaaaagattgcggcccgatggcccgaatttctgtctctgaatccgtcgggaatgtttatgaacggcaccaacggtctccaggtctgggatactgcgtttgccgtgcaatacgcgtgtgtttgtggctttgccgaacttccccagtaccagaagacgatccgagcggcgtttgattttctcgatcggtcccagatcaacgagccgacggaggaaaattcctatcgagacgaccgcgtcggaggatggccctttagtaccaagacccaggggtatccggtctccgactgtactgccgaggctctcaaggccatcatcatggtccagaatacgcctggatacgaggatctgaagaaacaagtgtctgacaagcggaaacacactgccatcgatctacttttgggaatgcagaacgtgggctcgtttgaaccgggctctttcgcctcctatgagcctatccgggcgtcgtccatgctggagaagatcaatccggccgaggtgtttggaaacatcatggtggagtatccgtacgtggaatgcactgattctgttgttctgggtctctcctactttcgaaagtaccacgattaccgcaacgaagacgtggaccgagccatctctgctgccattggatacattattcgagagcagcagcctgacggcggcttctttggctcctggggcgtgtgctactgctacgctcacatgtttgccatggaggctctggagacgcagaatctcaactataacaactgttccacggttcaaaaggcgtgcgactttctggcgggctaccaggaagcagatggaggctgggccgaggactttaagtcgtgcgagacccagatgtacgtgcgcggaccccattcgctggtcgtgcctactgccatggccctgttgagtttgatgagtggtcggtatccccaggaggacaagattcatgctgcggcccggtttctcatgagcaagcagatgagcaacggtgagtggctcaaggaggagatggagggggtgtttaaccatacttgtgccattgagtatcccaactaccggttttattttgtcatgaaggctttggggttgtatttcaagggatattgccagtga

SEQ ID NO: 4358 - protein, 742 aa, Yarrowia lipolytica CLIB99
MGIHESVSKQFAKNGHSKYRSDRYGLPKTDLRRWTFHASDLGAQWWKYDDTTPLEELEKRATDYVKYSLELPGYAPVTLDSKPVKNAYEAALKNWHLFASLQDPDSGAWQSEYDGPQFMSIGYVTACYFGGNEIPTPVKTEMIRYIVNTAHPVDGGWGLHKEDKSTCFGTSINYVVLRLLGLSRDHPVCVKARKTLLTKFGGAINNPHWGKTWLSILNLYKWEGVNPAPGELWLLPYFVPVHPGRWWVHTRWIYLAMGYLEAAEAQCELTPLLEELRDEIYKKPYSEIDFSKHCNSISGVDLYYPHTGLLKFGNALLRRYRKFRPQWIKEKVKEEIYNLCLREVSNTRHLCLAPVNNAMTSIVMYLHEGPDSANYKKIAARWPEFLSLNPSGMFMNGTNGLQVWDTAFAVQYACVCGFAELPQYQKTIRAAFDFLDRSQINEPTEENSYRDDRVGGWPFSTKTQGYPVSDCTAEALKAIIMVQNTPGYEDLKKQVSDKRKHTAIDLLLGMQNVGSFEPGSFASYEPIRASSMLEKINPAEVFGNIMVEYPYVECTDSVVLGLSYFRKYHDYRNEDVDRAISAAIGYIIREQQPDGGFFGSWGVCYCYAHMFAMEALETQNLNYNNCSTVQKACDFLAGYQEADGGWAEDFKSCETQMYVRGPHSLVVPTAMALLSLMSGRYPQEDKIHAAARFLMSKQMSNGEWLKEEMEGVFNHTCAIEYPNYRFYFVMKALGLYFKGYCQ

SEQ ID NO: 4359 - DNA, 2196 bp, Kluyveromyces lactis NRRL Y
  CDS (1)..(2196)
atgccagaactttattctgaaactattggattgcccaggacggatccaaaacgttggaggctcatcacagatgacttgggaagacaaacatgggaatatttaagtgagaatgatagcaagaaagttccgcaatcaacttttgcacgatggctattgaaatgtgaagattttccagaaccgcacccagagattaatagcaagacatcaggttttactgcttggaacgctgcacataacggtgcaaaattctttgaacttttgcaggaccctgattctggaacattcccatgccagtataagggtccaatgttcatgacaattgggtatgttgtgacgatgtatattgccaagattgaaatacctgagcatgagaaagctgaaatgattaggtacgttgccaactatgcacacccagtcgatgggggatggggtttgcatcatgtcgataagtcaactgttttgggtactgtactaaattatgtcatgatgagattgttaggtttacccaaggatcacgaagtttgtgttagagcaagggacactttactcaggttaggaggtgccattgcgtctcctcattgggccaagatatggttgtcaatcttaaatttgtataaatgggagggtgtcaacccagccccaccagaattatggatgttgccatacggattaaatattcatccagcaagatggtgggttcatacaagaggtatttatcttccggtgagttatttgtcaagtacccaatatagctgtgaacttgatcccttgttggaagaaattagaacggagatttacacccaaccgttcgagacaattgatttcaagaaacacagaaataccgtgtgcggtgttgatctatactatccacacacaaaagttttagacactatgaattacttcatatctaagtacgaaagatacgttagaccaaattggttgttgaaaaaatccactaatagagtatatgaacttgtcaagaaagaaattgcaaatacggattatctatgtattgcaccagttaataatgccttttgtgcaattgtgacattgattgaagaagggaaggattcggaagaatttggtagattcctttatagattcaaggacgtgttattccatggacctcagggcctaaccgttatggggaccaacggtgtccaagtttgggattgtgcattttacattcagtatatgtttatggcaggtttggctgaattgcccgaattccatgaaaccattgttagatcgtttaagttcttatgtcgctctcaatttactgaggattgtgttgaagggagtttcagagataaaaggttgggtgcttggccattttccacaaaaacccaaggatacaccgtttcagattgtacagcggaggcaatcaaagctatcataatggttcttaattccgacaaatatagagatgtctggggtgtatatgataccgaaaagttgaaaaacggcatagatgtccttttgggattgcaaaacttgtcatcatttgaatacggatccttcgctacatatgagaagatcaaagcgcccttactaatggaaaaattgaatccagcagaagtgtttggaaatatcatggttgaattcccatatgtggaatgtacagattcctcggtcctcggcttgacgtacttccgtcgctatttcaattatcggaaaaaggatatcgatcatgctattgattcagctattgcatatattaaaaagagtcagcagcctaatggttcttggtacggctgttggggtatttgttacacgtatgctggaatgttcgccttagaagcgctaaacacgattggagaaacgtatgagaatagcgaagttgttcgtaaagggtgtgacttctttgttactaaacagcttcctgatggtggttggtctgagaaaatgaaatctagtgaacttcacacatatgtatcggacaaagaatcttacgttgtacagactgcatgggtgctcattgggttgatattagcaaaattccctgacaaatcagttatcgatagggcaattaaccttttaaagcaaagacaacaaccgtcaggtgaatggaaatatgaagctgtggaaggtgttttcaatcattcatgtgccattgaatatccaagttacagatttttgttcccaataaaagctctcggtctatatgtaaaagaatacggccacagtgcaatttaa

SEQ ID NO: 4360 - protein, 731 aa, Kluyveromyces lactis NRRL Y
MPELYSETIGLPRTDPKRWRLITDDLGRQTWEYLSENDSKKVPQSTFARWLLKCEDFPEPHPEINSKTSGFTAWNAAHNGAKFFELLQDPDSGTFPCQYKGPMFMTIGYVVTMYIAKIEIPEHEKAEMIRYVANYAHPVDGGWGLHHVDKSTVLGTVLNYVMMRLLGLPKDHEVCVRARDTLLRLGGAIASPHWAKIWLSILNLYKWEGVNPAPPELWMLPYGLNIHPARWWVHTRGIYLPVSYLSSTQYSCELDPLLEEIRTEIYTQPFETIDFKKHRNTVCGVDLYYPHTKVLDTMNYFISKYERYVRPNWLLKKSTNRVYELVKKEIANTDYLCIAPVNNAFCAIVTLIEEGKDSEEFGRFLYRFKDVLFHGPQGLTVMGTNGVQVWDCAFYIQYMFMAGLAELPEFHETIVRSFKFLCRSQFTEDCVEGSFRDKRLGAWPFSTKTQGYTVSDCTAEAIKAIIMVLNSDKYRDVWGVYDTEKLKNGIDVLLGLQNLSSFEYGSFATYEKIKAPLLMEKLNPAEVFGNIMVEFPYVECTDSSVLGLTYFRRYFNYRKKDIDHAIDSAIAYIKKSQQPNGSWYGCWGICYTYAGMFALEALNTIGETYENSEVVRKGCDFFVTKQLPDGGWSEKMKSSELHTYVSDKESYVVQTAWVLIGLILAKFPDKSVIDRAINLLKQRQQPSGEWKYEAVEGVFNHSCAIEYPSYRFLFPIKALGLYVKEYGHSAI

SEQ ID NO: 4361 - DNA, 2202 bp, Candida glabrata CBS138
  CDS (1)..(2202)
atgactcagttttattctgataccgtcggtatacctagaactgatccgaaaagatggaggttaagaactactgaattgggtagagaagcttgggagtatattgaacaagacaaggttgatgcagacccgcaatccacatttgttcaatggttattacaagatgaggaattcccgacaccttcaccaagaaaagaaggtgatgacttaagctctgagcaagcttgttattatggagcatccttctataagcttcttcaggatcaaaagtcaggtattttcccatgccaatataaggggcctatgttcatgacaattgggtatgttgctgtcaattacattgctggcgttaaattaccagagcatgagagaatcgagctaattaggtacattgttaacactgcgcatcctgttgatggtggatggggtcttcactcagttgacaagtctactgtatttggtacagtcttgaactatgtctgtctaaggttgttgggactgccaaaggatcatatagtttgtgtgagagccagacatactctgcatagacttggaggagctactggtgcaccacactggggtaagatatggctaagcattttgaacttatataaatgggagggtgttaatccagctccccctgaaacttggctattaccttactcattgccaattcatcccggtagatggtgggtacacacaagagctgtttatttaccggtaagttacctttcattgattaagtactcatgtcctttaactgaccttctttcagagattaggcaggagatctatacaaagtcatttgataaaataaacttttctcaacacaggaatactgtgtgtggtgtggatttgtactatccacatagcaaaattctggacactgcaaatgatgtcattgtattttatgagaagtatttacgtcctagacttgtatcgatggcatccaagaaggtagtttacaatttgatcaagaaagagatacaaaatacagattctctatgtattgcaccagttaatcaagcattttgtgcattagtgacttatttagaagaagggaaagattcaaaggcttttgaacgatttcagtatagattcaaagatggcttattccatggcccacaaggtatgacagtaatgggtaccaatggtgtgcaaacttgggactgtgcttttatgatacaatatttctttgttgctggcttggctgagaaaccggaatttagagaaatgataataaatgcctataagtttttgtgtagatcacagttcgatacagaatgtgttgaaggaagttttagagacaaaagagttggtgcctgggggttctctaccaagacccaaggctatactgtgtctgactgtactgcggaagcaataaaggcaataattatggtgagaaactctcctgtattttcctctgtacatgatgagataactgatgaaaggctctgtaaaggtattgatgtgttattaagtctacaaaatattggtaagtttgaatacggttcatttgcgacttacgaaaagatcaaggctccgctttcgatggagaaattaaatcctgcagaagtattcgggaacattatggtcgagtacccatatgtcgagtgcacagactcgagcgttttgggtttgacgtatttccacaaatattatgattataggaaggacgagatatctcacagaatcaggattgccattgactacattaaacaggcacaacaagatgatggtgggtggtacggctgctggggtatttgcttcacatatgccggtatgtttgccatggaggcactgcactctgtaggagaaacctatgataattccttgacagtgagaaagggctgtgacttccttttgagcaaacagatgcctgatggtggttggggtgaatccatgaagtccagtgagctacatgactatgttgacagtccaaagtcattggtggtgcaaacggcatgggctttgatcgccctgttgttggctaagtgtccaaatgaagacgccattgagaggggtatcaacctgctaaagtccaggcagcaaccatcaggtgaatggaagttcgagagcgcggaaggtgtgttcaaccactcttgcgctatcgagtatccaagctataggttcctcttcccaataaaagctctgggactgtacaatggcagaaactacaccaactcatctcaaaatacacaataa

SEQ ID NO: 4362 - protein, 733 aa, Candida glabrata CBS138
MTQFYSDTVGIPRTDPKRWRLRTTELGREAWEYIEQDKVDADPQSTFVQWLLQDEEFPTPSPRKEGDDLSSEQACYYGASFYKLLQDQKSGIFPCQYKGPMFMTIGYVAVNYIAGVKLPEHERIELIRYIVNTAHPVDGGWGLHSVDKSTVFGTVLNYVCLRLLGLPKDHIVCVRARHTLHRLGGATGAPHWGKIWLSILNLYKWEGVNPAPPETWLLPYSLPIHPGRWWVHTRAVYLPVSYLSLIKYSCPLTDLLSEIRQEIYTKSFDKINFSQHRNTVCGVDLYYPHSKILDTANDVIVFYEKYLRPRLVSMASKKVVYNLIKKEIQNTDSLCIAPVNQAFCALVTYLEEGKDSKAFERFQYRFKDGLFHGPQGMTVMGTNGVQTWDCAFMIQYFFVAGLAEKPEFREMIINAYKFLCRSQFDTECVEGSFRDKRVGAWGFSTKTQGYTVSDCTAEAIKAIIMVRNSPVFSSVHDEITDERLCKGIDVLLSLQNIGKFEYGSFATYEKIKAPLSMEKLNPAEVFGNIMVEYPYVECTDSSVLGLTYFHKYYDYRKDEISHRIRIAIDYIKQAQQDDGGWYGCWGICFTYAGMFAMEALHSVGETYDNSLTVRKGCDFLLSKQMPDGGWGESMKSSELHDYVDSPKSLVVQTAWALIALLLAKCPNEDAIERGINLLKSRQQPSGEWKFESAEGVFNHSCAIEYPSYRFLFPIKALGLYNGRNYTNSSQNTQ

SEQ ID NO: 4363 - DNA, 2274 bp, Avena ventricosa
  CDS (1)..(2274)
atgtggaggctaacaataggtgagggagccggtgatccctggctcaagtccaacaacggcttcctcggccgccaagtgtggcactacgacgccgatgccggcacgcccgaagagcgtgccgaggttgagagggtgcgtgcggagttcacaaagaacaggttcaacaggaaggagtcacaggaccttcttctacgcttgcagtacgcaaaagccaaccctcttccggcgaatgttccgacagctaagcttgataagagtacagaggtcactcacgagactatacacgcttcgttgatgcgagctttacatcagtattccgctctacaagcagacgatggccactggcctggtgattacagtgggattctcttcattatgcctatcattatattctcattacatgttactagatcactggacacctttttatctacggaacatcgtcatgagatatgtcgctacatttacaatcaacagaacgaagatggtggttgggggaaaatggttcttggcccaagtactatgtttggatcgtgtatgacttatgcaaccttaatgcttcttggtgagaagcgagacggtgaacatgaggatgcattgacaaaagggcgttcctggattttatctcatggaactgcaactgcaataccacagtgggggaaaatatggttgtcgataattggcgtttacgattggtccggaaacaatcctattatacctgaattgtggttggttccacattttcttccgattcacccaggtcgattttggtgttttacccggttgatatacatgtcaatggcatatctttatggaaagaaatttgttgggcctattactccaacaatattagctctgcgacaagacctctatagtataccttacagcaacgttaattgggacaaggcgcgtgattattgtgcaaaggaggaccttcattatccacgctcacgggcacaagatcttataactggatgcctaacaaaaattgtggagccagttttgaattggtggccagcaaacaagctaagagatagagctttaagtaacctaatggagcatatccattatgatgacgaatcaacaaaatacgtgggcatttgccctattaacaaggcattgaacatgatttgttgttgggtagaaaacccaaattcagctgaattcaaacaacatcttccacgattccatgactatttgtggatgtcagaggatggaatgaaggcacaggtatatgatggatgtcatagttgggaactagcgttcattattcatgcctattattccacggatcttgctagcgagtttattccgactataaaaaaggctcacgagttcatgaagaactcacaggttcttttcaaccacccaaatcatgaaagttattatcgccacagatcaaaaggctcatggacactttcaagtgtagataatggttggtctgtttctgattgtactgcggaagctgttaaggcattgctactattatcaaaaatatcgcctgacctcattggagatccaataaaacaagataggttgtatgatgccattgattgcatcctatctttcatgaatacagatggcacattttctacctacgaatgcaaacggacattcggttggttagaggttctcaacccttctgagagttttcggaacattgtcgtggactatccatctgttgaatgcacatcatctgtgcttgatgcttttgtattattcaaggagacacatccacgatatcgtagagcggagatagataaatgcattcaagaagctgttctatttattgagaaaagtcaaaataaggatggttcatggtatggctcatggggtatttgttttgcatatggatgcatgtttgcagtaagagcgttagttgccactggaaaaacctacgataattgtgcttctatcaggaaatcatgcaaatttatcttatcaaagcaacaaactacaggtggatggggtgaagactatctttctagtgacaatggggaatatattgatagcggtaggcctaatgctgtgaccacctcatgggcaatgttgtctttaatttatgctggacaggttgaacgtgacccggtaccactatataatgctgcaaggcagctaatgaatatgcaactagaaacaggcgacttcccccagcaggaacacatgggttgcttcaactcctccttgaacttcaactacgcaaattaccgcaatctatacccgattatggctcttggggaacttcgccgtcggcttcttccgattaagagctga

SEQ ID NO: 4364 - protein, 757 aa, Avena ventricosa
MWRLTIGEGAGDPWLKSNNGFLGRQVWHYDADAGTPEERAEVERVRAEFTKNRFNRKESQDLLLRLQYAKANPLPANVPTAKLDKSTEVTHETIHASLMRALHQYSALQADDGHWPGDYSGILFIMPIIIFSLHVTRSLDTFLSTEHRHEICRYIYNQQNEDGGWGKMVLGPSTMFGSCMTYATLMLLGEKRDGEHEDALTKGRSWILSHGTATAIPQWGKIWLSIIGVYDWSGNNPIIPELWLVPHFLPIHPGRFWCFTRLIYMSMAYLYGKKFVGPITPTILALRQDLYSIPYSNVNWDKARDYCAKEDLHYPRSRAQDLITGCLTKIVEPVLNWWPANKLRDRALSNLMEHIHYDDESTKYVGICPINKALNMICCWVENPNSAEFKQHLPRFHDYLWMSEDGMKAQVYDGCHSWELAFIIHAYYSTDLASEFIPTIKKAHEFMKNSQVLFNHPNHESYYRHRSKGSWTLSSVDNGWSVSDCTAEAVKALLLLSKISPDLIGDPIKQDRLYDAIDCILSFMNTDGTFSTYECKRTFGWLEVLNPSESFRNIVVDYPSVECTSSVLDAFVLFKETHPRYRRAEIDKCIQEAVLFIEKSQNKDGSWYGSWGICFAYGCMFAVRALVATGKTYDNCASIRKSCKFILSKQQTTGGWGEDYLSSDNGEYIDSGRPNAVTTSWAMLSLIYAGQVERDPVPLYNAARQLMNMQLETGDFPQQEHMGCFNSSLNFNYANYRNLYPIMALGELRRRLLPIKS

SEQ ID NO: 4365 - DNA, 2274 bp, Avena prostrata
  CDS (1)..(2274)
atgtggaggctaacaataggtgagggtggcggtccgtggctgaagtcgaacaatggcttccttggccgccaagtgtgggagtacgacgccgatgccggcacgccggaagagcgtgccgaggttgagagggtgcgtgcggaattcacaaagaacaggttccagaggaaggagtcacaggaccttcttctacgcttgcagtacgcaaaaaacaaccctcttccggccaatattccgacagcagctaagcttgaaaagagtacagaggtcactcacgagaccatctacgaatcattgatgcgagctttacatcaatattcctctatacaagcagacgatgggcattggcctggtgattacagtgggattctcttcattatgcctatcattatattctctttatatgttactagatcactggacacctttttatctccggaacatcgtcatgagatatgtcgctatatttacaatcaacagaatgaagatggtggttggggaaaaatggtccttggcccaagtaccatgtttggatcgtgtatgaattatgcaaccttaatgattcttggcgagaagcgaaatggtgatcataaggatgcattggaaaaagggcgttcttggattttatctcatggaactgcaactgcaataccacagtggggaaaaatatggttgtcgataattggcgtttacgaatggtcaggaaacaatcctattatacctgaattgtggttggttccacattttcttccgattcacccaggtcgattttggtgttttacccggttgatatacatgtcaatggcatatctctatggtaagaaatttgttgggcctattagtcctacaatattagctctgcgacaagacctctatagtataccttactgcaacattaattgggacaaggcgcgtgattattgtgcaaaggaggaccttcattacccacgctcacgggcacaagatcttatatctggttgcctaacgaaaattgtggagccaattttgaattggtggccagcaaacaagctaagagatagagctttaaataacctcatggagcatatccattacgacgacgaatcaaccaaatatgtgggcatttgccctattaacaaggcattgaacatgatttgttgttgggtagaaaacccaaattcgcctgaattccaacaacatcttccacgattccatgactatttgtggatggcggaggatggaatgaaggcacaggtatatgatggatgtcatagctgggaactagcgttcataattcatgcctattgttccacggatcttactagcgagtttatcccgactctaaaaaaggcgcatgagttcatgaagaactcacaggttcttttcaaccacccaaatcatgaaagctattatcgccacagatcaaaaggctcatggaccctttcaagtgtagataatggttggtctgtatctgattgtaccgcggaagctgttaaggcattgctactattatcaaagatatccgcagaccttgttggcgatccaataaaacaagacaggttgtatgatgccattgattgcatcctatctttcatgaatacagatggaacattttctacctacgaatgcaaacggacattcgcttggttagaggttctcaacccttctgagagttttcggaacattgtcgtggactatccatctgttgaatgcacatcatctgtggttgatgctctcatattatttaaagagacgaatccacgatatcgaagagcagagatagataaatgcattgaagaagctgttgtatttattgagaacagccaaaataaggatggttcatggtatggctcatggggtatatgtttcgcatatggatgcatgtttgcagtaagggcgttggttgctacaggaaaaacctacgacaattgtgcttctatcaggaaatcatgcaaatttgtcttatcaaagcaacaaacaacaggtggatggggtgaagactatctttctagtgacaatggggaatatattgatagcggtaggcctaatgctgtgaccacctcatgggcaatgttggctttaatttatgctggacaggttgaacgtgacccagtaccactgtataatgctgcaaggcagctaatgaatatgcagctagaaacaggtgacttcccccaacaggaacacatgggttgcttcaactcctccttgaacttcaactacgccaactaccgcaatctatacccgattatggctcttggggaacttcgccgtcgacttcttgcgattaagagctga

SEQ ID NO: 4366 - protein, 757 aa, Avena prostrata
MWRLTIGEGGGPWLKSNNGFLGRQVWEYDADAGTPEERAEVERVRAEFTKNRFQRKESQDLLLRLQYAKNNPLPANIPTAAKLEKSTEVTHETIYESLMRALHQYSSIQADDGHWPGDYSGILFIMPIIIFSLYVTRSLDTFLSPEHRHEICRYIYNQQNEDGGWGKMVLGPSTMFGSCMNYATLMILGEKRNGDHKDALEKGRSWILSHGTATAIPQWGKIWLSIIGVYEWSGNNPIIPELWLVPHFLPIHPGRFWCFTRLIYMSMAYLYGKKFVGPISPTILALRQDLYSIPYCNINWDKARDYCAKEDLHYPRSRAQDLISGCLTKIVEPILNWWPANKLRDRALNNLMEHIHYDDESTKYVGICPINKALNMICCWVENPNSPEFQQHLPRFHDYLWMAEDGMKAQVYDGCHSWELAFIIHAYCSTDLTSEFIPTLKKAHEFMKNSQVLFNHPNHESYYRHRSKGSWTLSSVDNGWSVSDCTAEAVKALLLLSKISADLVGDPIKQDRLYDAIDCILSFMNTDGTFSTYECKRTFAWLEVLNPSESFRNIVVDYPSVECTSSVVDALILFKETNPRYRRAEIDKCIEEAVVFIENSQNKDGSWYGSWGICFAYGCMFAVRALVATGKTYDNCASIRKSCKFVLSKQQTTGGWGEDYLSSDNGEYIDSGRPNAVTTSWAMLALIYAGQVERDPVPLYNAARQLMNMQLETGDFPQQEHMGCFNSSLNFNYANYRNLYPIMALGELRRRLLAIKS

SEQ ID NO: 4367 - DNA, 2274 bp, Avena longiglumis
  CDS (1)..(2274)
atgtggaggctaacaataggtgagggcggcggtccgtggctgaagtcgaacaatggcttccttggccgccaagtgtgggagtacgacgccgatgccggcacgccggaagagcgtgccgaggttgagagggtgcgtgcggaattcacaaagaacaggttccagaggaaggagtcacaggaccttcttctacgcttgcagtacgcaaaagacaaccctcttccggcgaatattccgacagaagctaagcttgaaaagagtacagaggtcactcacgagactatctacaaatcattgatgcgagctttacatcaatattcctctctacaagcagacgatgggcattggcctggtgattacagtgggattctcttcattatgcctatcattatattctctttatatgttactagatcacttgacacctttttatctccggaacatcgtcatgagatatgtcgctacatttacaatcaacagaatgaagatggtggttggggaaaaatggttcttggaccaagtaccatgtttggatcgtgtatgaattatgcaaccttaatgattcttggcgagaagcgaaatggtgatcataaggatgcattggaaaaagggcgttcttggattttatctcatggaactgcaactgcaataccacagtggggaaaaatatggttgtcgataattggcgtttacgaatggtcaggaaacaatcctattatacctgaattgtggttggttccacattttcttccgattcacccaggtcgtttttggtgttttacccggttgatatacatgtcaatggcatatctctatggtaagaaatttgttgggcctattagtcctacaatattagctctgcgacaagacctctatagtataccttactgcaacattaattgggacaaggcgcgtgattattgtgcaaaggaggaccttcattacccacgctcacgggcacaagatcttatatctggttgcctaacgaaaattgtggagccaattttgaattggtggccagcaaacaagctaagagatagagctttaactaacctcatggagcatatccattatgacgacgaatcaaccaaatatgtgggcatttgccctattaacaaggcattgaacatgatttgttgttgggtagaaaacccaaattcgcctgaattccaacaacatcttccacgattccatgactatttgtggatggcggaggatggaatgaaggcacaggtatatgatggatgtcatagctgggaactagcgttcataattcatgcctattgttccacggatcttactagcgagtttatcccgactctaaaaaaggcgcacgagttcatgaagaactcacaggttcttttcaaccacccaaatcatgaaagctattatcgccacagatcaaaaggctcatggaccctttcaagtgtagataatggttggtctgtatctgattgtaccgcggaagctgttaaggcattgctactattatcaaagatatccgctgaccttgttggcgatccaataaaacaagacaggttgtatgatgccattgattgcatcctatctttcatgaatacagatggaacattttctacctacgaatgcaaacggacattcgcttggttagaggttctcaacccttctgagagttttcggaacattgtcgtggactatccatctgttgaatgcacatcatctgtggttgatgctctcatattatttaaagagacgaatccacgatatcgaagagcagagatagataaatgcattgaagaagctgttgtatttattgagaacagtcaaaataaggatggttcatggtatggctcatggggtatatgtttcgcatatggatgcatgtttgcagtaagggcgttggttgctacaggaaaaacctacgacaattgtgcttctatcaggaaatcatgcaaatttgtcttatcaaagcaacaaacaacaggtggatggggtgaagactatctttctagtgacaatggggaatatattgatagcggtaggcctaatgctgtgaccacctcatgggcaatgttggctttaatttatgctggacaggttgaacgtgacccagtaccactgtataatgctgcaaggcagctaatgaatatgcagcttgaaacaggtgacttcccccaacaggaacacatgggttgcttcaactcctccttgaacttcaactacgccaactaccgcaatctatacccgattatggctcttggggaacttcgccgtcgacttcttgcgattaagagctga

SEQ ID NO: 4368 - protein, 757 aa, Avena longiglumis
MWRLTIGEGGGPWLKSNNGFLGRQVWEYDADAGTPEERAEVERVRAEFTKNRFQRKESQDLLLRLQYAKDNPLPANIPTEAKLEKSTEVTHETIYKSLMRALHQYSSLQADDGHWPGDYSGILFIMPIIIFSLYVTRSLDTFLSPEHRHEICRYIYNQQNEDGGWGKMVLGPSTMFGSCMNYATLMILGEKRNGDHKDALEKGRSWILSHGTATAIPQWGKIWLSIIGVYEWSGNNPIIPELWLVPHFLPIHPGRFWCFTRLIYMSMAYLYGKKFVGPISPTILALRQDLYSIPYCNINWDKARDYCAKEDLHYPRSRAQDLISGCLTKIVEPILNWWPANKLRDRALTNLMEHIHYDDESTKYVGICPINKALNMICCWVENPNSPEFQQHLPRFHDYLWMAEDGMKAQVYDGCHSWELAFIIHAYCSTDLTSEFIPTLKKAHEFMKNSQVLFNHPNHESYYRHRSKGSWTLSSVDNGWSVSDCTAEAVKALLLLSKISADLVGDPIKQDRLYDAIDCILSFMNTDGTFSTYECKRTFAWLEVLNPSESFRNIVVDYPSVECTSSVVDALILFKETNPRYRRAEIDKCIEEAVVFIENSQNKDGSWYGSWGICFAYGCMFAVRALVATGKTYDNCASIRKSCKFVLSKQQTTGGWGEDYLSSDNGEYIDSGRPNAVTTSWAMLALIYAGQVERDPVPLYNAARQLMNMQLETGDFPQQEHMGCFNSSLNFNYANYRNLYPIMALGELRRRLLAIKS

SEQ ID NO: 4369 - DNA, 2274 bp, Avena longiglumis
  CDS (1)..(2274)
atgtggaggctaacaataggtgagggcggcggtccgtggctgaagtcgaacaatggcttccttggccgccaagtgtgggagtacgacgcccatgccggcacgccggaagagcgtgccgaggttgagagggtgcgtgcggaattcacaaagaacaggttccagaggaaggagtcacaggaccttcttctacgcttgcagtacgcaaaagacaaccctcttcgggcgaatattccgacagaagctaagcttgaaaagagtacagaggtcactcacgagactatctacaaatcattgatgcgagctttacatcaatattcctctctacaagcagacgatgggcattggcctggtgattacagtgggattctcttcattatgcctatcattatattctctttatatgttactagatcacttgacacctttttatctccggaacatcgtcatgagatatgtcgctacatttacaatcaacagaatgaagatggtggttggggaaaaatggttcttggaccaagtaccatgtttggatcgtgtatgaattatgcaaccttaatgattcttggcgagaagcgaaatggtgatcataaggatgcattggaaaaagggcgttcttggattttatctcatggaactgcaactgcaataccacagtggggaaaaatatggttgtcgataattggcgtttacgaatggtcaggaaacaatcctattatacctgaattgtggttggttccacattttcttccgattcacccaggtcgtttttggtgttttacccggttgatatacatgtcaatggcatatctctatggtaagaaatttgttgggcctattagtcctacaatattagctctgcgacaagacctctatagtataccttactgcaacattaattgggacaaggcgcgtgattattgtgcaaaggaggaccttcattacccacgctcacgggcacaagatcttatatctggttgcctaacgaaaattgtggagccaattttgaattggtggccagcaaacaagctaagagatagagctttaactaacctcatggagcatatccattatgacgacgaatcaaccaaatatgtgggcatttgccctattaacaaggcattgaacatgatttgttgttgggtagaaaacccaaattcgtctgaattccaacaacatcttccacgattccatgactatttgtggatggcggaggatggaatgaaggcacaggtatatgatggatgtcatagctgggaactagcgttcataattcatgcctattgttccacggatcttactagcgagtttatcccgactctaaaaaaggcgcacgagttcatgaagaactcacaggttcttttcaaccacccaaatcatgaaagctattatcgccacagatcaaaaggctcatggaccctttcaagtgtagataatggttggtctgtatctgattgtaccgcggaagctgttaaggcattgctactattatcaaagatatccgctgaccttgttggcgatccaataaaacaagacaggttgtatgatgccattgattgcatcctatctttcatgaatacagatggaacattttctacctacgaatgcaaacggacattcgcttggttagaggttctcaacccttctgagagttttcggaacattgtcgtggactatccatctgttgaatgcacatcatctgtggttgatgctctcatattatttaaagagacgaatccacgatatcgaagagcagagatagataaatgcattgaagaagctgttgtatttattgagaacagtcaaaataaggatggttcatggtatggctcatggggtatatgtttcgcatatggatgcatgtttgcagtaagggcgttggttgctacaggaaaaacctacgacaattgtgcttctatcaggaaatcatgcaaatttgtcttatcaaagcaacaaacaacaggtggatggggtgaagactatctttctagtgacaatggggaatatattgatagcggtaggcctaatgctgtgaccacctcatgggcaatgttggctttaatttatgctggacaggttgaacgtgacccagtaccactgtataatgctgcaaggcagctaatgaatatgcagcttgaaacaggtgacttcccccaacaggaacacatgggttgcttcaactcctccttgaacttcaactacgccaactaccgcaatctatacccgattatggctcttggggaacttcgccgtcgacttcttgcgattaagagctga

SEQ ID NO: 4370 - protein, 757 aa, Avena longiglumis
MWRLTIGEGGGPWLKSNNGFLGRQVWEYDAHAGTPEERAEVERVRAEFTKNRFQRKESQDLLLRLQYAKDNPLRANIPTEAKLEKSTEVTHETIYKSLMRALHQYSSLQADDGHWPGDYSGILFIMPIIIFSLYVTRSLDTFLSPEHRHEICRYIYNQQNEDGGWGKMVLGPSTMFGSCMNYATLMILGEKRNGDHKDALEKGRSWILSHGTATAIPQWGKIWLSIIGVYEWSGNNPIIPELWLVPHFLPIHPGRFWCFTRLIYMSMAYLYGKKFVGPISPTILALRQDLYSIPYCNINWDKARDYCAKEDLHYPRSRAQDLISGCLTKIVEPILNWWPANKLRDRALTNLMEHIHYDDESTKYVGICPINKALNMICCWVENPNSSEFQQHLPRFHDYLWMAEDGMKAQVYDGCHSWELAFIIHAYCSTDLTSEFIPTLKKAHEFMKNSQVLFNHPNHESYYRHRSKGSWTLSSVDNGWSVSDCTAEAVKALLLLSKISADLVGDPIKQDRLYDAIDCILSFMNTDGTFSTYECKRTFAWLEVLNPSESFRNIVVDYPSVECTSSVVDALILFKETNPRYRRAEIDKCIEEAVVFIENSQNKDGSWYGSWGICFAYGCMFAVRALVATGKTYDNCASIRKSCKFVLSKQQTTGGWGEDYLSSDNGEYIDSGRPNAVTTSWAMLALIYAGQVERDPVPLYNAARQLMNMQLETGDFPQQEHMGCFNSSLNFNYANYRNLYPIMALGELRRRLLAIKS

SEQ ID NO: 4371 - DNA, 2274 bp, Avena clauda
  CDS (1)..(2274)
atgtggaggctaacaataggtgagggagccggtgatccctggctcaagtccaacaacggcttcctcggccgccaagtgtggcactacgacgccgatgccggcacgcccgaagagcgtgccgaggttgagagggtgcgtgcggagttcacaaagaacaggttcaacaggaaggagtcacaggaccttcttctacgcttgcagtacgcaaaagccaaccctcttccggcgaatgttccgacagcaaagcttgataagagtacagaggtcactcacgagactatacacgcttcgttgatgcgagctttacatcagtattccgctctacaagcagacgatggccactggcctggtgattacagtgggattctcttcattatgcctatcattatattctcattacatgttactagatcactggacacctttttatctccagaacatcgtcatgagatatgtcgctacatttacaatcaacagaacgaagatggtggttgggggaaaatggttcttggcccaagtactatgtttggatcatgtatgacttatgcaaccttaatgcttcttggtgagaagcgagacggtgaacatgaggatgcattgacaaaagggcgttcctggattttatctcatggaactgcaactgcaataccacagtgggggaaaatatggttgtcgataattggcgtttacgattggtccggaaacaatcctattatacctgaattgtggttggttccacattttcttccgattcacccaggtcgattttggtgttttacccggttgatatacatgtcaatggcatatctttatggaaagaaatttgttgggcctattactccaacaatattagctctgcgacaagacctctatagtataccttacagcaacgttaattgggacaaggcgcgtgattattgtgcaaaggaggaccttcattatccacgctcacgggcacaagatcttataactggatgcctgacaaaaattgtggagccagttttgaattggtggccagcaaacaagctaagagatagagctttaagtaacctaatggagcatatccattatgatgacgaatcaacaaaatacgtgggcatttgccctattaacaaggcattgaacatgatttgttgttgggtagaaaacccaaattcagctgaattcaaacaacatcttccacgattccatgactatttgtggatgtcagaggatggaatgaaggcacaggtatatgatggatgtcatagttgggaactagcgttcattattcatgcctattattccacggatcttgctagcgagtttattccgactataaaaaaggctcacgagttcatgaagaactcacaggttcttttcaaccacccaaatcatgaaagttattatcgccacagatcaaaaggctcatggacactttcaagtgtagataatggttggtctgtttctgattgtactgcggaagctgttaaggcattgctactattatcaaaaatatcgcctgacctcattggagatccaataaaacaagataggttgtatgatgccattgattgcatcctatctttcatgaatacagatggcacattttctacctacgaatgcaaacggacatttggttggttagaggttctcaacccttctgagagttttcggaacattgtcgtggactatccatctgttgaatgcacatcatctgtgcttgatgcttttgtactattcaaggagacacatccacgatatcgtagagcggagatagataaatgcattaaagaagctgttctatttattgagaaaagtcaaaataaggatggttcatggtatggctcatggggtatttgttttgcatatggatgcatgtttgcagtaagagcgttagttgctacgggaaaaacctacgataattgtgcttctatcaggaaatcatgcaaatttatcttatcaaagcaacaaaccacaggtggatggggtgaagactatctttctagtgacaatggggaatatattgatagcggtaggcctaatgctgtgaccacctcatgggcaatgttgtctttaatttatgctggacaggttgaacgtgacccggtaccactatataatgctgcaaggcagctaatgaatatgcaactagaaacaggcgacttcccccagcaggaacacatgggttgcttcaactcctccttgaacttcaactacgcaaattaccgcaatctatacccgattatggctcttggggaacttcgtcgtcggcttcttccgattaagagctga

SEQ ID NO: 4372 - protein, 757 aa, Avena clauda
MWRLTIGEGAGDPWLKSNNGFLGRQVWHYDADAGTPEERAEVERVRAEFTKNRFNRKESQDLLLRLQYAKANPLPANVPTAKLDKSTEVTHETIHASLMRALHQYSALQADDGHWPGDYSGILFIMPIIIFSLHVTRSLDTFLSPEHRHEICRYIYNQQNEDGGWGKMVLGPSTMFGSCMTYATLMLLGEKRDGEHEDALTKGRSWILSHGTATAIPQWGKIWLSIIGVYDWSGNNPIIPELWLVPHFLPIHPGRFWCFTRLIYMSMAYLYGKKFVGPITPTILALRQDLYSIPYSNVNWDKARDYCAKEDLHYPRSRAQDLITGCLTKIVEPVLNWWPANKLRDRALSNLMEHIHYDDESTKYVGICPINKALNMICCWVENPNSAEFKQHLPRFHDYLWMSEDGMKAQVYDGCHSWELAFIIHAYYSTDLASEFIPTIKKAHEFMKNSQVLFNHPNHESYYRHRSKGSWTLSSVDNGWSVSDCTAEAVKALLLLSKISPDLIGDPIKQDRLYDAIDCILSFMNTDGTFSTYECKRTFGWLEVLNPSESFRNIVVDYPSVECTSSVLDAFVLFKETHPRYRRAEIDKCIKEAVLFIEKSQNKDGSWYGSWGICFAYGCMFAVRALVATGKTYDNCASIRKSCKFILSKQQTTGGWGEDYLSSDNGEYIDSGRPNAVTTSWAMLSLIYAGQVERDPVPLYNAARQLMNMQLETGDFPQQEHMGCFNSSLNFNYANYRNLYPIMALGELRRRLLPIKS

SEQ ID NO: 4373 - DNA, 2280 bp, Avena ventricosa
  CDS (1)..(2280)
atgtggcggctgaagatcgcggagggcgggggcgacccgtggctgcgcaccaagaacgcgcacgtcggccgccaggtctgggagttcgaccccgaggccggcgacccggagaccctcgccgccgtcgaagccgcgcgacgggacttcgccgcgggccgccaccggctcaagcacagctccgaccgcctcatgcgcatccagtttgagaaagaaaatccacttaagttggatcttcctgctatcaagctggaggagaatgaagatgtcactgaggaagctgtgtcgacctctctgaaaagggcgatcagcagattttctactctccaggcacacgatgggcactggcctggggattatggtggtcctatgttccttatgccaggattgcttataacactatatgtgactggatcactgaacactgtcttatcaccagaacatcagaaggagatccgccgatatctctataatcatcagaatgaagatggaggctggggattgcacattgagggtccaagcaccatgtttggctcggccttgacctatgtttccctgagattgcttggagagggaccagagagtggagatggtgctatggcaaaaggtcgaaattggattttagaccacgggggagcaacttatataacatcatggggaaagttttggctcgcggtacttggtgtatttgattggtctggtaacaacccactgccaccagaagtatggatgttgtcataccgcctgccaattcatccaggtcgaatgtggtgtcactgccgaatggtgtatctacccatgtgctatgtttatggaaagaggtttgtcggcaagatcacaccacttatattggaactaagaaatgaactctacaaaaccccctacagcaagattgattgggacaatgctcgcaatctttgtgctaaggaagatctgtactatccacatccattgatacaggatatattatgggccacactccataaatttgtcgaaccagttatgatacattggcctgggaacaaattgagggagaaagctttgaactatgttatgcagcatgttcattatgaagatgagaacactcgatacatttgtattggtcctgtgaacaaggtactaaatatgcttacttgttggattgaagatccaaattcagaagcattcaagctccatattccaagaatccatgattacttgtgggttgctgaagatggcatgaagatgcagggttataatggcagccagctctgggacacagctttcgcagtccaagctattgcggctactggcctcattgatgagtttgctcccactcttaagctagcacacaacttcattaagaactcccaggttcttgatgactgccccggagatctgagttactggtaccgtcacatatctaaaggtgcatggcctttttctactgctgatcatggttggcctatatcagattgcactgcagaaggactaaaggctgcattattgctatcgaagatttctccagaaattgtgggcgaaccagtggaagttaacagactttatgatgctgtcaattgtctgatgtcttggatgaacaataatggtggttttgcaacatacgaactcacaaggtcttatgcctggctggagcttatcaaccctgctgagacctttggagacattgtcattgattacccgtatgtggaatgtacttcagcagcaattcaggccctgacatcatttaaaaagctctatcctgggcaccgcaggaaagatgtagataactgtatcaacaaagctgctaattacatagagagtattcaaagaagtgatggttcatggtatggctcttgggctgtttgtttcacctacgccacatggtttggagtgaaggcattagttgctgctggtaggccgttcaagagtagtcctgcaatcaggaaggcatgtgaatttctgatgtcaaaagagcttcctttcggtggctggggagaaagttatttgtcatgtcgagatcaggtttacactaatcttgaaggcaagcatgctcacgcagtcaacactggctgggccatgctgaccctaattgacgcaggacaggctgagagagatccagcacctctgcatcgagcagcgaaggttttgatcaacttacaatctgaggatggggaatttcctcaacaagagatcatgggagtcttcaacaagaactgcatgatcagttactcccagtacagggacatcttccctgtgtgggcactcggagagtaccgttgccgagtcttggctgcgggcaagtag

SEQ ID NO: 4374 - protein, 759 aa, Avena ventricosa
MWRLKIAEGGGDPWLRTKNAHVGRQVWEFDPEAGDPETLAAVEAARRDFAAGRHRLKHSSDRLMRIQFEKENPLKLDLPAIKLEENEDVTEEAVSTSLKRAISRFSTLQAHDGHWPGDYGGPMFLMPGLLITLYVTGSLNTVLSPEHQKEIRRYLYNHQNEDGGWGLHIEGPSTMFGSALTYVSLRLLGEGPESGDGAMAKGRNWILDHGGATYITSWGKFWLAVLGVFDWSGNNPLPPEVWMLSYRLPIHPGRMWCHCRMVYLPMCYVYGKRFVGKITPLILELRNELYKTPYSKIDWDNARNLCAKEDLYYPHPLIQDILWATLHKFVEPVMIHWPGNKLREKALNYVMQHVHYEDENTRYICIGPVNKVLNMLTCWIEDPNSEAFKLHIPRIHDYLWVAEDGMKMQGYNGSQLWDTAFAVQAIAATGLIDEFAPTLKLAHNFIKNSQVLDDCPGDLSYWYRHISKGAWPFSTADHGWPISDCTAEGLKAALLLSKISPEIVGEPVEVNRLYDAVNCLMSWMNNNGGFATYELTRSYAWLELINPAETFGDIVIDYPYVECTSAAIQALTSFKKLYPGHRRKDVDNCINKAANYIESIQRSDGSWYGSWAVCFTYATWFGVKALVAAGRPFKSSPAIRKACEFLMSKELPFGGWGESYLSCRDQVYTNLEGKHAHAVNTGWAMLTLIDAGQAERDPAPLHRAAKVLINLQSEDGEFPQQEIMGVFNKNCMISYSQYRDIFPVWALGEYRCRVLAAGK

SEQ ID NO: 4375 - DNA, 2280 bp, Avena strigosa
  CDS (1)..(2280)
atgtggcggctgaagatcgcggagggcgggggcgacccgtggctgcgcaccaagaacgcgcacgtcggccgccaggtctgggagttcgaccccgaggccggcgacccggaggccctcgccgccgtcgaagccgcgcgacgggacttcgccgcgggccgccaccggctcaagcacagcgccgaccgcctcatgcgcatccagtttgagaaagaaaatccacttaagttggatctttctgctatcaagctggaggagaatgaagatgtcactgaggaagctgtgtcgacctctctgaaaagggcgatcagcagattttctactctccaggcacatgatgggcactggcctggggattatggtggtcctatgttccttatgccaggattgcttataacattatacgtgactggagcactgaacgctgtcttatcaccagaacatcagaaggagatccgccgatatctctataatcatcagaatgaagatggaggatggggattgcacattgagggtccaagcaccatgtttggctcagccttgacctatgtttccctgagattgcttggagagggaccagagagtggagatggtgctatggaaaaaggtcgaaattggattttagaccatgggggagcaacttatataacatcatggggaaagttttggctcgcggtacttggcgtatttgattggtctggtaacaatccactaccaccagaaatatggatgttgccttaccgcctgccaattcatccaggtcgaatgtggtgtcactgccgcatggtgtatctacccatgtgctatgtttatggaaagaggtttgtcggcaaaatcacaccacttatattggaactaagaaacgaactctacaaaaccccctacagcgagattgattgggacagtgctcgcaatctttgtgctaaggaagatctgtactatccacatccattgatacaggatatactatgggccacactccataaatttgtcgaaccagttatgatgcattggcctgggaacaaattgagggagaaagctttgaaccatgtcatgcagcatgttcattatgaagatgagaacacccgctacatttgtattggtcctgtgaacaaggtactaaatatgcttacttgttggattgaagatccaaattcggaagcattcaagctccatattccaagagtccatgattacttgtgggttgctgaagatggcatgaagatgcagggttataatggcagccagctctgggacacagctttcgcagtccaagctattacagctactggcctcattgatgagtttgctcccactcttaagcttgcacacaacttcattaagaactcccaggttcttgatgactgccctggagatctgagttattggtaccgtcacatatcgaaaggtgcatggcctttttctactgctgatcatggttggcctatatcagattgcactgcagaaggactaaaggccgcattattgctatcgaagatttctccagaaattgttggcgaaccagtggaagttaaccgactttatgatgctgtcaattgtctgatgtcttggatgaacaacaatggtggttttgcaacttatgaactcacaaggtcttatgcctggctagagcttatcaaccctgctgagaccttcggggacattgtcattgattacccgtacgtggaatgtacgtcagctgcaattcaggccctgacatcatttaaaaagctctatcctgggcaccgcaggaaagatgtagataactgtatcaacaaagctgctaatttcatagagagtattcaaagaagtgacggttcatggtatggctcttgggctgtttgtttcacctatggcacatggtttggagtgaaggcattagttgctgctggtaggacgttcaagagtagtcctgcaatcaggaaggcgtgtgaatttctgatgtcaaaagagcttcctttcggtggctggggagaaagttatttgtcatgtcaagatcaggtttacaccaatcttgaaggcaagcatgctcacgcagtcaacactggctgggccatgctgaccctaattgacgcaggacaggccgagagagatccaacacctctgcatcgggcagcgaaggttttgatcaacttacaatctgaggatggggaatttcctcaacaagagatcatgggagtcttcaacaagaactgcatgatcagttactcccagtacagggacatcttccctgtctgggcactcggagagtaccgttgccgagtcttggctgcgggcaagtag

SEQ ID NO: 4376 - protein, 759 aa, Avena strigosa
MWRLKIAEGGGDPWLRTKNAHVGRQVWEFDPEAGDPEALAAVEAARRDFAAGRHRLKHSADRLMRIQFEKENPLKLDLSAIKLEENEDVTEEAVSTSLKRAISRFSTLQAHDGHWPGDYGGPMFLMPGLLITLYVTGALNAVLSPEHQKEIRRYLYNHQNEDGGWGLHIEGPSTMFGSALTYVSLRLLGEGPESGDGAMEKGRNWILDHGGATYITSWGKFWLAVLGVFDWSGNNPLPPEIWMLPYRLPIHPGRMWCHCRMVYLPMCYVYGKRFVGKITPLILELRNELYKTPYSEIDWDSARNLCAKEDLYYPHPLIQDILWATLHKFVEPVMMHWPGNKLREKALNHVMQHVHYEDENTRYICIGPVNKVLNMLTCWIEDPNSEAFKLHIPRVHDYLWVAEDGMKMQGYNGSQLWDTAFAVQAITATGLIDEFAPTLKLAHNFIKNSQVLDDCPGDLSYWYRHISKGAWPFSTADHGWPISDCTAEGLKAALLLSKISPEIVGEPVEVNRLYDAVNCLMSWMNNNGGFATYELTRSYAWLELINPAETFGDIVIDYPYVECTSAAIQALTSFKKLYPGHRRKDVDNCINKAANFIESIQRSDGSWYGSWAVCFTYGTWFGVKALVAAGRTFKSSPAIRKACEFLMSKELPFGGWGESYLSCQDQVYTNLEGKHAHAVNTGWAMLTLIDAGQAERDPTPLHRAAKVLINLQSEDGEFPQQEIMGVFNKNCMISYSQYRDIFPVWALGEYRCRVLAAGK

SEQ ID NO: 4377 - DNA, 2280 bp, Avena prostrata
  CDS (1)..(2280)
atgtggcggctgaagatcgcggagggcgggggcgacccgtggctgcgcaccaagaacgcgcacgtcggccgccaggtctgggagttcgaccccgaggccggcgacccggaggccctcgccgccgtcgaagccgcgcgacgggacttcgccgcgggccgccaccggctcaagcacagcgccgaccgcctcatgcgcatccagtttgagaaagaaaatccacttaagtcggatcttcctgctatcaagctggaggagaatgaagatgtcactgaggaagctgtgtcgacctctctgaaaagggcgatcagcagattttctactctccaggcacacgatgggcactggcctggggattatggtggtcctatgttccttatgccaggattgcttataacactatatgtgactggatcactgaacactgtcttatcaccagaacatcagaaggagatccgccgatatctctataatcatcagaatgaagatggaggctggggattgcacattgagggtccaagcaccatgtttggctcagccttgacctatgtttccctgagattgcttggagagggaccagagagtggagatggtgctatggaaaaaggtcgaaattggattttagaccatgggggagcaacttatataacatcatggggaaagttttggctcgcggtacttggtgtatttgattggtctggtaacaatccactgccaccagaaatatggatgttgccataccgcctgccaattcatccaggtcgaatgtggtgtcactgccgcatggtgtatctacccatgtgctatgtttatggaaagaggtttgtcggcaaaatcacaccacttatattggaattaagaagcgaactctacaaaaccccctacagcaagattgattgggacagtgctcgcaatctttgtgctaaggaagatctgtactatccacatccattgatacaggatatattatgggccacactccataaatttgttgaaccagttatgatgcattggcctgggaacaaattgagggagaaagctttgaaccatgtcacgcagcatgttcattatgaagatgagaacactcgatacatttgtattggtcctgtgaacaaggtactaaatatgcttacttgttggattgaagatccaaattcggaagcattcaagctccatattccaagagtccatgattacttgtgggttgctgaagatggcatgaagatgcagggttataatggcagccagctctgggacacagctttcgcagtccaagctattacggctactggcctcattgatgagtttgctcccactcttaagcttgcacacaacttcattaagaactcccaggttcttgatgactgccctggagatctgagttattggtaccgtcacatatctaaaggtgcatggcctttttctactgctgatcatggttggcctatatcagattgcactgcagaaggactaaaggccgcattattgctatcgaagatttctccagaaattgtgggcgaaccagtggaagttaacagactttatgatgctgtcaattgtctgatgtcttggatgaacaacaatggtggttttgcaacttatgaactcacaaggtcttatgcctggctagagcttatcaaccctgctgagacctttggggacattgtcattgattacccgtacgtagaatgtacgtcagctgcaattcaggccctcacatcatttaaaaagctctatcctgggcaccgcaggaaagatgtagataactgtatcaacaaagctgctaatttcatagagagtattcaaagaagtgacggttcatggtatggctcttgggctgtttgtttcacctacggcacatggtttggagtgaaggcattagttgctgctggtaggacgttcaagagtagtcctgcaatcaggaaggcatgtgaatttctgatgtcaaaagagcttcctttcggtggctggggagaaagttatttgtcatgtcaagatcaggtttacaccaatcttgaaggcaagcatgctcacgcagtcaacactggctgggccatgctgaccttaattgacgcaggacaggctgacagagatccaacacctctgcatcgagcagcgaaggttttgatcaacttacaatctgaggatggggaatttcctcaacaagagatcatgggagtcttcaacaagaactgcatgatcagttactcccagtacagggacatattccctgtctgggcactcggagagtaccgttgccgagtcttggctgcgggcaagtag

SEQ ID NO: 4378 - protein, 759 aa, Avena prostrata
MWRLKIAEGGGDPWLRTKNAHVGRQVWEFDPEAGDPEALAAVEAARRDFAAGRHRLKHSADRLMRIQFEKENPLKSDLPAIKLEENEDVTEEAVSTSLKRAISRFSTLQAHDGHWPGDYGGPMFLMPGLLITLYVTGSLNTVLSPEHQKEIRRYLYNHQNEDGGWGLHIEGPSTMFGSALTYVSLRLLGEGPESGDGAMEKGRNWILDHGGATYITSWGKFWLAVLGVFDWSGNNPLPPEIWMLPYRLPIHPGRMWCHCRMVYLPMCYVYGKRFVGKITPLILELRSELYKTPYSKIDWDSARNLCAKEDLYYPHPLIQDILWATLHKFVEPVMMHWPGNKLREKALNHVTQHVHYEDENTRYICIGPVNKVLNMLTCWIEDPNSEAFKLHIPRVHDYLWVAEDGMKMQGYNGSQLWDTAFAVQAITATGLIDEFAPTLKLAHNFIKNSQVLDDCPGDLSYWYRHISKGAWPFSTADHGWPISDCTAEGLKAALLLSKISPEIVGEPVEVNRLYDAVNCLMSWMNNNGGFATYELTRSYAWLELINPAETFGDIVIDYPYVECTSAAIQALTSFKKLYPGHRRKDVDNCINKAANFIESIQRSDGSWYGSWAVCFTYGTWFGVKALVAAGRTFKSSPAIRKACEFLMSKELPFGGWGESYLSCQDQVYTNLEGKHAHAVNTGWAMLTLIDAGQADRDPTPLHRAAKVLINLQSEDGEFPQQEIMGVFNKNCMISYSQYRDIFPVWALGEYRCRVLAAGK

SEQ ID NO: 4379 - DNA, 2280 bp, Avena longiglumis
  CDS (1)..(2280)
atgtggcggctgaagatcgcggagggcgggggcgacccgtggctgcgcaccaagaacgcgcacgtcggccgccaggtctgggagttcgaccccgaggccggcgacccggagaccctcgccgccgtcgaagccgcgcgacgggacttcgccgcgggacgccaccggctcaagcacagctccgaccgcctcatgcgcatccagtttgagaaagaaaatccacttaagttggatcttcctgctatcaagctggaggagaatgaagatgtcactgaggaagctgtgtcgacctctctgaaaagggcgatcagcagattttctactctccaggcacacgatgggcactggcctggggattatggtggtcctatgttccttatgccaggattgcttataacactatatgtgactggatcactgaacactgtcttatcaccagaacatcagaaggagatccgccgatatctctataatcatcagaatgaagatggaggctggggattgcacattgagggtccaagcaccatgtttggctcagccttgacctatgtttccctgagattgcttggagagggaccagagagtggagatggtgctatggaaaaaggtcgaaattggattttagaccatgggggagcaacttatataacatcatggggaaagttttggctcgcggtacttggtgtatttgattggtctggtaacaatccactgccaccagaaatatggatgttgccataccgcctgccaattcatccaggtcgaatgtggtgtcactgccgcatggtgtatctacccatgtgctatgtttatggaaagaggttttttgggaaaatcacaccacttatattggaactaagaaacgaactctacaagaccccctacagcaagattgattgggacagtgctcgcaatctttgtgctaaggaagatctgtactatccacatccattgatacaggatatactatgggccacactccataaatttgtcgaaccagttatgatgcattggcctgggaacaaattgagggagaaagctttgaaccatgtcatgcagcatgttcattatgaagatgagaacacccgctacatttgtattggtcctgtgaacaaggtactaaatatgcttacttgttggattgaagatccaaattcggaagcattcaagctccatattccaagagtccatgattacttgtgggttgctgaagatggcatgaagatgcagggttataatggcagccagctctgggacacagctttcgcagtccaagctattacggctactggcctcattgatgagtttgctcccactcttaagcttgcacacaacttcattaagaactcccaggttcttgatgactgccctggagatctgagttattggtaccgtcacatatctaaaggtgcatggcctttttctactgctgatcatggttggcctatatcagattgcactgcagaaggactaaaggccgcattattgctatcgaagatttctccagaaattgtgggcgaaccagtggaagttaacagactttatgatgctgtcaattgtctgatgtcttggatgaataataatggtggttttgcaacttatgaactcacaaggtcttatgcctggctagagcttatcaaccctgctgagacctttggggacattgtcattgattacccgtacgtagaatgtacgtcagctgcaattcaggccctgacatcatttaaaaagctctatcctgggcaccgcaggaaagatgtagataactgtatcaacaaagctgctaatttcatagagagtattcaaagaagtgatggttcatggtatggctcttgggctgtttgtttcacctacggcacatggtttggagtgaaggcattagttgctgctggtaggacgttcaagagtagtcctgcaatcaggaaggcatgtgaatttctgatgtcaaaagagcttcctttcggtggctggggagaaagttatttgtcatgtcaagatcaggtttacaccaatcttgaaggcaagcatgctcatgcagtcaacactggctgggccatgctgaccctaattgacgcaggacaggccgagagagatccaacacctctgcatcgggcagcgaaggttttgatcaacttacaatctgaggatggggaatttcctcaacaagagatcatgggagtcttcaacaagaactgcatgatcagttactcccagtacagggacatcttccctgtgtgggcactcggagagtaccgttgccgagtcttggctgcgggcaagtag

SEQ ID NO: 4380 - protein, 759 aa, Avena longiglumis
MWRLKIAEGGGDPWLRTKNAHVGRQVWEFDPEAGDPETLAAVEAARRDFAAGRHRLKHSSDRLMRIQFEKENPLKLDLPAIKLEENEDVTEEAVSTSLKRAISRFSTLQAHDGHWPGDYGGPMFLMPGLLITLYVTGSLNTVLSPEHQKEIRRYLYNHQNEDGGWGLHIEGPSTMFGSALTYVSLRLLGEGPESGDGAMEKGRNWILDHGGATYITSWGKFWLAVLGVFDWSGNNPLPPEIWMLPYRLPIHPGRMWCHCRMVYLPMCYVYGKRFFGKITPLILELRNELYKTPYSKIDWDSARNLCAKEDLYYPHPLIQDILWATLHKFVEPVMMHWPGNKLREKALNHVMQHVHYEDENTRYICIGPVNKVLNMLTCWIEDPNSEAFKLHIPRVHDYLWVAEDGMKMQGYNGSQLWDTAFAVQAITATGLIDEFAPTLKLAHNFIKNSQVLDDCPGDLSYWYRHISKGAWPFSTADHGWPISDCTAEGLKAALLLSKISPEIVGEPVEVNRLYDAVNCLMSWMNNNGGFATYELTRSYAWLELINPAETFGDIVIDYPYVECTSAAIQALTSFKKLYPGHRRKDVDNCINKAANFIESIQRSDGSWYGSWAVCFTYGTWFGVKALVAAGRTFKSSPAIRKACEFLMSKELPFGGWGESYLSCQDQVYTNLEGKHAHAVNTGWAMLTLIDAGQAERDPTPLHRAAKVLINLQSEDGEFPQQEIMGVFNKNCMISYSQYRDIFPVWALGEYRCRVLAAGK

SEQ ID NO: 4381 - DNA, 2280 bp, Avena longiglumis
  CDS (1)..(2280)
atgtggcggctgaagatcgcggagggcgggggcgacccgtggctgcgcaccaagaacgcgcacgtcggccgccaggtctgggagttcgaccccgaggccggcgacccggagaccctcgccgccgtcgaagccgcgcgacgggacttcgccgcgggccgccaccggctcaagcacagctccgaccgcctcatgcgcatccagtttgagaaagaaaatccacttaagttggatcttcctgctatcaagctggaggagaatgaagatgtcactgaggaagctgtgtcgacctctctgaaaagggcgatcagcagattttctactctccaggcacacgatgggcactggcctggggattatggtggtcctatgttccttatgccaggattgcttataacactatatgtgactggatcactgaacactgtcttatcaccagaacatcagaaggagatccgccgatatctctataatcatcagaatgaagatggaggctggggattgcacattgagggtccaagcaccatgtttggctcagccttgacctatgtttccctgagattgcttggagagggaccagagagtggagatggtgctatggaaaaaggtcgaaattggattttagaccatgggggagcaacttatataacatcatggggaaagttttggctcgcggtacttggtgtatttgattggtctggtaacaatccactgccaccagaaatatggatgttgccataccgcctgccaattcatccaggtcgaatgtggtgtcactgccgcatggtgtatctacccatgtgctatgtttatggaaagaggttttttgggaaaatcacaccacttatattggaactaagaaacgaactctacaagaccccctacagcaagattgattgggacagtgctcgcaatctttgtgctaaggaagatctgtactatccacatccattgatacaggatatactatgggccacactccataaatttgtcgaaccagttatgatgcattggcctgggaacaaattgagggagaaagctttgaaccatgtcatgcagcatgttcattatgaagatgagaacacccgctacatttgtattggtcctgtgaacaaggtactaaatatgcttacttgttggattgaagatccaaattcggaagcattcaagctccatattccaagagtccatgattacttgtgggttgctgaagatggcatgaagatgcagggttataatggcagccagctctgggacacagctttcgcagtccaagctattacggctactggcctcattgatgagtttgctcccactcttaagcttgcacacaacttcattaagaactcccaggttcttgatgactgccctggagatctgagttattggtaccgtcacatatctaaaggtgcatggcctttttctactgctgatcatggttggcctatatcagattgcactgcagaaggactaaaggccgcattattgctatcgaagatttctccagaaattgtgggcgaaccagtggaagttaacagactttatgatgctgtcaattgtctgatgtcttggatgaataataatggtggttttgcaacttatgaactcacaaggtcttatgcctggctagagcttatcaaccctgctgagacctttggggacattgtcattgattacccgtacgtagaatgtacgtcagctgcaattcaggccctgacatcatttaaaaagctctatcctgggcaccgcaggaaagatgtagataactgtatcaacaaagctgctaatttcatagagagtattcaaagaagtgatggttcatggtatggctcttgggctgtttgtttcacctacggcacatggtttggagtgaaggcattagttgctgctggtaggacgttcaagagtagtcctgcaatcaggaaggcatgtgaatttctgatgtcaaaagagcttcctttcggtggctggggagaaagttatttgtcatgtcaagatcaggtttacaccaatcttgaaggcaagcatgctcatgcagtcaacactggctgggccatgctgacccaaattgacgcaggacaggccgagagagatccaacacctctgcatcgggcagcgaaggttttgatcaacttacaatctgaggatggggaatttcctcaacaagagatcatgggagtcttcaacaagaactgcatgatcagttactcccagtacagggacatcttccctgtgtgggcactcggagagtaccgttgccgagtcttggctgcgggcaagtag

SEQ ID NO: 4382 - protein, 759 aa, Avena longiglumis
MWRLKIAEGGGDPWLRTKNAHVGRQVWEFDPEAGDPETLAAVEAARRDFAAGRHRLKHSSDRLMRIQFEKENPLKLDLPAIKLEENEDVTEEAVSTSLKRAISRFSTLQAHDGHWPGDYGGPMFLMPGLLITLYVTGSLNTVLSPEHQKEIRRYLYNHQNEDGGWGLHIEGPSTMFGSALTYVSLRLLGEGPESGDGAMEKGRNWILDHGGATYITSWGKFWLAVLGVFDWSGNNPLPPEIWMLPYRLPIHPGRMWCHCRMVYLPMCYVYGKRFFGKITPLILELRNELYKTPYSKIDWDSARNLCAKEDLYYPHPLIQDILWATLHKFVEPVMMHWPGNKLREKALNHVMQHVHYEDENTRYICIGPVNKVLNMLTCWIEDPNSEAFKLHIPRVHDYLWVAEDGMKMQGYNGSQLWDTAFAVQAITATGLIDEFAPTLKLAHNFIKNSQVLDDCPGDLSYWYRHISKGAWPFSTADHGWPISDCTAEGLKAALLLSKISPEIVGEPVEVNRLYDAVNCLMSWMNNNGGFATYELTRSYAWLELINPAETFGDIVIDYPYVECTSAAIQALTSFKKLYPGHRRKDVDNCINKAANFIESIQRSDGSWYGSWAVCFTYGTWFGVKALVAAGRTFKSSPAIRKACEFLMSKELPFGGWGESYLSCQDQVYTNLEGKHAHAVNTGWAMLTQIDAGQAERDPTPLHRAAKVLINLQSEDGEFPQQEIMGVFNKNCMISYSQYRDIFPVWALGEYRCRVLAAGK

SEQ ID NO: 4383 - DNA, 2280 bp, Avena clauda
  CDS (1)..(2280)
atgtggcggctgaagatcgcggagggcgggggcgacccgtggctgcgcacgaagaacgcgcacgtcggccgccaggtctgggagttcgaccccgaggccggcgacccggaggccctcgccgccgtcgaggccgcgcgccgggagttcgccgcggggcgccaccgcctcaagcacagcgccgaccgcctcatgcgcatccagtttgagaaagaaaatccacttaagttggaccttcctgctatcaagctggaggagaatgaagatgtcactgaggaagctgtgtcgacctctttgaaaagggcgatcagcagattttctactctccaggcacatgatgggcactggcctggggattatggtggtcctatgttccttatgccaggattgcttataacactgtatgtgactggatcactgaacactgtcttatcaccagaacatcagaaggagatccgccgatatctctataatcatcagaatgaagatggaggctggggattgcacattgagggtccaagcaccatgtttggctcggccttgacctatgtttccctgagattgcttggagagggaccagagagtggagatggtgctatggcaaaaggtcgaaattggattttagaccacgggggagcaacttatataacatcatggggaaagttttggctcgcggtacttggtgtatttgattggtctggtaacaacccactgccaccagaagtatggatgttgtcataccgcctgccaattcatccaggtcgaatgtggtgtcactgccgaatggtgtatctacccatgtgctatgtttatggaaagaggtttgtcggcaagatcacaccacttatattggaactaagaaatgaactctacaaaaccccctacagcaagattgattgggacaatgctcgcaatctttgtgctaaggaagatctgtactatccacatccattgatacaggatatattatgggccacactccataaatttgtcgaaccagttatgatacattggcctgggaacaaattgagggagaaagctttgaactatgttatgcagcatgttcattatgaagatgagaacactcgatacatttgtattggtcctgtgaacaaggtactaaatatgcttacttgttggattgaagatccaaattcagaagcattcaagctccatattccaagaatccatgattacttgtgggttgctgaagatggcatgaagatgcagggttataatggcagccagctctgggacacagctttcgcagtccaagctattgcggctactggcctcattgatgagtttgctcccactcttaagctagcacacaacttcattaagaactcccaggttcttgatgactgccccggagatctgagttactggtaccgtcacatatctaaaggtgcatggcctttttctactgctgatcatggttggcctatatcagattgcactgcagaaggactaaaggctgcattattgctatcgaagatttctccagaaattgtgggcgaaccagtggaagttaacagactttatgatgctgtcaattgtctgatgtcttggatgaacaataatggtggttttgcaacatacgaactcacaaggtcttatgcctggctggagcttatcaaccctgctgagacctttggagacattgtcattgattacccgtatgtggaatgtacttcagcagcaattcaggccctgacatcatttaaaaagctctatcctgggcaccgcaggaaagatgtagataactgtatcaacaaagctgctaattacatagagagtattcaaagaagtgatggttcatggtatggctcttgggctgtttgtttcacctacgccacatggtttggagtgaaggcattagttgctgctggtaggccgttcaagagtagtcctgcaatcaggaaggcatgtgaatttctgatgtcaaaagagcttcctttcggtggctggggagaaagttatttgtcatgtcgagatcaggtttacactaatcttgaaggcaagcatgctcacgcagtcaacactggctgggccatgctgaccctaattgacgcaggacaggctgagagagatccagcacctctgcatcgagcagcgaaggttttgatcaacttacaatctgaggatggggaatttcctcaacaagagatcatgggagtcttcaacaaaaactgcatgatcagttactcccagtacagggacatcttccctgtgtgggcactcggagagtaccgttgccgagtcttggctgcgggcaagtag

SEQ ID NO: 4384 - protein, 759 aa, Avena clauda
MWRLKIAEGGGDPWLRTKNAHVGRQVWEFDPEAGDPEALAAVEAARREFAAGRHRLKHSADRLMRIQFEKENPLKLDLPAIKLEENEDVTEEAVSTSLKRAISRFSTLQAHDGHWPGDYGGPMFLMPGLLITLYVTGSLNTVLSPEHQKEIRRYLYNHQNEDGGWGLHIEGPSTMFGSALTYVSLRLLGEGPESGDGAMAKGRNWILDHGGATYITSWGKFWLAVLGVFDWSGNNPLPPEVWMLSYRLPIHPGRMWCHCRMVYLPMCYVYGKRFVGKITPLILELRNELYKTPYSKIDWDNARNLCAKEDLYYPHPLIQDILWATLHKFVEPVMIHWPGNKLREKALNYVMQHVHYEDENTRYICIGPVNKVLNMLTCWIEDPNSEAFKLHIPRIHDYLWVAEDGMKMQGYNGSQLWDTAFAVQAIAATGLIDEFAPTLKLAHNFIKNSQVLDDCPGDLSYWYRHISKGAWPFSTADHGWPISDCTAEGLKAALLLSKISPEIVGEPVEVNRLYDAVNCLMSWMNNNGGFATYELTRSYAWLELINPAETFGDIVIDYPYVECTSAAIQALTSFKKLYPGHRRKDVDNCINKAANYIESIQRSDGSWYGSWAVCFTYATWFGVKALVAAGRPFKSSPAIRKACEFLMSKELPFGGWGESYLSCRDQVYTNLEGKHAHAVNTGWAMLTLIDAGQAERDPAPLHRAAKVLINLQSEDGEFPQQEIMGVFNKNCMISYSQYRDIFPVWALGEYRCRVLAAGK

SEQ ID NO: 4385 - DNA, 2547 bp, Centella asiatica
  CDS (32)..(2305)
ggcaattctctctctaaattattgactgaaaatgtggaagctcaaagtcgctgaaggaggaaatccatggcttcggactgtcaacaatcacgtcggccggcaaatttgggagttcgatccaaaacttggatctcccgaagagcttgcggagatcgagaaagctcgcgagaattttcacaatcatcgattcgagaaacagcacagttccgatctactgatgcggctacagttcgccaatgagaatccacgccatgaagtcttaccccaagttaaagtaaaagatatcggagatatttcggaggataaagtaacaattacgttaaaaagagctttgagtttttattcaactcttcaagccaatgatggacattgggcaggagattatggtggtcctatgtttttaatgcctggtttggttatcactctatcaattactgaggcactgaatgctatcttgtccaaagaacacaaacgtgagatatgccgctatctttacaatcatcagaatagagatggtgggtggggtttacacattgaaggtccaagcactatgtttggtagtgtcttgaactatgttactctgagattgcttggtgaaggaactaaggatgggcaaggagcaatggagaaagggcgtcagtggattctggatcatggtggtgccactgcaattacatcatggggaagaatgtggctttcagttcttggtgtatttgaatggtctggaaataatcccctcccccctgagatatggttatttccatataatcttccattccacccaggaaggatgtggtgccactgtcggatggtttatcttcctatgtcatacttatatgggaagaggtttgttggtccaatcacaccgactgtcctttctttgagaaaggagctcttcactgtcccttatcatgaaatagattggaatcaagcacgcaacctatgtgcaaaggaagatctgtactatccacaccctcttgtgcaggatatactttgggcatcaattgataaggttttggaacctattttaatgcgttggcctggaaaaaagttgagagagaaagctcttcgcaccgtgatggaacacatacattatgaagatgaaaatactcgctatatatgcatagggcctgtaaacaaggtgttaaatatgctatgctgttgggctgaggatccaaactctgaggctttcaagctgcatcttccaagactctatgattttttatggcttgctgaggatggcatgaaaatgcaggggtacaatggaagtcaattatgggacactgcttttgctgttcaagcaatcatatcaactagtttgactgaatattgtggcccaactctcagaaaagcacatacattcatgaaagactcacaggtgctagatgattgtcctggtgatcttgatttttggtatcgtcatatatcaaaaggtgcatggcctttctccactgctgatcatggatggcccatttcagattgtacagccgaaggatttaaggctgtgcttctgttatcaaaattcccagcagaacttgttggtgaaccattagatgccaagcgactgtatgatgctgtcaacgttattctttctttacagaatagtgatggtggctatgcaacatatgaactcacaagatcctatcgctggctagagttaatcaaccctgccgagacgttcggggacattgttattgactatccttatgcagaatgtacatcagctgcaattcaagcgttatcagctttcaaaaaattatatcctgggcaccgtcgggaagagatacagtgttctattgaaaaagctgcagacttcatagagaagatacaagcttcagatggctcatggtatggctcttggggagtttgcttcacctatggtacatggtttggtgtaaaagggttgatatctgctgggagaaccttctctaattgctcaagcattcgcaaggcttgttattttctactgtccaaacaacttgcttctggtggttggggagagagttacctctcctgtcagaacaaggtgtatacaaatcttgagggagaacgttctcatgttgtaaatactggatgggctatgctggctctcattgaggctgggcaggcagagagagatgcaacaccattgcaccatgcagctaaattattgattaattctcaaatggaaaatggagatttccctcaggaggagatcatgggggtcttcaacaagaattgtatgatcacttatgctgcgtacagaaacattttccctatttgggctttgggggactaccggtgtcgtgtacttctggcgccatgagattatctaagcattttgagtataaattttcagtgtttgttacatagttgttctgtgtggcatcttgtacgtcatatttgccacacgctcgggctacagtagagtaatatagacgtgattagttcacagatgaaaccttagacgttaccatatgtttgtaaatccggccagaacttgttcgcagcactttacgtgcatgcatcatagtgccttataagagttcctgtaaaaaaaaaaaaaaa

SEQ ID NO: 4386 - protein, 757 aa, Centella asiatica
MWKLKVAEGGNPWLRTVNNHVGRQIWEFDPKLGSPEELAEIEKARENFHNHRFEKQHSSDLLMRLQFANENPRHEVLPQVKVKDIGDISEDKVTITLKRALSFYSTLQANDGHWAGDYGGPMFLMPGLVITLSITEALNAILSKEHKREICRYLYNHQNRDGGWGLHIEGPSTMFGSVLNYVTLRLLGEGTKDGQGAMEKGRQWILDHGGATAITSWGRMWLSVLGVFEWSGNNPLPPEIWLFPYNLPFHPGRMWCHCRMVYLPMSYLYGKRFVGPITPTVLSLRKELFTVPYHEIDWNQARNLCAKEDLYYPHPLVQDILWASIDKVLEPILMRWPGKKLREKALRTVMEHIHYEDENTRYICIGPVNKVLNMLCCWAEDPNSEAFKLHLPRLYDFLWLAEDGMKMQGYNGSQLWDTAFAVQAIISTSLTEYCGPTLRKAHTFMKDSQVLDDCPGDLDFWYRHISKGAWPFSTADHGWPISDCTAEGFKAVLLLSKFPAELVGEPLDAKRLYDAVNVILSLQNSDGGYATYELTRSYRWLELINPAETFGDIVIDYPYAECTSAAIQALSAFKKLYPGHRREEIQCSIEKAADFIEKIQASDGSWYGSWGVCFTYGTWFGVKGLISAGRTFSNCSSIRKACYFLLSKQLASGGWGESYLSCQNKVYTNLEGERSHVVNTGWAMLALIEAGQAERDATPLHHAAKLLINSQMENGDFPQEEIMGVFNKNCMITYAAYRNIFPIWALGDYRCRVLLAP

SEQ ID NO: 4387 - DNA, 2562 bp, Centella asiatica
  CDS (77)..(2359)
aaagaagattttattttatttttttcagcaaaaaaaagttgaaaaaataagaaattgatagatcgagctaggggagatgtggaagctgaagatagcagagggtaatggagcatacttgtacagcaccaacaactttgtggggagacagatatgggagtatgatcctgatgctggaactcctgaagagcgactagaggtcgagaaacttcgagaaacttacaaatataatctcatcaacaatgggattcacccttgtggtgatatgctcatgaggttgcagctgataaaggagagtgggctggatcttttgagcataccgccggtgagacttggagaacaagaagaagtgaattatcaagtagtgacgacggctgttaagaaagctctgcggttaaaccgcgcaatccaagctcacgacggtcactggccagctgaaaatgctggacctatgttttttacaccacccctcatcatagcgctatacatcagcggagcaattgacactcatctaacaatacaacacaagaaggagatgattcgttttatttacctccaccaaaacaaagatggaggatggggattctatatagagggacatagcacgatgatagggtcagcacttagctacgtggcgttacgtttgctgggagaagggcctgatgacggcgatggtgcagtggagagagcaagaaaatggatccttgaccatggtggtgctgcttctataccctcctggggtaagacttatcttgcggttcttggggtatacgagtgggaagggtgtaaccccctgcccccagaattttggcttttccctgaagctttaccttatcatccagcaaaaatgtggtgttactgtcgcacaacatacatgccgatgtcgtatttgtatgggaagaaatatcatggtccaattacggatcttgttatatctttaagaaaagaaatacaccccattccttatgagaagataaattggaacaaacagcgccataactgtaacaaggaggatctttactaccctcatagctttatacaggatttgctatgggatggtcttcactattttactgaacctatcattaaaatgtggcccttcaataagttgcgaaagaaagggatgaaaagagccattgaacttatgcgctacggaggttatgagagcagattcattaccattggatgtgtatccaagagtctagatatgatgtgttggtgggcagagaacccgaatggtccagaattcaaacatcacttagctagagtacctgattacttgtggcttgcagaggatggaatgaagatgcagagttttggtagtcaattatgggactgtgttcttgctactcaagctgtcatgtctactggtatggttgatgaatatggggattgtcttaagaaagcacatttctatattaaagaatcacagtgcaagaaaaatccgtcaggagattatgcaagtatgtgccggtattttacaaaaggatcatggacattttctgatcaagatcagggttgggttgtctctgattgcacagctgaagcgctgaagtgtctattagcactttctcaaatgccagaggaaattgcaggggaaaaggcagatgttgagcgattatatgatgccgtaaacgtcctcctctacttgcaaagccctataagtgggggttttgccatttgggagccaccagttccaagaccatacttgcaggtgttgaatccttcggagatttttgccgacatcgttgtcgaaaaagagcatacggagtgcacagcatcaataatagcagctctggtagcattcaaacgtttgcatccgggtcatcggtcgaaagaaataagtgttgccatcgcaaaagctgtacattttcttgaaggaaaacaattggaagatggttcatggtatggctactggggaatatgctttttgtatggcacattttttgcgttagctgggttagcttctgtgggacagacttatgaaaacagtgaaaccgttcgtaaagctgttaagtttttcctttctacacaaaatgaagaaggtggttggggagaaagtcttgaatcatgtccgagcgagatattcacaccattagaaggaaacagaacaaatttagtacaaacatcatgggcaatgcttggtctcatgtttggtggacaggccacgagagatccaactccattgcatagagcagcaaagttattgattaatgcacaattgaataacggagatttccctcagcaggaaacaactggagtgtacatgaagaattgtatgttgcattatgccgagtatagaaatgtatttccgttatgggcacttggagagtaccgcaaacgcttgtggctctccaattgaagtactttggttccaaaacatatatcgatccatttataaatgcatatatatggggtgtatgtttaagagtctcaagttattgtaatctttatatatatttattaattaattgtaatgtcaaagagaacatttgaaaacatttgtagttgcttaattgatgcatatgtcattgcaatttacttttaaaaaaaaaaaaaaaaaaa

SEQ ID NO: 4388 - protein, 760 aa, Centella asiatica
MWKLKIAEGNGAYLYSTNNFVGRQIWEYDPDAGTPEERLEVEKLRETYKYNLINNGIHPCGDMLMRLQLIKESGLDLLSIPPVRLGEQEEVNYQVVTTAVKKALRLNRAIQAHDGHWPAENAGPMFFTPPLIIALYISGAIDTHLTIQHKKEMIRFIYLHQNKDGGWGFYIEGHSTMIGSALSYVALRLLGEGPDDGDGAVERARKWILDHGGAASIPSWGKTYLAVLGVYEWEGCNPLPPEFWLFPEALPYHPAKMWCYCRTTYMPMSYLYGKKYHGPITDLVISLRKEIHPIPYEKINWNKQRHNCNKEDLYYPHSFIQDLLWDGLHYFTEPIIKMWPFNKLRKKGMKRAIELMRYGGYESRFITIGCVSKSLDMMCWWAENPNGPEFKHHLARVPDYLWLAEDGMKMQSFGSQLWDCVLATQAVMSTGMVDEYGDCLKKAHFYIKESQCKKNPSGDYASMCRYFTKGSWTFSDQDQGWVVSDCTAEALKCLLALSQMPEEIAGEKADVERLYDAVNVLLYLQSPISGGFAIWEPPVPRPYLQVLNPSEIFADIVVEKEHTECTASIIAALVAFKRLHPGHRSKEISVAIAKAVHFLEGKQLEDGSWYGYWGICFLYGTFFALAGLASVGQTYENSETVRKAVKFFLSTQNEEGGWGESLESCPSEIFTPLEGNRTNLVQTSWAMLGLMFGGQATRDPTPLHRAAKLLINAQLNNGDFPQQETTGVYMKNCMLHYAEYRNVFPLWALGEYRKRLWLSN

SEQ ID NO: 4389 - DNA, 2190 bp, Ashbya gossypii
  CDS (1)..(2190)
atgctatactcagatgaactaggattgccaactaccgactcgaggcgttggaggcttttctgcgatgaggtgggtgcggagcggtgggagtacatggatgagcaagagacaagcaaggttccgcaaacgacgtgtgtgcagtggttgctgaatgtcccgagctttccgacacctgaaccagaggtgagcagtaaagaccagggatttactgcggcaaatgcggcgtacaacggggcgcggtttctgggcctgctgcaggacgaggcttcgggcacgttcccctgctcgtacaggggcccgatgttcatgactatcgggtatgtggtggcgatgcatgtgggcggggtggtaatccctgagcctcagcggcgggagctagtgcgctacgtggtgaacacggcacaccctgtcgacggcgggtggggattgcattcggaggacaagtcgactgtgatgggcaccgcgctgaactacgttctgctgcggctcttagggatggagcgcgaacacatcgtgatgcagcgggcgcggaagaccctgctgcgcatggggggtgctattggctcgccgtactggggtaaagtgtggctttccgtgctcaatttatacaagtgggagggcgtgaacccagcgccaccagagctatggctgctgccgtaccagtttccttatcacccggctcgctggtgggtacatacgcgtgctatctttttgccgatgagctacctggcaggggtccgctaccagtgtgctctgacgccattactggaggagatcaggtccgagatatttacgaggccattcgaagagattgactttgctgccaacaggaacaatgtgtgcggtattgacctctactacccgcatacgaccgtacttaacacgctcaacaaatgcattgtggggtatgaaaagtacttgcgccccaactggctactaaaatactctcttaacagaatatatgagctgattaagatggaaatccagaatactgactacctctgtattgcaccggttaataatgctctgaatgccattgtaacgtgtatcgaagagggccctgactcagcggagttcggtcgctttcttgacagatttaaggaggtcctgtttctcggtcctcaaggcatgctggtaatgggaactaacggtgttcaagtgtgggattgtgccttctatatacagtcaatgtttgccgccaacttgcaagacaagcccgagttttatgaaaacatcgttagggcgtaccgctttctctgtcgttcacagatcactgatgattgtgttcccggcagctacagggatcctcgtattggtgcttggcccttttctactaaaacccaaggttacgcagtttcagattgtacggctgaggcggccaagtctgtcttgcttgtgcggaattctccagttttcaaggaggtgcgggacgagatatcgagcgagaagctgcaaaaggccattgatgcgcttttgggtttgcaaaatcttggatcattcaagtatggctcattcgcttcttatgagaagatcagagcgccattatcgattgagagtttgaattctgcggaggtgtttgctaatataatggttgagcatccgtatgttgaatgtaccgattcatccgtactaggcttatcgttctatcgcaaataccacgattatcgccaagatgaggtcgaccacgccatcaagatcgctgtcaagtttataaagagtgcccaagagaaggatggttcgtggtatggatgctggggtatttgctatacatatgctggaatgtttgcgcttgaagcgcttcataacgccggcgaaagctacgcggactcggaagtagtaaagaaggggtgtgagtttctggtaagcaagcagttgcccgatggcggttggagtgagacaatgaaatcttcagaactgcacacgtacgtcagtgacaagaggtcatacgttgttcaaactgcatgggctttgattggtttgctgctagccgattatccggatagaaaagtgattgaccgtggcattcaactgcttaaggaaagacaattgccctctggtgaatggaagtatgagagtattgagggtgttttcaatcattcatgtgccattgagtacccaagttaccgatttgtgtttccaataaaggccctaggaatctatagcaaaaaatacgccaaagacgctttgtag

SEQ ID NO: 4390 - protein, 729 aa, Ashbya gossypii
MLYSDELGLPTTDSRRWRLFCDEVGAERWEYMDEQETSKVPQTTCVQWLLNVPSFPTPEPEVSSKDQGFTAANAAYNGARFLGLLQDEASGTFPCSYRGPMFMTIGYVVAMHVGGVVIPEPQRRELVRYVVNTAHPVDGGWGLHSEDKSTVMGTALNYVLLRLLGMEREHIVMQRARKTLLRMGGAIGSPYWGKVWLSVLNLYKWEGVNPAPPELWLLPYQFPYHPARWWVHTRAIFLPMSYLAGVRYQCALTPLLEEIRSEIFTRPFEEIDFAANRNNVCGIDLYYPHTTVLNTLNKCIVGYEKYLRPNWLLKYSLNRIYELIKMEIQNTDYLCIAPVNNALNAIVTCIEEGPDSAEFGRFLDRFKEVLFLGPQGMLVMGTNGVQVWDCAFYIQSMFAANLQDKPEFYENIVRAYRFLCRSQITDDCVPGSYRDPRIGAWPFSTKTQGYAVSDCTAEAAKSVLLVRNSPVFKEVRDEISSEKLQKAIDALLGLQNLGSFKYGSFASYEKIRAPLSIESLNSAEVFANIMVEHPYVECTDSSVLGLSFYRKYHDYRQDEVDHAIKIAVKFIKSAQEKDGSWYGCWGICYTYAGMFALEALHNAGESYADSEVVKKGCEFLVSKQLPDGGWSETMKSSELHTYVSDKRSYVVQTAWALIGLLLADYPDRKVIDRGIQLLKERQLPSGEWKYESIEGVFNHSCAIEYPSYRFVFPIKALGIYSKKYAKDAL

SEQ ID NO: 4391 - DNA, 2562 bp, Panax ginseng
  CDS (48)..(2357)
ggccattacggccggggaccacataccaacaagtagtagacttaagaatgtggaagctgaaggttgctcaaggaaatgatccatatttgtatagcactaacaactttgttggcagacaatattgggagtttcagcccgatgctggtactccagaagagagggaagaggttgaaaaagcacgcaaggattatgtaaacaataagaagctacatggaattcatccatgcagtgatatgctgatgcgcaggcagcttattaaagaaagtggaatcgatctcctaagcataccgccgttgagattagatgaaaacgaacaagtgaactacgatgcagttacaaccgctgtgaagaaagctcttcgattgaaccgggcaattcaagcacacgatggtcactggccagctgaaaatgcaggctctttactttatacacctccccttatcattgccctatatatcagcggaacgattgacactattctgacaaaacaacacaagaaggaactgattcgcttcgtttacaaccatcaaaatgaggatggtggatggggatcctatattgaggggcacagcacgatgattgggtcagtacttagctacgtgatgttacgtttgctaggagaaggattagctgaatctgatgatggaaatggtgcagttgagagaggccggaagtggatacttgatcatggaggtgcagccggcataccctcttggggaaagacttatctagcggtgcttggagtatatgagtgggaagggtgcaacccgctgcccccagaattctggcttttcccttcaagttttccttttcatccagcaaaaatgtggatctactgccggtgcacttacatgccaatgtcgtatttgtatgggaagagatatcatggaccaataaccgatcttgttttatctttgaggcaagaaatttacaacattccttatgagcagataaagtggaatcaacagcgccatatctgttgcaaggaggatctctactaccctcatacccttgtacaagacctggtttgggatggtcttcactactttagtgaaccattcctcaaacgttggcccttcaacaaactgcgaaaaagaggtctaaaaagagttgttgaactaatgcgctatggtgccaccgagaccagattcataaccacaggaaatggggaaaaagctttacaaataatgagttggtgggcagaagatcccaatggtgatgagtttaaacatcaccttgctagaattcctgatttcttatggattgctgaggatggaatgacagtacagagttttggtagtcaactatgggactgtattcttgctactcaagcaattatcgccaccaatatggttgaagaatacggagattctcttaagaaggtgcatttcttcatcaaagaatcgcagataaaagaaaatccaagaggagacttcctaaaaatgtgtcgacagtttaccaaaggtgcgtggactttctctgatcaagatcatggttgcgttgtctcggactgcacagctgaagcactaaagtgcctactgttactttcacaaatgccacaggatattgtcggagaaaaacctgaggttgagcgattatatgaggctgtgaatgttcttctctatttgcagagtcgtgtaagtggtggtttcgcagtttgggagcctccagttccaaaaccatatttggagatgttgaatccttcagaaatttttgcagacattgttgttgagagagagcacattgaatgcactgcatctgtaatcaaaggtctgatggcatttaaatgcttgcatcctgggcatcgtcagaaagagatagaggattctgtggcgaaagccatccgttatcttgaaagaaaccaaatgcctgatggttcatggtatggcttttggggaatttgtttcctctatgggacattttttaccctatctgggtttgcttctgctgggaggacttatgacaacagtgaagcagttcgtaagggtgttaaatttttcctttcaacacaaaatgaagaaggtggttggggggagagtcttgaatcatgcccaagcgaaaaatttacaccactcaagggaaacagaacaaatctagtacaaacatcatgggctatgctaggtcttatgtttggtggacaggccgagagagatccgacacctctgcatagagcagcaaagttgttgatcaatgcgcaaatggataatggagatttccctcaacaggaaattactggagtatactgtaaaaatagtatgttacattatgcggagtacagaaatatatttcctctttgggcactcggagaatatcggaaacgtgtttggttgcctaagcaccagcagctcaaaatttaagttacattcttatgattcttcaaaatgttttgataggatgaattaatgcgctaaattccacactagtatcgtctccaaataaattagaaaaattaaggagcttctagcttccagcttctggcttcagttgtgttgtgtactgtattaatttggacggccttttaagctctcaaataaataataaatcggaaataggtgttgtttg

SEQ ID NO: 4392 - protein, 769 aa, Panax ginseng
MWKLKVAQGNDPYLYSTNNFVGRQYWEFQPDAGTPEEREEVEKARKDYVNNKKLHGIHPCSDMLMRRQLIKESGIDLLSIPPLRLDENEQVNYDAVTTAVKKALRLNRAIQAHDGHWPAENAGSLLYTPPLIIALYISGTIDTILTKQHKKELIRFVYNHQNEDGGWGSYIEGHSTMIGSVLSYVMLRLLGEGLAESDDGNGAVERGRKWILDHGGAAGIPSWGKTYLAVLGVYEWEGCNPLPPEFWLFPSSFPFHPAKMWIYCRCTYMPMSYLYGKRYHGPITDLVLSLRQEIYNIPYEQIKWNQQRHICCKEDLYYPHTLVQDLVWDGLHYFSEPFLKRWPFNKLRKRGLKRVVELMRYGATETRFITTGNGEKALQIMSWWAEDPNGDEFKHHLARIPDFLWIAEDGMTVQSFGSQLWDCILATQAIIATNMVEEYGDSLKKVHFFIKESQIKENPRGDFLKMCRQFTKGAWTFSDQDHGCVVSDCTAEALKCLLLLSQMPQDIVGEKPEVERLYEAVNVLLYLQSRVSGGFAVWEPPVPKPYLEMLNPSEIFADIVVEREHIECTASVIKGLMAFKCLHPGHRQKEIEDSVAKAIRYLERNQMPDGSWYGFWGICFLYGTFFTLSGFASAGRTYDNSEAVRKGVKFFLSTQNEEGGWGESLESCPSEKFTPLKGNRTNLVQTSWAMLGLMFGGQAERDPTPLHRAAKLLINAQMDNGDFPQQEITGVYCKNSMLHYAEYRNIFPLWALGEYRKRVWLPKHQQLKI

SEQ ID NO: 4393 - DNA, 2277 bp, Glycyrrhiza glabra
  CDS (1)..(2277)
atgtggaagctgaagataggagaaggaggagcggggttgatttccgtgaacaacttcatcggacggcaacactgggagttcgatccaaatgcaggaactccacaggaacacgctgagattgaaaggctacgccgggaattcaccaaaaaccgtttttccatcaaacaaagcgctgacctcttgatgagaatgcagctcagaaaggagaaccattacggcaccaataataatattccagcagcagtgaaattgagtgacgcagagaacataacggtggaagcattggttacaacaattacaagggctatcagtttctattcctcaattcaagcccatgatggacactggcctgcagaatctgctgggcctctctttttccttcaaccattggtaatggccctatatattacaggatcccttgatgacgttttaggacctgaacataagaaggaaattgttcgctatttgtataatcatcagaatgaagatggtgggtggggattccatatagagggtcatagcacaatgtttggatctgcattgagctacgttgcattaaggatacttggagaagggcctcaagacaaggcaatggccaaaggcagaaaatggatcctcgaccacggtggtttagttgctattccatcatggggaaagttctgggtcacggtacttggagcttatgagtggtcaggctgcaatccacttccaccagagttatggcttctgcccaaattcgccccttttcatccaggaaaaatgttgtgctactgtcgcttggtttacatgcccatgtcatatttatatgggaagaagttcgtgggccctatcactgccttaatcagatcactacgagaagaattgtacaatgagccttataatcaaattaactggaatacagctcgaaacactgttgctaaggaggatctctactacccacatcctctgatccaagatatgttatggggatttctttatcacgtgggagagcgttttctgaattgctggcccttttccatgcttagacggaaggcattagaaatcgcaattaatcatgtacattacgaggacgagaacagtagatacctttgcattggcagtgtagagaaggtgttatgtttgattgcgcgttgggttgaagatcccaactcagaggcatacaaacttcatttagcccgaatccctgattacttctggctcgctgaagatggcttgaaaatccagagctttgggtgccagatgtgggatgcagcattcgctatacaagcaatacttgcctgtaatgtgagtgaggagtatggacctacgctccggaaagcacaccacttcgtgaaggcttcgcaggttcgcgaaaacccatccggtgacttcaacgcaatgtacagacacatttcgaaaggagcatggacattctcaatgcatgatcacggttggcaagtctctgactgcaccgcagaaggactaaaggctgcactgctattgtcagaaatgccaagtgaactagttggggggaaaatggaaacagagcgcttctacgacgctgttaatgtcatcctctctctacaaagcagtaatggcgggttccctgcttgggagcctcagaaagcgtaccgttggttagagaaattcaatccaactgaattctttgaagacactatgattgagagggagtatgttgagtgcactggatccgcaatgcaagggttggctctcttcagaaagcaattcccacagcacagaagcaaggaaatagatcgctgcattgccaaagcaatccgttacatagaaaacatgcaaaatcctgatggctcttggtatgggtgttggggaatttgctatacatacggtacatggtttgccgtggagggactaacggcctgtgggaagaactgccacaacagtctttccttgcgaaaagcttgtcaattcttgttgtcaaagcagcttcctaatgcggggtggggagaaagttacttgtcaagccaaaacaaggtgtatacaaacctagaaggaaaccgtgcaaatttagttcaaagttcgtgggctttgttgtcccttactcatgcagggcaggccgagatagatcctacacccatacaccgtggaatgaagttactcatcaattcacaaatggaagatggagacttcccacagcaggagattacaggagtatttatgaggaactgtaccctgaactactcatcgtatcgaaacatctttcccatatgggctatgggagagtatcgtcgccaagtcttgtgtgctcacagttattga

SEQ ID NO: 4394 - protein, 758 aa, Glycyrrhiza glabra
MWKLKIGEGGAGLISVNNFIGRQHWEFDPNAGTPQEHAEIERLRREFTKNRFSIKQSADLLMRMQLRKENHYGTNNNIPAAVKLSDAENITVEALVTTITRAISFYSSIQAHDGHWPAESAGPLFFLQPLVMALYITGSLDDVLGPEHKKEIVRYLYNHQNEDGGWGFHIEGHSTMFGSALSYVALRILGEGPQDKAMAKGRKWILDHGGLVAIPSWGKFWVTVLGAYEWSGCNPLPPELWLLPKFAPFHPGKMLCYCRLVYMPMSYLYGKKFVGPITALIRSLREELYNEPYNQINWNTARNTVAKEDLYYPHPLIQDMLWGFLYHVGERFLNCWPFSMLRRKALEIAINHVHYEDENSRYLCIGSVEKVLCLIARWVEDPNSEAYKLHLARIPDYFWLAEDGLKIQSFGCQMWDAAFAIQAILACNVSEEYGPTLRKAHHFVKASQVRENPSGDFNAMYRHISKGAWTFSMHDHGWQVSDCTAEGLKAALLLSEMPSELVGGKMETERFYDAVNVILSLQSSNGGFPAWEPQKAYRWLEKFNPTEFFEDTMIEREYVECTGSAMQGLALFRKQFPQHRSKEIDRCIAKAIRYIENMQNPDGSWYGCWGICYTYGTWFAVEGLTACGKNCHNSLSLRKACQFLLSKQLPNAGWGESYLSSQNKVYTNLEGNRANLVQSSWALLSLTHAGQAEIDPTPIHRGMKLLINSQMEDGDFPQQEITGVFMRNCTLNYSSYRNIFPIWAMGEYRRQVLCAHSY

SEQ ID NO: 4395 - DNA, 2505 bp, Oryza sativa
  CDS (1)..(2505)
atgcacccagttgcatcagactcgcatgaccaggaggcagaggaagccagaacaaggctcatgctcatcatgcacgcagaagccatttctctcatgctttcagctgccaagcttcacccagcacggcttgcgaatagtttctacaatatgtggaagctcaagattgccgagggaggaccatggctaaagagtggaaacagtcatgttggaagagaaacatgggaatttgacccaaattttggaacaagtgaagagcgggaggcggttgaggctgcacggatagagttccagaagaataggttcagaacaagacacacctccgatgttttggctcgcatgcagttagctaaggcgaacaacttcagtattgatctacagaaagaaaaagatggaaaccccataaatattgacacagctacagtatcagatatactgaagaaggcactcagttatttctcagccatacaggcatatgatgggcactggccaggggatttcccaggcccactgtttaccactgcaaccatgatcatagttctatatgtcacagagtcattaactattacactgtcatcggaacatcacaaggagatctgtcgatatctgtacaatcgtcagaacatcgatggaggatggggactacatgcagaaggtgaaagttccatgcttagcacagctctcaattatactgctctgagactacttggggagaatgttgatgatggaccagatatatccatgcataaagcaagaaaatggatacatgaccatggaggtgcaacaatgataccgatcttgggaaaagtgtggctctcggtgcttggagtttttgactggtcaggtgtaaatcctattcccccagaattatttcttcttccatctttcgttcctatccaaccaggacgattatggagtcacttccgaatggcttttattcccatgtcttatttgtatggaaaaaagtttgtcggtcctataacaagattggttatatcattaagggaagagctacatattcatccctataaaaagattgactggaaggaggcacgcaaattatgtgcaaaggaagatgcctataatccacatatgtggctacaagagtgcctatctgactgcctttatagttttggtgagccgtttcttacacgttggccaatttcctacatgagaaaaagagctctataccaaattgctgagttcttgaagtatgaagatgaaaattctcagtatatctgcattggtgctgcacagaaggcattatccatgttgtgctgttggattgaaaatcccaattcagatgcattcaagcgtcatttggctagagtagctgattttctatgggttggcgaagatggcatgaaagttcgggtctgtgcgggtcaattatgggatgttgctttcgcagtccaagcgatattagcgtgtagcatcgcagaagaatttggaagtacccttaagaaagcacatggtttcataaaaacttcccagattatggacaatccttctggtgacttcagcagaaagtaccgtcacatatctaaaggaggatgggccttccaggttgcagatcaggggtggcaggtttcagattgcacagcagaagctcttaaggctttgctactgctgtcaaagtgtttgtcagatggtgcagattatcaaatggaaacctactgctactttgacgcggtgaatgtattactctcgttacagaacccaaatggtgggtatggagcatgggagctagctcgcacatatccatggatggagtcacaaggcatacttcagagcattaggactatcaaaggtgaaggagagtacgtagagtgtacctcatcagtcatccaagcattggcattgttccgggagaagtaccctgggcatcggaaagatgaaatagatcaatgcatcaggaaagcaacagaattcatcgagaagttacagaatgatgatggatcatggtttggatcatggggtatttgcttcacgtatggaacatggtttgcaatagagggtctgtcagccgtggggcagtgttatgatgacagcacctgcattcggaaagcctgtaagtttctgttatcaaagcaactaacaaatggtggatggggggagagtcatctttcatccagaaccaaggcatacacaaacctagatggggagaaatcacatatagtcaatactgcatgggcaatgttggcactcatgaaagctggacaggtagagagagaccccgctcctctgcacaaagcagcaagacttatcatgagcatgcagctcagtgatggtgactttccacaagaggaaatgatcggaagtttcttgaaaaatggccccttgtgttatatggcttatcgcaatatattcccaatatgggctcttggagagtatcagaaattagtatttcagaactatcagacctctagcatcaagcaaacaaatatagctccatctgctggcaatgctgctctgaagaattcagcaagtacaacagcgccaacttga

SEQ ID NO: 4396 - protein, 834 aa, Oryza sativa
MHPVASDSHDQEAEEARTRLMLIMHAEAISLMLSAAKLHPARLANSFYNMWKLKIAEGGPWLKSGNSHVGRETWEFDPNFGTSEEREAVEAARIEFQKNRFRTRHTSDVLARMQLAKANNFSIDLQKEKDGNPINIDTATVSDILKKALSYFSAIQAYDGHWPGDFPGPLFTTATMIIVLYVTESLTITLSSEHHKEICRYLYNRQNIDGGWGLHAEGESSMLSTALNYTALRLLGENVDDGPDISMHKARKWIHDHGGATMIPILGKVWLSVLGVFDWSGVNPIPPELFLLPSFVPIQPGRLWSHFRMAFIPMSYLYGKKFVGPITRLVISLREELHIHPYKKIDWKEARKLCAKEDAYNPHMWLQECLSDCLYSFGEPFLTRWPISYMRKRALYQIAEFLKYEDENSQYICIGAAQKALSMLCCWIENPNSDAFKRHLARVADFLWVGEDGMKVRVCAGQLWDVAFAVQAILACSIAEEFGSTLKKAHGFIKTSQIMDNPSGDFSRKYRHISKGGWAFQVADQGWQVSDCTAEALKALLLLSKCLSDGADYQMETYCYFDAVNVLLSLQNPNGGYGAWELARTYPWMESQGILQSIRTIKGEGEYVECTSSVIQALALFREKYPGHRKDEIDQCIRKATEFIEKLQNDDGSWFGSWGICFTYGTWFAIEGLSAVGQCYDDSTCIRKACKFLLSKQLTNGGWGESHLSSRTKAYTNLDGEKSHIVNTAWAMLALMKAGQVERDPAPLHKAARLIMSMQLSDGDFPQEEMIGSFLKNGPLCYMAYRNIFPIWALGEYQKLVFQNYQTSSIKQTNIAPSAGNAALKNSASTTAPT

SEQ ID NO: 4397 - DNA, 2458 bp, Lotus japonicus
  CDS (12)..(2300)
ggcagaagatcatgtggaagctgaaggtagcagatggtggcaagaatccttacatattcagcatcaacaacttcgtgggaaggcagacatgggagtatgatcctgatgcaggtactcctgaggaacgagctcaggttgaagaagctcgtcaggatttctataacaaccgctacaaggtcaagacttgtggcgaccgactttggcggtttcaggttatgagggaaaataacttcaaacaaacaataccgagtgtgaagatagaggatggagagaaggtaacatacgataaagtgacaacaactgtgagaagggccgcacatcacctagcaggattacagaccagtgatggccattggcctgctcaaattgctggtcctctgcttttcacgcctcccttgatcttttgtatgtacataacaggtcatcttgattctgtattcccagaagtgtaccgcaaagagattcttcgttacacatacgttcatcagaatgaagatggagggtggggactacacatagagggtcatagcaccatgttttgtactgtactcaactacatatgcatgcgaatacttggagaaggacctgatggaggtcaagacaatgcttgtgcaagagcaagaaaatggattcatgatcatgggggcgcgacacacatagcttcttgggggaagacatggctttcgatacttggtatatttgattggagcggaaccaatccaatgcctccagaattttggatccttccttcatttcttcctatgcatccagctaaaatgtggtgttattgccgattggtgtacatgcctatgtcttacttgtatgggaagagatttgtgggtccaataacaccactcatcttacagttgagagaagaactctttactcaaccttatgaaaaagttaattggaagaaggcacgtcatcaatgtgcaaaggaagatctttactatcctcatcctttgatacaagacttgatgtgggatagtttatacctattcactgagccattcttgactcgttggcctttcaacaagctgatcagagaaagagcccttcaagtaacaatgaaacatatccattatgaagatcataatagtcgatacattaccattgggtgcgtggaaaaggttttatgcatgcttgcttgttgggtggaagatccgaacggaattgctttcaagagacatcttgccagggtcccggattacttgtggcttgcagaagatggaatgtgcatgcagagttttggtagccaagaatgggatgctggtttcgccgttcaagctctgctttctactaacctaattgacgaactcggtcccgcacttgcaaaaggacatgattttatcaagaattctcaggttaaggacaacccttcaggagattttaagagtatgcatcgccatatttccaaaggagcatggaccttttctgatcaagaccatggatggcaagtttctgattgcactgcagaaggttttaagtgttgtctacttttgtcaatgttgcctccagagattgtaggggaaaagatagagcctgaaaggttattcgatactgtcaatctcctattgtcacttcagagtaaaaagggtggttttgcagtatgggagccagcaggagctcaggagtggctggaactactcaatcccatagaattttttgaggacattgtaattgagcatgaattggttgagtgcactggatcagcaattggagccttagttttgttcaagaatcattatccagagcatagaaagaaagagatcgaggattgcattgctaatgcagttcgttactttgaagatatacaaacagcagatggttcttggtatggaaatgcaggaatttgcttcatttatggtacttggtttgcacttggtggtctagaagcagctggcaaaacttatgccaattgtgctgccattcgcaaaggtgttaaatttctactcacgacacaatcaaaggatggtgggtggggagagagttatctatcatgcccaaaaaagatatatgtacctcttgaaggaaaccgatcaaatgttgtacagacagcatgggctcttatgggtttgattcatgctggccaggcggagagagaccctactccacttcaccgtgctgcaaaattgctcatcaattctcagcttgaagatggtgattggccccaacaggatattactggagtatacgtgaaaaattgcacgctgcattacccaatgtacagaaataattttacaacgatggccctagctgaatatcgtcgacgggttccattaccatccattgcagtttaacttgtaaagatagctgtgtgcacaaaaaggcacagccacatcaatagatcatgcaaataaaataatcaaacaagttctgcagttgaccttgtacaattgtactcttattactatagtatgtatttagtgtcggtttgttgccaaaaaaaaaaaaggcc

SEQ ID NO: 4398 - protein, 762 aa, Lotus japonicus
MWKLKVADGGKNPYIFSINNFVGRQTWEYDPDAGTPEERAQVEEARQDFYNNRYKVKTCGDRLWRFQVMRENNFKQTIPSVKIEDGEKVTYDKVTTTVRRAAHHLAGLQTSDGHWPAQIAGPLLFTPPLIFCMYITGHLDSVFPEVYRKEILRYTYVHQNEDGGWGLHIEGHSTMFCTVLNYICMRILGEGPDGGQDNACARARKWIHDHGGATHIASWGKTWLSILGIFDWSGTNPMPPEFWILPSFLPMHPAKMWCYCRLVYMPMSYLYGKRFVGPITPLILQLREELFTQPYEKVNWKKARHQCAKEDLYYPHPLIQDLMWDSLYLFTEPFLTRWPFNKLIRERALQVTMKHIHYEDHNSRYITIGCVEKVLCMLACWVEDPNGIAFKRHLARVPDYLWLAEDGMCMQSFGSQEWDAGFAVQALLSTNLIDELGPALAKGHDFIKNSQVKDNPSGDFKSMHRHISKGAWTFSDQDHGWQVSDCTAEGFKCCLLLSMLPPEIVGEKIEPERLFDTVNLLLSLQSKKGGFAVWEPAGAQEWLELLNPIEFFEDIVIEHELVECTGSAIGALVLFKNHYPEHRKKEIEDCIANAVRYFEDIQTADGSWYGNAGICFIYGTWFALGGLEAAGKTYANCAAIRKGVKFLLTTQSKDGGWGESYLSCPKKIYVPLEGNRSNVVQTAWALMGLIHAGQAERDPTPLHRAAKLLINSQLEDGDWPQQDITGVYVKNCTLHYPMYRNNFTTMALAEYRRRVPLPSIAV

SEQ ID NO: 4399 - DNA, 2289 bp, Medicago truncatula
  CDS (1)..(2289)
atgtggaagctgaagattggagagggaaagaatgagccatacttattcagcacaaataattttgtgggaagacaaacatgggagtatgatccagaagcaggtagtgaagaagaaagagcacaagttgaagaagctcgtaagaatttctatgacaacagattcaaggtcaagccctgtggtgacctcctatggcgttttcaggttctaagagaaaataactttatgcaaacaatagatggagtgaagatagaagatggagaagagataacatatgagaaagcaacgacaacgttgagaaggggcacacaccatctagcagcattgcaaaccagtgatggccattggcctgctcaaattgcaggtcctctatttttcatgcctcccttggttttctgtgtctacattactggacatcttgattccgtcttcccacgagaacatcgcaaagagattcttcgttacatttactgtcaccaaaatgaagatggaggatgggggctacacattgagggtcacagcaccatgttttgtactgcacttaactatatatgtatgcgaattctcggagaaggacctgatggcggtcaagacaatgcttgtgctagagccagaaactggattcgggcacacggtggtgtcacatatataccttcatggggaaaaacttggctttcgatacttggtctctttgattggttgggaagcaacccaatgccccctgagttttggatccttccttcatttcttcctatgcatccagctaaaatgtggtgttattgtcgattggtatacatgcctatgtcttacttgtacgggaagagatttgtgggtccgatcacaccactcatcttacagttgagagaagaactccatactcagccttatgaaaaaattaactggacgaaatcacgtcacctatgtgcaaaggaagatatttactatccccatcctttgatacaagatctgatatgggatagcttatacatatttaccgagccgcttctcactcgctggcctttcaacaagctggtcagaaaaagagcccttgaagttacaatgaagcatatccactacgaggatgagaacagtcgatacctaaccattgggtgtgtggaaaaggtattatgtatgcttgcttgttgggtggaagatccaaatggagatgcttacaagaagcatcttgcaagggtccaagattacttgtggatgtcagaagatggaatgaccatgcagagttttggtagccaagaatgggatgctggttttgccgttcaagctttgcttgccgctaacctaaatgatgaaatcgaacctgcacttgccaaaggacatgatttcattaagaaatctcaggttacagagaacccttctggagattttaagagtatgcatcgtcatatttctaaaggctcatggaccttctccgatcaagaccatggatggcaagtttctgattgcaccgctgaaggtttgaagtgttgtctacttttatcaatgttgcctccagagattgtgggggaaaagatggaaccagaaaggttatatgattcggtcaatgtcttgttgtcgcttcagagtaaaaagggtggtttggcagcatgggagcccgcaggagctcaagagtggttagaactactcaatcccactgagttttttgcggacattgttgttgagcatgaatatgttgagtgcactggatcagcaattcaagctttagttttgttcaagaagctatatccagggcataggaagaaagagatagagaatttcatctccgaggcagttcgattcattgaagatatacaaacagccgatggttcatggtatggaaactggggagtttgcttcacttatgggtcttgggttgctcttggtggtttagcagctgctggcaagacttataccaattgcgctgctattcgcaaagctgttaaatttcttctcacaacacagagagaggatggtgggtggggggagagctatctttcaagcccaaaaaagatatatgtacctctcgaaggaagccgatccaatgttgtacatactgcatgggctcttatgggtttaattcatgccggccaggcagagagagaccctactcctctccatcgtgctgcaaaattgctcatcaattcccagttggaagaaggcgattggccccaacaggaaatcacaggagtattcatgaaaaattgtatgttgcattacccaatgtatagagatatttaccccttgtgggctctagccgagtatcgtagacgggttccattgccttccactgcagtttaa

SEQ ID NO: 4400 - protein, 762 aa, Medicago truncatula
MWKLKIGEGKNEPYLFSTNNFVGRQTWEYDPEAGSEEERAQVEEARKNFYDNRFKVKPCGDLLWRFQVLRENNFMQTIDGVKIEDGEEITYEKATTTLRRGTHHLAALQTSDGHWPAQIAGPLFFMPPLVFCVYITGHLDSVFPREHRKEILRYIYCHQNEDGGWGLHIEGHSTMFCTALNYICMRILGEGPDGGQDNACARARNWIRAHGGVTYIPSWGKTWLSILGLFDWLGSNPMPPEFWILPSFLPMHPAKMWCYCRLVYMPMSYLYGKRFVGPITPLILQLREELHTQPYEKINWTKSRHLCAKEDIYYPHPLIQDLIWDSLYIFTEPLLTRWPFNKLVRKRALEVTMKHIHYEDENSRYLTIGCVEKVLCMLACWVEDPNGDAYKKHLARVQDYLWMSEDGMTMQSFGSQEWDAGFAVQALLAANLNDEIEPALAKGHDFIKKSQVTENPSGDFKSMHRHISKGSWTFSDQDHGWQVSDCTAEGLKCCLLLSMLPPEIVGEKMEPERLYDSVNVLLSLQSKKGGLAAWEPAGAQEWLELLNPTEFFADIVVEHEYVECTGSAIQALVLFKKLYPGHRKKEIENFISEAVRFIEDIQTADGSWYGNWGVCFTYGSWVALGGLAAAGKTYTNCAAIRKAVKFLLTTQREDGGWGESYLSSPKKIYVPLEGSRSNVVHTAWALMGLIHAGQAERDPTPLHRAAKLLINSQLEEGDWPQQEITGVFMKNCMLHYPMYRDIYPLWALAEYRRRVPLPSTAV

SEQ ID NO: 4401 - DNA, 2202 bp, Mus musculus
  CDS (1)..(2202)
atgactgagggcacgtgtctgcggcgtcgtgggggaccctataaaactgagcccgccaccgatctcacccgctggcggctccagaatgagttgggtcggcagagatggacttattatcaagcggaggacgaccctggtcgagagcagaccgggctagaggcccactctttgggactggacacaagaagttatttcacggacttaccaaaagcgcaaacagcccatgagggggccctgaatggagtaaccttttatgccaagctgcaggctgaggatggacactgggctggtgattatggtggtccgctcttcctcttgccaggtctcctgattacctgtcacatatcacacatctctctgccagctggatacagagaggagatggtgcggtacctgcggtcagtgcagctccctgatggcggctggggcttgcacatcgaggacaagtccacagtgtttgggactgccctgaactatgtggctctcagaatcctgggtattgggcctgatgatcctgaccttgtgcgcgctcggaacgtccttcacaaaaaaggtggtgcggtggccatcccttcctgggggaagttctggctggctgtcctgaatgtttatagctgggaaggactcaacaccctattccctgagatgtggctgtttcctgaatgggtaccagcgcacccctccactctctggtgtcactgccggcaggtctatctgcccatgagttactgctacgccactcggctaagtgcctcagaggacccactggttcagagcctccgccaggaactctatgtgcaggattacgccagcatcgattggccagcgcagaggaacaacgtgtcccccgatgagatgtacacgccacacagctggctgctgcatgtggtgtatggactcctcaacctgtatgaacgtttccatagcaccagcctgcggaagtgggccgtccagatgctgtatgaacacattgcagctgatgactgtttcactaagtgcatcagcatcggcccgatctcaaagaccatcaacatgcttgttcgttggtcagtggatggaccatcctccccggccttccaggagcacgtttctcggatcaaagattacctttggctgggccttgatggcatgaaaatgcagggcaccaatggatcacagatctgggacacttcatttgctatccaagcactgttagaggcaggtgcacaccacagacctgagtttctgccctgcctgcagaaggctcacgagttcctgcggctttcacaggttccagaaaactgtcctgactatcagaagtactatcgccatatgcgcaagggtggtttctccttcagcacactggactgtggctggatcgttgctgactgcacagccgagggtttgaaggctgtgctgctcctgcagaatcagtgtccgtccatcactgagcatatcccccgagagcggctgtgcgatgctgtggatgtgttactgagcttgaggaatgctgatggcgggttcgctacctatgagaagaagcgtgggggttacttgctggagctgctgaacccctcagaggtctttggagacatcatgattgactacacgtatgtagagtgtacctccgctgtgatgcaggcactgaagcatttccatgaacacttcccagactacagggcagcagaggtcagggagaccctcaatcaaggcctggacttctgccgaaggaagcagagagccgatggctcctgggagggctcctggggtgtttgtttcacctacggcacctggtttggcttggaagcgttcgcttgcatggggcatacctaccaagatggggctgcttgtgcagaagtagctcaggcctgcaacttcctcctgtcccagcagatggcggatggaggctggggagaggactttgaatcatgtgaacagcggcggtatgtgcagagtgctaggtcccaggtccatagcacctgctgggccctgatgggtttgatggctgtcaggcatcccgacatcactgctcaggagagagggatcagatgtctgctagggaagcagttacccaatggagactggcctcaggagaacatctctggggtcttcaacaagtcctgtgccatcagctacacaagttacagaaacatcttccccatctgggccctgggccgcttctccaacctgtatcctgacaataccctcgccggccacatttga

SEQ ID NO: 4402 - protein, 733 aa, Mus musculus
MTEGTCLRRRGGPYKTEPATDLTRWRLQNELGRQRWTYYQAEDDPGREQTGLEAHSLGLDTRSYFTDLPKAQTAHEGALNGVTFYAKLQAEDGHWAGDYGGPLFLLPGLLITCHISHISLPAGYREEMVRYLRSVQLPDGGWGLHIEDKSTVFGTALNYVALRILGIGPDDPDLVRARNVLHKKGGAVAIPSWGKFWLAVLNVYSWEGLNTLFPEMWLFPEWVPAHPSTLWCHCRQVYLPMSYCYATRLSASEDPLVQSLRQELYVQDYASIDWPAQRNNVSPDEMYTPHSWLLHVVYGLLNLYERFHSTSLRKWAVQMLYEHIAADDCFTKCISIGPISKTINMLVRWSVDGPSSPAFQEHVSRIKDYLWLGLDGMKMQGTNGSQIWDTSFAIQALLEAGAHHRPEFLPCLQKAHEFLRLSQVPENCPDYQKYYRHMRKGGFSFSTLDCGWIVADCTAEGLKAVLLLQNQCPSITEHIPRERLCDAVDVLLSLRNADGGFATYEKKRGGYLLELLNPSEVFGDIMIDYTYVECTSAVMQALKHFHEHFPDYRAAEVRETLNQGLDFCRRKQRADGSWEGSWGVCFTYGTWFGLEAFACMGHTYQDGAACAEVAQACNFLLSQQMADGGWGEDFESCEQRRYVQSARSQVHSTCWALMGLMAVRHPDITAQERGIRCLLGKQLPNGDWPQENISGVFNKSCAISYTSYRNIFPIWALGRFSNLYPDNTLAGHI

SEQ ID NO: 4403 - DNA, 2729 bp, Medicago truncatula
  CDS (96)..(2384)
gtctttcctcatatcaatcaaattaaggaggtcttgctagcttccatatataactcatcactaaaacttctaataattgaaaaaaagtaattaagatgtggaagctgaagattggagagggaaagaatgagccatacttattcagcacaaataattttgtgggaagacaaacatgggagtatgatccagaagcaggtagtgaagaagaaagagcacaagttgaagaagctcgtaagaatttctatgacaacagattcaaggtcaagccctgtggtgacctcctatggcgttttcaggttctaagagaaaataactttatgcaaacaatagatggagtgaagatagaagatggagaagagataacatatgagaaagcaacgacaacgttgagaaggggcacacaccatctagcagcattgcaaaccagtgatggccattggcctgctcaaattgcaggtcctctatttttcatgcctcccttggttttctgtgtctacattactggacatcttgattccgtcttcccacgagaacatcgcaaagagattcttcgttacatttactgtcaccaaaatgaagatggaggatgggggctacacattgagggtcacagcaccatgttttgtactgcacttaactatatatgtatgcgaattctcggagaaggacctgatggcggtcaagacaatgcttgtgctagagccagaaactggattcgggcacacggtggtgtcacatatataccttcatggggaaaaacttggctttcgatacttggtctctttgattggttgggaagcaacccaatgccccctgagttttggatccttccttcatttcttcctatgcatccagctaaaatgtggtgttattgtcgattggtatacatgcctatgtcttacttgtacgggaagagatttgtgggtccgatcacaccactcatcttacagttgagagaagaactccatactcagccttatgaaaaaattaactggacgaaatcacgtcacctatgtgcaaaggaagatatttactatccccatcctttgatacaagatctgatatgggatagcttatacatatttaccgagccgcttctcactcgctggcctttcaacaagctggtcagaaaaagagcccttgaagttacaatgaagcatatccactacgaggatgagaacagtcgatacctaaccattgggtgtgtggaaaaggtattatgtatgcttgcttgttgggtggaagatccaaatggagatgcttacaagaagcatcttgcaagggtccaagattacttgtggatgtcagaagatggaatgaccatgcagagttttggtagccaagaatgggatgctggttttgccgttcaagctttgcttgccgctaacctaaatgatgaaatcgaacctgcacttgccaaaggacatgatttcattaagaaatctcaggttacagagaacccttctggagattttaagagtatgcatcgtcatatttctaaaggctcatggaccttctccgatcaagaccatggatggcaagtttctgattgcaccgctgaaggtttgaagtgttgtctacttttatcaatgttgcctccagagattgtgggggaaaagatggaaccagaaaggttatatgattcggtcaatgtcttgttgtcgcttcagagtaaaaagggtggtttggcagcatgggagcccgcaggagctcaagagtggttagaactactcaatcccactgagttttttgcggacattgttgttgagcatgaatatgttgagtgcactggatcagcaattcaagctttagttttgttcaagaagctatatccagggcataggaagaaagagatagagaatttcatctccgaggcagttcgattcattgaagatatacaaacagccgatggttcatggtatggaaactggggagtttgcttcacttatggttcttggtttgctcttggtggtttagcagctgctggcaagacttataccaattgcgctgctattcgcaaagctgttaaatttcttctcacaacacagagagaggatggtgggtggggggagagctatctttcaagcccaaaaaagatatatgtacctctcgaaggaagccgatccaatgttgtacatactgcatgggctcttatgggtttaattcatgccggccaggcagagagagaccctactcctctccatcgtgctgcaaaattgctcatcaattcccagttggaagaaggcgattggccccaacaggaaatcacaggagtattcatgaaaaattgtatgttgcattacccaatgtatagagatatttaccccttgtgggctctagccgagtatcgtagacgggttccattgccttccactgcagtttaactggaaaataagctataagctatgagtacaaaaagatgacaaaatcagtaaaataaaaccaaataagttgggcagtcaagcctattttctacatgtgttgattaatttttgttttatgttagcttatggtatgtatagtatagatggatgtgttcttccacgttttcatttctaaaatggatgtctagctccagaaagaatgatcagttcaaacaaccaaaagaaaaaagttggccatgtttgccgtagggatatatagcaacattcaagcataggtagaatatttacataattcattttaataatatattcttatttcctcctataaaaaaaaaaaaaaaaaaa

SEQ ID NO: 4404 - protein, 762 aa, Medicago truncatula
MWKLKIGEGKNEPYLFSTNNFVGRQTWEYDPEAGSEEERAQVEEARKNFYDNRFKVKPCGDLLWRFQVLRENNFMQTIDGVKIEDGEEITYEKATTTLRRGTHHLAALQTSDGHWPAQIAGPLFFMPPLVFCVYITGHLDSVFPREHRKEILRYIYCHQNEDGGWGLHIEGHSTMFCTALNYICMRILGEGPDGGQDNACARARNWIRAHGGVTYIPSWGKTWLSILGLFDWLGSNPMPPEFWILPSFLPMHPAKMWCYCRLVYMPMSYLYGKRFVGPITPLILQLREELHTQPYEKINWTKSRHLCAKEDIYYPHPLIQDLIWDSLYIFTEPLLTRWPFNKLVRKRALEVTMKHIHYEDENSRYLTIGCVEKVLCMLACWVEDPNGDAYKKHLARVQDYLWMSEDGMTMQSFGSQEWDAGFAVQALLAANLNDEIEPALAKGHDFIKKSQVTENPSGDFKSMHRHISKGSWTFSDQDHGWQVSDCTAEGLKCCLLLSMLPPEIVGEKMEPERLYDSVNVLLSLQSKKGGLAAWEPAGAQEWLELLNPTEFFADIVVEHEYVECTGSAIQALVLFKKLYPGHRKKEIENFISEAVRFIEDIQTADGSWYGNWGVCFTYGSWFALGGLAAAGKTYTNCAAIRKAVKFLLTTQREDGGWGESYLSSPKKIYVPLEGSRSNVVHTAWALMGLIHAGQAERDPTPLHRAAKLLINSQLEEGDWPQQEITGVFMKNCMLHYPMYRDIYPLWALAEYRRRVPLPSTAV

SEQ ID NO: 4405 - DNA, 2416 bp, Glycine max
  CDS (48)..(2267)
acgccggggaaagaggtttgtttggtgtgagtgaatagggatcagggatgtggaggctgaagatagcagatggaggaaatgatccatacatattcagcacaaacaatttcgttgggaggcagacatgggagtttgatcctgaagcaggcagtccagaggaacgggcccaggttgaagcagctcgtcagcatttctaccacaaccgcttcaaggtcaagccctgcgctgacctcctttggcgttttcaggttctcagagaaaataacttcaaacaaacaattcctcgtgtgactatagaagatggagaggaaatcacataccaaaaagtcacaagcgccgtcagaaggggcgcacaccaccttgcggcactgcagacctctgatggccattggcctgctcaaattgcaggtcctctcttctttcttcctcctttggttttttgtatgtatattacaggaaatcttgaatcagtatttccagaagaacatcgcaaagaaattcttcgttacacatattatcaccagaatgaagacggaggatggggactacacatagagggtcatagcactatgttttgtactgcactgaactatatatgcatgcgaatgcttggagaaggacctaatggaggtcatgacaatgcttgtgctagagcaagaaagtggattcgagatcatggtggtgtaacacatataccttcatggggaaaaacttggctttcgatactcggtgtatttgattggtgcggaagcaacccaatgcccccagagttttggatccttccatcttttcttcctatgcatccgggtccaatcacaccactcatcttacaattaagagaagagttgtttactcaaccttatgaaaaagttaattggaagaaagcgcgtcaccaatgtgcaaaggaagatctttactatccccatcctttgatacaagacctaatatgggatagtttatacatattcactgaaccgctacttactcgttggcctttcaacaagttgattagagaaaaggcccttcaagtaactatgaaacatattcattatgaagatgagactagtcgatacataaccattggttgtgtggaaaaggttttatgtatgcttgcttgttgggtggaagatccaaacggagatgctttcaagaagcatcttgcaagggtcccagattacttatgggtttctgaagatggaatgaccatgcagagttttggtagccaagaatgggatgctggctttgctgttcaagctttgcttgccactaacataattgaagaaattggtcctacgtttgcaaaaggacatgatttcatcaagaagtctcaggtgaaggataatccttttggagattttaaaagtatgcatcgtcatatttctaaagggtcttggacattctctgatcaagaccatggatggcaagtttctgattgcactgcagaaggtttaaagtgttgtctacttctatcaatgttgccaccagagattgtgggagaaaagatggaacctgaaagattatacgattcagtcaatgtcttgttgtcgcttcagagtaaaaaaggtggtttagcagcatgggagcctgcaggagctcaagagtggttagaatactccaatcccacagaattttttgcggacattgtagttgaacatgaatatgttgagtgccctggatctgcaatccaagctttagttttgttcaagaagctatatccaggacttaggaggaaagagatagaaaatttcattaccaatgcagttcgatcccttgaagatacacaaacagctgatggttcatggtatggaaattggggagtttgcttcacttatggctcttggtttgcacttggaggtctagcagctgccggtaagacttacaccaagtgtgctgccattcgcaaagccgttaaatttctacttacaacacaaagagaggacggtggatggggagagagttatctttcaagcccaaaaaagatatatgtacctctagaaggaagccgatcaaatgttgtacatacagcatgggctcttatgggactaattcatgctggacaggcggatagagaccccatgcctcttcaccgtgctgcaaagttgctcattaattctcagttggaagagggtgattggccccaacaggaaatcacgggagtattcatgaaaaattgcatgttgcattatccaatgtacagagatatttatccaatgtgggctctagctgaatatcgaaggcgggttccattgccttccactgaagtttaatttagaatggtttgagcacgaaaaggcaaaggcattttcattaagattgaggcaaataaagcaaataagttgtgtgtaatcaagcttaatcaattttttcatattcctatgtttatttcctacatatattggtagaaaaattatttcag

SEQ ID NO: 4406 - protein, 739 aa, Glycine max
MWRLKIADGGNDPYIFSTNNFVGRQTWEFDPEAGSPEERAQVEAARQHFYHNRFKVKPCADLLWRFQVLRENNFKQTIPRVTIEDGEEITYQKVTSAVRRGAHHLAALQTSDGHWPAQIAGPLFFLPPLVFCMYITGNLESVFPEEHRKEILRYTYYHQNEDGGWGLHIEGHSTMFCTALNYICMRMLGEGPNGGHDNACARARKWIRDHGGVTHIPSWGKTWLSILGVFDWCGSNPMPPEFWILPSFLPMHPGPITPLILQLREELFTQPYEKVNWKKARHQCAKEDLYYPHPLIQDLIWDSLYIFTEPLLTRWPFNKLIREKALQVTMKHIHYEDETSRYITIGCVEKVLCMLACWVEDPNGDAFKKHLARVPDYLWVSEDGMTMQSFGSQEWDAGFAVQALLATNIIEEIGPTFAKGHDFIKKSQVKDNPFGDFKSMHRHISKGSWTFSDQDHGWQVSDCTAEGLKCCLLLSMLPPEIVGEKMEPERLYDSVNVLLSLQSKKGGLAAWEPAGAQEWLEYSNPTEFFADIVVEHEYVECPGSAIQALVLFKKLYPGLRRKEIENFITNAVRSLEDTQTADGSWYGNWGVCFTYGSWFALGGLAAAGKTYTKCAAIRKAVKFLLTTQREDGGWGESYLSSPKKIYVPLEGSRSNVVHTAWALMGLIHAGQADRDPMPLHRAAKLLINSQLEEGDWPQQEITGVFMKNCMLHYPMYRDIYPMWALAEYRRRVPLPSTEV

SEQ ID NO: 4407 - DNA, 2487 bp, Costus speciosus
  CDS (80)..(2359)
ctggcgccacctctgtagtctgcactagcatttcttgtcgtctcgatcggtctctcggcaaagcagagatactccggcgatgtggaggctcaaggtcgcggagggctccgggccgtggctgcggagcacaaacaaccacgtcgggcgggaggtgtgggagttcgacccgagcggtggcacgccggaggagatcgcggaggtggagagggcccgggagacgttccgcgaccactgggtcgaacacacgaacagcgctgatctcatcatgcgcttgcagtttgagaaggagaatcccgctgagatgaagtactctgtcattaggattcaagaggcggaaaatatcagtaaagaggctgtagatatctgcttaagaaaggctgtcactcgtatttctactctccaagctcacgacggacactggcctggggattgcggcgccggtccgatgtttcttttgcctggattggtaattagtttgcatataactggagctctaaatacaattctgacgcctgagcaccagaaggagatgcgtcgatatctgtacaaccaccagaacgtggatggtggttggggattgtatagtaacgggccaagcaacatgattggctcagtcttgcattatgttactttgagattgcttggagaaggagcaaacgatggagaaggggcaatggagaaaggtcgcaagtggattttagaccatggcagcgcaactgcaacttcatcgtggggaaagttgtggctttctgtacttggagtatatgaatgggctggtaacaatcctatgccgccagaattttggttgctgccatactgcgttcctcttcatccaggaaaaatgtggtgcctcagccggacggtttacctgcccatgtcatatttgtatgggaagagatttgttggtgcaatcacaccaatcgtcgtatcactaagaaaagagttatacaatgttccatatgaccatatcgattggaacaaggcgcgtaccgactgcgcaaaggaagatcagtactatccgcatccattgatacaagatattatttgggggtcgctacataattttgtagaacctattctaatgcgttggcctggaagcaagttgagagagaaggctctttccactgtcatgcagcacatacattacgaggatgagaatactagatatatttgcgttggtcctgttaacaaggcacttaatatgctttgttgctggatcgatgatccaaattcggaggcattcaagctacaccttccaagggtatatgattatctgtggctggccgaagatggaatgaagatgaaggcctacgatggcttccagttatgggaagctgctttcgctgttcaggcaattgtatcaactaatctttcagaggaatttggccctacactgaagaaagcacatgaattcgttaaaaactcgcagattctggaggactgccctggtgatctaaactattggtaccgccacatctccaaaggtgcatggacattttccactgctgatgagggctggcccgtctcagattgcaccggagaaggacttgaagcggttctcttattatcaatgatttctcccaaaattgttggcgatccactagatgaaaggaggctttatgatgccgtaaatctgctgctttcactaatgaacaaaaatggaggttttgctacttatgaacttacgagatcctatgcctggttggagattatgaatcctgctgacgttttcataaacattgttgttgatcatcaatatgtggaatgtacgtcatcagcgattcaaccattggcattatttaaaaagctttatcctgggcatcggcaagaggagatagacaattgcatcatgaaagcagcccgtttcatagagaggactcagcgagctgatggttcatggtatggaagttggggtgtttgcttcacgtatgctacatggtttggagtaaagggactggtggctgctggaaggacatacgagaacagttgttatatccaaaaggcatgcaactttctattgtcgaaacaagaggcttctggtggctggggagagagcttcctttcatgtcgaaaaaaggtttatatcaatcttgagggtaacaaaactcatgcagtgaacactagctgggccatgctagctctgattgctgctgggcagggggagagagacccaaaaccattgcacagagcagcaaaagctttaataaatatgcaaatggagaatggcgattttccccaacaagagatgatgggaaacttcatgggaggttcttcgttgaattatccattatatcgaaacatatttccaacatgggctcttggagaataccgaaatcatattttccactctatgacttgattcatgttagcgcacaaggagaaacacatatggaaattatcccagataattttattttataactaaatgttattggttatactatgcaccttattttaatagaattgttcttatcaaactatttattt

SEQ ID NO: 4408 - protein, 759 aa, Costus speciosus
MWRLKVAEGSGPWLRSTNNHVGREVWEFDPSGGTPEEIAEVERARETFRDHWVEHTNSADLIMRLQFEKENPAEMKYSVIRIQEAENISKEAVDICLRKAVTRISTLQAHDGHWPGDCGAGPMFLLPGLVISLHITGALNTILTPEHQKEMRRYLYNHQNVDGGWGLYSNGPSNMIGSVLHYVTLRLLGEGANDGEGAMEKGRKWILDHGSATATSSWGKLWLSVLGVYEWAGNNPMPPEFWLLPYCVPLHPGKMWCLSRTVYLPMSYLYGKRFVGAITPIVVSLRKELYNVPYDHIDWNKARTDCAKEDQYYPHPLIQDIIWGSLHNFVEPILMRWPGSKLREKALSTVMQHIHYEDENTRYICVGPVNKALNMLCCWIDDPNSEAFKLHLPRVYDYLWLAEDGMKMKAYDGFQLWEAAFAVQAIVSTNLSEEFGPTLKKAHEFVKNSQILEDCPGDLNYWYRHISKGAWTFSTADEGWPVSDCTGEGLEAVLLLSMISPKIVGDPLDERRLYDAVNLLLSLMNKNGGFATYELTRSYAWLEIMNPADVFINIVVDHQYVECTSSAIQPLALFKKLYPGHRQEEIDNCIMKAARFIERTQRADGSWYGSWGVCFTYATWFGVKGLVAAGRTYENSCYIQKACNFLLSKQEASGGWGESFLSCRKKVYINLEGNKTHAVNTSWAMLALIAAGQGERDPKPLHRAAKALINMQMENGDFPQQEMMGNFMGGSSLNYPLYRNIFPTWALGEYRNHIFHSMT

SEQ ID NO: 4409 - DNA, 2683 bp, Costus speciosus
  CDS (207)..(2486)
agggcagtcgtttgctctgccctgcgctccctttgaaagcgtactgtgccggaacatcttcgcctcttcccctcggatcccagcagatctgtatacatcccaccccgcagccgatttctcaaccttttccctcggcctttccgcccatcgatcgctcccgacgggcttcgagaagcgttcctgcggcgctcccttttcttccgtgaatgtggaggctcaagatcgcggagggcggcggcccgtggctgcggacgaagaacaaccacgtcgggaggcaggtgtgggagttcgacccgagcctcggcacgcccgaggagatagcggaggtggagagagtccgggaggctttccgcgagacccggttcgagaagaagcacagcgccgatctcctcatgcggttgcagtttgccaaggagaatccacttgaaatgaactatcctatcatcaagattgaagaacacgaagatgtcactgaagaacttgtggtgacctccttaagaaaggctatcagtcgcgtttctactctccaagctcacgatggacactggcctggggattatggtggtccaatgttccttatgccgggattgataataactttgtatgtcactggagctctaaacactgttcttacatctgaacaccagaaggagatccgtcgatacctctacaaccaccagaatgaagacggaggctggggcttgcatattgagggtgaaagcactatgtttggttctgccttgacttatgttattttgagattgctcggagaaggacctgatgatggagatggggcaatggaaaaagggcgaaagtggatcctagatcatggcagtgcaactgctataacctcatggggaaagatgtggttatctgtgcttggagtgtttgactggtctggcaacaatcctttgccgccagaaatgtggttattaccatacttcttgccagttcatccaggacgaatgtggtgtcattgccggatggtttacctgcccatgtcatacatctatggaaagaggtttactggtccaattacaccacttatcttgtcactaaggaaggaactatttaatcttccatttgatcagttagattggaacaaggctcgtaacgagtgtgcaaaggaagatctgtactatccacatccatttatacaagacgtcctttgggcatctctacataaatttgtcgaacctattctgatgcattggcctggaagcaaattaagagagaaggctgttaatactgctatgcagcatgtccattatgaggatgaaaatacaagatatatttgcattggtcctgtcaacaaggtacttaatatgctttgctgctggattgaagatccaaattcagaggcattcaagctacatcttcctagagtaatggattatctgtggttggctgaagatggaatgaaaatgcggggctataatggcagccagttgtgggacacagctttcactgttcaggcaataatatcgactgacctttttgaggaatttggtcttgcactgacgaaggcacatgaatttattaaaaaaacacaggttcttgaagactgccctggcgatcttaatttttggtaccgccacatctctaaaggtgcatggcctttctccaccgctgatcatggatggcctatctcagattgcacttccgaaggacttaaggcagcgctcttattatctaagatttctcctgaaattgttggtgatccacttgatggaaagagcctctatgatgccgttaatgttatcctttcactaatgaataatgatggtggttttgctacgtatgaacttacgagatcctatgcctggttggagattatcaatcctgctgaaacatttggagacattgttatcgattacccatatgttgagtgcacttcggcagcaattcaggcattgacattatttaaaaagacatatcctggacatcgccgagaggagatagacaattgcatcagaaaatcagctcgttttattgaaaagattcagctagctgatggttcatggtatggatcttggggtgtttgcttcacatatggtatatggtttggaatgaagggattacttgccgctggtcggacctatgagactagctcttgcatccgaaaggcatgtgactttctgttgtctaaacaagttgcctctggtggttggggggagagctatctttcatgtcaaaataaggtctacacaaatcttgagggtaacagggctcatgcagtgaatactggctgggccatgctggctctaattgatgctgggcagggtgagagagatccaaaaccattgcacagagcagcaaaagttctaataaacatgcaaatggagaatggcgagtttccccaacaagagattatgggggtttttaacaaaaattgcatgatcagttattcagaatatcgaaacatatttccaatctgggctctcggagaataccgaagacgcgtcctgtgttctcaattccactgaattcatctcctgcctagttaagaatcaatgtagttaaggttcttttcgtcaagaaatggaatggtggtgtgccacgcagcacagttggaatggaatgaattccaactcacaattttgaaccattttgatcgactgaactaatttggttagccttttgtagtactctcaattttagttagtattcatgtgaagaatcc

SEQ ID NO: 4410 - protein, 759 aa, Costus speciosus
MWRLKIAEGGGPWLRTKNNHVGRQVWEFDPSLGTPEEIAEVERVREAFRETRFEKKHSADLLMRLQFAKENPLEMNYPIIKIEEHEDVTEELVVTSLRKAISRVSTLQAHDGHWPGDYGGPMFLMPGLIITLYVTGALNTVLTSEHQKEIRRYLYNHQNEDGGWGLHIEGESTMFGSALTYVILRLLGEGPDDGDGAMEKGRKWILDHGSATAITSWGKMWLSVLGVFDWSGNNPLPPEMWLLPYFLPVHPGRMWCHCRMVYLPMSYIYGKRFTGPITPLILSLRKELFNLPFDQLDWNKARNECAKEDLYYPHPFIQDVLWASLHKFVEPILMHWPGSKLREKAVNTAMQHVHYEDENTRYICIGPVNKVLNMLCCWIEDPNSEAFKLHLPRVMDYLWLAEDGMKMRGYNGSQLWDTAFTVQAIISTDLFEEFGLALTKAHEFIKKTQVLEDCPGDLNFWYRHISKGAWPFSTADHGWPISDCTSEGLKAALLLSKISPEIVGDPLDGKSLYDAVNVILSLMNNDGGFATYELTRSYAWLEIINPAETFGDIVIDYPYVECTSAAIQALTLFKKTYPGHRREEIDNCIRKSARFIEKIQLADGSWYGSWGVCFTYGIWFGMKGLLAAGRTYETSSCIRKACDFLLSKQVASGGWGESYLSCQNKVYTNLEGNRAHAVNTGWAMLALIDAGQGERDPKPLHRAAKVLINMQMENGEFPQQEIMGVFNKNCMISYSEYRNIFPIWALGEYRRRVLCSQFH

SEQ ID NO: 4411 - DNA, 2629 bp, Betula platyphylla
  CDS (225)..(2432)
gcgggtaaaggagatgagttcgattttgggttgatttcttgagtttcggttgattcttgaacgaatttttggttgattttgtgtgggctatctgggtaagcaccgaattggtgtgggtggtttgagaagctttgggcaagaacacaatctcacaagcagatttgggcagattgctcacacccaagctctcaagcagatttgggaggaacacaatcttcagaagaatgtggaggctgaagattgcagagggtggcaatgactctttcctctcaagcacaaacaacttcgtggggagacaaacatgggagtttgatgcaaatgctggtacacctgaagagcgagccgaagttgaagaggcccgtcagaattattacaagaaccgtcataaaatcaagccaggcagtgacctcctatggcaaatgcagtttttaagagagaaaaatttcaagcaaacaattccccaagtgaaggttaaggatggtgaggaaattacatatgaaattgccacaaccacgttaaggagggccgcccgcttcttttcagctttgcaggccagcgacggccattggcctgctgaaatctctggcgtattatttccccttcctccatttatcttgtgtctatacattacagggcatcttaatactatattcactacagaacatcgcaaagaagtcttcggtatataccacaatcatcagtatgtagacggggggtgggggttgcacatagagagtcacagcagtatgtattctacaggtttgcactacgtttgtatgcgtatacttggagaaggagctgatggtgatgcttgtgcgagagcccgaaagtggattctcgaccgtggtggtgtaacccatataccatattggggaaagatttggctttcgatacttggtgtctatgaagcaaacttgtggtgctatattcggatgtcttacttacccatgtcatatttgtacgggaagaggtttgttggccccataacacctctcattttacaattgagagaagagctctacattcaaccttatcatactattaattggtggagagcacgccacttatgtgcgaaggaggatctctattattctcaaacttggatgcaagatttattttgggatagtctttacattttcattgaacctgttcttagttgttggccttttaacaagttgagaaataaggctcttcaagtagcgatgaaacacattcattacgaagatgagaatagtcggtatcttaccattggaggggggcaaaagccattttttatgctcgcttgttgggatgaagatccacatggggattactttaagaagcatcttcctaggatacaagatttcttatggatttcagaagatggaatgaagatgactaatgctggccaggtttgggatgctagttttgccattcaagctttgcttgctactgatcttagtgatgaaattggacaaacactaatgagaggatacgactttataagaatccaggtcaaggataatccttctggcgatttcagcagcatgtggttcgtcacttttctaaaagggggatggcctttctctgaacaagatcatggttggcaagcttctgattgtactgcagaagctttaaagtgctgtttgttgctatctatgcttccatcagaaattgccggtgaggaaatggatcctgagcggctatatgatgcagtccatatcatactttctttgcagagtaaaaacggtggcgtgacaggttgggagccagcaggtggggcatcatgtttcgagctgcttaatcctatagaatttctcgagggcactctccttgagcatgagtatgttgagtgcacttcatcagcaatacaggcattagttttgttcaagaaattatatccagggcacaggaaagaagaatgtgaaatttttatctcaaatgctgtacgattccttgaagatatacaaatgcctaatggttcatggtacggaatttggggaatttgcttcatatatgcaacttggtttgcactcgtagggttagaagttgctggcaagacttatcataactgtcttgctatgcgcaaaggcgtacaatttctcctcaaaacacaaaaccaagatggtggttggggagagagctatctttcatgctcaaaaaaggaatatgtgcctctcgaaggaaatcgatcaaatttggtgcaaactgcgatggctttgattgggctagttcatgctcagcaggcagagagagaccctactcctcttcatcgtgcagcaaagctgttgatcaattctcaaatggaaaatggcgatttcccccaacaggaacttgtgggagctgttatgcagaattgcatgttgcactatacactttttagggatactttcccgttgtgggctcttgcggaatatcgtaattatgtttctctgcccaccaaatccctttaaactatattttgtggattacaaaatgaggagaataaaaggaacttgtgaagtccattaattgatgcgtcatgttgcatcaaagtctatttatagtccaaagggcaattaatggctctgtaacaattattcaacataaataaatggtaacgtaagcataaatggttatgaaatgcattcttcggatgacataatttacg

SEQ ID NO: 4412 - protein, 735 aa, Betula platyphylla
MWRLKIAEGGNDSFLSSTNNFVGRQTWEFDANAGTPEERAEVEEARQNYYKNRHKIKPGSDLLWQMQFLREKNFKQTIPQVKVKDGEEITYEIATTTLRRAARFFSALQASDGHWPAEISGVLFPLPPFILCLYITGHLNTIFTTEHRKEVFGIYHNHQYVDGGWGLHIESHSSMYSTGLHYVCMRILGEGADGDACARARKWILDRGGVTHIPYWGKIWLSILGVYEANLWCYIRMSYLPMSYLYGKRFVGPITPLILQLREELYIQPYHTINWWRARHLCAKEDLYYSQTWMQDLFWDSLYIFIEPVLSCWPFNKLRNKALQVAMKHIHYEDENSRYLTIGGGQKPFFMLACWDEDPHGDYFKKHLPRIQDFLWISEDGMKMTNAGQVWDASFAIQALLATDLSDEIGQTLMRGYDFIRIQVKDNPSGDFSSMWFVTFLKGGWPFSEQDHGWQASDCTAEALKCCLLLSMLPSEIAGEEMDPERLYDAVHIILSLQSKNGGVTGWEPAGGASCFELLNPIEFLEGTLLEHEYVECTSSAIQALVLFKKLYPGHRKEECEIFISNAVRFLEDIQMPNGSWYGIWGICFIYATWFALVGLEVAGKTYHNCLAMRKGVQFLLKTQNQDGGWGESYLSCSKKEYVPLEGNRSNLVQTAMALIGLVHAQQAERDPTPLHRAAKLLINSQMENGDFPQQELVGAVMQNCMLHYTLFRDTFPLWALAEYRNYVSLPTKSL

SEQ ID NO: 4413 - DNA, 2519 bp, Betula platyphylla
  CDS (39)..(2378)
  misc_feature (1787)..(1787): n is a, g, c or t
ctgatgtaataatgagggaagaaaggcactagtaaggaatgtggaggcttaagatcgcagacggtgggagtgacccttatatctactctacaaacaactttgttgggaggcagacatgggagtttgaccctcaggctggttccccacaagagcgggctgaggttgaagaggctcgtcggaatttctacgacaaccggtatcaggtcaaacctagtggtgatctcctatggcgaatgcagtttcttaaggagaaaaacttcaaacaaacaattcctccagtaaaggttgaggatggagaggaaatcacatatgaaaagtccacagctgcattgagaagggccgtccatttctattcggccttgcaagctagtgatggccattggcctgctgaaaatgccggtccattatttttccttccccccttggttatgtgtatgtacattacaggacatcttaatactgtgttccctgctgagcatcaaaaggaaatccttcgatacatatactatcatcagaatgaagatggtgggtggggattacacatagagggtcacagcaccatgttttgcactgctctcagctacatctgtatgcgcatactcggggaagggcctgatggtggtcaggacaatgcttgtgcaagagcgcgaaagtggatccttgatcatggtggtgtaacacacatgccttcttggggaaagacctggctttcgatacttggtatattcgagtggattggaagcaacccaatgcctccagaattttggatccttccttcatttcttcccatgcatccagccaaaatgtggtgctactgccgcatggtgtacatgcctatgtcatacctctatgggaaaaggtttgtaggcccaatcacacctctcattcttcaattgagggaggaactctacactcaaccttaccaccaagttaactggaagaaagtgcgtcatctatgtgcaaaggaggatatctactatccccaccctttgatacaagatctattgtgggatagtctatacatattcactgagcctcttctaactcgttggccctttaacaagctggtcagagagaaggctcttcaagtaacaatgaagcacattcattatgaagatgagaacagtcgatacatcaccattggatgcgtggaaaaggtcctctgtatgcttgcttgttgggttgaagatccaaatggggattatttcaagaaacatattgctaggataccagattacatatgggttgctgaagatggaatcaagatgcagagttttggaagtcaagagtgggataccggttttgctattcaagctttgcttgctagtaatctaactgatgaaattggacctacacttgcgagagggcacgacttcataaagaaatctcaggtcaaggacaacccttctggagactttgaaagcatgcaccgtcacatttctaaaggatcatggactttctctgatcaagatcatggatggcaagtttctgattgcactgccgaaggtttgaagtgttgcttgcttttctccattatgccaccagaaattgttggtgagaaaatggaacctgagcaattgtatgattctgtaaatgtcctactttctctacagagtaaaaatggtggtttagctgcctgggaaccagcaggagcccaagaatggttggaattgcttaattccacagaattctttgcggacattgtcattgagcatgagtacattgagtgcactgcatcagcaatgcaaactttagttttgtttaagaagttataccccgggcaccgnaagaaagagatcgaaaatttcataaaaaatgctgctcagttccttcaagtcatacaaatgcctgatggttcatggtatggaaattggggagtttgcttcacatatggtacatggtttgcacttggaggattggctgcagttggcaagacttacaacaattgtctagccgtgcgcagagctgttgattttctactcagagcacaaagagataatggtggttggggagagagctatctctcatgtccaaagaaggagtatgtacctcttgaaggaaacaaatcaaatttggtacatactgcatgggcaatgatgggtctcattcatgctggacaggctgaaagagacccaacacctcttcaccgcgcagcaaagttgataattaattctcaactcgaagatggagattttcctcaacaggaaatcactggagtctttatgaagaactgtatgttacactatgcagcatacaaaaatatttacccactgtgggctctggcagaataccgcaagcatgtcccattgccattaggaaaaaatttaaatcaagtagtgaactgtataggtcaatcactatataagaagtataaataagaaatccacttgttaatcctcttactttcccaacacagccatctaagatagatgagagtaaggattacacaatgttgtactagtgaataatatatagtaaacgaaaagctcttcattcggctataccattatttgctcttg

SEQ ID NO: 4414 - protein, 779 aa, Betula platyphylla
MWRLKIADGGSDPYIYSTNNFVGRQTWEFDPQAGSPQERAEVEEARRNFYDNRYQVKPSGDLLWRMQFLKEKNFKQTIPPVKVEDGEEITYEKSTAALRRAVHFYSALQASDGHWPAENAGPLFFLPPLVMCMYITGHLNTVFPAEHQKEILRYIYYHQNEDGGWGLHIEGHSTMFCTALSYICMRILGEGPDGGQDNACARARKWILDHGGVTHMPSWGKTWLSILGIFEWIGSNPMPPEFWILPSFLPMHPAKMWCYCRMVYMPMSYLYGKRFVGPITPLILQLREELYTQPYHQVNWKKVRHLCAKEDIYYPHPLIQDLLWDSLYIFTEPLLTRWPFNKLVREKALQVTMKHIHYEDENSRYITIGCVEKVLCMLACWVEDPNGDYFKKHIARIPDYIWVAEDGIKMQSFGSQEWDTGFAIQALLASNLTDEIGPTLARGHDFIKKSQVKDNPSGDFESMHRHISKGSWTFSDQDHGWQVSDCTAEGLKCCLLFSIMPPEIVGEKMEPEQLYDSVNVLLSLQSKNGGLAAWEPAGAQEWLELLNSTEFFADIVIEHEYIECTASAMQTLVLFKKLYPGHRKKEIENFIKNAAQFLQVIQMPDGSWYGNWGVCFTYGTWFALGGLAAVGKTYNNCLAVRRAVDFLLRAQRDNGGWGESYLSCPKKEYVPLEGNKSNLVHTAWAMMGLIHAGQAERDPTPLHRAAKLIINSQLEDGDFPQQEITGVFMKNCMLHYAAYKNIYPLWALAEYRKHVPLPLGKNLNQVVNCIGQSLYKKYK

SEQ ID NO: 4415 - DNA, 2471 bp, Betula platyphylla
  CDS (87)..(2354)
gatcttgcatcttttcagttaagcacacctcgaggagcaacctcttagaatttattttccactcaaaaactttccaagatagagggatgtggaagttgaagatagcggaaggagggccagggctggtgagcggaaatgatttcatcgggcggcaacactgggaattcgacccggatgccggcactccccaagagcgtgctgaagttgaaaaggtccgggaggagttcaccaaaaatcggtttcagatgaaacaaagcgctgatcttttgatgaggatgcagcttaggaaggagaacccatgccaaccaattccaccaccagtgaaagtgaaagaaacagaggtgataacagaggaagcagtgattactacactgagaagatcactaagcttttattcctccattcaagctcatgatggccactggcctggtgaatctgctggccccttgtttttccttcaaccctttgtaatggcattatacatcactggagatctcaatactattttttccccagcacaccagaaggaaattattcgatacttgtataatcatcagaacgaagatggaggctgggggttccatatagagggtcacagcacaatgtttgggtcagctttgagctacattgccttgagaatacttggagagggacttgaagatggtgaagatggggctatggctaaaagccggaaatggattcttgaccatggtggtttagtggctattccttcatggggaaagttttgggtcacggtactgggactgtatgagtggtcaggctgcaatccactgcccccagagttctggtttcttcctgatatctttcccatacatccaggtaaaatgttatgctactgtcgcttggtttacatgccaatgtcttatttatatgggaagaggtttgttggtccaatcactggattgattcaatcacttagacaagagttatataacgagccttaccatcaaattaactggaataaagcccggagtacagttgcaaaggaggatctctactatccgcatcccctcatacaagatctgctatggggatttcttcaccatgtagccgagcctgtcctgacgcgttggcccttttcaatgctgagagagaaggcactcaaagctgcaattggtcatgtacattatgaggacgagaacagcaaatacctttgcattggaagcgttgaaaaggtattatgtttgattgcctgttgggctgaagatccaaatggggaggcatacaagcttcatctaggaaggattccagacaactattgggttgctgaagatggcttaaaaattcagagtttcggctgtcagatgtgggatgcgggttttgctattcaagcaattctctcttgcaatttaaacgaagagtattggccaacacttcgtaaagcacatgagtttgtaaaggcttcacaggtcccagaaaacccttctggggacttcaaagccatgtaccgccacataaacaaaggagcatggacattctcgatgcaggaccatggatggcaggtctctgactgcaccgctgaagggctgaaggttgcaatcttgttctcgcaaatgcctccggaccttgttggggaaaaaattgagaaagagcggttatatgatgctgtgaatgtcattctttctctacaaagtagcaatggtggtttcccagcatgggagcctcaaagagcatatggttggttggagaagttcaaccccacggaattctttgaagatacccttattgagcgagagtacgtagagtgcacttcacctgcagttcatggtctggcactctttaggaagttctatccccggcaccgggggacggagatagatagtagcatttacaggggaattcaatacattgaagacgtgcaagaacctgatggatcatggtatggtcattgggggatttgctacacctacggtacatggtttgctgtaggggcactggcagcttgtggaagaaactacaaaaattgtcctgcattgcgcaaatcttgtgaatttttgctatcaaagcagctacctaatggtggatggggagaaagttacctatcaagccaaaacaaggtgtggacgaatatagaaggcaaccgtgcaaatttggtccaaacagcatgggccttgttatccctcattgatgctaggcaggccgagatagatccaacaccaattcatcgtggagtaagagtattgatcaattcacagatggaagatggtgactttcctcaacaggaaatcactggagtatttatgcgaaactgcacactaaactactcatcatatagaaacatttttccgatatgggctcttggagaatatcggaggcgagttctatttgcatgaatgatacctgaatgagtaagcaaaggattgcatattgaccttcaggagcccaaattagcttgaaagagaatggtctctctaatgcatatgcaacaactttcatgtaattaagtatac

SEQ ID NO: 4416 - protein, 755 aa, Betula platyphylla
MWKLKIAEGGPGLVSGNDFIGRQHWEFDPDAGTPQERAEVEKVREEFTKNRFQMKQSADLLMRMQLRKENPCQPIPPPVKVKETEVITEEAVITTLRRSLSFYSSIQAHDGHWPGESAGPLFFLQPFVMALYITGDLNTIFSPAHQKEIIRYLYNHQNEDGGWGFHIEGHSTMFGSALSYIALRILGEGLEDGEDGAMAKSRKWILDHGGLVAIPSWGKFWVTVLGLYEWSGCNPLPPEFWFLPDIFPIHPGKMLCYCRLVYMPMSYLYGKRFVGPITGLIQSLRQELYNEPYHQINWNKARSTVAKEDLYYPHPLIQDLLWGFLHHVAEPVLTRWPFSMLREKALKAAIGHVHYEDENSKYLCIGSVEKVLCLIACWAEDPNGEAYKLHLGRIPDNYWVAEDGLKIQSFGCQMWDAGFAIQAILSCNLNEEYWPTLRKAHEFVKASQVPENPSGDFKAMYRHINKGAWTFSMQDHGWQVSDCTAEGLKVAILFSQMPPDLVGEKIEKERLYDAVNVILSLQSSNGGFPAWEPQRAYGWLEKFNPTEFFEDTLIEREYVECTSPAVHGLALFRKFYPRHRGTEIDSSIYRGIQYIEDVQEPDGSWYGHWGICYTYGTWFAVGALAACGRNYKNCPALRKSCEFLLSKQLPNGGWGESYLSSQNKVWTNIEGNRANLVQTAWALLSLIDARQAEIDPTPIHRGVRVLINSQMEDGDFPQQEITGVFMRNCTLNYSSYRNIFPIWALGEYRRRVLFA

SEQ ID NO: 4417 - DNA, 2514 bp, Betula platyphylla
  CDS (162)..(2435)
  misc_feature (1086)..(1086): k is g or t
cagcgctgcataataatgtcataaatctgtctcctctctctcatatacacattctgaatttcgtttttctttattttgtgatcattttctctgtacgctggagagatcaattttctctcagttgcgttgcagattggtgatcattgtgcgaatagtagacaatgtggaagctgaagatcgcggagggagggagtccatggctgcggacgttgaacaatcacgtcggacgacaagtttgggaattcgatcccaagctcgggtcgcctgaagagcttgccgagatcgaaagagctcgcgagacttctctgaaagtccgtttcgagaaaaagcatagctcagatctacttatgcggattcagttcgccaaggagaacccacgtggtgcagttctaccccaagtcaaagtaaatgaaacagaagatgttacagaggagatggtgacaaggatgttaagaagggctataagtttccactcaactctccaggcccatgatggacattgggcgggggactatggaggtccaatgtttcttatgcctggcttggtaatcactctgtctatcactggagcactaaatacagttttatctgaagaacataaaaaggaaatgtgccgttacctctataatcatcagaacaaagatggtgggtggggattacacattgagggcccaagtaccatgtttggtactgtcttaagctatgttacgttaaggttgcttggtgaaggagctaatgatgggcaaggagcaattgagagagggcgtaaatggattctggaccatggcagtgctactgcaattatatcatggggaaagatgtggctttcagtacttggagcatttgaatggtcgggcaataatccccttccccctgaaatatggcttcttccttacatgctccctgtacatccaggaagaatgtggtgtcactgtcggatggtctatttgccaatgtcttacttatatgggaagagatttgttggtccaatcacgccaacagttatgtctttgaggaaggagctttattctgtcccctatcatgaaatagattggaatcaggcacgcaacctatgtgcaaaggaakatctgtactacccacatccgctggtgcaggatatactttgggcatctcttcataagcttgttgaaccggttttaatgcgttggcctggaaaaagactgagagaaaaggctcttcgcactgtgttggaacatatacactatgaagatgaaaatactcgttatatttgcataggacctgtaaacaaggtgttaaatatgctctgttgttgggtggaagatccaaattccgaggcttttaagttgcatcttccaagaataaatgactatttgtggattgctgaagatggaatgaaaatgcagggttataatggaagtcaattatgggatactgcctttgctgttcaagctattatttcaaccaacctttttgaagaatatggtccaactctcgaaaaagcacatatgtacataaaaaaatcgcaggttcgagaagattgcccaggtgatcttgatttttggtatcgccacatttcaaaaggcgcttggcctttctcaactgccgatcacggatggcccatatcagactgcacagcagaaggattgaaagctgctcttttattatctaaaattccgccagatgttgttggtgaaccattagttgaagagcgattgtatgatgctgtaaatgtcattctctcattacagaatgcggatggtggctttgcaacatatgagctcacaagatcctatccctggttggagttgatcaaccctgctgaaacctttggggacattgttattgattataattatgtggaatgtacgtcagcagcaattcaagctctgacatcgtttaagaaatcatatcccaagcatcgggaggaggaggtagacgtctgtatcaaaagagctgctatgttcactgaaaagatacaagcatcagatggttcatggtatggttcttggggtgtttgcttcacttacggtacatggtttggggtaaaagggttagtggctgctggaaagaacttcaatgattgctttggtatccgcaaagcttgtgattttctgctgtctaagcagcttccttcaggtggctggggagagagttatctttcatgtcaaaacaaggtgtattcacatgtagagggcaacaggtctcatgttgtaaatactggatgggctatgttggcgcttatagaagctggacaggctgagagagacccaacgccattgcaccgtgcagctagggttttgataaattctcaaatggagaatggagattttcctcaagaggaaatcatgggggtcttcaataggaactgtatgattacctacgccgcttacaggaacatttttcctatttgggcattgggagagtaccgctgtcgggtattgcaggctccctaagctaacaatgtcgttattctcagtagtcagtacatttaagtaaagcgttgttgaaatcgccggaatgcaaaacaattcg

SEQ ID NO: 4418 - protein, 757 aa, Betula platyphylla
  misc_feature (309)..(309): The Xaa at location 309 stands for Asp, or Tyr.
MWKLKIAEGGSPWLRTLNNHVGRQVWEFDPKLGSPEELAEIERARETSLKVRFEKKHSSDLLMRIQFAKENPRGAVLPQVKVNETEDVTEEMVTRMLRRAISFHSTLQAHDGHWAGDYGGPMFLMPGLVITLSITGALNTVLSEEHKKEMCRYLYNHQNKDGGWGLHIEGPSTMFGTVLSYVTLRLLGEGANDGQGAIERGRKWILDHGSATAIISWGKMWLSVLGAFEWSGNNPLPPEIWLLPYMLPVHPGRMWCHCRMVYLPMSYLYGKRFVGPITPTVMSLRKELYSVPYHEIDWNQARNLCAKEXLYYPHPLVQDILWASLHKLVEPVLMRWPGKRLREKALRTVLEHIHYEDENTRYICIGPVNKVLNMLCCWVEDPNSEAFKLHLPRINDYLWIAEDGMKMQGYNGSQLWDTAFAVQAIISTNLFEEYGPTLEKAHMYIKKSQVREDCPGDLDFWYRHISKGAWPFSTADHGWPISDCTAEGLKAALLLSKIPPDVVGEPLVEERLYDAVNVILSLQNADGGFATYELTRSYPWLELINPAETFGDIVIDYNYVECTSAAIQALTSFKKSYPKHREEEVDVCIKRAAMFTEKIQASDGSWYGSWGVCFTYGTWFGVKGLVAAGKNFNDCFGIRKACDFLLSKQLPSGGWGESYLSCQNKVYSHVEGNRSHVVNTGWAMLALIEAGQAERDPTPLHRAARVLINSQMENGDFPQEEIMGVFNRNCMITYAAYRNIFPIWALGEYRCRVLQAP

SEQ ID NO: 4419 - DNA, 2460 bp, Betula platyphylla
  CDS (48)..(2351)
gattgtagctcatcgtatccgcgaaaagaatttgacaaaactgtgcaatgtggaagttgaagatcggcgcagagacagccagaggagatggtggtggcggcggcggcagtgaaacatggctgaggagtttgaacaatcacttgggacgccaaatatgggagttccatccagagctcggcacccaagaagagcttcagcagatcgacgatgctcgccggaggttctgggaacgccgcttcgaaaggcggcacagctccgacctcctcatgcggattcagtttgcaaaggagaatccatcttctgcaaatataccacaagtcaaaattaaagatacagaggaggtcagagaggaggctgtaggaatgaccttacgaagggccatcaatttctactcaacaatacaggcagatgatggtcattggcctggggattatgggggtcccatgtttctaattcctggtctggtgattactctttcaattactggaactctaaatgctttcttatcaaaggaacatcaatgtgagatctgcagatatctctacaatcatcagaatgaagatgggggttggggtctacatattgagggcccaagcaccatgtttggtactgcactaaattatattactttgagattgcttggtgaacctgaggatggaatgggagctgtggaaaaagcacggaagtggatcttggatcatggtggtgcaactgcaatcacttcatggggaaaaatgtggctttcagtacttggagtgtacgaatggtctgggaataatccactgccaccagaagtatggctttgcccttatcttctcccatgtcatccaggaaggatgtggtgtcattgccgaatggtgtatttgcccatgtcatatttatatggtaagaggtttgttggtcctatcacatccacaatccaatctttgagaaaggagctttatacagtcccttatcatgagatcgattggaataaggctcgcaatgattgtgcaaaggaagatctatactacccccatccactggttcaggatatcctctgggcatctctttactatgcatatgaacccatttttatgtattggcctgcaaaaagattgagggagaaggctctggacactgtgatgcagcatatccactatgaagatgaaaatacacggtatatatgcatagggcctgtcaataaggtgttaaatatgctttgttgttgggctgaggatccaaactcagaggcattcaaattacatcttccaagaatcttagattatttgtggattgccgaagatggcatgaaaatgcagggatataatggaagtcaattatgggatactacttttgctgttcaagcgattatatcaactaatattgctgaagaatatggacaaactttaagaaaagcacatgagtacataaaggattcccaggtcttagaagattgtccaggagatctaaatttttggtatcgtcatatttcaaagggtgcttggccattctcaactgcagatcatggatggcctatttctgactgtacagcggaaggattgaaggctgttatattgctatcacaatttccatcagaaacagttgggaaatcggtagatgtgaagcggttatatgatgctgtacatgttatcctttccttacagaatactgatggtggctttgcaacttatgaattgaccagatcctaccattggttggagctaatcaatcctgctgaaacttttggtgatattgtcattgattacccatatgttgaatgtacatcagcagcaattcaagcactgacattattcaagaaattacatcctgggcataggagggaagaaatagaaaattgtattgctaaagctgcagagtttattgaaaatatacaagcatcagatggctcttggtatggatcctggggagtctgtttcacctatgctggctggtttgggataaaggggttggttgctgctggaaggacatacaagaattgttctagcatccacaaggcatgcgattatctgttgtccaaagagctcgcttcaggtggttggggagaaagttacctatcatgtcaggacaaggtgtataccaatctcaaagataataggccacatattgtcaatactggatgggctatgttggccctcattgatgccggacaggctgagagagatccaaccccattgcaccgagcggcaagaatactaataaattctcaaatggagaatggagattttcctcaagaggagattatgggagttttcaacaagaattgtatgatcagctattctgcataccgaaacatttttcctatctgggcccttggagaatatcgttgtcgggtattgaaggccctctgatacctgaatgggtaagcaaaggattgcatattgaccttcaggagcccaaattagcttgaaagagaatgggctctctaatgcatatgcaacaactttcatgtaattaagt

SEQ ID NO: 4420 - protein, 767 aa, Betula platyphylla
MWKLKIGAETARGDGGGGGGSETWLRSLNNHLGRQIWEFHPELGTQEELQQIDDARRRFWERRFERRHSSDLLMRIQFAKENPSSANIPQVKIKDTEEVREEAVGMTLRRAINFYSTIQADDGHWPGDYGGPMFLIPGLVITLSITGTLNAFLSKEHQCEICRYLYNHQNEDGGWGLHIEGPSTMFGTALNYITLRLLGEPEDGMGAVEKARKWILDHGGATAITSWGKMWLSVLGVYEWSGNNPLPPEVWLCPYLLPCHPGRMWCHCRMVYLPMSYLYGKRFVGPITSTIQSLRKELYTVPYHEIDWNKARNDCAKEDLYYPHPLVQDILWASLYYAYEPIFMYWPAKRLREKALDTVMQHIHYEDENTRYICIGPVNKVLNMLCCWAEDPNSEAFKLHLPRILDYLWIAEDGMKMQGYNGSQLWDTTFAVQAIISTNIAEEYGQTLRKAHEYIKDSQVLEDCPGDLNFWYRHISKGAWPFSTADHGWPISDCTAEGLKAVILLSQFPSETVGKSVDVKRLYDAVHVILSLQNTDGGFATYELTRSYHWLELINPAETFGDIVIDYPYVECTSAAIQALTLFKKLHPGHRREEIENCIAKAAEFIENIQASDGSWYGSWGVCFTYAGWFGIKGLVAAGRTYKNCSSIHKACDYLLSKELASGGWGESYLSCQDKVYTNLKDNRPHIVNTGWAMLALIDAGQAERDPTPLHRAARILINSQMENGDFPQEEIMGVFNKNCMISYSAYRNIFPIWALGEYRCRVLKAL

SEQ ID NO: 4421 - DNA, 2410 bp, Cephalosporium caerulens
  CDS (46)..(2328)
aagcaattccatcagttgccagcgaaaaataatcctagactcaacatggctcgcgccacgggaagtgaagctcaggagactgagcaagccttgtcgcgcaaaaggtccagcggcccctgtggtgaagggcccaagcatgacttccccaagaggcccaagatcgagaaaggcacagatcccacccgctggcgcatgagagacgatgaaagtcgacacacatggcattatcttccatctgaggaagccgcaaaggcttggcctcagacatgtgctgacaagtattacctaaacctacctctggggcttccctcactgccccagcccaccacgccactggatagcgctcgcaatggcctgacgttttttgagaagctgcaactgccttctggtcactggggttgcgagtatggtggcccaatgttccttttgcctggcatcgtcatcgcttggtacgtgacgaggactcctataccctcggcctatgccacagccatgaaggactacctctctgcacgggcaaaccaggatggtggatggggtcttcacatcgaaggcgagacatcggcttttggtactgcattgaattacaccgcgttgaggctggtgggtgtcgaggcaaacgaaccgatgatgatcaaggctcgagctgctctacacaggcttggaggcgccttgaacgcaccgcactggaccaaattctggcttgctgtactcggtgtcatggattgggatgtcgtgaaccccgttcctcccgagctctggctcctgccagactgggttccaatcgccccctggcgctggtggattcatatccgccaagtctacctcccaatgggttatctttactccaaaaggtggagttgtgaggaaaccgagaccacacgaagcttgaaagaagaactcttcgttcagccacacgctgagattaactgggcagcacaccgaaacgatatctccgtcatggacaattatcaccctaagagctgggtcctgaatacggccaactggttcctggtcaacatctggaacccttacctacgtacaaatgggatcaaggaacgggcggagaagtggaccagtgagctcattgacatggaggacaagaataccgactattctgatctggctcctgtaaacgcaccgatgaacacagtggcatgctacgttagggacgggccggattcctactccgttcgtcgacatctggagcgcctagaggagtgtctatgggtgaaggatgagggcatgctcgtgaatggtaccaacggcgtacagtgttgggacacctcgttcctggtggctgccttctgtgaagctggcctgcaccacgaggatagatggcaaccaatgctgcgcagagcgctcgaattccttgagaagcagcagctgcgagaaaacgtgcaggaccaggctaagtgttaccgacagacaagaaagggtggctggcccttcagcaataaggaccagggctacgctgtgagtgattgtacctcggaagctctgaaggctgttatcaaactgcagaagacccagggcttcccgcagttgctagatgaccgtcgcatcttcgatacggttgatacactcctcttgtatcagaatgacgacacgggtgcctgttcatcttatgagaaccgcagagctggagagtggatggagatgttcaacgctgccgaggtttttggcaacattatggtcgagtatgactaccccgagtgcacaacatcatgtgttacagccctcaatctgttcagaaaacactggcccgagtatcgtgcggaagacatcgagaagtttatcaagagggcaacgaactggattcgagggtcttcattacacctctcaagcggtggccgcatggcagggtggtacggaagctggggcatttgctttacatatgctactatgtttggcttagagagcctggcaagcattggggagacctattcaaattcggatgttgccaagagagcttgcgattaccttctgtccaaacagagggaagacggcggctggtcagagagctacaagtcttgcgagaccatgcaatggcacgaacatcccgatgggtctcaggttgtgcagactgcctgggccttgattgccctcatgcatggacagtgccctgatattgcagccatgaagcgaggtatcaagctcatcatggagcgccagcaaccgaacggcgaatggcttcaggaagcgattgaaggtgttttcaacaagtcttgcatgatctcataccccaactacaagttcatcttccccattaccgcactggggatgtttggcaacaggtacccggatgagaagatcgacctcaactgaagtaaaaagtagaacaatagcgcatgcagatacttagtctaatctaatacataatactctctggtgataaaaaaaaaaaaaa

SEQ ID NO: 4422 - protein, 760 aa, Cephalosporium caerulens
MARATGSEAQETEQALSRKRSSGPCGEGPKHDFPKRPKIEKGTDPTRWRMRDDESRHTWHYLPSEEAAKAWPQTCADKYYLNLPLGLPSLPQPTTPLDSARNGLTFFEKLQLPSGHWGCEYGGPMFLLPGIVIAWYVTRTPIPSAYATAMKDYLSARANQDGGWGLHIEGETSAFGTALNYTALRLVGVEANEPMMIKARAALHRLGGALNAPHWTKFWLAVLGVMDWDVVNPVPPELWLLPDWVPIAPWRWWIHIRQVYLPMGYLYSKRWSCEETETTRSLKEELFVQPHAEINWAAHRNDISVMDNYHPKSWVLNTANWFLVNIWNPYLRTNGIKERAEKWTSELIDMEDKNTDYSDLAPVNAPMNTVACYVRDGPDSYSVRRHLERLEECLWVKDEGMLVNGTNGVQCWDTSFLVAAFCEAGLHHEDRWQPMLRRALEFLEKQQLRENVQDQAKCYRQTRKGGWPFSNKDQGYAVSDCTSEALKAVIKLQKTQGFPQLLDDRRIFDTVDTLLLYQNDDTGACSSYENRRAGEWMEMFNAAEVFGNIMVEYDYPECTTSCVTALNLFRKHWPEYRAEDIEKFIKRATNWIRGSSLHLSSGGRMAGWYGSWGICFTYATMFGLESLASIGETYSNSDVAKRACDYLLSKQREDGGWSESYKSCETMQWHEHPDGSQVVQTAWALIALMHGQCPDIAAMKRGIKLIMERQQPNGEWLQEAIEGVFNKSCMISYPNYKFIFPITALGMFGNRYPDEKIDLN

SEQ ID NO: 4423 - DNA, 2274 bp, Avena strigosa
  CDS (1)..(2274)
atgtggaggctaacaataggtgagggcggcggtccgtggctgaagtcgaacaatggcttccttggccgccaagtgtgggagtacgacgccgatgccggcacgccggaagagcgtgccgaggttgagagggtgcgtgcggaattcacaaagaacaggttccagaggaaggagtcacaggaccttcttctacgcttgcagtacgcaaaagacaaccctcttccggcgaatattccgacagaagccaagcttgaaaagagtacagaggtcactcacgagactatctacgaatcattgatgcgagctttacatcaatattcctctctacaagcagacgatgggcattggcctggtgattacagtgggattctcttcattatgcctatcattatattctctttatatgttactagatcacttgacacctttttatctccggaacatcgtcatgagatatgtcgctacatttacaatcaacagaatgaagatggtggttggggaaaaatggttcttggcccaagtaccatgtttggatcgtgtatgaattatgcaaccttaatgattcttggcgagaagcgaaatggtgatcataaggatgcattggaaaaagggcgttcttggattttatctcatggaactgcaactgcaataccacagtggggaaaaatatggttgtcgataattggcgtttacgaatggtcaggaaacaatcctattatacctgaattgtggttggttccacattttcttccgattcacccaggtcgtttttggtgttttacccggttgatatacatgtcaatggcatatctctatggtaagaaatttgttgggcctattagtcctacaatattagctctgcgacaagacctctatagtataccttactgcaacattaattgggacaaggcgcgtgattattgtgcaaaggaggaccttcattacccacgctcacgggcacaagatcttatatctggttgcctaacgaaaattgtggagccaattttgaattggtggccagcaaacaagctaagagatagagctttaactaacctcatggagcatatccattatgacgacgaatcaaccaaatatgtgggcatttgccctattaacaaggcattgaacatgatttgttgttgggtagaaaacccaaattcgcctgaattccaacaacatcttccacgattccatgactatttgtggatggcggaggatggaatgaaggcacaggtatatgatggatgtcatagctgggaactagcgttcataattcatgcctattgttccacggatcttactagcgagtttatcccgactctaaaaaaggcgcacgagttcatgaagaactcacaggttcttttcaaccacccaaatcatgaaagctattatcgccacagatcaaaaggctcatggaccctttcaagtgtagataatggttggtctgtatctgattgtactgcggaagctgttaaggcattgctactattatcaaagatatccgctgaccttgttggcgatccaataaaacaagacaggttgtatgatgccattgattgcatcctatctttcatgaatacagatggaacattttctacctacgaatgcaaacggacattcgcttggttagaggttctcaacccttctgagagttttcggaacattgtcgtggactatccatctgttgaatgcacatcatctgtggttgatgctctcatattatttaaagagacgaatccacgatatcgaagagcagagatagataaatgcattgaagaagctgttgtatttattgagaacagtcaaaataaggatggttcatggtatggctcatggggtatatgtttcgcatatggatgcatgtttgcagtaagggcgttggttgctacaggaaaaacctacgacaattgtgcttctatcaggaaatcatgcaaatttgtcttatcaaagcaacaaacaacaggtggatggggtgaagactatctttctagtgacaatggggaatatattgatagcggtaggcctaatgctgtgaccacctcatgggcaatgttggctttaatttatgctggacaggttgaacgtgacccagtaccactgtataatgctgcaagacagctaatgaatatgcagctagaaacaggtgacttcccccaacaggaacacatgggttgcttcaactcctccttgaacttcaactacgccaactaccgcaatctatacccgattatggctcttggggaacttcgccgtcgacttcttgcgattaagagctga

SEQ ID NO: 4424 - protein, 757 aa, Avena strigosa
MWRLTIGEGGGPWLKSNNGFLGRQVWEYDADAGTPEERAEVERVRAEFTKNRFQRKESQDLLLRLQYAKDNPLPANIPTEAKLEKSTEVTHETIYESLMRALHQYSSLQADDGHWPGDYSGILFIMPIIIFSLYVTRSLDTFLSPEHRHEICRYIYNQQNEDGGWGKMVLGPSTMFGSCMNYATLMILGEKRNGDHKDALEKGRSWILSHGTATAIPQWGKIWLSIIGVYEWSGNNPIIPELWLVPHFLPIHPGRFWCFTRLIYMSMAYLYGKKFVGPISPTILALRQDLYSIPYCNINWDKARDYCAKEDLHYPRSRAQDLISGCLTKIVEPILNWWPANKLRDRALTNLMEHIHYDDESTKYVGICPINKALNMICCWVENPNSPEFQQHLPRFHDYLWMAEDGMKAQVYDGCHSWELAFIIHAYCSTDLTSEFIPTLKKAHEFMKNSQVLFNHPNHESYYRHRSKGSWTLSSVDNGWSVSDCTAEAVKALLLLSKISADLVGDPIKQDRLYDAIDCILSFMNTDGTFSTYECKRTFAWLEVLNPSESFRNIVVDYPSVECTSSVVDALILFKETNPRYRRAEIDKCIEEAVVFIENSQNKDGSWYGSWGICFAYGCMFAVRALVATGKTYDNCASIRKSCKFVLSKQQTTGGWGEDYLSSDNGEYIDSGRPNAVTTSWAMLALIYAGQVERDPVPLYNAARQLMNMQLETGDFPQQEHMGCFNSSLNFNYANYRNLYPIMALGELRRRLLAIKS

SEQ ID NO: 4425 - DNA, 2280 bp, Avena strigosa
  CDS (1)..(2280)
atgtggcggctgaagatcgcggagggcgggggcgacccgtggctgcgcaccaagaacgcgcacgtcggccgccaggtctgggagttcgaccccgaggccggcgacccggaggccctcgccgccgtcgaagccgcgcgacgggacttcgccgcgggccgccaccggctcaagcacagctccgaccgcctcatgcgcatccagtttgagaaagaaaatccacttaagttggatcttcctgctatcaagctggaggagaatgaagatgtcactgaggaagctgtgtcgacctctctgaaaagggcgatcagcagattttctactctccaggcacacgatgggcactggcctggggattatgggggtcctatgttccttatgccaggattgcttataacactatatgtgactggatcactgaacactgtcttatcaccagaacatcagaaggagatccgccgatatctctataatcatcagaatgaagatggaggctggggattgcacattgagggtccaagcaccatgtttggctcagccttgacctatgtttccctgagattgcttggagagggaccagagagtggagatggtgctatggaaaaaggtcgaaattggattttagaccatgggggagcaacttatataacatcatggggaaagttttggctcgcggtacttggtgtatttgattggtctggtaacaatccactgccaccagaaatatggatgttgccataccgcctgccaattcatccaggtcgaatgtggtgtcactgccgcatggtgtatctacccatgtgctatgtttatggaaaaaggtttgttgggaaaatcacaccacttatattggaactaagaaacgaactctacaaaaccccctacagcaagattgattgggacagtgctcgcaatctttgtgctaaggaagatctgtactatccacatccattgatacaggatatattatgggccacactccataaatttgtcgaaccagttatgatgcattggcctgggaacaaattgagggagaaagctttgaaccatgtcatgcagcatgttcattatgaagatgagaacacccgctacatttgtattggtcctgtgaacaaggtactaaatatgcttacttgttggattgaagatccaaattcggaagcattcaagctccatattccaagagtccatgattacttgtgggttgccgaagatggcatgaagatgcagggttataatggcagccagctctgggacacagctttcgcagtccaagctattacagctactggcctcattgatgagtttgctcccactcttaagcttgcacacaacttcattaagaactcccaggttcttgatgactgccctggagatctgagttattggtaccgtcacatatctaaaggtgcatggcctttttctactgctgatcatggttggcctatatcagattgcactgcagaaggactaaaggccgcattattgctatcgaagatttctccagaaattgtgggcgaaccagtggaagttaacagactttatgatgctgtcaattgtctgatgtcttggatgaacaacaatggtggttttgcaacttatgaactcacaaggtcttatgcctggctagagcttatcaaccctgctgagaccttcggggacattgtcattgattacccgtatgtggaatgtacgtcagctgcaattcaggccctgacatcatttaaaaagctctatcctgggcaccgcaggaaagatgtagataactgtatcaacaaagctgctaatttcatagagagtattcaaagaagtgacggttcatggtatggctcttgggctgtttgtttcacctatggcacatggtttggagtgaaggcattagttgctgctggtaggacgttcaagagtagtcctgcaatcaggaaggcgtgtgaatttctgatgtcaaaagagcttcctttcggtggctggggaaaaagttatttgtcatgtcaagatcaggtttacaccaatcttgaaggcaagcatgctcacgcagtcaacactggctgggccatgctgaccctaattgacgcaggacaggccgagagagatccaacacctttgcatcgagcagcgaaggttttgatcaacttacaatctgaggatggggaatttcctcaacaagagatcatgggagtcttcaacaagaactgcatgatcagttactcccagtacagggacatcttccctgtctgggcactcggagagtaccgttgccgagtcttggctgcgggcaagtag

SEQ ID NO: 4426 - protein, 759 aa, Avena strigosa
MWRLKIAEGGGDPWLRTKNAHVGRQVWEFDPEAGDPEALAAVEAARRDFAAGRHRLKHSSDRLMRIQFEKENPLKLDLPAIKLEENEDVTEEAVSTSLKRAISRFSTLQAHDGHWPGDYGGPMFLMPGLLITLYVTGSLNTVLSPEHQKEIRRYLYNHQNEDGGWGLHIEGPSTMFGSALTYVSLRLLGEGPESGDGAMEKGRNWILDHGGATYITSWGKFWLAVLGVFDWSGNNPLPPEIWMLPYRLPIHPGRMWCHCRMVYLPMCYVYGKRFVGKITPLILELRNELYKTPYSKIDWDSARNLCAKEDLYYPHPLIQDILWATLHKFVEPVMMHWPGNKLREKALNHVMQHVHYEDENTRYICIGPVNKVLNMLTCWIEDPNSEAFKLHIPRVHDYLWVAEDGMKMQGYNGSQLWDTAFAVQAITATGLIDEFAPTLKLAHNFIKNSQVLDDCPGDLSYWYRHISKGAWPFSTADHGWPISDCTAEGLKAALLLSKISPEIVGEPVEVNRLYDAVNCLMSWMNNNGGFATYELTRSYAWLELINPAETFGDIVIDYPYVECTSAAIQALTSFKKLYPGHRRKDVDNCINKAANFIESIQRSDGSWYGSWAVCFTYGTWFGVKALVAAGRTFKSSPAIRKACEFLMSKELPFGGWGKSYLSCQDQVYTNLEGKHAHAVNTGWAMLTLIDAGQAERDPTPLHRAAKVLINLQSEDGEFPQQEIMGVFNKNCMISYSQYRDIFPVWALGEYRCRVLAAGK

SEQ ID NO: 4427 - DNA, 2551 bp, Luffa cylindrica
  CDS (130)..(2409)
gttaggtataaattaaaagtcctcctcctccctccacagccggccatgaacaactagcttagattaagtttattatgatttgagaatataggttggtgggtaaagacgattgagttgaggtgattgatcatgtggaggcttaaggtagcagatgggggaaatgacccctacatctattccatgaacaacttcataggaaggcaaatatgggagttcgatccaaatgctggcacccccgaagagcgagcagaaattgaacgcctccgtcaccatttcaccaaaaaccgtcacaagggttttcctagcgccgatttgctttggcgtgtccagcttctgagggagaaaaatttcaaacaaagtatcccagcagtaaaggttggagatggagaagaaataagttatgaaatggcattagatgcaatgaggagaggggcacatttcctagcggccatacaggcgagtgatggacactggccgagtgaaacatcaggcccactattttacgtttgtcccttgctaatttgcatgtacataatgggttttatggataaagtatttagtcccgagcacaaaaaggaaatgatgcgttacatttacaaccatcagaatgaagatgggggatgggggttacacgtaggtggtcacagtaacatgttttgcactaccttcaattatatctctttacgtttacttggtgaagaacctgatgttgaggcagtttgcaaagccagaaattggatccatgaccatgatggtgtcacctccatactttcttggggaaagacatggctctcgatattaaacgtgttcgattggtctgcgagcaaccccatgcctcctgagtattggatgttgcccacttgggtccccattcatccatcaaacatgatgtgctacactcgaatcacctacatgcccatgtcttacttgtatggcaaaaggtttcaagcacctctaacgcctcttgttttacaattaagagacgaacttcacacccaaccctacgatcaaattaactggaggaaagttcgtcacatgtgtgctacggaagacctctactttccacatccctttgttcaagacctactttgggacactctttacttactcagtgaaccactcatgactcggtggccttttaacaaactgattcgccaaaaagccctgaatgaaactatgaggcatattcattatgaggatgaaaacagtcgctacattaccattggctgcgttgaaaagcctttatgcatgcttgcttgctgggttgaagatccgaatagtgagtatgtgaagaaacatttagcacgaattcctgattatttatggatggccgaagatgggatgaaaatgcaaagttttggtagccagtcatgggatgctgctttggccatgcaagctctgctttcttgtaatatcacacgtgaaattgggtctgtgctcaattctggccatgatttcatcaagaactcccaggttagaaacaatcctcccggtgactacaaaagtatgtttcgctatatgtccaaaggatcttggaccttttcagactgtgatcatggatggcaagtgtcggattgcactgccgagaacttgaagtgttgcctactattgtcgttgctaccacctgacatagttggtgagaagatggaacctgaacgtttctacgatgctgtcaatgtcattctaaatatgcaaagcaaaaacgggggtttgccagcttgggagccagcgtcaagttactactggatggagtggttgaatccagtggaatttcttgaagacctaatcatcgagcaccagcatgtggagtgcacctcatctgcgttgcaggcgatactcttatttaggaaacaatacccaggacatagaagaaaagaaatcaataatttcatcaacaaggccgttcaatttcttcaagacatacaactgccagatgggtcttggtatggaaattggggaatttgctatacttatggaacgtggtttgcacttaaggcattgtcgatggcagggaagacgtatgaaaattgtgaggcagttcggaaaggtgcgaattttctaagaaaaatacagaatccagaaggagggtttggagagagctacttgtcatgtccttataagagatatataccgctggatgggaaacgatcaaatttggtgcaaacggcatggggtatgatgggtttgatatgtgcaggacaggcagatgtagatcccactcctattcatcgtgcagccaagttgttgatcaattctcaaacggaagatggtgattttcctcaagaggaaattactggagaattcttcaaaaattgtacattacactttgcagcatttagggaagtctttcctgtgatggcgttgggagaatattgtaacaaggttccgttgccttctaagaaaaaatagtaaattaagattggagacttttactcttcaataatctttaaacggtcacgtgtaatataataacttttttttttttttttttttgaaaagacgtgtagtataatactaaacaaaaggtaatcgagcacaacttttaattccc

SEQ ID NO: 4428 - protein, 759 aa, Luffa cylindrica
MWRLKVADGGNDPYIYSMNNFIGRQIWEFDPNAGTPEERAEIERLRHHFTKNRHKGFPSADLLWRVQLLREKNFKQSIPAVKVGDGEEISYEMALDAMRRGAHFLAAIQASDGHWPSETSGPLFYVCPLLICMYIMGFMDKVFSPEHKKEMMRYIYNHQNEDGGWGLHVGGHSNMFCTTFNYISLRLLGEEPDVEAVCKARNWIHDHDGVTSILSWGKTWLSILNVFDWSASNPMPPEYWMLPTWVPIHPSNMMCYTRITYMPMSYLYGKRFQAPLTPLVLQLRDELHTQPYDQINWRKVRHMCATEDLYFPHPFVQDLLWDTLYLLSEPLMTRWPFNKLIRQKALNETMRHIHYEDENSRYITIGCVEKPLCMLACWVEDPNSEYVKKHLARIPDYLWMAEDGMKMQSFGSQSWDAALAMQALLSCNITREIGSVLNSGHDFIKNSQVRNNPPGDYKSMFRYMSKGSWTFSDCDHGWQVSDCTAENLKCCLLLSLLPPDIVGEKMEPERFYDAVNVILNMQSKNGGLPAWEPASSYYWMEWLNPVEFLEDLIIEHQHVECTSSALQAILLFRKQYPGHRRKEINNFINKAVQFLQDIQLPDGSWYGNWGICYTYGTWFALKALSMAGKTYENCEAVRKGANFLRKIQNPEGGFGESYLSCPYKRYIPLDGKRSNLVQTAWGMMGLICAGQADVDPTPIHRAAKLLINSQTEDGDFPQEEITGEFFKNCTLHFAAFREVFPVMALGEYCNKVPLPSKKK

SEQ ID NO: 4429 - DNA, 2310 bp, Arabidopsis thaliana
  CDS (1)..(2310)
atgtggaggctgagaactggaccgaaggctggagaggatactcacctgttcaccaccaacaactatgcagggaggcagatttgggaatttgatgccaacgcaggctctccacaagaaattgccgaggtagaggatgctcggcacaaattctcagacaacacgtcacgtttcaagactactgccgatctcttatggcgcatgcagtttcttagggagaagaaattcgaacagaagattccacgagtgataatcgaggatgcaagaaagataaagtacgaagatgcaaagacagcattgaaaagagggttactctatttcacagccttgcaggctgatgatggacactggccagctgaaaactctggcccaaatttctatacccctccttttttgatatgcttgtacatcactggacatctggagaaaatcttcactcccgagcatgttaaagagttactacgtcacatctacaacatgcagaacgaagatggtgggtggggtttacacgtagaaagccacagtgttatgttctgtacagtcattaattacgtctgtctacgaattgtgggagaagaagtcggtcatgatgatcaaagaaatggttgtgcaaaggctcataagtggatcatggaccatggtggtgctacctacacgcccttgatcggaaaagcgttgctttcggttcttggagtgtatgattggtctggctgcaatcctatacctccagagttctggttgcttccgtcttcttttcctgttaatggagggactctctggatttatttacgggatactttcatggggttgtcatacttgtatggtaaaaaatttgtggctcccccaacacctctcattctccagctccgagaagagctttatccggagccttatgcaaaaatcaattggacgcaaacacgaaaccgatgtggaaaggaagatctctactatccacgctcatttttacaagatttgttttggaagagtgttcacatgttctcagagagtatcctagatcgatggcctttaaacaagctaataagacaaagagctcttcaatccactatggcactcattcactatcatgacgaatccaccagatatattacaggcggatgcctgccaaaggtagtcgttgcctttcatatgcttgcatgttggatagaagaccctaagagtgattattttaaaaaacatcttgctcgagttcgcgaatacatatggattggcgaggatggcctgaaaattcaatcttttggtagccaattatgggatacagccttatcgctacatgcattactagacggaattgatgatcatgatgttgatgatgagattaaaacaacgctcgttaaaggatatgattacttgaagaaatcacaaattacagagaaccctcgcggtgatcacttcaaaatgtttcgtcacaagacaaaaggtggatggacattttcagatcaagatcaaggatggcctgtttcagattgtactgctgaaagcttagagtgttgtctattcttcgagagcatgccgtccgagcttattggaaaaaaaatggatgtggagaaactctatgatgccgttgattatcttctctatctgcagagtgataatggaggcatagcagcatggcaaccagttgaaggaaaagcctggttagagtggcttagtccagtggagttccttgaagacacaatcgtggagtatgagtatgtagaatgtacggggtcagcgattgcagcattgactcagtttaacaaacagtttccagggtataaaaacgtagaggttaaacggtttataacaaaggctgcaaagtacattgaagacatgcaaacggtggatggttcatggtacggaaattggggagtgtgttttatatacgggaccttctttgcggtaagaggtcttgtggccgctgggaagacttacagtaactgtgaagcaattcgtaaagcagttcgttttcttctagacacacaaaatccggagggtggctggggagagagctttctctcttgtccaagcaagaaatatactcctttgaaaggaaacagcacaaatgtggtgcaaacagcacaagcacttatggtgctaattatgggtgatcagatggagagagatcctttaccggttcatcgtgctgctcaagtgttgatcaattcacagttggataatggcgattttccacagcaggaaataatgggaacgttcatgagaactgtgatgctccattttccgacctataggaacacgttctctctttgggctctcacacattacacacatgctctgcgacgtctcctcccttaa

SEQ ID NO: 4430 - protein, 769 aa, Arabidopsis thaliana
MWRLRTGPKAGEDTHLFTTNNYAGRQIWEFDANAGSPQEIAEVEDARHKFSDNTSRFKTTADLLWRMQFLREKKFEQKIPRVIIEDARKIKYEDAKTALKRGLLYFTALQADDGHWPAENSGPNFYTPPFLICLYITGHLEKIFTPEHVKELLRHIYNMQNEDGGWGLHVESHSVMFCTVINYVCLRIVGEEVGHDDQRNGCAKAHKWIMDHGGATYTPLIGKALLSVLGVYDWSGCNPIPPEFWLLPSSFPVNGGTLWIYLRDTFMGLSYLYGKKFVAPPTPLILQLREELYPEPYAKINWTQTRNRCGKEDLYYPRSFLQDLFWKSVHMFSESILDRWPLNKLIRQRALQSTMALIHYHDESTRYITGGCLPKVVVAFHMLACWIEDPKSDYFKKHLARVREYIWIGEDGLKIQSFGSQLWDTALSLHALLDGIDDHDVDDEIKTTLVKGYDYLKKSQITENPRGDHFKMFRHKTKGGWTFSDQDQGWPVSDCTAESLECCLFFESMPSELIGKKMDVEKLYDAVDYLLYLQSDNGGIAAWQPVEGKAWLEWLSPVEFLEDTIVEYEYVECTGSAIAALTQFNKQFPGYKNVEVKRFITKAAKYIEDMQTVDGSWYGNWGVCFIYGTFFAVRGLVAAGKTYSNCEAIRKAVRFLLDTQNPEGGWGESFLSCPSKKYTPLKGNSTNVVQTAQALMVLIMGDQMERDPLPVHRAAQVLINSQLDNGDFPQQEIMGTFMRTVMLHFPTYRNTFSLWALTHYTHALRRLLP

SEQ ID NO: 4431 - DNA, 2456 bp, Arabidopsis thaliana
  CDS (1)..(2286)
atgtggagactgcgaattggagctgaggcaagacaagaccctcacttgttcaccacgaacaactttgccggaagacagatctgggagtttgatgccaacgggggctctcctgaggaactcgccgaggtcgaggaggctcgcctcaatttcgcaaacaacaagtcacgtttcaaggctagtcccgatctcttctggcgtaggcagtttctgagggagaaaaagttcgagcagaagatcccgagagtgagaatagaggatgcagagaagataacatatgaagacgcaaagacggcactaagaagaggagtactctattacgcggcatgtcaggctaacgatggccattggccttctgaagtctctggttccatgttcttggacgctccctttgtgatatgcttgtacattaccggacacctggagaaaatctttacactagagcatgtcaaagagttactccgttacatgtataacactcagaatgaagatggtgggtgggggttagatgtggaaagccacagtgtcatgttttgcacggtcctcaactacatctgcttacgtattttgggagtagaaccagatcatgacggtcaaaaaagtgcatgcgcaagggctcgtaaatggatcctagaccatgggggtgccacgtatgcgcctatggtggctaaagcttggctttcggttctaggagtgtatgactggtctggttgcaaaccgctaccacccgagatttggatgctcccttctttttctcccattaatggaggtactctatggatatatatccgggatcttctcatgggcatgtcatatttgtatggtaaaaaatttgtagctacaccaaccgctctcattctacagctccgagaagaactttatccccagccttacagcaaaatcatttggagcaaagcccgtaatcgatgcgcaaaggaagatctattatatccaaagtcatttggacaagatttgttttgggaaggtgttcatatgctttcggagaatatcataaaccgctggcctctcaacaagtttgttagacaaagagcactacgaaccacaatggaacttgttcactaccatgatgaaacgacccactatatcacaggtgcatgtgttgcgaagccgtttcatatgcttgcttgttgggtagaagatcctgatggtgattatttcaagaaacatcttgctcgagtccctgatttcatatggattgctgaagatggccttaaatttcagttaatggggatgcagtcgtggaatgcagccctctccctccaagttatgttagccgcaaacatggatgacgaaattcgatcaaccctgataaaaggatacgacttcttgaagcaatctcagattagcgagaaccctcaaggtgaccatctgaaaatgtttagagacattacaaaagggggatggacttttcaagatcgagaacaagggttgccgatttcggatggtacagcagaaagtatagagtgctgcatacacttccaccgcatgccctccgagttcatcggcgaaaaaatggatgtagagaagctctatgatgccgtcaattttctaatctatttgcagagtgataatggaggtatgccagtttgggagccagctcctggaaaaaaatggctagagtggcttagtccggtggagcatgtggagaacacagttgtggagcaagagtaccttgagtgtacgggctcggtgattgcgggattggtttgcttcaagaaagagtttcccgatcacagaccgaaagagatcgaaaagttaataaaaaaaggcctaaaatacatagaggacttgcaaatgccggacggttcatggtacggaaactggggagtttgtttcacgtatggtactctctttgcagtaagaggtctagcggctgcagggaagacttttggcaactctgaagctatacgtagagctgttcagtttattctcaacacgcaaaacgccgaaggcggttggggagaaagtgctctctcttgccctaacaagaaatatattccttctaaaggaaacgtgacgaatgtggttaataccggacaagctatgatggttttacttattggtggtcagatggagagggacccttctcctgttcatcgcgccgccaaagtgttgattaactcacagttggatattggcgatttcccacaacaggaaagaagggggatctacatgaatatgctgctgcattatccaacctatagaaacatgttctctctttgggctctcgcattgtacacaaatgctctgcgtctgcttgtttcttgacgacttcacatttaaatcttaataatgaatcaccatcggtttgatgctatatgtatatcctatctgtatatctttcttgtttgtccctaaatgacataaaaataaaactatttgtgtacaaagtgtttgttgtttatatttgatttaaggaataacgaaatatttcatat

SEQ ID NO: 4432 - protein, 761 aa, Arabidopsis thaliana
MWRLRIGAEARQDPHLFTTNNFAGRQIWEFDANGGSPEELAEVEEARLNFANNKSRFKASPDLFWRRQFLREKKFEQKIPRVRIEDAEKITYEDAKTALRRGVLYYAACQANDGHWPSEVSGSMFLDAPFVICLYITGHLEKIFTLEHVKELLRYMYNTQNEDGGWGLDVESHSVMFCTVLNYICLRILGVEPDHDGQKSACARARKWILDHGGATYAPMVAKAWLSVLGVYDWSGCKPLPPEIWMLPSFSPINGGTLWIYIRDLLMGMSYLYGKKFVATPTALILQLREELYPQPYSKIIWSKARNRCAKEDLLYPKSFGQDLFWEGVHMLSENIINRWPLNKFVRQRALRTTMELVHYHDETTHYITGACVAKPFHMLACWVEDPDGDYFKKHLARVPDFIWIAEDGLKFQLMGMQSWNAALSLQVMLAANMDDEIRSTLIKGYDFLKQSQISENPQGDHLKMFRDITKGGWTFQDREQGLPISDGTAESIECCIHFHRMPSEFIGEKMDVEKLYDAVNFLIYLQSDNGGMPVWEPAPGKKWLEWLSPVEHVENTVVEQEYLECTGSVIAGLVCFKKEFPDHRPKEIEKLIKKGLKYIEDLQMPDGSWYGNWGVCFTYGTLFAVRGLAAAGKTFGNSEAIRRAVQFILNTQNAEGGWGESALSCPNKKYIPSKGNVTNVVNTGQAMMVLLIGGQMERDPSPVHRAAKVLINSQLDIGDFPQQERRGIYMNMLLHYPTYRNMFSLWALALYTNALRLLVS

SEQ ID NO: 4433 - DNA, 3057 bp, Abies magnifica
  CDS (503)..(2773)
attaatttctccgagtctaaagtcttctcttttgaagattacacggtctgaacttacatatacctgttatgcgttgaaccgtggtggggtgcggagtaatagaaagccctccttgatattctaccttttaccagcgatagccttcaatcgcaactcgatctgaagcttaaaaccttccagcactaaacaaaacggcagatcggagcatttggagtcagtttccgacaattatattcctagtttcagtttggagttcagcatttcgttccaacattttaattttaagagtactgagtatagagaatttgaacgagccggcaagcaagaggatgaactcgttgaggattgagttcttcgacactcatgatgtaaaacgaaacaaacatcattggcgttgagaatcaggaaccaagaatatcgcaaactgtgggataggtagagttagaactgcaatctgtgtgtttctgttgaaattccagattgtgcattggaagaattggcaatgtggaagctgaagattgctgaggggggaagcccctggttgcagaccttgaacaatcacgtgggaagacaagtgtgggaatttgatccaaaagctggtacatctgaggaccaccttgctgtagaaaaagctcgtgtagacttttataacaagagatttattcaacaccatagtgctgatcttcttatgaggttgcagtgtggtggagaaaatccactctcacctcttccagctcaagtaaaattagaaagtgctaatgacatcactgaggaggtaatacaaactacattggtgcgagcaatacgcttttatgccactattcaagcacacgatggacactggcctggtgattatggtggtccaatgttccttatgccaggtttggttattgccttgtatgtgacaggagcactaaatgcagttttatctgaaatgcataaaaaggaaatttgtcgttatctatataaccatcagaatgaagatggtggatggggtttgcatattgaggggcacagcacaatgtttggaaccgtgttaaactatgttactttgagacttcttggacaagcacctgatggagggcaaggagccatggaaaaggggtgtgcatggattttggatcatggtggtgccactgcaataccttcctggggaaaaatgtggctctcagtacttggagtatttgattggactggaaacaatccattgcctccagaaatgtggctcctcccttattttcttccaacccatccagggagaatgtggtgtcactgtcgaatggtttatttgccaatgtcatatatatatggacggagatttgtgggtcctctaactggaattgttatgtctttaagggaagagctctatacagtgccttatgagaaaatagattggaatcaagcacgtagcatgtgtgcaaaggaagatctttactacccacatccttttctacaagatatcctatggggaactcttcataaagtagtagagcctgcacttatgcattggccaggatcgatgctacgggagagggcacttcagtcagtgatgaagcatatacattatgaggatgaaaacactcgctacatctgcattggccctgttaacaaagtattgaatatgctttgttgctgggtagaagattcaaactcagaggcatttaaaaggcatcttgctcgagtcgtagactatctatgggttgcagaagatggcatgaagatgcagggatacaatggcagtcagttatgggatacagcatttgctacgcaagctcttatatcgaccaacctccttgatgattgtggtccactgcttaagaaggcacatatatatatagaaaggtcacaggttcaagaagattgtccaggtgatttgaatttctggtatcgccatatttctaatggtgcctggcctttctcgacaagggatcatggttggccaatttcagactgctcttctgaaggcctaaaggccgcattagcattgtcacaattgcctcaagacattgtggggaaaccaattccctcgcaacggatttttgattgtgtcaatttgatgctttctatgcagaatagcgatggtggttttgcaacttatgaattgacaagatcctatccttggctagagaaaatcaatcctgcagagacatttggagatattgtcattgactattcgtatgtggagtgcacttcagcaataactcaagctcttgtatcgtttaagaaactgtatccagagcaccgacacaaagaaatagaaacatgcattttaaaggccacccggtacattgaaaacatccagaggcctgatggttcatggtatggttcatggggagtctgcttcacatatggtacatggtttggtgttctggggttagcagcggctggaaaaacctaccaaaactgttcaaatattcgtaaagcttgcgagttccttctttcaaagcagcttccttctggtggctggggagaaagttatctttcatgccaagagaaggtctatacacacttggagggtggaagatcacacatagtaagcacggcatgggctatgcttgctcttatttatgctggccaggctttgagggatccaaaacctcttcatcgagcagcaattgtactagtcaattatcagatggagaatggtgattttccacaacaggaaattatgggagtattcaataggaattgtatgatctcttactctgcctatcggaatatctttcctatatgggctctaggggaatattgccgtcatgtactgcaatcataatgtatagatttctcatatattttaagggtaagtttttgggataaaccttacaggtatttttgcaggaggcaggattgatctctatggatcagcgattgaagaataaaaataattttcaacttttattgacttctactcaagcttgcatgaaagaaaacttggtaatgtctctcatgtgatgatactcaattttatatttgatcatgactgaagcaattgtatcacccataattattacggtactaaactttctactgcttagatcataattgaagaaaaaaaaa

SEQ ID NO: 4434 - protein, 756 aa, Abies magnifica
MWKLKIAEGGSPWLQTLNNHVGRQVWEFDPKAGTSEDHLAVEKARVDFYNKRFIQHHSADLLMRLQCGGENPLSPLPAQVKLESANDITEEVIQTTLVRAIRFYATIQAHDGHWPGDYGGPMFLMPGLVIALYVTGALNAVLSEMHKKEICRYLYNHQNEDGGWGLHIEGHSTMFGTVLNYVTLRLLGQAPDGGQGAMEKGCAWILDHGGATAIPSWGKMWLSVLGVFDWTGNNPLPPEMWLLPYFLPTHPGRMWCHCRMVYLPMSYIYGRRFVGPLTGIVMSLREELYTVPYEKIDWNQARSMCAKEDLYYPHPFLQDILWGTLHKVVEPALMHWPGSMLRERALQSVMKHIHYEDENTRYICIGPVNKVLNMLCCWVEDSNSEAFKRHLARVVDYLWVAEDGMKMQGYNGSQLWDTAFATQALISTNLLDDCGPLLKKAHIYIERSQVQEDCPGDLNFWYRHISNGAWPFSTRDHGWPISDCSSEGLKAALALSQLPQDIVGKPIPSQRIFDCVNLMLSMQNSDGGFATYELTRSYPWLEKINPAETFGDIVIDYSYVECTSAITQALVSFKKLYPEHRHKEIETCILKATRYIENIQRPDGSWYGSWGVCFTYGTWFGVLGLAAAGKTYQNCSNIRKACEFLLSKQLPSGGWGESYLSCQEKVYTHLEGGRSHIVSTAWAMLALIYAGQALRDPKPLHRAAIVLVNYQMENGDFPQQEIMGVFNRNCMISYSAYRNIFPIWALGEYCRHVLQS

SEQ ID NO: 4435 - DNA, 2301 bp, Arabidopsis thaliana
  CDS (1)..(2301)
atgtggagactaagaattggagctaaggccggaaatgatactcacttgttcacgaccaacaactatgttgggaggcagatttgggagtttgatgccaacgcaggctcccctcaagaacttgccgaggtcgaggaggctcgtcggaatttctctaacaataggtcacattacaaggccagtgctgatctcttatggaggatgcagtttcttagggaaaaaggttttgaacagaagattccacgtgtgagagtagaggatgcagcgaaaataaggtatgaagatgcaaaaaccgcattgaaaagaggattacattattttacggccttgcaggcagatgatggacactggcctgcagataactctggtccaaatttcttcatcgctcctttagttatatgcttgtacattactggacatctggagaaaatctttacagtcgagcatcgtatagagttaatacgttacatgtataaccatcagaacgaagatggtgggtggggattacatgtagaaagccctagtattatgttttgtacagtcatcaactacatttgtttacgaatcgtgggagtagaagccggtcatgatgatgatcaaggaagtacttgtacaaaggctcgtaagtggatactcgaccacggtggtgctacctacacacccttgatcggaaaagcttgcctatcagttcttggagtgtatgattggtctggctgcaaacctatgccgccagagttctggttccttccttcttcttttcctattaatggaggaactctatggatttatttacgggatattttcatggggttgtcatacttgtatggtaaaaaatttgttgcaactccaacacctctcatcctccagctccaagaagagctttatccagagccttacaccaaaatcaattggaggcttaccagaaaccgatgtgcaaaggaagatctctgttatccatcctcatttttacaagatttgttttggaaaggtgttcatatcttctcagagagtattctaaatcgatggcctttcaacaagctcataagacaagcagctcttcgaaccactatgaaactccttcactatcaagatgaagccaatagatacattacaggcggatcagtgccaaaggcctttcatatgcttgcatgttgggtagaagacccagagggtgaatattttaaaaagcatcttgctcgagtctctgatttcatatggattggcgaggatggcctcaaaattcagtcttttggcagccaattgtgggatacagtcatgtcgctacatttcctgttagacggtgttgaggatgatgtcgatgatgaaattagatccacgctcgttaaaggatacgattacttgaagaaatctcaagttacagagaatcctcctagtgatcacataaaaatgttccgccatatttcgaaaggtggatggacgttttcggacaaagatcaaggatggcctgtttcagactgcactgctgagagtttaaaatgctgtctattatttgagaggatgccgtcggagtttgttggccagaaaatggatgtggagaaactctttgatgccgttgattttcttctctacttgcagagtgataacggaggtataacagcttgggaacccgcggatgggaaaacctggttagagtggtttagtccggtggaatttgttcaagacacggtcatcgagcatgagtatgtggaatgtacagggtcagccattgtagcgttgactcagtttagtaaacaattcccggagtttagaaagaaagaggttgaaaggtttataactaacggagtgaaatacattgaggatttgcaaatgaaggatggttcatggtgcggaaactggggagtgtgctttatctatgggaccttatttgccgtaagaggtcttgtggctgcaggaaagactttccataactgtgaacccattcgtcgagcagttcgtttccttctcgacacgcaaaaccaggagggtggttggggagagagctatctctcttgcctaaggaagaaatatactcctttagcaggaaacaagacaaatatagtgagtacaggacaagcgcttatggttctaattatgggtggtcagatggagagagatcctttgccggttcatcgtgctgccaaagtagtgatcaatttacagttggataacggtgatttcccgcaacaggaagtaatgggagtattcaatatgaatgtgctgctccattatccaacatataggaacatttattctctttgggccctcacactatacacgcaagctctacggcggcttcagccttga

SEQ ID NO: 4436 - protein, 766 aa, Arabidopsis thaliana
MWRLRIGAKAGNDTHLFTTNNYVGRQIWEFDANAGSPQELAEVEEARRNFSNNRSHYKASADLLWRMQFLREKGFEQKIPRVRVEDAAKIRYEDAKTALKRGLHYFTALQADDGHWPADNSGPNFFIAPLVICLYITGHLEKIFTVEHRIELIRYMYNHQNEDGGWGLHVESPSIMFCTVINYICLRIVGVEAGHDDDQGSTCTKARKWILDHGGATYTPLIGKACLSVLGVYDWSGCKPMPPEFWFLPSSFPINGGTLWIYLRDIFMGLSYLYGKKFVATPTPLILQLQEELYPEPYTKINWRLTRNRCAKEDLCYPSSFLQDLFWKGVHIFSESILNRWPFNKLIRQAALRTTMKLLHYQDEANRYITGGSVPKAFHMLACWVEDPEGEYFKKHLARVSDFIWIGEDGLKIQSFGSQLWDTVMSLHFLLDGVEDDVDDEIRSTLVKGYDYLKKSQVTENPPSDHIKMFRHISKGGWTFSDKDQGWPVSDCTAESLKCCLLFERMPSEFVGQKMDVEKLFDAVDFLLYLQSDNGGITAWEPADGKTWLEWFSPVEFVQDTVIEHEYVECTGSAIVALTQFSKQFPEFRKKEVERFITNGVKYIEDLQMKDGSWCGNWGVCFIYGTLFAVRGLVAAGKTFHNCEPIRRAVRFLLDTQNQEGGWGESYLSCLRKKYTPLAGNKTNIVSTGQALMVLIMGGQMERDPLPVHRAAKVVINLQLDNGDFPQQEVMGVFNMNVLLHYPTYRNIYSLWALTLYTQALRRLQP

SEQ ID NO: 4437 - DNA, 2516 bp, Pisum sativum
  CDS (73)..(2367)
aaatgtattataagctgaaacttgcagtatatatattaaagtgaagagatagtataatacacctaaaataagatgtggaagctgaagataggagatggtggaaaagatcgaaacatattcagcacaaataattttgtagggagacaaacatgggagtttgatcctgatgctggtacttcccaagagaaagctcaagttgaagctgctcgccaacatttctatgataaccgtttcgaggttaaggcatgcagtgatcttctttggcgctttcagattctgaaagaaaagaattttaaacaaacaatagaaagtgtaaagatcaaagatgaagaggagatatcagaagaaaatgttgcaattacattaagaagagctgttcatcacctatcaactcttcaatctaatgatggtcattggcctgctttaaacgcaggtcctctattttattttcctcctctggtcttttgtatgtacgttacaggacatcttgattcaatattcccctatgagtatcggaaagagattcttcgttacatatattgtcatcagaatgaagatggagggtggggactacacgtggagggtcacagtatcatgttttgtactgtactcaattacatatgtatgcgaatacttggagaaggtccaaatggaggtaaagaagatgcttgtgctagagcaagaaaatggattcatgatcatggtagtgtgacacatgtatcttcatgggggaaaatctggctttcggtacttggtatctttgattggtgtgcaagcaacccaatgccccctgagttttggatgcttccctcatttcttctcaagcatccagctaaaatgttgtgttattgccgattggtatacatgcctatgtcttacttgtatgggaagagatttgtgggtccaatcacaccactcatcttaatgttgagagaagaactcctgactcaaccatatgaaaaagttaactggaaaaaaacacgtcacctatgtgcaaaggaagatctttactatccccatcctttgatacaagatctaatatgggatagtttatacattttcgtggagccacttttgactcattggccttttaacaagctgcttagagaaaaagctctccaaacagtaatgaaacatatccattatgaagatgaaaatagtcgatacataactattgggtgtgtggaaaaggttttgtgcatactagcttgttgggtggaagatccaaatggagatgcattcaagaagcatcttgctaggctcccagattatttatgggtttcagaagatggaatgaccttgcatagttttggtagccaaacatgggatgctagtttgatcattcaagctttgcttgccactaacctaattgaggatgttggtccaatacttacaaaagcacatgaattcatcaagaagtctcaggttagggacaacccttcaggagactttaagagcatgtatcgtcatatctctaaagggtcatggaccttctctgataaagatcatggatggcaagtttctgattgcacagcagaaagtttaaagtgttgtctgcttttgtctatgttgcctccggagattgtgggggaaaagatggaacctgaaatgttatatgattcggtcaacattctattatcacttcagggtaaaaaaggtggtttaccagcttgggagccatcagaagctgtagaatggttggaactattcaatccaatagaatttcttgaggaaattgtagttgagcgtgaatatgttgaatgcacttcatcagcaattcaagctttagttttgtttaaaaaactatatccagaacacagaaagaaagaggttgaaaatttcattgcaaatgcagttcgatttctcgaatataaacaaacaagtgatggttcatggtatggaaattggggaatttgcttcacttatggttcttggtttgcacttaacggtctagtggctgctggcaagacttatgataattgtgcagccattcgcaaaggtgttgaatttttgcttacaacacaaagagaggatggtgggtggggggagagccatctttctagctcaaaaaagatatatgtacctcttgaaagaagtcaatcaaatattgtgcagacatcatgggctattatgggtttaattcatgctggtcagatggagagagaccctactcctcttcatcgtgctgtaaagttgatcatcaatttccaacaagaagagggtgattggccccaacaggaacttacaggagtattcatgaaaaattgtatgttacaatatgcaatgtatagagatattttcccaacatgggctctagctgaatatcgtagacggattctgttggcttcaccagcagttgcaatttaaaatgaaacatttatgcaattatgtgtgtatcttacttcataaaagatatttgaaagatatatatatatatatacacaaattagtctcggtataagataacaaaaaaaaaaaaatcgatgtcgactcgagtcaatccatatgactagtag

SEQ ID NO: 4438 - protein, 764 aa, Pisum sativum
MWKLKIGDGGKDRNIFSTNNFVGRQTWEFDPDAGTSQEKAQVEAARQHFYDNRFEVKACSDLLWRFQILKEKNFKQTIESVKIKDEEEISEENVAITLRRAVHHLSTLQSNDGHWPALNAGPLFYFPPLVFCMYVTGHLDSIFPYEYRKEILRYIYCHQNEDGGWGLHVEGHSIMFCTVLNYICMRILGEGPNGGKEDACARARKWIHDHGSVTHVSSWGKIWLSVLGIFDWCASNPMPPEFWMLPSFLLKHPAKMLCYCRLVYMPMSYLYGKRFVGPITPLILMLREELLTQPYEKVNWKKTRHLCAKEDLYYPHPLIQDLIWDSLYIFVEPLLTHWPFNKLLREKALQTVMKHIHYEDENSRYITIGCVEKVLCILACWVEDPNGDAFKKHLARLPDYLWVSEDGMTLHSFGSQTWDASLIIQALLATNLIEDVGPILTKAHEFIKKSQVRDNPSGDFKSMYRHISKGSWTFSDKDHGWQVSDCTAESLKCCLLLSMLPPEIVGEKMEPEMLYDSVNILLSLQGKKGGLPAWEPSEAVEWLELFNPIEFLEEIVVEREYVECTSSAIQALVLFKKLYPEHRKKEVENFIANAVRFLEYKQTSDGSWYGNWGICFTYGSWFALNGLVAAGKTYDNCAAIRKGVEFLLTTQREDGGWGESHLSSSKKIYVPLERSQSNIVQTSWAIMGLIHAGQMERDPTPLHRAVKLIINFQQEEGDWPQQELTGVFMKNCMLQYAMYRDIFPTWALAEYRRRILLASPAVAI

SEQ ID NO: 4439 - DNA, 2601 bp, Pisum sativum
  CDS (70)..(2346)
cgataaacaacgagttcatcactttgtatagctaccatcacctcttcacacaccaccttctctaaaaagatgtggaggttgaagatagcagaaggtggtaacgatccatatttgttcagcacaaacaactttgttggaagacagacatgggagtatgatccagaagcaggtagtgaagaagaaagagctcaagttgaagaagctcgtcgcaatttctacaacaaccgcttcgaggttaagccatgtggtgatctcctatggcgttttcaggttcttagagaaaataacttcaagcaaacaataggcggcgtaaagatagaagatgaagaagaaataacatatgaaaaaactacaacaacattgagaagaggcacacatcacttagcaacattgcaaaccagtgatggtcattggccagctcaaattgcaggtcctctatttttcatgcctcctttggttttctgtgtctacattactggacatcttgattcggtgttcccaccagagcatcgcaaagagattcttcgttatatatattgccaccagaacgaagatggagggtgggggcttcacattgagggtcatagcaccatgttttgtactgcactcaactatatatgtatgcggattctcggagaagggcctgatggtggtgaagacaatgcttgcgttagagcaagaaattggattcgtcaacacggtggtgtcacacatataccttcctgggggaaaacttggctttcgatacttggtgtgtttgattggttgggaagtaacccaatgccccctgaattttggatccttccttcatttcttcctatgcatccagctaaaatgtggtgttattgtcgattggtatacatgcctatgtcttatttgtatggaaaaagatttgtgggtcctatcacaccgctcattttacagttgcgagaagaactccatactgaaccttatgaaaagattaattggacgaaaacacgtcatctatgtgcaaaggaagatatttactatcctcatcctttgatacaagatcttatatgggatagcttgtatattttcaccgagccacttttgactcgttggcctttcaacaaattggtcaggaaaagagctcttgaagtaacaatgaagcatattcactacgaggatgagaatagtcgataccttactattggctgtgtggaaaaggttttatgtatgcttgcttgttgggtggaagatccaaatggagatgctttcaagaagcatatagcaagagttccagattatttgtggatttctgaagatggaatgaccatgcagagtttcggtagtcaagagtgggatgctggttttgccgttcaagctttgcttgccactaacctaattgaggaaatcaaacctgcacttgcaaaaggacacgatttcatcaaaaagtctcaggttacagagaatccttccggagattttaagagtatgcatcgtcatatttctaaaggctcgtggaccttctctgatcaagaccacggatggcaagtttctgattgcaccgcagaaggtttaaagtgttgtctacttttatcattgttgcctccagaaattgtgggggaaaagatggaacccgaaaggctatttgattctgtcaatctcctactatcgcttcagagtaaaaaaggaggtttggcggcctgggagcccgcaggagctcaagaatggttagaactactcaatcctacagaattttttgcggacattgttgttgaacatgaatatgttgagtgcacgggatcagcaattcaagctttagttttattcaagaagttatatccgggtcataggaagaaagagatagaaaatttcattttcaatgcagttcgattccttgaagatacgcagacagaggatggttcatggtatggaaactggggagtttgctttacgtatggctcttggttcgctcttggcggtttagcggccgccggaaagacttataccaattgtgctgctattcgtaaaggtgttaaatttcttcttacaacacagagagaggacggcgggtggggggaaagctatctttcaagcccaaaaaagatatatgtacctcttgaaggaaaccggtcaaatgtggtacatactgcatgggctcttatgggtttaattcatgccggccagtcagagagagaccccactcctcttcatcgtgcagcaaaattgcttattaattcccaattagaacaaggcgattggccacaacaggaaatcacaggagtattcatgaaaaattgcatgttgcactatccaatgtatagagatatatatccactatgggctctagctgagtatcgtagaagagttcctttgccttgagaaaaaggacaaatccatatcattaaagaaagaatcgctcaaatgattactttttcttacatgttagcttgtgaatgtatcaatagatgtgtcgtttcatattttgctttctaaaatggatgtctctacctccacacaaaaaaaggtagtatttgctgcaagatgtataacaacaatgaagtataggtagaatatttacatatttatttttaacaatatattaatatttgctcctaaaaaaaaaaaaaaaaaaaa

SEQ ID NO: 4440 - protein, 758 aa, Pisum sativum
MWRLKIAEGGNDPYLFSTNNFVGRQTWEYDPEAGSEEERAQVEEARRNFYNNRFEVKPCGDLLWRFQVLRENNFKQTIGGVKIEDEEEITYEKTTTTLRRGTHHLATLQTSDGHWPAQIAGPLFFMPPLVFCVYITGHLDSVFPPEHRKEILRYIYCHQNEDGGWGLHIEGHSTMFCTALNYICMRILGEGPDGGEDNACVRARNWIRQHGGVTHIPSWGKTWLSILGVFDWLGSNPMPPEFWILPSFLPMHPAKMWCYCRLVYMPMSYLYGKRFVGPITPLILQLREELHTEPYEKINWTKTRHLCAKEDIYYPHPLIQDLIWDSLYIFTEPLLTRWPFNKLVRKRALEVTMKHIHYEDENSRYLTIGCVEKVLCMLACWVEDPNGDAFKKHIARVPDYLWISEDGMTMQSFGSQEWDAGFAVQALLATNLIEEIKPALAKGHDFIKKSQVTENPSGDFKSMHRHISKGSWTFSDQDHGWQVSDCTAEGLKCCLLLSLLPPEIVGEKMEPERLFDSVNLLLSLQSKKGGLAAWEPAGAQEWLELLNPTEFFADIVVEHEYVECTGSAIQALVLFKKLYPGHRKKEIENFIFNAVRFLEDTQTEDGSWYGNWGVCFTYGSWFALGGLAAAGKTYTNCAAIRKGVKFLLTTQREDGGWGESYLSSPKKIYVPLEGNRSNVVHTAWALMGLIHAGQSERDPTPLHRAAKLLINSQLEQGDWPQQEITGVFMKNCMLHYPMYRDIYPLWALAEYRRRVPLP

SEQ ID NO: 4441 - DNA, 2671 bp, Glycyrrhiza glabra
  CDS (308)..(2605)
gactcactctccaaatcaattgagattcaacagtgttggtgttgagcgtcacctgctctgctctgctctgctctgcttgctttaaaactcgtttaatttgtggagactagctgtgtgattcagctaagcttatagttcaaaagttcagcaccggatcaatctcaagacacacaaattaatctcacggatggagtggaggaggtagctagcactttcaattgattcaagcattaaggcggggattgtaataataatagaatagaatagaatagaatagaatactaagaagaagaatcagaagaggaagatgtggaggctgaagatagcggaaggagggaaggacccatacatatacagcacaaacaacttcgtggggaggcagacatgggagtatgatcccgatggtgggactcccgaggagagagctcaggttgatgccgctcgtctccatttctataacaaccgcttccaggtcaagccctgtggcgacctcctttggcgttttcagattctgagagaaaataacttcaaacaaacaatagctagcgtgaagataggagatggagaggaaataacatacgaaaaggcgacaacggcggtgagaagggctgcacatcacctatccgcattgcagaccagcgatggccattggcctgctcaaattgcaggtcctctgtttttccttccccccttggttttttgtatgtacattacaggacatcttgattcggtattcccagaagagtatcgcaaagagattcttcgttacatatactatcaccagaatgaagatggagggtgggggctacacatagagggtcacagcaccatgttttgtactgcactcaactatatatgcatgcgaattcttggagaagggcccgatgggggtcaagacaatgcttgtgctagagcaagaaagtggattcatgatcatggtggtgtaacacatataccttcatggggaaaaacttggctttcgatacttggtgtatttgattggtgcggaagcaacccaatgccccctgagttttggatcctgccttcatttcttcctatgcatccagctaaaatgtggtgttattgccgattggtatacatgcctatgtcttacttgtatgggaaaaggtttgtgggtccaatcacaccgctcattctacagctgagagaagaactgtttactgaaccttacgaaaaagttaattggaagaaagcacgtcaccaatgtgcaaaggaagatctttactatccccatcctttgttacaagatctgatatgggatagtttatacttattcactgagccacttctgactcgttggcctttcaacaagctggttagagaaaaggcccttcaagtaacaatgaagcatatccactatgaagatgagactagtcgatacataaccattgggtgtgtggaaaaggttttatgtatgcttgcttgttgggtggaagatccaaatggagatgctttcaagaagcatcttgcaagggtcccggattacttatgggtttcggaagatggaatgaccatgcagagttttggtagccaagaatgggatgctggttttgccgttcaagctttgcttgccactaacctagtcgaggaaattgctcccacacttgccaaaggacatgatttcatcaagaaatctcaggttagggacaacccttcaggagattttaagagcatgtatcgtcatatttctaaaggctcatggaccttctccgatcaagaccatggatggcaagtttctgattgcacagcagaaggtttgaagtgttgtctacttttatcaatgttgcctccagagattgtgggggaaaagatggaacctgaaaggttatatgattcagtcaatgtcctattgtcgcttcagagtaaaaagggtggtttatcagcgtgggaaccagcaggagctcaagaatggttagaactactcaatcccacggaattttttgcggacattgtagttgagcatgaatacgttgagtgcactggatcagcaattcaggcactagttctgttcaagaagctatatccagggcataggaagaaagagatagagaatttcattgccaatgcagttcgattccttgaagatacacaaacagctgatggttcatggtatggaaattggggagtttgcttcacttacggttcttggttcgcacttggtggtcttgcagctgctggcaagacttttgccaattgtgctgctattcgcaaagctgttaaatttcttctcacaacacagagagaggatggtggatggggggagagctatctttcaagcccaaaaaagatatatgtacctcttgaaggaagtcgatcaaatgttgtgcatactgcatgggcccttatgggtttaattcatgctggccaggcagagagagaccctgctcctcttcatcgagctgcaaaattgatcatcaattcccaattggaagagggtgattggccccaacaggaaatcacgggagtattcatgaaaaattgtatgctgcattacccaatgtatagagatatttatccaatgtgggctctagctgagtatcgtagacgggttccattgccttccactccagtttgtttaacttaaaagctgtgtgagcacaaaaaggacaaagccatatatcaataaagaaccatgcaggcaaattaaatc

SEQ ID NO: 4442 - protein, 765 aa, Glycyrrhiza glabra
MWRLKIAEGGKDPYIYSTNNFVGRQTWEYDPDGGTPEERAQVDAARLHFYNNRFQVKPCGDLLWRFQILRENNFKQTIASVKIGDGEEITYEKATTAVRRAAHHLSALQTSDGHWPAQIAGPLFFLPPLVFCMYITGHLDSVFPEEYRKEILRYIYYHQNEDGGWGLHIEGHSTMFCTALNYICMRILGEGPDGGQDNACARARKWIHDHGGVTHIPSWGKTWLSILGVFDWCGSNPMPPEFWILPSFLPMHPAKMWCYCRLVYMPMSYLYGKRFVGPITPLILQLREELFTEPYEKVNWKKARHQCAKEDLYYPHPLLQDLIWDSLYLFTEPLLTRWPFNKLVREKALQVTMKHIHYEDETSRYITIGCVEKVLCMLACWVEDPNGDAFKKHLARVPDYLWVSEDGMTMQSFGSQEWDAGFAVQALLATNLVEEIAPTLAKGHDFIKKSQVRDNPSGDFKSMYRHISKGSWTFSDQDHGWQVSDCTAEGLKCCLLLSMLPPEIVGEKMEPERLYDSVNVLLSLQSKKGGLSAWEPAGAQEWLELLNPTEFFADIVVEHEYVECTGSAIQALVLFKKLYPGHRKKEIENFIANAVRFLEDTQTADGSWYGNWGVCFTYGSWFALGGLAAAGKTFANCAAIRKAVKFLLTTQREDGGWGESYLSSPKKIYVPLEGSRSNVVHTAWALMGLIHAGQAERDPAPLHRAAKLIINSQLEEGDWPQQEITGVFMKNCMLHYPMYRDIYPMWALAEYRRRVPLPSTPVCLT

SEQ ID NO: 4443 - DNA, 2262 bp, Neurospora crassa
  CDS (1)..(2262)
atggccaggaagcaggccactgaagccccggcggtctcaaacggatcacccaagaaacggtccagcgccgacagcgataatcacaatgtcaaacggcctcggctacaggagagcaccgataaggcgcgttggcgtttgagcagtgagggcggccgacacacatggcactatctcgaggacgacgaggctgcaaaagaatggccgcagtcatatgctgacaagtacttcctgggaatgcctctggtaaaacatccagccgagctccccgaacttcccaaggcgacgaaccccctcgatgcggtacgaaacggccttactttcttcgaaaagctccagctccccgagggccattggggttgcgagtacggcggtcccatgttcctcctccccggtgttgtcatcgctcgctacgtcaccaagaacccagtcccttggtactatgctaccgagatcaagaactacctgtttgcgcgagcgaaccccgtcgacggcggatgggggctacacattgaaggcgagagcaccatgttgggtacgacgctgaactatacgacgttgcgccttgtgggtgtggaggcagaccatccggtcatggtgaaagcgcgagcaacaatgcataagatgggaggtgctatttacgcgccacactgggccaaattttggctcacggtattgggcattatgaaatgggacatcgtaaaccctgtcccgcccgagctttggcttctccccgactgggtgccgattgcgccgtggagatggtggattcatatgcgccaggtcttcctgcctatgagttacctatggtccaagaagtggcaggcggaggagacggacttgattcgggagttgcgcaatgaattgttcgtggaggactggaacaagattgattgggctggaaaccgcaacaccattcatcccaacgacaactaccacccaaaaaccgccttcctcaacaccgtcaactggcttcttgtaaacatctggaatcccgtcttccgaaccaagtacttggtagagaaggcagaggcatgggcgtcggagctcatcgacatggaggacgaaaacacggattattctgacctagccccggtcaacgccgcgatgaataccgtttgctgttatgttcgggacggacctggggcctactctgtacgaaggcatgtggaaaggctggatgaggtactctgggtcaacgccgagggtatgctctgcaatggcacaaacggcgtgcaatgctgggacactgcctttgcaatccaggctatcatggacgccggcctgactgaagacccacgctggaggccgatgcttatcaagtcattggaattcctggaggaccagcagattcgagaaaacgtcaaggatcaggataagtgctatcgccatccccgcaagggtgcttgggcatttagcaacaaggaccaagggtatgcagtcagcgattgtgtctctgaagcgttgaagtccgtcatcatcctgcaaaagacgccaggcttccctactctgattgatgaccagcgtatttttgacgccgttgacacaatgcttacctaccaaaacccatctggcgcctgctcatcctacgagactccgcgcgccggccagtggatggaggttttgaatgccgcggaagtgttcggcaacatcatggtcgaatatgaatatcccgaatgcaccacggccgttctcactacactctcgcttttcaagaaacactggcccaatcatcgcacagccgagattgacaacttcatcacccgcgctgtcaagtggattaagagcaatcagaagcctcatggtggttggtatggcaattggggcatttgcttcacgtacgccactatgtttgctttggagagtttggccagcgttggtgaaacgtatgagaacagcagatatgccaagaagggatgtgatttcctcgtcgccaagcagagggaggacggtggttggtctgagagctacaaggcatgtgagacgggcgagtacgttgagcatccaactggatcccaagtggtcatgaccgcctgggcccttgttgggttgatcaaggccaaatatcccaataacgacccgatcaagaagggcatcaagttgatcatggaccgtcagcagcctaacggagagtggcggcaagaggctatcgagggtgtcttcaacaagagctgcatgatttcttacccgaactacaagttcagctttccgttgaaggcactgggcttgtttgccacacggtatccggacgagaaggtcgtttga

SEQ ID NO: 4444 - protein, 753 aa, Neurospora crassa
MARKQATEAPAVSNGSPKKRSSADSDNHNVKRPRLQESTDKARWRLSSEGGRHTWHYLEDDEAAKEWPQSYADKYFLGMPLVKHPAELPELPKATNPLDAVRNGLTFFEKLQLPEGHWGCEYGGPMFLLPGVVIARYVTKNPVPWYYATEIKNYLFARANPVDGGWGLHIEGESTMLGTTLNYTTLRLVGVEADHPVMVKARATMHKMGGAIYAPHWAKFWLTVLGIMKWDIVNPVPPELWLLPDWVPIAPWRWWIHMRQVFLPMSYLWSKKWQAEETDLIRELRNELFVEDWNKIDWAGNRNTIHPNDNYHPKTAFLNTVNWLLVNIWNPVFRTKYLVEKAEAWASELIDMEDENTDYSDLAPVNAAMNTVCCYVRDGPGAYSVRRHVERLDEVLWVNAEGMLCNGTNGVQCWDTAFAIQAIMDAGLTEDPRWRPMLIKSLEFLEDQQIRENVKDQDKCYRHPRKGAWAFSNKDQGYAVSDCVSEALKSVIILQKTPGFPTLIDDQRIFDAVDTMLTYQNPSGACSSYETPRAGQWMEVLNAAEVFGNIMVEYEYPECTTAVLTTLSLFKKHWPNHRTAEIDNFITRAVKWIKSNQKPHGGWYGNWGICFTYATMFALESLASVGETYENSRYAKKGCDFLVAKQREDGGWSESYKACETGEYVEHPTGSQVVMTAWALVGLIKAKYPNNDPIKKGIKLIMDRQQPNGEWRQEAIEGVFNKSCMISYPNYKFSFPLKALGLFATRYPDEKVV

SEQ ID NO: 4445 - DNA, 2433 bp, Luffa cylindrica
  CDS (3)..(2300)
aaatgtggcagctcaagattggggccgataccgtacctgccgatccttctaacgccggcggatggctctcatctctcaacaaccacgtgggtcgccaggtttggcattttcatcccgaactcggcaccccggaagatcttcagcagatacaacatgcgcgccagcgcttctctgaccacagattcgagaagaagcatagtgctgatctccttatgcggatgcagtttgcgaagaataactcatcctttgtgaatctaccgcaaatcaaagttaaagataaagaagacgtgacagaggaggcagtatcgcgcactctaagaagggctatcaatttttattcaacaatccagggagatgatggtcactggcctggagattatggcggtccaatgtttctaattcctggtttggtcattactctttccattactggtgccttgaatgccgtcttatctacagaacaccagcgtgagatttgcagatatctatacaatcatcagaataaagatgggggttggggtttacatattgaaggcccaagcacaatgttcggttctgtgctgaattatgtttctttgagattgcttggtgaagaagctgaagatgggcagggtgctgtggacaaagcacggaaatggatcttggaccatggtggtgcatctgcaattacttcttgggggaaaatgtggctttcagtacttggagtatatgaatgggctggaaataatccacttcctcccgaactatggctcttgccttatcttctcccttttcatccaggaaggatgtggtgtcactgccgaatggtatacttgcctatgtgttatctgtatggcaagagatttgttggtcctataacgcctataattcgatctttaaggaaggaactttatcttgtcccttatcatgaagttgattggaataaggctcgcaatgagtgtgcaaaggaagatctgtattacccacatccgctggttcaggatattgtgtgggcttcgcttcatcatgtctatgagcctctttttatgcgttggcctgcaaaaagactgagggaaaaggctttgcagtgtgtaatgcagcatatccactatgaagatgaaaatactcggtatatatgcatagggcctgtcaacaaggtattaaacatgctttgttgttgggtggaggatccacattcggaggcattcaaattgcatattccaagaatctttgactatctgtggattgctgaagatggcatgaaaatgcagggttataatggaagtcaattatgggatactgcatttgctgttcaagccatcatgtcaactaagcttgctgaagaatatgggacaactttaagaaaggcacacaagtatataaaagattcccaggtcttagaagattgtcctggtgatttacaaagttggtatcgtcatatttcaaaaggtgcatggccattttcaactgcagatcatggatggcccatctctgactgcactgctgaaggtttgaaggctgttcttttattatcaaaacttccttcagaaatagtagggaagtcaattgatgaagaacagatatacgatgctgtaaatgtcatcctctccttacagaatactgatggtggctttgccacttacgaactgaccagatcttacccgtggctggagctaatgaaccctgctgaaactttcggtgatattgtcattgactacacatatgtcgagtgtacctcagcagcaattcaagcacttgtagcgttcaagaaattatatccaggtcatagaagggatgaaattgataattgtgttgctaaagctgcggacttcattgaaagcatacaagcaactgatggatcttggtatggatcttggggggtctgcttcacctatggtggttggtttgggataaggggtctggtcgctgctggaaggagatacgataactgttctagccttcgtaaagcttgtgatttcctgttgtctaaagagcttgcttccggtggctggggagaaagttatctttccggccagaataaggtgtacacgaatattaaagatgataggccgcatattgtcaatactggttgggctatgttatccctcatcgatgctgggcagtctgagagagatccaacaccgttacaccgtgcagcaaggatattaatcaattctcagatggacgatggagattttcctcaagaggagatcatgggaatttttaacaagaactgcatgattagttatgccgcttatcgtaacatttttcctatatgggcccttggagaatatcgctgccgggtactgcaagccccttaaataatgtattactgccaatgtgtcggtcataaaactatttggatcttatttcagatgcttatgttttcttgagatctaaactaaatcagatgaacaaatatttctttattaccaggtcaagttgcaggagagc

SEQ ID NO: 4446 - protein, 765 aa, Luffa cylindrica
MWQLKIGADTVPADPSNAGGWLSSLNNHVGRQVWHFHPELGTPEDLQQIQHARQRFSDHRFEKKHSADLLMRMQFAKNNSSFVNLPQIKVKDKEDVTEEAVSRTLRRAINFYSTIQGDDGHWPGDYGGPMFLIPGLVITLSITGALNAVLSTEHQREICRYLYNHQNKDGGWGLHIEGPSTMFGSVLNYVSLRLLGEEAEDGQGAVDKARKWILDHGGASAITSWGKMWLSVLGVYEWAGNNPLPPELWLLPYLLPFHPGRMWCHCRMVYLPMCYLYGKRFVGPITPIIRSLRKELYLVPYHEVDWNKARNECAKEDLYYPHPLVQDIVWASLHHVYEPLFMRWPAKRLREKALQCVMQHIHYEDENTRYICIGPVNKVLNMLCCWVEDPHSEAFKLHIPRIFDYLWIAEDGMKMQGYNGSQLWDTAFAVQAIMSTKLAEEYGTTLRKAHKYIKDSQVLEDCPGDLQSWYRHISKGAWPFSTADHGWPISDCTAEGLKAVLLLSKLPSEIVGKSIDEEQIYDAVNVILSLQNTDGGFATYELTRSYPWLELMNPAETFGDIVIDYTYVECTSAAIQALVAFKKLYPGHRRDEIDNCVAKAADFIESIQATDGSWYGSWGVCFTYGGWFGIRGLVAAGRRYDNCSSLRKACDFLLSKELASGGWGESYLSGQNKVYTNIKDDRPHIVNTGWAMLSLIDAGQSERDPTPLHRAARILINSQMDDGDFPQEEIMGIFNKNCMISYAAYRNIFPIWALGEYRCRVLQAP

SEQ ID NO: 4447 - DNA, 2493 bp, Taraxacum officinale
  CDS (116)..(2392)
gacaactataaaagttggcgatccctcgttcatcaacagcccagcctctacggccacccccttgcaattgtgcacaggatttgaaatatctctgagtctgaaactcaaggaaataatgtggaaacttcagctgtcaaaaggtgacgatgatccagaagtcagaagcgtgaatcatcatatgggtaggcaatattgggaattcgatccacacgcaggaactccagaagagcaatctcaaatcgagagcatgcgtgaagaatttaccagaaacaggttgaatgtgacgcatagttctgatcttctgatgagattccagttaacaagcaagaatcgtggtggaattgaaaagtctcatgtaaaggaggaaggaggggacgatgaagtggtagtaaagacgttgaagaaagcgttgaagttctattcaagtcttcaaggtgaggatgggagttggcctggtgattatggtggtcctttgtttctccttccaggcctgatcattggattgcatgtcatggggatgaaggaccttgttttgtccatagaacagcaaaatgaaatccgtcgatatctttataatcatcagaatgtagatggaggttggggtttacacatagaagggaatagcaccatgctttctacagccttgaactatgtgagcctaagattgcttggagaagagctagatgatggtaaaggagccatgactaaagcacaatcttggattcttaaacatggtagtgtcacacacataccctcttgggggaaattgtggctctcagtacttggtgtgtatgaatggagaggcaacaatccattgccaccagaaacttggcttctcccatactttcttcctttacacccaggaagattgtggtgccatacaaggatggtatacctaccaatgtcctatttatatggtaaacgatttgtcgggccaattagttccattgttttgtcactaagaagagagttgtactcgacactttattaccaagttaattgggacttggctagaaagcaatgtgccaaggatgatttgtattatcctcatcccttaatacaagaccttctatgggatagtttgaacaagatcgttgaaccccttctgatgcaatggcccgtcgcaaaactcagaaaagaagcattgaaaacggtgatgcagcatatcattatgaggatgagaacacgaactatattttgcattggacctgttaataaggttctcaacatgttatgttgttgggtggaggatccaaaaacacctataaataaactgcacctctctaggataaaagactatctttgggtagctgaagatggcatgaagatgcagggatacaacggatcacaattatgggatgttgttttctctgttcaagcaatagtagcaaccaatcttgttgatgaatacagttccatgcttcataaagcacacgacttcattaaaaactcacaagtaaagaaaaatagttcaggtaatagtcagtcatggtaccgccacatatcacggggtggatggccattttctactcccgataatggttggcctgtatcggattgtactgctgaagctttaaagacagtattgatgctatcacaaatgccacatgacatagttggagaagcaatagcaccagaatgtttatatgatgccgtcaatgttattttatctttacagaattctgatggtagttttgcaacatatgaactcacaagatcctacagctggttagagttagtgaatcctgctgaaactttcggcgacattgttatcgactacccgtatgtagagtgcacatcggctgtggtgcagagcctaagatcatttacaaaactgtatccaagtcaccgtaggattcaaatagaaacgtgcattgaaaaagccatagcatttattgagagatcacaactaggagatggctcatggtatggatcatgggcaatatgctacacttatggaacatggtttggtataaaaggattggttgcaggtggtaagacatatgaaactagccatagcattagaaaggcttgtgctttcttactctcgaagcagcttcattctgggggttggggagaaagctacacttcttgccaacaaaagacgtatacaaatcttgtaggaaacaaatcccacataacaaacacttcatgggctttgctagctctcatagaagccggacaacccagaagagatcgaatcccactccatcgtgctgcaaaggtactcattgatcaccaactgggaaatggagattttccacaacaggaaattataggggtgtttaacaagaactgtatgataagttactcgtcgtataggaacatatttcctatttgggctcttggagaatacctcaatcatgtaatcacgaagaaatctcttggttgatatgcatgtatttaaaaccttttcatatgatgtcttcatgtacgtttgtatttatctttttacacatctatatataatcaaatataaaaaaaaaaaaaaaa

SEQ ID NO: 4448 - protein, 758 aa, Taraxacum officinale
MWKLQLSKGDDDPEVRSVNHHMGRQYWEFDPHAGTPEEQSQIESMREEFTRNRLNVTHSSDLLMRFQLTSKNRGGIEKSHVKEEGGDDEVVVKTLKKALKFYSSLQGEDGSWPGDYGGPLFLLPGLIIGLHVMGMKDLVLSIEQQNEIRRYLYNHQNVDGGWGLHIEGNSTMLSTALNYVSLRLLGEELDDGKGAMTKAQSWILKHGSVTHIPSWGKLWLSVLGVYEWRGNNPLPPETWLLPYFLPLHPGRLWCHTRMVYLPMSYLYGKRFVGPISSIVLSLRRELYSTLYYQVNWDLARKQCAKDDLYYPHPLIQDLLWDSLNKIVEPLLMQWPVAKLRKEALKTVMQHIIMRMRTRTIFCIGPVNKVLNMLCCWVEDPKTPINKLHLSRIKDYLWVAEDGMKMQGYNGSQLWDVVFSVQAIVATNLVDEYSSMLHKAHDFIKNSQVKKNSSGNSQSWYRHISRGGWPFSTPDNGWPVSDCTAEALKTVLMLSQMPHDIVGEAIAPECLYDAVNVILSLQNSDGSFATYELTRSYSWLELVNPAETFGDIVIDYPYVECTSAVVQSLRSFTKLYPSHRRIQIETCIEKAIAFIERSQLGDGSWYGSWAICYTYGTWFGIKGLVAGGKTYETSHSIRKACAFLLSKQLHSGGWGESYTSCQQKTYTNLVGNKSHITNTSWALLALIEAGQPRRDRIPLHRAAKVLIDHQLGNGDFPQQEIIGVFNKNCMISYSSYRNIFPIWALGEYLNHVITKKSLG

SEQ ID NO: 4449 - DNA, 2452 bp, Taraxacum officinale
  CDS (30)..(2306)
actttgagattttagttacaaaagatagtatgtggaagctgaaaatagcagaaggtggtgatgatgagtggctgaccaccaccaacaaccacgtcggccgtcagcactggcagtttgatccggatgctggaaccgaagaggaacgtgctgagattgaaaagattcgtctcaacttcaaacttaatcgttttcaattcaaacaaagtgccgacttgttaatgcgtactcaactaagaaaagagaacccaatcaataaaataccggatgcaataaaattgaatgaaacagaagaagtgacaaatgacgcagtgacaactacactcaaaagagccattagcttttactccaccattcaagcccatgatgggcactggccagctgagtctgctggccctttgttcttccttcctccattggtaatagcactatatgtgactggagcaatgaatgatattctaacacccgcacatcagctagaaataaaacgttacatatacaatcatcagaatgaagatggaggttggggattacatatagagggtcatagcacaatatttggatcagtacttagttacataactttaagattacttggggaagaagctgatagtgttgcagaggacatggctttggttaaggggcgtaaatggatccttgaccatggtggtgcagttgggattccttcatggggaaagttttggcttacgatacttggagtatacgaatggggaggctgtaatcctatgccacccgaattttggctcatgcctaagtttttcccaattcatccaggcaaaatgttgtgttattgtcgcttagtttacatgcccatgtcgtacttatacggcaaaagatttgtgggaaaaataaccgagttggttcgagacctaaggcaagagctttatacggacccttatgatgagattaattggaataaagcacgaaacacgtgtgcaaaggaagatctctactatccacacccttttgttcaagatatggtatggggtgtacttcataatgttgttgaacctgtattaacaagtcgtccgatttccacactaagagaaaaggctttgaaagtcgcaatggatcatgttcactatgaagataagagcagtagatatctttgcattggatgtgtggaaaaggtgttatgcttgattgcaacgtgggtggaagatccaaatggtgatgcatataaacgtcatcttgctagaattcctgactacttttgggttgctgaggatgggatgaaaatgcagagttttggatgtcaaatgtgggatgcagcatttgctattcaagctattttttcaagtaatctaacagaagaatacggcccgactcttaaaaaagcacacgagtttgtaaaagcatcacaggttcgtgataatcctcctggagatttcagtaaaatgtaccgacatacttctaagggtgcatggacattttccatacaagaccacggttggcaagtctctgattgtaccgcagaaggcttgaaggtttcacttttgtactcccaaatgaacccaaaactagtgggcgaaaaagttgaaacggagcatctctacgacgctgtcaatgtcattctttcattacaaagtgaaaatggtggctttcctgcttgggaaccacaaagggcgtacgcttggctggagaaattcaaccccactgaattctttgaagatgtgttgattgagcgagagtatgttgaatgcacttcatctgcaatccaaggtttgacactcttcaagaagttgcacccagggcacagaaccaaggagatcgagcattgtatatcaagagctgtaaagtacgttgaagacacacaagaaagtgatggttcatggtatggttgttggggaatttgctacacctatggtacatggtttgcggtagatgcgctagtagcttgtgggaagaactatcataactgtcccgctcttcaaaaagcttgcaaatttctgttatccaaacaacttccggatggtggatggggagagagttatctttcgagctcaaataaggtgtatacgaatttggagggaaatcgttcgaatttagtgcatacatcatgggctttaatatcccttattaaagctggacaggctgaaattgatcctacaccaatatctaatggcgtacggcttctcatcaattcacaaatggaagaaggggactttcctcaacaggaaatcacaggagtgttcatgaagaactgtaacctcaattactcatcatttcgaaatatttttcccatatgggcacttggtgaatatcgtcgtattgttcaaaatatatgaactcttcttatgtaaaataaggacagaggctataacacatatttatacaatgggacgattagggttattttaaatgtatcaaagatttgttattacttgttatatatacaaccggagtctttaaattaaaaaaaaaaaaaaaaaaa

SEQ ID NO: 4450 - protein, 758 aa, Taraxacum officinale
MWKLKIAEGGDDEWLTTTNNHVGRQHWQFDPDAGTEEERAEIEKIRLNFKLNRFQFKQSADLLMRTQLRKENPINKIPDAIKLNETEEVTNDAVTTTLKRAISFYSTIQAHDGHWPAESAGPLFFLPPLVIALYVTGAMNDILTPAHQLEIKRYIYNHQNEDGGWGLHIEGHSTIFGSVLSYITLRLLGEEADSVAEDMALVKGRKWILDHGGAVGIPSWGKFWLTILGVYEWGGCNPMPPEFWLMPKFFPIHPGKMLCYCRLVYMPMSYLYGKRFVGKITELVRDLRQELYTDPYDEINWNKARNTCAKEDLYYPHPFVQDMVWGVLHNVVEPVLTSRPISTLREKALKVAMDHVHYEDKSSRYLCIGCVEKVLCLIATWVEDPNGDAYKRHLARIPDYFWVAEDGMKMQSFGCQMWDAAFAIQAIFSSNLTEEYGPTLKKAHEFVKASQVRDNPPGDFSKMYRHTSKGAWTFSIQDHGWQVSDCTAEGLKVSLLYSQMNPKLVGEKVETEHLYDAVNVILSLQSENGGFPAWEPQRAYAWLEKFNPTEFFEDVLIEREYVECTSSAIQGLTLFKKLHPGHRTKEIEHCISRAVKYVEDTQESDGSWYGCWGICYTYGTWFAVDALVACGKNYHNCPALQKACKFLLSKQLPDGGWGESYLSSSNKVYTNLEGNRSNLVHTSWALISLIKAGQAEIDPTPISNGVRLLINSQMEEGDFPQQEITGVFMKNCNLNYSSFRNIFPIWALGEYRRIVQNI

SEQ ID NO: 4451 - DNA, 2546 bp, Olea europaea
  CDS (89)..(2365)
  misc_feature (745)..(745): n is a, g, c or t
catcgagttcctttctgtgtcaagaatcataccgctcctactatcattttgtaattcccgaaaactaaaaggcatatctcaccagaaaatgtggaagttgaagattgctgatggaacagggccgtggcttacaacaaccaataatcatattggaagacagcattgggaattcgatcctgaggctggaactccagatgaacgagtcgaggttgaaagactgcgtgaagagttcaagaagaacagatttcgaactaaacaaagtgctgatttgctgatgcgtatgcagcttgtgaaggagaaccaacgtgttcaaatcccaccagcgatcaaaatcaaagaaacagaaggtataacagaggaagcagtgataactactctaagaagagccataagtttctattccacaattcaagctcacgatggccactggccagctgaatccgccggccctttgtttttcctccctcctttggtcttagccttgtatgtgactggagcaatcaatgttgttctatcgcgagaacatcagaaagagattacacgatacatatacaatcatcagaatgaagatggaggttgggggatacatatagagggtcatagcaccatgtttggttctgtgcttagctacattacgcttaggttgctaggagaaggacaagaagatggtgaagacaaggccgtagctagaggtcgaaaatggatacttgaccatggtggcgccgtggggataccatcgtggggnaagttttggcttacggtgctcggagtatacgagtgggatggctgcaacccaatgcccccagaattctggctgcttcccaatttttccccaattcatccaggaaagatgttgtgttattgtcggttggtatacatgcccatgtcatatttgtatggcaagaggtttgttggaccaattactggattggtgctatcactaaggcaagagatttatactgaaccttatcatggaataaattggaatagggcaaggaacacctgtgcaaaggaggatctttactacccacaccctctggcacaagatatgctttggggattcctccatcattttgccgagccagttctaactcgatggccgttttctaaactaagagagaaggctttaaaagttgcaatggagcatgttcattatgaggacatgaacagcagatacctttgcattggatgtgtagagaaggtgttatgtcttattgcttgttgggtagaagatcctaattctgaagcatacaaaagacatatagcacgtatacctgattacttctgggtcgccgaagatggcctgaaaatgcagagttttgggtgtcaaatgtgggatgcagcttttgctattcaagccatattatcatccaatctagctgaagagtacgggccgaccctcatgaaagcacacaactttgtgaaagcctcacaggtccaagaaaatccatctggagattttaatgaaatgtatcgtcacacttctaaaggcgcctggacattttctatgcaagatcatggttggcaagtctcagattgtacagctgaaggacttaaggccgcactcttattctcgcaaatgcctatagaactagttggagcagaaatcgaaacaggacatttatatgatgctgtaaatgtcattttgacccttcagagtgctagtggcggttttccagcatgggagcctcagaaagcatatcgatggttggagaagctcaaccctacagagttttttgaagatgttcttatagagcgagattatgtagagtgcacatcatcagcagtccaagccttaaagctctttaagcagttgcatccaggacacagaagaaaggaaatagcaagctgcatctcaaaagcaatacaatacatcgaagctactcaaaatcctgatggttcatgggatggtagttggggaatatgctttacgtatggcacgtggtttgcagtagagggcttggtcgcttgtgggaaaaattatcataactctcccacactacggagagcatgtgaatttttgttgtcgaaacaattaccggatggtggatggagtgaaagctacctttcgagctcgaacaaggtatatactaatcttgaaggtaatcggtcaaatttggtgcaaacctcatgggctctgttgtctctcatcaaagctgggcaggtcgagattgatcctgggcctatacatcgtggaataaaactgctagtaaattcacaaatggaagatggtgactttcctcaagaggaaattacaggagcattcatgaagaattgtactctgaactattcatcgtaccggaatatctttccaatatgggctctcggtgagtatcgtcgtcggattcttcatgcacaaacatagttaaatcgatgtgaaagaggaaaattataaatgcgaagtgaaagtaaaatataaatgtatgttaaaatttgctctctctctctctctctctctctacacattatgatgttagtacaactacttttttcccgtaaagtgccatgttataagatatttatgtttgaaataaaaaaaaaaaaaa

SEQ ID NO: 4452 - protein, 758 aa, Olea europaea
MWKLKIADGTGPWLTTTNNHIGRQHWEFDPEAGTPDERVEVERLREEFKKNRFRTKQSADLLMRMQLVKENQRVQIPPAIKIKETEGITEEAVITTLRRAISFYSTIQAHDGHWPAESAGPLFFLPPLVLALYVTGAINVVLSREHQKEITRYIYNHQNEDGGWGIHIEGHSTMFGSVLSYITLRLLGEGQEDGEDKAVARGRKWILDHGGAVGIPSWGKFWLTVLGVYEWDGCNPMPPEFWLLPNFSPIHPGKMLCYCRLVYMPMSYLYGKRFVGPITGLVLSLRQEIYTEPYHGINWNRARNTCAKEDLYYPHPLAQDMLWGFLHHFAEPVLTRWPFSKLREKALKVAMEHVHYEDMNSRYLCIGCVEKVLCLIACWVEDPNSEAYKRHIARIPDYFWVAEDGLKMQSFGCQMWDAAFAIQAILSSNLAEEYGPTLMKAHNFVKASQVQENPSGDFNEMYRHTSKGAWTFSMQDHGWQVSDCTAEGLKAALLFSQMPIELVGAEIETGHLYDAVNVILTLQSASGGFPAWEPQKAYRWLEKLNPTEFFEDVLIERDYVECTSSAVQALKLFKQLHPGHRRKEIASCISKAIQYIEATQNPDGSWDGSWGICFTYGTWFAVEGLVACGKNYHNSPTLRRACEFLLSKQLPDGGWSESYLSSSNKVYTNLEGNRSNLVQTSWALLSLIKAGQVEIDPGPIHRGIKLLVNSQMEDGDFPQEEITGAFMKNCTLNYSSYRNIFPIWALGEYRRRILHAQT

SEQ ID NO: 4453 - DNA, 2347 bp, Luffa cylindrica
  CDS (7)..(2289)
agagagatgtggaagttgaaggtctcgaaaggatgggagacgagcgagaacgatcatgtaggaagacaatattgggaattcgacccgaatctcgaaccttctgaagaagaaagggctgaaatagaaaatgtttgcaatgagttccacaaaaatcgttttcatgtcaaacagagctctgatcttcttatgagacttcagttgagaaaggagaatgcaagcaacgtgaagcttcttactcaaataaaagttgcaagcgaagaggaaataagtgaggaagcagttgaaaccacattgagaagggcaatcagattctactcaaccatgcaaacacaagatggcttttggcctggtgattatggtggccctttgtttctccttcctggcctggtgattgggttaagtgtaacaaatgccctcaatgtagctctctcgtgcaaccatcgacaacagatgtgtcgttacctttacaatcatcagaatgaagatggagggtggggattgcatatagaagggaacagcacaatgctctgtacggctctatcgtacgtgagcctaagattaatgggagaggaaatggacggtcacgatggagccttgcccaaagcaagaagatggattcttgatcgaggtggggcaacctcaatcccctcttggggaaaaatatggctctccgtccttggtgtctatgagtgggaaggaaacaatccacttctacccgagatatggctcttgccttacaatattcttccatttcatccaggaagaatgtggtgtcatagtcgaatggtatatctaccaatgtcatatttgtatggaaaaagatttgtaggatcaattagccccatcgtaatgagcctccggcgagagctttacaaatgtccttatcatatggttgattggaattcttctcgaaacctatgtgctaaggaggacttatacactccacattccaagatacaagacatgttatgggactcaattaacaagtttggggaaccatttatgaagaaatggcctctctcaaagcttaggcaaagggctcttgaccttgtgattcaacacatccactatgaggatgaaaacactcactacctttgccttggacctgttaacaaggtgctaaacatggtgtgttgttgggttgaggatcaaaactcagaagcatttagaagacacatctcaagaatcaaagattatctttggctagctgaggatggaatgaaaatgcagggatacaatgggtctcaattatgggatgtagcttttgcagtgcaagccgtagttgcagctgatttggttgaagaatatggttcagtccttaagaaagctcatgattttgtcaagaactcacaagtgaggagaaatgggcttggagattcaagtgattggtaccgccacatctcaaagggtggatggcccttctcaactccagacaatggatggcctgtctctgactgtacttctgaagctttgaaggtagcaattttgctatcaaaaatgccatcaacaatggtgggtgagccaatagatgtagataagttatatgatgctgttaatctcattctgtcacttcagaatcccaatggaggatttgcatcatatgaactcacaagatcctatccatggttggagatgttcaatccagctgaaatatttggagatgtcatgattgattatcaatatgtggagtgcacttcagcagcaattcaaggacttaaagcattcatgcagttacatccaggccatcgcaagaaagagatacaaaaatgtattgctaaagcagcaaatttcattgaaagcattcaacagactgatggatcatggtatggatcatggggaatttgctacacatatgggacatggtttgggataaagggattggttgcctgtggaaggacctatgataatagcaaaagcataagaaaggcaacagaatttcttctttcaaaacaactcaaatctggtggttggggagagagctacctctcagcccatcataaggtatacaccaatctcaaagggtgcaaatcacatatagtcaatacttcttgggccttgttggctctcattaaagcgggtcaggcgcaaagagacctaactcctttacatcgagcagcaatggtgctgattaattcccaactccacgatggagatttcccacaacaggaaatcatgggagttttcaacaagagttgtatgatcagttactcagcctacagaaacatatttccaatatgggcccttggagagtatcgcattagggttttgcaactccatgaaaaattctagctatatttcaacattacatggacatggaagtgtattatattatatgtataaagaaatt

SEQ ID NO: 4454 - protein, 760 aa, Luffa cylindrica
MWKLKVSKGWETSENDHVGRQYWEFDPNLEPSEEERAEIENVCNEFHKNRFHVKQSSDLLMRLQLRKENASNVKLLTQIKVASEEEISEEAVETTLRRAIRFYSTMQTQDGFWPGDYGGPLFLLPGLVIGLSVTNALNVALSCNHRQQMCRYLYNHQNEDGGWGLHIEGNSTMLCTALSYVSLRLMGEEMDGHDGALPKARRWILDRGGATSIPSWGKIWLSVLGVYEWEGNNPLLPEIWLLPYNILPFHPGRMWCHSRMVYLPMSYLYGKRFVGSISPIVMSLRRELYKCPYHMVDWNSSRNLCAKEDLYTPHSKIQDMLWDSINKFGEPFMKKWPLSKLRQRALDLVIQHIHYEDENTHYLCLGPVNKVLNMVCCWVEDQNSEAFRRHISRIKDYLWLAEDGMKMQGYNGSQLWDVAFAVQAVVAADLVEEYGSVLKKAHDFVKNSQVRRNGLGDSSDWYRHISKGGWPFSTPDNGWPVSDCTSEALKVAILLSKMPSTMVGEPIDVDKLYDAVNLILSLQNPNGGFASYELTRSYPWLEMFNPAEIFGDVMIDYQYVECTSAAIQGLKAFMQLHPGHRKKEIQKCIAKAANFIESIQQTDGSWYGSWGICYTYGTWFGIKGLVACGRTYDNSKSIRKATEFLLSKQLKSGGWGESYLSAHHKVYTNLKGCKSHIVNTSWALLALIKAGQAQRDLTPLHRAAMVLINSQLHDGDFPQQEIMGVFNKSCMISYSAYRNIFPIWALGEYRIRVLQLHEKF

SEQ ID NO: 4455 - DNA, 2579 bp, Allium macrostemon
  CDS (81)..(2369)
cctaatattcattaaccacgtctgttagttcaatatccaagctacttacagggcaatcgactctttccacggattgaataatgtggaagctgctgaagatggcggatggtggcaaccagtggttaagaacaactaataatcatgctggaagacagatctgggagtttgatcccaatctaggcacgcccgaagaaatcgaagcagtcgaaaatgcacgtgaaatttataggaaaaatcgttttaagatgaagcatagttctgatcttctaatgagattgcagtttgcaaaggaaaatcctgcagaaattggtcttccacaagtcaagctcgcagagaatgaaaatattacagaagaagcagcagccataactttaagaagagctatgaaccggtattcaactcttcaagcccatgacgggcaatggcctggtgactatggtggtccaatgtttcttatgcccggactgataatagcactatcagttactggggcattaaatactgtattatctgtagaacatcagcatgagattcgccgttatctgtacaatcaccagaatgaagatggaggatggggtttgcacattgaaggacacagtacgatgtttggttcagttcttgcatatgttactctgagattgcttggtgaaggagctgatggtggagatgatcaagcaatgcagaaaggacgaaagtggattttggatcatggcagtgcaacagcaataacatcatggggaaaattttggctctcggtgcttggtgtttttgactggtctggcaacaatcccctacctccagagatgtatttacttccatatgttcttccagtgcatccaggtcgaatgtggtgccattgtcggatgatttatcttcctatgtcgtatatatatggaaaaagattcgtgggccctgtaacacaaactattatatcattaagaaaggaattgtttaatgttccatatgatcaggtagattggaatgcagcacgtaaccagtgtgccaaggaagatttgtactatcctcatcctttaatacaagatattctttggacaactctacacaaatgtgtggaacctattttgatgcgctggcccggtggcaagttgagggggaaagctctaaaaactgttatggagcatgttcattatgaagatgaaaatactcgatatatttgtcttggccatttctctaaggttctaaatatgctttgctgttgggtggaagatcaaaattcagaggctttcaaattgcacctacctaggctcaatgattatctctggattgccgaagatggaatgaaaatacagggttacaatggaagccagttgtgggacactgcttatgctgttcaagcaataattgcgactgggttttccaatgaatttgggaccacactcaaaaaggcgtataaatatgtcaaggactcccaggttctagaagactgccctggcgatcttagttactggcatcgccatatatctaagggttcatggcctttctccacggctgatcaaggatggctcgtctctgattgtacagctgaaggattgaaggcagcactcctgttgtcaaaaatttctccagaaatcgttggtgacccaatagttgcaaatcgtctttatgatgctgtaaatgtgattctttctctaaagaatcctggcggtggatttgcatcaattgaattgacaaggtcatatgcatggttggagatcatcaatcctgcagaatcatttggagacattgttatagattatccaactgctgaatctacatcagcatgtattcaggcattggcttcatttagaatgttataccctggacatcgcagagatgaaatagaaaaatgcattacgaaaggcgttcagtttattgaaaagacacaagagcatgatggttcatggtatggttcttgggcagtctgctacacaaatggaacatggtatggagtaaagggattgatttccggggggaaatgttatgaaaacagccatagcatcaggaaagcatgtgattttctgctgtcaaaacagttgaaatcaggtggatggggcgagagttacctttcatgtcaagagaaggtctacaccaatctcgagggcaatagagctcatgcagtgaacactagttgggctatgttggctcttattgatgcagggcaggcacaaagagatgctgagcctttgcatcgagctgcaaaagtattgataaatatgcagatggaaaatggagagttcccacagcaagaaataatgggagttttcaatagaaattgcatgataagctattcagcatatcggaatatctttccaatatgggctctaggagagtatcgcacaagggtattgtcttcctctgcaggtcattgactaccttgactgatgaaaacttatgagtgagtacccaagaaccgtacatggttattgctgtatcatttggtctgtagttccaataaaagctggtttaaatgcacagtgttggggttctgtatatcttaacctgagcattttccctcaagtcagttctgtatctttaatttattcttctttttttaataataatttagtaccatcttaaaa

SEQ ID NO: 4456 - protein, 762 aa, Allium macrostemon
MWKLLKMADGGNQWLRTTNNHAGRQIWEFDPNLGTPEEIEAVENAREIYRKNRFKMKHSSDLLMRLQFAKENPAEIGLPQVKLAENENITEEAAAITLRRAMNRYSTLQAHDGQWPGDYGGPMFLMPGLIIALSVTGALNTVLSVEHQHEIRRYLYNHQNEDGGWGLHIEGHSTMFGSVLAYVTLRLLGEGADGGDDQAMQKGRKWILDHGSATAITSWGKFWLSVLGVFDWSGNNPLPPEMYLLPYVLPVHPGRMWCHCRMIYLPMSYIYGKRFVGPVTQTIISLRKELFNVPYDQVDWNAARNQCAKEDLYYPHPLIQDILWTTLHKCVEPILMRWPGGKLRGKALKTVMEHVHYEDENTRYICLGHFSKVLNMLCCWVEDQNSEAFKLHLPRLNDYLWIAEDGMKIQGYNGSQLWDTAYAVQAIIATGFSNEFGTTLKKAYKYVKDSQVLEDCPGDLSYWHRHISKGSWPFSTADQGWLVSDCTAEGLKAALLLSKISPEIVGDPIVANRLYDAVNVILSLKNPGGGFASIELTRSYAWLEIINPAESFGDIVIDYPTAESTSACIQALASFRMLYPGHRRDEIEKCITKGVQFIEKTQEHDGSWYGSWAVCYTNGTWYGVKGLISGGKCYENSHSIRKACDFLLSKQLKSGGWGESYLSCQEKVYTNLEGNRAHAVNTSWAMLALIDAGQAQRDAEPLHRAAKVLINMQMENGEFPQQEIMGVFNRNCMISYSAYRNIFPIWALGEYRTRVLSSSAGH

SEQ ID NO: 4457 - DNA, 2889 bp, Glycyrrhiza glabra
  CDS (131)..(2404)
atcttctagtactactcctccaaagcaataaccatccttcattcccatttctccactctttctctttgattggtcagtcaggcctcttccaaatcgcagtagtatatcacacagactcacacagaggaaaatgtggaagctcaagattgcggagggagggagtccatggcttcggacagtgaacaatcacgttggaagacaggtgtgggagttcgatcctaagcttggatcgccagaagatctcctcgagattgaaaaggctcgccagaatttccacgacaaccgcttcactcacaaacacagcgctgatctactcatgcgcattcactttgcaaaagagaacccaatgaacgaagtcctacccaaagtcagagtcaaagatattgaagatgtaactgaagagaccgtgaaaactacattaagaagggccataaatttccattcaactctccagagtcatgatggacactggccaggagattatggaggtcccatgtttcttatgcctggcttggtaattactctgtctatcaccggggctctgaatgcagtcttaacagaagagcatagaaaggaaatatgccgttacctctataaccatcagaacaaggatggtgggtggggtttacatattgaaggtccaagcaccatgtttggctctgtcttgaattatgttgctctgagattgcttggcgagggacctaatgatagacaaggggaaatggagaagggacgtgactggattcttgggcatggcggtgctacttttataacatcgtggggaaagatgtggctttcagtacttggagtgtatgaatggtctggaaataatcccctgcctcctgagatatggctccttccatacgttcttccaattcatccaggaaggatgtggtgtcactgccggatggtctatttgccaatgtcctacttatatggaaagaggtttgttggcccaatcacaccaacaatattatctttgagaaaggagctttataccataccatatcatgatatagactggaatcaggctcgcaatttgtgtgcaaaggaagacttatactatcctcacccacttgtgcaagatattctgtgggcatctctacacaagttcttggagcctattttgatgcattggcctggcaaaaagttgagagaaatggctattaagactgcaatcgagcatatacattatgaagatgataatactcgttatctttgcataggtcctgtaaataaggtgttaaatatgctttgctgttgggtggaggatccaaattcagaggccttcaagttgcatcttccaaggatctatgattatctatggattgctgaagatggcatgaaaatgcagggctacaatggaagtcaactatgggatactgcatttactgctcaagcaattatttcatctaacctcatcgaagaatatggtccaactctaagaaaagcccatacatacattaagaattcgcaggttttagaagattgtccaggtgatcttagtaaatggtatcgtcacatttcaaaaggtgcttggcctttttcgactgcagatcatggatggccaatttctgactgcacagctgaaggactgaaagctgttctattgctatctaaaattgcaccagagattgttggtgagccattggatgcaaagcgattatatgatgctgtaaatgtcattctctcattacagaatgaagatggtggctttgcaacatatgagctcacaagatcttatacctggttggagttaatcaatccggctgagacttttggtgacatcgttattgattacccttatgtggaatgtacctcagcggcaattcaagctttgacatcatttaagaaactatatcctgggcatcgtcgagaagaaatacaatgctgtattgaaaaagctgcttcctttattgaaaaaacacaagcttcagatggttcatggtatggttcttggggagtttgcttcacttatggcacttggtttggggtaaaagggctgattgctgctggaaagagtttcaataattgctcaagcatccgtaaagcttgtgaatttctgctgtctaagcagctcccatctggtggctggggagagagctatctgtcatgccaaaacaaggtgtattcaaatgtggaaagcaaccggtctcatgtagtaaatactgggtgggctatgctggctctcattgatgctgaacaggctaagagagatccaacgccactgcaccgtgcagctgtatacttgataaattcccaaatggagaatggtgactttccgcaacaggaaataatgggagtcttcaacaagaattgcatgatcacatacgcagcatacagaaatgtattccccatatgggcgttgggagaataccgtcatcgcgtattgcagtcgcagtaatcccgctttagttaggatgccataattacttcggctatttatctttttccatggttctcatctttaaaaagtttatggttaatgagtttggtagtccgctaaacagaaagcaaactcgtgtggagaatgtctatttgctttttctaatgctgattagcgcctctcttgctttccctgcggctgcggcggaggaactagatttatagaggaaaaaatgtttgtgtcgcccttccttttagcacaaggagcacagctatgtgtgttttaattatgtaaatttcaaaaacttacccatcatctctctacccccaattatctccttcattctatatcccttttgcagttttgcgcctacctctgccttcactcttattgagtatccttttggctatcacacttgcattactattactaaatactaggagtaaatgttttgtgtcccttggcctttctttttatagtgcaagtgaaaatttttgctttca

SEQ ID NO: 4458 - protein, 757 aa, Glycyrrhiza glabra
MWKLKIAEGGSPWLRTVNNHVGRQVWEFDPKLGSPEDLLEIEKARQNFHDNRFTHKHSADLLMRIHFAKENPMNEVLPKVRVKDIEDVTEETVKTTLRRAINFHSTLQSHDGHWPGDYGGPMFLMPGLVITLSITGALNAVLTEEHRKEICRYLYNHQNKDGGWGLHIEGPSTMFGSVLNYVALRLLGEGPNDRQGEMEKGRDWILGHGGATFITSWGKMWLSVLGVYEWSGNNPLPPEIWLLPYVLPIHPGRMWCHCRMVYLPMSYLYGKRFVGPITPTILSLRKELYTIPYHDIDWNQARNLCAKEDLYYPHPLVQDILWASLHKFLEPILMHWPGKKLREMAIKTAIEHIHYEDDNTRYLCIGPVNKVLNMLCCWVEDPNSEAFKLHLPRIYDYLWIAEDGMKMQGYNGSQLWDTAFTAQAIISSNLIEEYGPTLRKAHTYIKNSQVLEDCPGDLSKWYRHISKGAWPFSTADHGWPISDCTAEGLKAVLLLSKIAPEIVGEPLDAKRLYDAVNVILSLQNEDGGFATYELTRSYTWLELINPAETFGDIVIDYPYVECTSAAIQALTSFKKLYPGHRREEIQCCIEKAASFIEKTQASDGSWYGSWGVCFTYGTWFGVKGLIAAGKSFNNCSSIRKACEFLLSKQLPSGGWGESYLSCQNKVYSNVESNRSHVVNTGWAMLALIDAEQAKRDPTPLHRAAVYLINSQMENGDFPQQEIMGVFNKNCMITYAAYRNVFPIWALGEYRHRVLQSQ

SEQ ID NO: 4459 - DNA, 2160 bp, Pneumocystis carinii
  CDS (1)..(2160)
atgatttatgggtataccgaaaaagaactagaaaaaacggacccggatgggtggagattgatcgtagaagatacaggacgacaacgctggaagtacctaaaaacagaggaagagaggcgagaaaggcctcaaacatatatggaaaagtattttctggggaaaaatatggatctaccggaacaaccagcagcaaaaacgccgatagaatcggcgagaaaagggttttcgttttataaacatctacaaacgagtgatggtaattgggcatgtgaatatgggggggtaatgtttcttcttccgggacttataattgcaatgtatatttcaaaaatcgaatttccagatgaaatgagaattgaagtaattcgttatttagtgaaccatgctaatcctgaagatggtggttgggggatacacatagagggaaaatctacagtttttgggacagcacttaattatgttgttttacgtatcctaggtcttggaccagaccatccagttactatgaaagcaagaataaggttgaatgagcttgggggtgctattggatgtcctcaatggggaaagttttggctagcagttttaaattgttatggttgggaaggtataaatcctattttacccgagttttggatgttacctgaatggcttcctatacatccatcacgttggtgggtccatacaagagctgtatatcttccaatgggatatatttatggagagaaatttacagcgcctgttgatcctttgatagaatctttgagagaagaattatatactcagccttattcttcaattaatttctcaaaacatagaaacacaacatcaccagtagatgtttatgtacctcatactagatttcttcgtgttattaattctattttaacattttatcatacaatttttcggttttcatggataaaagatatggcatcaaaatatgcttacaaattgattgaatatgaaaataagaatactgatttcttatgtattggtccagttaattttagtattcatattttagcagtttattggaaagaaggtcctgatagttatgcatttaaatctcataaagaaaggatggccgactttttatggatatctaaaaaaggaatgatgatgaatggcactaatggtgttcagctttgggatacttcttttgctgtacaagctcttgtagaatctggattagcagaagatcctgagtttaaagatcatatgattaaggcattggactttcttgataagtgtcaaatacaaaaaaattgtgatgatcagcaaaaatgttatagacatcgaagaaagggtgcatggccatttagtacacgacaacagggatatactgtttcagattgtactgcagaggctttaaaagctgttttacttttacaaaatttaaaatcatttccaaagagagtgtcatatgacagattaaaagattccgttgatgtaatcttatctttacagaataaagatggcggttttgcttcttatgaattgatacgaggaccatcatggttagaatttattaatccagctgaagtttttggagatatcatgatagaacattcttatccagagtgtacaaccgctgctgtcactgctttatgttattttagatcattgtgttctcattaccgtggaccagaaattaataaaagtgttaaaaatgccatccaatttattaaagaaagtcaacgtcctgatgggagttggtatgaaagttgggcaatctgctttacttatgctactatgtttgctttagaaagtctatcatgtgttaaagatttttatgaaaatagtttccattctagaagagcatgtgactttttagttaataaacaagaagaagatggaggatggtccgaaggctatcaatcatgtacagatggcatatggactagacatccaactggtagtcaagtagtacaaactgcatgggcatgcattggacttatgtatgcaaattatcctgatgaaacacctatcaaacgtggaattaatttaatcatgtcgagacaacagcctaatggtgaatggaaacaagaagcaattgaaggtgtttttaataaaaattgtatgattagttatccaaactataaattcaatttcactatcaaagctcttggaatgtattcgaaaagatatggtaatatttag

SEQ ID NO: 4460 - protein, 719 aa, Pneumocystis carinii
MIYGYTEKELEKTDPDGWRLIVEDTGRQRWKYLKTEEERRERPQTYMEKYFLGKNMDLPEQPAAKTPIESARKGFSFYKHLQTSDGNWACEYGGVMFLLPGLIIAMYISKIEFPDEMRIEVIRYLVNHANPEDGGWGIHIEGKSTVFGTALNYVVLRILGLGPDHPVTMKARIRLNELGGAIGCPQWGKFWLAVLNCYGWEGINPILPEFWMLPEWLPIHPSRWWVHTRAVYLPMGYIYGEKFTAPVDPLIESLREELYTQPYSSINFSKHRNTTSPVDVYVPHTRFLRVINSILTFYHTIFRFSWIKDMASKYAYKLIEYENKNTDFLCIGPVNFSIHILAVYWKEGPDSYAFKSHKERMADFLWISKKGMMMNGTNGVQLWDTSFAVQALVESGLAEDPEFKDHMIKALDFLDKCQIQKNCDDQQKCYRHRRKGAWPFSTRQQGYTVSDCTAEALKAVLLLQNLKSFPKRVSYDRLKDSVDVILSLQNKDGGFASYELIRGPSWLEFINPAEVFGDIMIEHSYPECTTAAVTALCYFRSLCSHYRGPEINKSVKNAIQFIKESQRPDGSWYESWAICFTYATMFALESLSCVKDFYENSFHSRRACDFLVNKQEEDGGWSEGYQSCTDGIWTRHPTGSQVVQTAWACIGLMYANYPDETPIKRGINLIMSRQQPNGEWKQEAIEGVFNKNCMISYPNYKFNFTIKALGMYSKRYGNI

SEQ ID NO: 4461 - DNA, 2675 bp, Glycine max
  CDS (209)..(2497)
agcgaagcctctccccaccccgagacctcaccctcccctccttctccctttcgccaccacaacgcccaacgtccacataaggaacaaccagctatcattttacattgaactagaaattcatttagaagatcaaagacaaaattttccgattaaaacgtacttaaattgaagaggggttgttggcattgtgcaccaaaaaggaaaaaaaatgtggaggttaaagatagcagatggagggaatgatccctatatatttagcacaaataattttgtggggaggcaaacatgggagtttgattctgaggcaggtaccgctgaggaacgagctcaaattgaagcagctcgtcaaaacttttatgaaaatcgcttcatggtcaaggcttgtggtgatcgactttggcggtttcagattttgagggaaaataatttcaaacaaacaataagtggcgtaaagatagaagatgatgagaaaattacatgcgagaaaattaggagcaccatgaagagggccactcattacctatcgtcactacagactagtgatggtcattggcctgctcatcttggaggttccctcttttttactccaccgttggtcatttgtttatatattacaggacatattgattctatattttcagaagagtatcgtaaagagattcttcgttacatatattaccaccagaacaaagatggaggttggggactacacatagaaggtcacagtatcatgttttgcactacactcaattatatatgcatgcgaattcttggagaaggacctaatggaggtcataacaatgcttgtgctaaagcaagaaagtggattcatgatcatggtggtgtaacacatataccttcatgggggaaattttggctttcggtacttggtatagttgattggtgtggaagcaacccaatgccgcctgaattttggatctttccttcttttctccctatgcatccgggtaaaatgtggtgttattgtcggttggtatacatgcccatgtcttatttgtatgggaagaaatttacgggtccaatcacaccgttagttgcaaatttgagagaagaactttttattcaaccttatgatgaaaatagttggaagaaagcacgtcataaatgtgcaaatgaagatctttactatccccatcattggatacaagatctattatgggatagtttgtatgtattcaccgagcctcttctaaattgttggcctttcaacaagttggttagagaaaaggcacttcaagtaacaatgaaacatattcattatgaagacgaaaatagtcggtatattgccatcgggtgtgtggaaaaggttctatgtatgcttgcttgttgggtagaagatccaaatggagatgctttcaagaagcatcttgcaaggatcccagattatttatgggtttctgaagatggaatgaccatgcagggtattggtactcaatcatgggatgctggtttcattgttcaagctttacttgctactaaccttatagatgattttggacctacaattgcaaaagctcacgatttcatcaagaaatctcaggtaagagaaaatccttcgggagattttaagagtatgtatcgtcacatttgtaaaggctcatggacccttgccgatagagatcatgcatggcaagtttctgataccactgcagaatgtttgaagtgttgtctacttttatcagtgctgccacaagatattgtgggagaaaaaatggaacttgaaaagttacatgattcaatcaatttgatactgtcacttcagagtaaaaatggaggtatgactgcgtgggagcccgcaggagcttataaatggttggaactactcaatcctacggaattttttgctgacatagtagttgagcacgaatatcttgaatgcactgcatcagcaattcaggttttagtgttgttcaaaaagctttacccagagcatagaaaggaagagatagagaacttcattgctaaagcagtaacattcattgaagatacacaattagagaatggttcttggtatgggaattgggcagtttgtttcacttacagctcttggtttgcacttggaggtctagttgctgctggcaagacttacacaaattgtgttactattcgtaaagctgtgaaatttctactcaaaatacaaaataaggacggtgggtggggagagagttatctttcttgcccaaggaagatgtacgtacctcttgaaggaagtcgatcaaatgttgtacaaacatcatgggctctaatggctctaattcatgctgagcaggctgagagagatccaactccccttcatcatgcagcaaagttactcattaattctcagttagaagatggcgattggccccaacaagaaactcttggagtatacttgagaaattgcttggttcattactcattctatagaaatatttttccaatgtgggctttggctgaataccgcacaaatgttttattgccttcctttactatttaagttgaaaaattgtgagctcaaaaagataatgtcataccaataaaagtctagaaaaagaaaagttggtaatgaagtttaataggcttattcatattcccatacttttgtaattttgaaacaaatatttcgtatacattgtcagggactccaaaatttatcatacaaaaaaaaaaaaaaa

SEQ ID NO: 4462 - protein, 762 aa, Glycine max
MWRLKIADGGNDPYIFSTNNFVGRQTWEFDSEAGTAEERAQIEAARQNFYENRFMVKACGDRLWRFQILRENNFKQTISGVKIEDDEKITCEKIRSTMKRATHYLSSLQTSDGHWPAHLGGSLFFTPPLVICLYITGHIDSIFSEEYRKEILRYIYYHQNKDGGWGLHIEGHSIMFCTTLNYICMRILGEGPNGGHNNACAKARKWIHDHGGVTHIPSWGKFWLSVLGIVDWCGSNPMPPEFWIFPSFLPMHPGKMWCYCRLVYMPMSYLYGKKFTGPITPLVANLREELFIQPYDENSWKKARHKCANEDLYYPHHWIQDLLWDSLYVFTEPLLNCWPFNKLVREKALQVTMKHIHYEDENSRYIAIGCVEKVLCMLACWVEDPNGDAFKKHLARIPDYLWVSEDGMTMQGIGTQSWDAGFIVQALLATNLIDDFGPTIAKAHDFIKKSQVRENPSGDFKSMYRHICKGSWTLADRDHAWQVSDTTAECLKCCLLLSVLPQDIVGEKMELEKLHDSINLILSLQSKNGGMTAWEPAGAYKWLELLNPTEFFADIVVEHEYLECTASAIQVLVLFKKLYPEHRKEEIENFIAKAVTFIEDTQLENGSWYGNWAVCFTYSSWFALGGLVAAGKTYTNCVTIRKAVKFLLKIQNKDGGWGESYLSCPRKMYVPLEGSRSNVVQTSWALMALIHAEQAERDPTPLHHAAKLLINSQLEDGDWPQQETLGVYLRNCLVHYSFYRNIFPMWALAEYRTNVLLPSFTI

SEQ ID NO: 4463 - DNA, 2504 bp, Triticum aestivum
  CDS (46)..(2325)
ggtactgagtgctaccaaattaacaaatcaatcatccagggagagatgtggaggctaaagatcgcggagggcagcggcaacccactgctgcgcaccaccaacggccacgtcggccggcaggtatgggagttcgatcctgccgcggatgaccccgacgaggtcgccgccgttgatgccgcccgccgcgacttcaccagccgccggcaccagatgaagaacagctccgacctcctcatgcgcatgcagctctctaagtcaaacaatctcaagatgaaccttcctcccatcaagctggaacaacatgggtatcacacagaagaagacgatgtcttgatatctttgaggagggcaatcaaccgatgttccactctccaggcacatgatggccattggccgggggattacgctggcactttatttctcttgcccagcttgattgtagcactgcatgtgactggagcactaactactgtgttgacatctgaacatcagaaagagattcggcggtatctctacaatcatcagaatgaagacgggggttggggactgcatatcgagggaacaagcacaatgttctgtactgtcatgaactatgttgctttgagattgcttggggaggggctggattcatgcggagccatgctacaagctcggagttggatcttggatcatggaggagcaactttaacaccatcgtggggaaaattctttctttcggtccttggggtatatgactggtccgggaacaacccattgccaccagaactatggatgatgccttatttcttgcctattcatccagggcgcatgtggtgtaattgtcggttggtatatttgcccatgtcatacctatacgggaagaggtttgtgggtgctactacatcgattgtactagacttgaggaaagagctctacaatgtcccgtataatgagattgactgggacaaggctcgcaatgggtgtgcaaaggaagatctctattatccccattcaccactacagaatattgtatgggccactctcaagaaaattggtgaaccggttcttatgcactggcctggcagcaatttgcgaaagaaagctctggacattgtcatgaaacatataaagtatgaggatgaaacaactcaatatatatgcattgctcctctcaataagatgttgaatatgatttgttgctgggtagaagatccaaagtcagaggcattcaaactccatattgaaagagtatatgatttcttatgggttgcagaagacggcatgaagatgaagtcttacaatggcagccagctatgggatacagctttgacagttcaggctatatttgctaccggcctcacaaaagagtttggccatacaattaaagtcgctcatgactatatcaaacattcccagattcgtgcggactgccctggagaccaaagcaagtggtatcgccatctatcaaaaggtggatggacacattcaactgctgaccaagggtggcctgtatcagattgtactgcagaagcatttaaggttttgttgttgttaactaaggttcctgaactggttgatgagcctatagaaacaagcagacttgatgatgcagtcaacattctactgtctttgatgaatgacgatggcagttttggtgcatatgagctaacaagatcttatgaatggcttgagttgttgaatccttctgagagctttggcggcataatgatcgagtatccgtatgttgagtgtacatcatcagtaattcagggtctggtgttatttagagaaatgtaccccaaacacattcgcttggaagagatagacagttgtatccaaaaggctgcagactacattgagagcatccaatggagtgatggatcatggtatggttgttgggctatctgtttcacatatggtacttggtttggggtgagaggattggttgctgcagggaggacgtatgtaaatagcctagcaatcagaaaagcgtgtgaatttcttttgtccaaggagcttctcccatctggagggtggggagaaagttacctttccagtcaagacaaggtttacaccaatcttgaaggaaacagggctcatgcagttaacactagttgggccatgttggccctaattgatgccgggcagggtcaaagagatcctgcatgtctacatagagcagccaagattctgatgaacttccaatcagaggatggagagttccctcagcaagacattattggagctaccaaccacaaccttatgctcacttatgcccagttcaggaacatattccctatctgggctcttggagagtactaccagagagtgcttccggtagcttaaaggaaaccatcgttatgtatatatagtggttgggaattacatacttctttgtgctctccatctcagctagagatgggcataaatatattgtagtgaatggtggttttttttacttgtatctagtgttattggttttaggagcatcaaccttctttccgagagagagagaccgacacgca

SEQ ID NO: 4464 - protein, 759 aa, Triticum aestivum
MWRLKIAEGSGNPLLRTTNGHVGRQVWEFDPAADDPDEVAAVDAARRDFTSRRHQMKNSSDLLMRMQLSKSNNLKMNLPPIKLEQHGYHTEEDDVLISLRRAINRCSTLQAHDGHWPGDYAGTLFLLPSLIVALHVTGALTTVLTSEHQKEIRRYLYNHQNEDGGWGLHIEGTSTMFCTVMNYVALRLLGEGLDSCGAMLQARSWILDHGGATLTPSWGKFFLSVLGVYDWSGNNPLPPELWMMPYFLPIHPGRMWCNCRLVYLPMSYLYGKRFVGATTSIVLDLRKELYNVPYNEIDWDKARNGCAKEDLYYPHSPLQNIVWATLKKIGEPVLMHWPGSNLRKKALDIVMKHIKYEDETTQYICIAPLNKMLNMICCWVEDPKSEAFKLHIERVYDFLWVAEDGMKMKSYNGSQLWDTALTVQAIFATGLTKEFGHTIKVAHDYIKHSQIRADCPGDQSKWYRHLSKGGWTHSTADQGWPVSDCTAEAFKVLLLLTKVPELVDEPIETSRLDDAVNILLSLMNDDGSFGAYELTRSYEWLELLNPSESFGGIMIEYPYVECTSSVIQGLVLFREMYPKHIRLEEIDSCIQKAADYIESIQWSDGSWYGCWAICFTYGTWFGVRGLVAAGRTYVNSLAIRKACEFLLSKELLPSGGWGESYLSSQDKVYTNLEGNRAHAVNTSWAMLALIDAGQGQRDPACLHRAAKILMNFQSEDGEFPQQDIIGATNHNLMLTYAQFRNIFPIWALGEYYQRVLPVA

SEQ ID NO: 4465 - DNA, 2902 bp, Glycine max
  CDS (379)..(2667)
ctctcaacctcttcatctcccacgcttcactttctccctccccctccctctccctctccctctccccaccccgagacctcaccctcccctccttctccctttcgccaccacaacgcccaacgtccacataagctagatgagatcaatctgaagcaaatggttataatttcaaaattttaagagtggaggacctgtgttgtgcacgttagagtgaatcgttcaagattaatccttaacaacctgaccaccaggaacaaccagctatcattttacattgaactagaaattcatttagaagatcaaagacaaaattttccgattaaaacgtacttaaattgaagaggggttgttggcattgtgcaccaaaaaggaaaaaaaatgtggaggttaaagatagcagatggagggaatgatccctatatatttagcacaaataattttgtggggaggcaaacatgggagtttgattctgaggcaggtaccgctgaggaacgagctcaaattgaagcagctcgtcaaaacttttatgaaaatcgcttcatggtcaaggcttgtggtgatcgactttggcggtttcagattttgagggaaaataatttcaaacaaacaataagtggcgtaaagatagaagatgatgagaaaattacatgcgagaaaattaggagcaccatgaagagggccactcattacctatcgtcactacagactagtgatggtcattggcctgctcatcttggaggttccctcttttttactccaccgttggtcatttgtttatatattacaggacatattgattctatattttcagaagagtatcgtaaagagattcttcgttacatatattaccaccagaacaaagatggaggttggggactacacatagaaggtcacagtatcatgttttgcactacactcaattatatatgcatgcgaattcttggagaaggacctaatggaggtcataacaatgcttgtgctaaagcaagaaagtggattcatgatcatggtggtgcaacacatataccttcatgggggaaattttggctttcggtacttggtatagttgattggtgtggaagcaacccaatgccgcctgaattttggatccttccttcttttctccctatgcatccgggtaaaatgtggtgttattgtcggttggtatacatgcccatgtcttatttgtatgggaagaaatttacgggtccaatcacaccgttagttgcaaatttgagagaagaactttttattcaaccttatgatgaaaatagttggaagaaagcacgtcataaatgtgcaaatgaagatctttactatccccatcattggatacaagatctattatgggatagtttgtatgtattcaccgagcctcttctaaattgttggcctttcaacaagttggttagagaaaaggcacttcaagtaacaatgaaacatattcattatgaagacgaaaatagtcggtatattgccatcgggtgtgtggaaaaggttctatgtatgcttgcttgttgggttgaagatccaaatggagatgctttcaagaagcatcttgcaaggatcccagattatttatgggtttctgaagatggaatgaccatgcagggtattggtactcaatcatgggatgttggtttcattgttcaagctttacttgctactaaccttatagatgattttggacctacaattgcaaaagctcacgatttcatcaagaaatctcaggtaagagaaaatccttcgggagattttaagagtatgtatcgtcacatttgtaaaggctcatggacccttgccgatagagatcatgcatggcaagtttctgataccactgcagaatgtttgaagtgttgtctacttttatcagtgctgccacaagatattgtgggagaaaaaatggaacttgaaaagttacatgattcaatcaatttgatactgtcacttcagagtaaaaatggaggtatgactgcgtgggagcccgcaggagcttataaatggttggaactactcaatcctacggaattttttgctgacatagtagttgagcacgaatatcttgaatgcactgcatcagcaattcaggttttagtgttgttcaaaaagctttaccctgagcatagaaaggaagagatagagaacttcattgctaaagcagtaacattcattgaagatacacaattagagaatggttcttggtatgggaattgggcagtttgtttcacttacagctcttggtttgcacttggaggtctagttgctgctggcaagacttacacaaattgtgttactattcgtaaagctgtgaaatttctactcaaaatacaaaataaggacggtgggtggggagagagttatctttcttgcccaaggaagatgtacgtacctcttgaaggaagtcgatcaaatgttgtacaaacatcatgggctctaatggctctaattcatgctgagcaggctgagagagatccaactccccttcatcatgcagcaaagttactcattaattctcagttagaagatggcgattggccccaacaagaaactcttggagtatacttgagaaattgcttggttcattactcattctatagaaatatttttccaatgtgggctttggctgaataccgcacaaatgttttattgccttcctttactatttaagttgaaaaattgtgagctcaaaaagataatgtcataccaataaaagtctagaaaaaaaaaagttggtaatgaagtttaataggcttattcatattcccatacttttgtaattttgaaacaaatatttcgtatacattgtcagggactccaaaatttatcataaaaaaaaaaaaagaaaaaaaaaaaaaaaaaaaaaaaaaaaaaaaaaaaaaaaaaaaaaaaaaaaaaaaaaaaa

SEQ ID NO: 4466 - protein, 762 aa, Glycine max
MWRLKIADGGNDPYIFSTNNFVGRQTWEFDSEAGTAEERAQIEAARQNFYENRFMVKACGDRLWRFQILRENNFKQTISGVKIEDDEKITCEKIRSTMKRATHYLSSLQTSDGHWPAHLGGSLFFTPPLVICLYITGHIDSIFSEEYRKEILRYIYYHQNKDGGWGLHIEGHSIMFCTTLNYICMRILGEGPNGGHNNACAKARKWIHDHGGATHIPSWGKFWLSVLGIVDWCGSNPMPPEFWILPSFLPMHPGKMWCYCRLVYMPMSYLYGKKFTGPITPLVANLREELFIQPYDENSWKKARHKCANEDLYYPHHWIQDLLWDSLYVFTEPLLNCWPFNKLVREKALQVTMKHIHYEDENSRYIAIGCVEKVLCMLACWVEDPNGDAFKKHLARIPDYLWVSEDGMTMQGIGTQSWDVGFIVQALLATNLIDDFGPTIAKAHDFIKKSQVRENPSGDFKSMYRHICKGSWTLADRDHAWQVSDTTAECLKCCLLLSVLPQDIVGEKMELEKLHDSINLILSLQSKNGGMTAWEPAGAYKWLELLNPTEFFADIVVEHEYLECTASAIQVLVLFKKLYPEHRKEEIENFIAKAVTFIEDTQLENGSWYGNWAVCFTYSSWFALGGLVAAGKTYTNCVTIRKAVKFLLKIQNKDGGWGESYLSCPRKMYVPLEGSRSNVVQTSWALMALIHAEQAERDPTPLHHAAKLLINSQLEDGDWPQQETLGVYLRNCLVHYSFYRNIFPMWALAEYRTNVLLPSFTI

SEQ ID NO: 4467 - DNA, 2786 bp, Glycine max
  CDS (179)..(2452)
ccgtagcagtcattgtcggctttgcaagctccgcctcggtgtcagtcgtagttgttataaattgaattaagtgattgaatggttccgaaatgcacttgctgtctttttctacttgactattacaccttccccattttgatttgatctgattgaattggcctcttgccagcaaaacagaatgtggaagctcaagttcgccgaaggagggaatccatggcttcggacattgaacaatcacgttggaagacaggtgtgggagttcgatcctaagcttggatcgccgcaagatctcctcgagattgagaaagctcgccagaattttcacgataaccgctttacccacaaacacagcgctgatctacttatgcggatgcagttcgcaagagagaacccaacacgtgaagtcttgcccaaagtcggagttaaggatattgaggatgtgacccaagagattgtgacaaaaacattaagaagggccgtaagtttccattcaactctccagtgccatgacggacactggccgggagattatggaggtcccatgtttctgatgcctggcttggtaattactctgtctatcactggggcgttgaatacagtcttaactgaagaacatagaaaggaaatatgccgttacctctataatcatcaaaacaaggatggtgggtggggtttgcatattgaaggtccaagcaccatgtttggctctgtcttgagttatattactctgagattgctaggtgaggggcctaatgatggacaaggggaaatggagaaggcacgtgactggattctagggcatggtggtgctacttatataacgtcatgggggaagatgtggctttcagtacttggagtgtatgaatggtctggaaataatcccctgccccctgagatatggctccttccatacatgcttccatttcatccaggaaggatgtggtgtcactgccggatggtctatttgccgatgtcctacttatatggcaagaggtttgttggtccaatctcaccaacagtattatctttgagaaaagagctttatacagtaccataccatgatatagattgggatcaggctcgcaatttgtgtgcaaaggaagatttgtactatcctcacccacttgtacaggatattctttgggcatctctacacaagttccttgagcctattctgatgcattggcctggaaaaagattgagggaaaaggctattatttctgcattggagcatatacattacgaagatgagaatactcgatatatttgcataggtcctgtaaataaggtgttaaatatgctttgctgttgggtggaagatccaaattctgaggccttcaagttgcatcttcccaggatttatgattatctatggattgcagaagatggcatgaaaatgcagggctacaatggaagtcaactatgggacactgcttttgctgtccaagcaattattgcatctaacctcattgaagaatttggtccaactataagaaaagctcatacctatattaagaattcacaggttttagaagattgtccaggtgatcttaataaatggtaccgtcacatttcaaaaggtgcttggcctttttcaactggagatcatggatggccaatttctgactgcacagctgaaggactgaaagctgttctattactatccaaaattgcaccagaaatagttggtgagccaatagacgtgaagcgattatatgattctgtaaatgtcattctctcactacagaatgaagatggtggttttgcaacatatgagcttaaacgatcttataattggttggagataatcaatcctgctgaaacttttggtgacatcgttattgattatccttatgtggaatgtacatcagcagcgattcaagctttggcatcatttaggaaattatatcctgggcatcgccgagaagaaatacaacattgtatcgataaagccactaccttcattgaaaaaatacaagcttcagatggatcatggtatggttcttggggagtttgcttcacttacggtgcttggtttggggtaaaaggtctgattgctgctggaaggagtttcagtaattgctcaagcatccgtaaagcttgtgaatttctgctgtccaagcagcttccttctggtggctggggagagagttatctgtcctgtcaaaacaaggtgtattcaaatctggaaggcaacaggtctcatgtggtcaacactgggtgggctatgttggctctcattgatgctggacaggctaagagagattcgcaaccactgcaccgggcagctgcatacttgataaattcccaattggaggacggtgactttccgcagcaggaaataatgggagtcttcaacaagaattgcatgatcacatacgccgcatacagaaacatattccccatttgggcgttgggagaataccaatcccaagtattgcaatctcgttaatcgagccttagttagggtgtcatcctaattatttcgacctgtggacagtaaaagaaataataataataacctatttttcttttatttccatggctctcttaaaatgtttgtgactaatgagtttagtagtcagctaaaaaaaaaagcaaacacgtggagaatgcctgtaagttttttctattactcatagacgcctctcttgctttccctgcagcagaggaattaaatatatacataaatagagatataaatgtttatgtcacttcttttgggacgaagaacgcaattctttctagcaatcgattcaaattgttttgcaaaaaaaaaaaaaaaa

SEQ ID NO: 4468 - protein, 757 aa, Glycine max
MWKLKFAEGGNPWLRTLNNHVGRQVWEFDPKLGSPQDLLEIEKARQNFHDNRFTHKHSADLLMRMQFARENPTREVLPKVGVKDIEDVTQEIVTKTLRRAVSFHSTLQCHDGHWPGDYGGPMFLMPGLVITLSITGALNTVLTEEHRKEICRYLYNHQNKDGGWGLHIEGPSTMFGSVLSYITLRLLGEGPNDGQGEMEKARDWILGHGGATYITSWGKMWLSVLGVYEWSGNNPLPPEIWLLPYMLPFHPGRMWCHCRMVYLPMSYLYGKRFVGPISPTVLSLRKELYTVPYHDIDWDQARNLCAKEDLYYPHPLVQDILWASLHKFLEPILMHWPGKRLREKAIISALEHIHYEDENTRYICIGPVNKVLNMLCCWVEDPNSEAFKLHLPRIYDYLWIAEDGMKMQGYNGSQLWDTAFAVQAIIASNLIEEFGPTIRKAHTYIKNSQVLEDCPGDLNKWYRHISKGAWPFSTGDHGWPISDCTAEGLKAVLLLSKIAPEIVGEPIDVKRLYDSVNVILSLQNEDGGFATYELKRSYNWLEIINPAETFGDIVIDYPYVECTSAAIQALASFRKLYPGHRREEIQHCIDKATTFIEKIQASDGSWYGSWGVCFTYGAWFGVKGLIAAGRSFSNCSSIRKACEFLLSKQLPSGGWGESYLSCQNKVYSNLEGNRSHVVNTGWAMLALIDAGQAKRDSQPLHRAAAYLINSQLEDGDFPQQEIMGVFNKNCMITYAAYRNIFPIWALGEYQSQVLQSR

SEQ ID NO: 4469 - DNA, 2538 bp, Triticum aestivum
  CDS (69)..(2324)
gtttggggtcagcgatagtgatcgggcatttcgtgagctaactgagctaaccacctgttcagagagagatgtggaggctcaaggtgtccgagggtggcggcccgtggctgcggtcggtgaacaacttcctcggcagggcagtgtgggagttcgaccccgactacggcacaccggaggagcgcgccgaggtgaagagggtgcgccgggagttcaccgaccgccgtttcgagaaaaaggagtcgcaggatcttctcatgcgcatgcagtatgcaaaagaaaagcatcttcaggtggaccttccagccatcaagcttgcagacagtgcacaagtcacagaagagactttactaacatcattgaggcgatgccttagccaacattctgctctacaagcacacgatgggcattgggccggggacttcagtggaattttgttcattatgcccatcttgatatttgctctacatgttactggatcactcaatactgtcctatcaacagaacatcgacgtgagatttgtcgctatatttacaaccatcagaatgaagatggtggttggggcacgcaagtgttgggtccgagcaccatgtttggatcatgcttaaactatgttaccttaaggcttcttggcgaggtggaaaatgatgccttaaccaagggacgtgcttggattctattgcgtggaagtgcaactgcaataccacaatggggaaagatatggctctcggtggttggtttgtatgaatggtctggaaataattcgatcattcctgagttatggcttgtcccacattttcttccgattcatccaggacgattctggtgcttttgccggttggtttatatgccaatgtcttatctttacggcaaaaagtttgttggcccaattacaccaacaataatggcaataagagaggagctctatagtgtatcatacaacgagattgattggaacaaagcacgtgatacttgtgctaaggaagaccttcggtatccacggtcgttgctgcaaaatgttatttggacttgtcttaataaatttgtagaaccagtgttgaattgttggccaattaataagttaagagatacggcgctgaagaacctcatgaaacatatacattatgaagacgaaagcactaaatacattggcgtatgtccgattaacaaggcactagacatgatttgttgttggagcgaggatccaaattcagatgcactgaagttgcatcttccaaggatctatgactatttatggcttgcagaagatggcatgaaagcacaggtttatgatggttgtcaaagctgggagcttgcttttattgttcaagcatattgctcgacagaccttgttaatgagtttggtccaacacttcggaaagcccatgaattcattaaaagttcacaggttcttgagaaccatcctaacagcgaaacttattaccgccatagatcaaaaggttcatggacactttcaacagcggataatgggtggtctgtatcagattgtactgcagaagcacttaaggcattgttgttgctgtcgaagatctctcctaatcttgtgggggatcccataaaaggagaaaggttgcatgatgcagtggattgcttactttcttttatgaataaagatggcacattttctacatatgagtgtaagagaactacatctctattagaggttctcaacccttctgaaagttttctgaacattattgtcgattatccatctgtcgaatgtacatcatctgtgcttcaggccctaattatgttcaaagagctttaccctgggtaccgcaaagaagagataggaaaatgcataaaaaatgcttccaagtttattgaggataagcaacgaaaggatggctcatggtttggcacttggggtatatgtttcacttatgggacgttctttggtgtaaaaggattgattgcttctggaagaacttacgaaaatagttcttccataaggaaagcatgcaattttctgttgtcaaagcaactaagtacaggtggatggggagagtcttatctttctagtgaaactgaggcttatgtggaggccactagtcctcatgcagtgaacactgcttgggcaatgttggctttaatttatgctgggcaggttgaacgagatcctactccactatatcatgctgcaaaagagttgatcaatatgcaactagagacaggagagtttccccagcaagaacacgttggatgcttcaactgctccatatactttaattacggcaactatcgcaacttataccccatttgggctcttggagagtttcgtcgtcgactgcttgcgaagaactgaaactgatgacgatgatatgtcgcttcactgctcttaggtttaggtgtggtcgtgcctgtgacgaaaaggatgaccttagccaaactatattatatatgtgtgtgtaacacatactgcaataacacttacaaccaaagtgactaatgcaaacataatagcgcctgtttggtttgtaaaaaaaaaaaaaaaaaaaaaaaaaaaaaaaaaaaaaaaa

SEQ ID NO: 4470 - protein, 751 aa, Triticum aestivum
MWRLKVSEGGGPWLRSVNNFLGRAVWEFDPDYGTPEERAEVKRVRREFTDRRFEKKESQDLLMRMQYAKEKHLQVDLPAIKLADSAQVTEETLLTSLRRCLSQHSALQAHDGHWAGDFSGILFIMPILIFALHVTGSLNTVLSTEHRREICRYIYNHQNEDGGWGTQVLGPSTMFGSCLNYVTLRLLGEVENDALTKGRAWILLRGSATAIPQWGKIWLSVVGLYEWSGNNSIIPELWLVPHFLPIHPGRFWCFCRLVYMPMSYLYGKKFVGPITPTIMAIREELYSVSYNEIDWNKARDTCAKEDLRYPRSLLQNVIWTCLNKFVEPVLNCWPINKLRDTALKNLMKHIHYEDESTKYIGVCPINKALDMICCWSEDPNSDALKLHLPRIYDYLWLAEDGMKAQVYDGCQSWELAFIVQAYCSTDLVNEFGPTLRKAHEFIKSSQVLENHPNSETYYRHRSKGSWTLSTADNGWSVSDCTAEALKALLLLSKISPNLVGDPIKGERLHDAVDCLLSFMNKDGTFSTYECKRTTSLLEVLNPSESFLNIIVDYPSVECTSSVLQALIMFKELYPGYRKEEIGKCIKNASKFIEDKQRKDGSWFGTWGICFTYGTFFGVKGLIASGRTYENSSSIRKACNFLLSKQLSTGGWGESYLSSETEAYVEATSPHAVNTAWAMLALIYAGQVERDPTPLYHAAKELINMQLETGEFPQQEHVGCFNCSIYFNYGNYRNLYPIWALGEFRRRLLAKN

SEQ ID NO: 4471 - DNA, 2780 bp, Zea mays
  CDS (148)..(2421)
  misc_feature (2780)..(2780): n is a, g, c or t
gagccacgccacgcaggcacgcacgcggaggggagcgccggccgtccgcggcggattgggatctccctcgcccgcccgtccactcgagactcgacggcacccgccgcatttgagctgagctgaggaggcgtgggggacggcgcggggatgtggcgcctgcggatcgcggaggggggcggggacccctggctccgcacgaagaacgcccacgtcggccgccaggtctgggagttcgacgcctccgccgaccccgaccccgccgtcgacgccgcgcgccgcgccttcgccggcagcaggggccacctcaagcacagcgccgacctcctcatgcgcatccagttcgccaaagaaaatcctcttgagcttgaccttccagcgatcaagctcggtgagcacgaagacgtaaccgaggaagccgtgtctactactttgagaagggcaatcagccgtctttctactctccaggcacatgatggacactggcctggggattatggtggccctatgttccttatgccaggcttgatcataacattgtatgtgactggagcactaaacactgtcttgtcatcagaacaccagaaggagatccgtcggtatctttataatcatcagaatgaagatggtggctggggcttgcacattgagggtccaagcaccatgtttggctcagcactgacctacgttactttgagattgcttggagagggaccagatagtggagatggagcaatggagaaaggccgaaactggatcttagaccatggcggagcaacatatataacatcctgggggaagttttggctctcggtacttggtgtatttgaatggtctggtaacaacccggtaccaccagaagtatggctactgccatatctcctgccatttcacccagggaggatgtggtgtcattgtcgaatggtgtatttgccaatgtgctacatctatgggaagaggtttgttggtcgaatcacaccactcgtgttggaattaagaaaggaacttttcaaagacccttacagcaagattgattgggacaaggcccgcaatctatgtgctaaggaagatctgtactatccacatccatttgttcaagatgtcttatgggccactctccataaatttgttgaaccagttatgatgagttggcctggcagtaaattgagggagaaagctctggagacagccatgcaacatgttcactatgaggatgagaacactcggtacatttgcattggtcctgtaaacaaggtattaaatatgcttgcttgctggattgaagatccaaactcagaggccttcaaactccacatcccacgagtctatgactacttgtggcttgctgaagatggcatgaagatgcagggctataatggtagccaactttgggatacagctttcatagttcaagccattgtggctaccaaccttaccgaagagtttggtcccacccttaaactagcacacaactatatcaagaaatcacaggttcttgacgactgccctggtgatctgaatgactggtaccgccacacatctaaaggcgcatggccattctcaaccgcggatcatggttggcctatatctgattgcactgctgaaggactaaaggcttcattattgttatcaaagatttctcctgaaattgttggtggaccgatagaagctaatagattttatgatgctgtcagttgtctgatgtcttatatgaatgataatggtggttttgcgacttatgaactcacaagatcctatgcctggctggagctgatcaatcctgctgagacctttggggatattgtgattgattacccgtatgttgaatgtacatcagcagcaatccaggccctgacatcattcagaaaactataccctgggcaccgcaggaaagaggtggacaactgtatcagcaaagctgctaatttcattgagagcattcagaaaagtgacggttcatggtatggctcttgggctgtttgtttcacgtacggcacttggtttggtgtgaagggactaattgctgctggtagaacatttgagagcagtcctgcaatcagaaaggcatgcggctttctgttatcaaaagagcttccttccggtggctggggagaaagctatttatcgtctcaagaccaggtttacaccaatctcaaaggcaaccgagctcatgcagcgaacactggttgggccatgctggcgctgattgatgcaggacaggcccagagagatcccgcgcctctacaccgagcagcaaaggttttgataaacttgcagtcagaggacggagaatttccccagcaagagatcataggagtgttcaacaagaactgcatgatcagttactcccagtacaggaacaccttcccgatctgggctctgggagagtaccggtgccgagtcctgggagctggcaagcggtagtgacccggcctggccccgtcaacttgactgaaaggcgctttgttgtcttggtgttcttggtgttctatcttggcacgccgagggctgtcttgccggccgcctagctgtctcatgaatcaatcagcttttttgtgagtagctagctatgtgcggtggttggaataatgcagctatgcttttttttagggttgcgctcctagttctaataatgtactacgtatattggaagcagaataaatgttagattgaactaaaaaaaaaaaaaaaaaaaaaaaaaaaaaaaaaaaaaaaaaaacaagcttacgtacgcgtgcatgcgacgtcatagctctaaaatagtgtcacctaaattcaaggcn

SEQ ID NO: 4472 - protein, 757 aa, Zea mays
MWRLRIAEGGGDPWLRTKNAHVGRQVWEFDASADPDPAVDAARRAFAGSRGHLKHSADLLMRIQFAKENPLELDLPAIKLGEHEDVTEEAVSTTLRRAISRLSTLQAHDGHWPGDYGGPMFLMPGLIITLYVTGALNTVLSSEHQKEIRRYLYNHQNEDGGWGLHIEGPSTMFGSALTYVTLRLLGEGPDSGDGAMEKGRNWILDHGGATYITSWGKFWLSVLGVFEWSGNNPVPPEVWLLPYLLPFHPGRMWCHCRMVYLPMCYIYGKRFVGRITPLVLELRKELFKDPYSKIDWDKARNLCAKEDLYYPHPFVQDVLWATLHKFVEPVMMSWPGSKLREKALETAMQHVHYEDENTRYICIGPVNKVLNMLACWIEDPNSEAFKLHIPRVYDYLWLAEDGMKMQGYNGSQLWDTAFIVQAIVATNLTEEFGPTLKLAHNYIKKSQVLDDCPGDLNDWYRHTSKGAWPFSTADHGWPISDCTAEGLKASLLLSKISPEIVGGPIEANRFYDAVSCLMSYMNDNGGFATYELTRSYAWLELINPAETFGDIVIDYPYVECTSAAIQALTSFRKLYPGHRRKEVDNCISKAANFIESIQKSDGSWYGSWAVCFTYGTWFGVKGLIAAGRTFESSPAIRKACGFLLSKELPSGGWGESYLSSQDQVYTNLKGNRAHAANTGWAMLALIDAGQAQRDPAPLHRAAKVLINLQSEDGEFPQQEIIGVFNKNCMISYSQYRNTFPIWALGEYRCRVLGAGKR

SEQ ID NO: 4473 - DNA, 2526 bp, Zea mays
  CDS (28)..(2298)
tccttcaccatcctaagctagccaagcatgtggaggctaaagatcggcgagaggccaagcaacccgctgcttcgctcgcccaatggcttccttgggagagaggtgtgggagttcgaccccgccgcaggcacgccggaggagcgcgccgaggtcgataggctgcgccaggagtacacccgcaaccgcttcacgcgacggcaatgcagtgaccttctcatgcgcatgcagtatgcaaaacagaaccttcataatacaaaccttccggctatcaagattgaccaggattcagacgtcacagaagaaactatactaattacattgaggcgtgctcttaatcaatattcttctttgcaaggacctgctgggcattggcctggggattacggcgggatttcgttcattttaccactcatgatatttgcattacatgtcacacgatcaatggatgaagttttgtcaatagagcatatacgtgagatatgtcgctacatttataacatgcagaatgaggatggaggctggggaacacataccttgggaccaagctccatgtttggcacatgtgtaaactatgcaaccttaaggattctaggagaggtgcttgatggagaaaatgatgcattatccaaagggcgttcttggattttgtctcatggaagtgcaactgcagcaccacaatgggcaaagatatatctctcgatgataggtgtatacgattgggctgggaacaatgcaatcattcctgagttatggatgcttccacattttctcccaattcatcctggaaggttttggtgcttttgtcggatggtttacatgccaatggcttacatttatggaaaaaagtttgttgggcctatcactacaactattttagaaataagaaatgagctctacaaaagaccaaataataagatcaactggaacaaggcttgcaattcttgtgccaaggaagaccttatctatgagccttcatggttgcaaagtattgcaatggcttatttgaataagtttatagaaccattatcaaatctttggccaatgaataagctacgagaaagagctatgagtgacctcatggaacatatccactatgaagatgaaaccagcaactatgttggcttatgccctataaacaaggcattaaatatgatatgttgttggatagaaaaaccaaactcaaatgaatttagacaacatctcccaaggattcatgatttcctatggcttggagaagacggaatgaagtcaaaggtgtatgttggttgccatagttgggaaactgcgctcatagttcaggctttttgctcaacagggctcaccgaggagttttgttcgactcttcaaaaagctcatcagttcttaaaaaatgcacaggttatcgaaaacattcctgattacaagagctactaccgtgaaagaactaaaggttcttggactctatccaatggagaaaacttttggcctattgctgatacaactgctgaggcacttaaggcaatactgttgctgtctaacattccttcagaacttgtcggggatccaataaaacaagaacgactatatgatgccgttgattgcctcctttctttcgtgaacaaagatggtacattatcatcagctgaatgtaaacgaacaacttcatgggtggagtttatcaatccttctgagagttttcgtaatatcatcgtcgactatccatatcctgaatgcacatcatcattaattcaagctttagtgctgtttagaggcaagcatccaatatatcgtcgtgatgagatagacaaaattatcaaaagtggtgcatcattcattgagaaagtacaacgaaaggatgggtcctggtatggttcttgggctgtgtgtttcacttatgcaacattctttgctataaaaggattagttgctgcaggaagaacataccggaatagtttggctattaggaaagcatgcaacttcttgttgtcaaagcaactaggaaccggtggatggggagaaaactatcttggttgtcaaattgaggagtatgttgacagtggcagtccacatggagtcaacactgcacaggcgatgctagctttactctacgctgggcaggtcgaacaagacccagcgccactataccgtgctgcaaaagaattaattaacatgcagatggagaacggagaatttccccaacaagaaattgttggcaacttcaactcctcacttttcttcaattacccgaactaccgaaacttatttcccatctgggctttaggagaatttcgccgccgacttgttgcaaaaaaaggttaagatgggtatcttaagctatttctaataattgtatttgggatacaagtatccatgtatattttatttttcgtgatgatgggaatgtaacacaaaataaaatttatatttagtacgtatatgttaatatttgtaagattatcacaaacaagttgataatcatcagtgatctggttcctcaaattcaataacaaggatgcaaaatgtttggtagcaataaaaaaaaaaaaa

SEQ ID NO: 4474 - protein, 756 aa, Zea mays
MWRLKIGERPSNPLLRSPNGFLGREVWEFDPAAGTPEERAEVDRLRQEYTRNRFTRRQCSDLLMRMQYAKQNLHNTNLPAIKIDQDSDVTEETILITLRRALNQYSSLQGPAGHWPGDYGGISFILPLMIFALHVTRSMDEVLSIEHIREICRYIYNMQNEDGGWGTHTLGPSSMFGTCVNYATLRILGEVLDGENDALSKGRSWILSHGSATAAPQWAKIYLSMIGVYDWAGNNAIIPELWMLPHFLPIHPGRFWCFCRMVYMPMAYIYGKKFVGPITTTILEIRNELYKRPNNKINWNKACNSCAKEDLIYEPSWLQSIAMAYLNKFIEPLSNLWPMNKLRERAMSDLMEHIHYEDETSNYVGLCPINKALNMICCWIEKPNSNEFRQHLPRIHDFLWLGEDGMKSKVYVGCHSWETALIVQAFCSTGLTEEFCSTLQKAHQFLKNAQVIENIPDYKSYYRERTKGSWTLSNGENFWPIADTTAEALKAILLLSNIPSELVGDPIKQERLYDAVDCLLSFVNKDGTLSSAECKRTTSWVEFINPSESFRNIIVDYPYPECTSSLIQALVLFRGKHPIYRRDEIDKIIKSGASFIEKVQRKDGSWYGSWAVCFTYATFFAIKGLVAAGRTYRNSLAIRKACNFLLSKQLGTGGWGENYLGCQIEEYVDSGSPHGVNTAQAMLALLYAGQVEQDPAPLYRAAKELINMQMENGEFPQQEIVGNFNSSLFFNYPNYRNLFPIWALGEFRRRLVAKKG

SEQ ID NO: 4475 - DNA, 2401 bp, Zea mays
  CDS (72)..(2174)
  misc_feature (2368)..(2368): n is a, g, c or t
gcaagtgcaagctagctaggtagtaaaagctagcctcgccaacaacactgactgtgggcagctagctgatcatgtggaggctgaagatcggcggcgagggcggcgggccatggctgcggtcggcgagcggcttcaccggcaggcaggtatgggagttcgaccccgacgccggtacgcaggacgagatcgccgaggttgagaggctgaggcgggagttcacggagcgccgccgcttcgacaagagggccgtggcgcaggatctcctcttgcgcatgcaggtatttgcactacatgtcactggatcactcaatacggttttatcagcagagcatcgacacgagatctgtcgctatatttacaaccatcagaatgaagatggtggctggggcatgcaagaggttgggccaagcaccatgtttagctcatgcctgaactatgtcaccttgagacttctcggggaggcgtgtgcgcagcatgacgctttggccaagggacaagcatggattctgtctcatggaagtgcggcggcaatacctcagtggggaaagatttggctctcggtgatcggtttatatgactggaacggcaataattcgatcgttcctgagttgtggcttgttccatattctctcccattccatccagggcgattctggtgtttctgtcggttgatatatatgccaatggcttatttatatggcaagaagtttgtggggccaattacaccaaccatattatcaataagaaatgaaatctataagataccatatgatgaggtcgattggaacaaagctcgagatacttgcgctaaggaagaccttctctacccaaggacgttcgtgcaaaacgtcatttggacttgtgtgaataaaatcgtggaaccattgctaaatctttggccggctaagatgttaagagatacagcactgaagaacatcatgaatcatatccattatgaagacgaaagtactaggtacctttgtgtatgcccagtaaacaaggcactaaatatgatttgttgttgggttgagaatccaaattcagatgcattcaagcggcaccttccaaggatctatgattatatatggcttgctgaagatggcatgaagttaaaggtgtatgacggcacgcaagcatgggatacagcttttattgtcaaagcatattgctcgactgacctggttcatgagttttctccaacactcaggaaggctcatgagttcataaaaagtttgcagatccctgaaaaccaacccgaccatgaaaattattaccgccatagatcaaagggttcatgggctcattcaacattagacaatggatggtctgtatctgattctacagcagaagcaattcaggcattgttgttgttatcaaagttctcttccaatcttgtgggggatcccataaaagaagaaagattatttgatgcagtggattgcttgctttcttttatgaataaagatggtacattttcaacatacgagcgtaagagaactgcatctttgttggaggttctcaacccttccgagacttttctaaacattgttgttgatcacccgtcggtcgaatgcacgtcatctgcgattcaagctcttgttatgttcagagaaatgtatccaaggtatcgcgatcaagagataaaaaaatgtattaaaggagcatctaaatttattgagagcaaacaacaaaaggatggcacatggtttggcacttggggtgtatgttacacttatgggacattatttgcagtgcaaggattagttgttgctggaagaacttatgaaaacagttcttctattaggaaagcatgtaggtttctattgtcaaagcagctaatcacgggtggatggggtgagacatatccgtctaatggaactgcggtctatgcagaggccagtagtcctcatgtagtgaatacagcttgggcaatgttggctttaatttatgctggacaggttcagcgagatccaacaccattgtatggtgctgcaaaagaactgatcaatatgcaacaagagtcaggcgagtttccccaacaagaacacattgggagcttcaattgttccttttacttcaactatggaaactaccgtaacttgttcccaatatgggctcttggagagtttcggagacgaattgttgcagaaaagaagaggaaccaacaaacatgattgttttaggcatcaacaaattcggggtgaaagcttgtaaggggctcaagtttaacatgtggtgaaagacatgtcaatatactaaagctgatgtccatctggctaaaccatatgtacatatttttactatggaaacaacgatccatatgtatatatggaataaagggccacatatatgaccgtttcgccatctnatattatatttttgaagtgaaaaaaaaaaaaaa

SEQ ID NO: 4476 - protein, 700 aa, Zea mays
MWRLKIGGEGGGPWLRSASGFTGRQVWEFDPDAGTQDEIAEVERLRREFTERRRFDKRAVAQDLLLRMQVFALHVTGSLNTVLSAEHRHEICRYIYNHQNEDGGWGMQEVGPSTMFSSCLNYVTLRLLGEACAQHDALAKGQAWILSHGSAAAIPQWGKIWLSVIGLYDWNGNNSIVPELWLVPYSLPFHPGRFWCFCRLIYMPMAYLYGKKFVGPITPTILSIRNEIYKIPYDEVDWNKARDTCAKEDLLYPRTFVQNVIWTCVNKIVEPLLNLWPAKMLRDTALKNIMNHIHYEDESTRYLCVCPVNKALNMICCWVENPNSDAFKRHLPRIYDYIWLAEDGMKLKVYDGTQAWDTAFIVKAYCSTDLVHEFSPTLRKAHEFIKSLQIPENQPDHENYYRHRSKGSWAHSTLDNGWSVSDSTAEAIQALLLLSKFSSNLVGDPIKEERLFDAVDCLLSFMNKDGTFSTYERKRTASLLEVLNPSETFLNIVVDHPSVECTSSAIQALVMFREMYPRYRDQEIKKCIKGASKFIESKQQKDGTWFGTWGVCYTYGTLFAVQGLVVAGRTYENSSSIRKACRFLLSKQLITGGWGETYPSNGTAVYAEASSPHVVNTAWAMLALIYAGQVQRDPTPLYGAAKELINMQQESGEFPQQEHIGSFNCSFYFNYGNYRNLFPIWALGEFRRRIVAEKKRNQQT

SEQ ID NO: 4477 - DNA, 2959 bp, Zea mays
  CDS (251)..(2530)
  misc_feature (21)..(21): n is a, g, c or t
  misc_feature (22)..(22): n is a, g, c or t
  misc_feature (23)..(23): n is a, g, c or t
  misc_feature (24)..(24): n is a, g, c or t
  misc_feature (25)..(25): n is a, g, c or t
  misc_feature (26)..(26): n is a, g, c or t
  misc_feature (27)..(27): n is a, g, c or t
  misc_feature (28)..(28): n is a, g, c or t
  misc_feature (29)..(29): n is a, g, c or t
  misc_feature (30)..(30): n is a, g, c or t
  misc_feature (31)..(31): n is a, g, c or t
  misc_feature (32)..(32): n is a, g, c or t
  misc_feature (33)..(33): n is a, g, c or t
  misc_feature (34)..(34): n is a, g, c or t
  misc_feature (35)..(35): n is a, g, c or t
  misc_feature (36)..(36): n is a, g, c or t
  misc_feature (37)..(37): n is a, g, c or t
  misc_feature (38)..(38): n is a, g, c or t
  misc_feature (39)..(39): n is a, g, c or t
  misc_feature (40)..(40): n is a, g, c or t
  misc_feature (41)..(41): n is a, g, c or t
  misc_feature (42)..(42): n is a, g, c or t
  misc_feature (43)..(43): n is a, g, c or t
  misc_feature (111)..(111): n is a, g, c or t
  misc_feature (112)..(112): n is a, g, c or t
  misc_feature (113)..(113): n is a, g, c or t
  misc_feature (114)..(114): n is a, g, c or t
  misc_feature (115)..(115): n is a, g, c or t
  misc_feature (116)..(116): n is a, g, c or t
  misc_feature (117)..(117): n is a, g, c or t
  misc_feature (118)..(118): n is a, g, c or t
  misc_feature (119)..(119): n is a, g, c or t
  misc_feature (120)..(120): n is a, g, c or t
  misc_feature (121)..(121): n is a, g, c or t
  misc_feature (122)..(122): n is a, g, c or t
  misc_feature (123)..(123): n is a, g, c or t
  misc_feature (124)..(124): n is a, g, c or t
  misc_feature (125)..(125): n is a, g, c or t
  misc_feature (126)..(126): n is a, g, c or t
  misc_feature (127)..(127): n is a, g, c or t
  misc_feature (128)..(128): n is a, g, c or t
  misc_feature (129)..(129): n is a, g, c or t
  misc_feature (130)..(130): n is a, g, c or t
  misc_feature (131)..(131): n is a, g, c or t
  misc_feature (132)..(132): n is a, g, c or t
  misc_feature (133)..(133): n is a, g, c or t
  misc_feature (134)..(134): n is a, g, c or t
  misc_feature (135)..(135): n is a, g, c or t
  misc_feature (136)..(136): n is a, g, c or t
  misc_feature (155)..(155): n is a, g, c or t
  misc_feature (156)..(156): n is a, g, c or t
  misc_feature (157)..(157): n is a, g, c or t
  misc_feature (158)..(158): n is a, g, c or t
  misc_feature (159)..(159): n is a, g, c or t
  misc_feature (160)..(160): n is a, g, c or t
  misc_feature (161)..(161): n is a, g, c or t
  misc_feature (162)..(162): n is a, g, c or t
  misc_feature (163)..(163): n is a, g, c or t
  misc_feature (164)..(164): n is a, g, c or t
  misc_feature (165)..(165): n is a, g, c or t
  misc_feature (166)..(166): n is a, g, c or t
  misc_feature (167)..(167): n is a, g, c or t
  misc_feature (168)..(168): n is a, g, c or t
  misc_feature (169)..(169): n is a, g, c or t
  misc_feature (170)..(170): n is a, g, c or t
  misc_feature (171)..(171): n is a, g, c or t
  misc_feature (172)..(172): n is a, g, c or t
  misc_feature (173)..(173): n is a, g, c or t
  misc_feature (174)..(174): n is a, g, c or t
  misc_feature (175)..(175): n is a, g, c or t
  misc_feature (176)..(176): n is a, g, c or t
  misc_feature (177)..(177): n is a, g, c or t
  misc_feature (178)..(178): n is a, g, c or t
  misc_feature (179)..(179): n is a, g, c or t
  misc_feature (180)..(180): n is a, g, c or t
  misc_feature (181)..(181): n is a, g, c or t
  misc_feature (182)..(182): n is a, g, c or t
  misc_feature (183)..(183): n is a, g, c or t
  misc_feature (184)..(184): n is a, g, c or t
  misc_feature (185)..(185): n is a, g, c or t
  misc_feature (226)..(226): n is a, g, c or t
  misc_feature (227)..(227): n is a, g, c or t
  misc_feature (228)..(228): n is a, g, c or t
  misc_feature (229)..(229): n is a, g, c or t
  misc_feature (230)..(230): n is a, g, c or t
  misc_feature (231)..(231): n is a, g, c or t
  misc_feature (232)..(232): n is a, g, c or t
  misc_feature (233)..(233): n is a, g, c or t
  misc_feature (234)..(234): n is a, g, c or t
  misc_feature (235)..(235): n is a, g, c or t
  misc_feature (236)..(236): n is a, g, c or t
  misc_feature (237)..(237): n is a, g, c or t
  misc_feature (238)..(238): n is a, g, c or t
  misc_feature (239)..(239): n is a, g, c or t
  misc_feature (240)..(240): n is a, g, c or t
  misc_feature (241)..(241): n is a, g, c or t
  misc_feature (242)..(242): n is a, g, c or t
  misc_feature (243)..(243): n is a, g, c or t
  misc_feature (244)..(244): n is a, g, c or t
  misc_feature (245)..(245): n is a, g, c or t
  misc_feature (246)..(246): n is a, g, c or t
  misc_feature (247)..(247): n is a, g, c or t
  misc_feature (248)..(248): n is a, g, c or t
  misc_feature (249)..(249): n is a, g, c or t
tcgaccacgaggcgctggcannnnnnnnnnnnnnnnnnnnnnnagtggccctatagaagagacgggatcccgccaggcctcccgggaccgggagccacgccacgcaggcannnnnnnnnnnnnnnnnnnnnnnnnnccgcggcggattgggatcnnnnnnnnnnnnnnnnnnnnnnnnnnnnnnnctcgagactcgacggcacccgccgcatttgagctgagctgnnnnnnnnnnnnnnnnnnnnnnnngatgtggcgcctgcggatcgcggaggggggcggggacccctggctacgcacgaagaacgcccacgtcggccgccaggtctgggagttcgacgccgccgccgaccccgaccccgccgtcgacgccgcgcgccgcgccttcgtcgccaccaggggccacctcaagcacagcgccgacctcctcatgcgcatccagttcgccaaagaaaactcgattgagcttcaccttccaggcatcaagctcggtgagcatgaagatgtgaccgaggaagctgtgttgactacattgaaaagggcaatcagccgtttctctactctccaggcacatgatggacactggcctggggattatggtggtcctatgttccttatgccaggcttgatcataacattgtatgtgactggagcactaaacactgtcttgtcattggaacaccagaaggagatccgccggtatctttataatcaccagaatgaagatggcggctggggcttgcacattgagggtccaagcaccatgttcggctcagcactgacctatgttattttgagattgcttggagagggaccagatagtggagatggagccatggagaaaggtcgaaactggatattagaccatggtggagcaacatatataacatcgtgggggaagttttggctttcggtactaggtgtatttgaatggtctggtaacaacccggtgccaccagaagtatggctactgccatatctcctcccatttcacccagggaggatgtggtgtcattgtcgaatggtgtatttgccaatgtgctacatttatgggaagaggtttgttggccgaatcacaccacttctgttggaattaaggaaggaacttttcaaagacccttacagcaagattgattgggacaaggcccgcaacctatgtgccaaggaagatctgtactacccacacccattcgttcaagatgtgttatgggccactctccataaattcgttgaaccagttatgatgcattggcctggcagcaaattgagggagaaagctctggaaacagtcatgcaacatgttcactatgaagatgagaacactcgttatatttgcattggtcctgtaaacaaggtattgaatatgcttgcttgctggattgaagatccaaactcggaggccttcaaacttcatatcccacgagtctatgattacttgtggcttgctgaagatggcatgaagatgcagggttataatggcagccaactttgggatacagctttcacagttcaagccattgtggctaccaaccttattgaagagtttggtcctacccttaaactagcacacaactatatcaagaattcacaggttcttgatgactgccctggtgatctgaatgactggtaccgccacacatctaaaggtgcatggccattctcaactgctgatcatggttggcctatatctgattgcactgctgaaggactaaaggcctcattattgttatcaaggatctctcccaaaattgttggtgaaccgatggaagctaatagattttatgatgctgtcagttgtctgatgtcttatatgaatgataatggcggcttcgcgacatatgaactcacaagatcttatccctggttggagctgatcaatcctgctgagacctttggggatattgtgattgattacccgtatgttgaatgtacatcagcagcaattcaggccctgacatcattcaaaaaactataccctgggcaccgcaggaaagaggtggataactgtatcagcaaagcttccaatttcatcgagagtattcagaaaagcgatggttcatggtatggctcttgggccgtttgtttcacatacggcacttggtttggtgtgaagggactaattgctgctggtagaacatttgagaacagtcctgcaattagaaaggcatgcgactttctgttgtcaaaagaacttccttccggtggttggggagaaagctatttgtcatctcaagaccaggtttacaccaatctcaaaggcaaccggcctcatgcagtgaacactagttgggccatgctggcgctgattgatgcaggccaggccgagagagatccaacgcctctacaccgagcagcaaaggttttgatcaacttgcaatcagaggacggagaatttcctcagcaagagatcataggagtgttcaacaagaactgcatgataagctactcccagtacaggaacatcttcccgatttgggctctgggtgagtaccggtgtcgagtcttgggggctggcaagccttggcggtgaacgggaggtgtgcgtgtgtgtgtgtcatggatcagcttttgtgagtagccatgtggaagttggaataatgtagctacgttacgttcagggggttgcgttactagtggtcctagtaataatagtgatggtgatagtaatgtactcctcattattacaatctcaaagcggttcatgccattgccatgcacatctcagatccgagtcacgcacttgagagagttcaaggattgcaagtatagttgggagaatcaaatccaatcggcttattgtctgctcatctcaggtgtcaggtctttcagccacacacacatacacataccctgacctagagatttttgccattatgaaacattacatgttcggcttcgttgaaatgaagatgagaagggattcgacgaaaaaaaaaaaaaaaaaaaaaaaaaaaaaaaa

SEQ ID NO: 4478 - protein, 759 aa, Zea mays
MWRLRIAEGGGDPWLRTKNAHVGRQVWEFDAAADPDPAVDAARRAFVATRGHLKHSADLLMRIQFAKENSIELHLPGIKLGEHEDVTEEAVLTTLKRAISRFSTLQAHDGHWPGDYGGPMFLMPGLIITLYVTGALNTVLSLEHQKEIRRYLYNHQNEDGGWGLHIEGPSTMFGSALTYVILRLLGEGPDSGDGAMEKGRNWILDHGGATYITSWGKFWLSVLGVFEWSGNNPVPPEVWLLPYLLPFHPGRMWCHCRMVYLPMCYIYGKRFVGRITPLLLELRKELFKDPYSKIDWDKARNLCAKEDLYYPHPFVQDVLWATLHKFVEPVMMHWPGSKLREKALETVMQHVHYEDENTRYICIGPVNKVLNMLACWIEDPNSEAFKLHIPRVYDYLWLAEDGMKMQGYNGSQLWDTAFTVQAIVATNLIEEFGPTLKLAHNYIKNSQVLDDCPGDLNDWYRHTSKGAWPFSTADHGWPISDCTAEGLKASLLLSRISPKIVGEPMEANRFYDAVSCLMSYMNDNGGFATYELTRSYPWLELINPAETFGDIVIDYPYVECTSAAIQALTSFKKLYPGHRRKEVDNCISKASNFIESIQKSDGSWYGSWAVCFTYGTWFGVKGLIAAGRTFENSPAIRKACDFLLSKELPSGGWGESYLSSQDQVYTNLKGNRPHAVNTSWAMLALIDAGQAERDPTPLHRAAKVLINLQSEDGEFPQQEIIGVFNKNCMISYSQYRNIFPIWALGEYRCRVLGAGKPWR

SEQ ID NO: 4479 - DNA, 2632 bp, Zea mays
  CDS (57)..(2330)
ggccgcggcggatcgggacctcccctgccgcccgccagccgcatttgaggagggcgatgtggcgcctgcggatcgcggaggggggcggggacccctggctacgcacgaagaacgcccacgtcggccgccaggtctgggagttcgacgccgccgccgaccccgaccccgccgtcgacgccgcgcgccgcgccttcgtcgccaccaggggccacctcaagcacagcgccgacctcctcatgcgcatccagttcgccaaagaaaactcgattgagcttcaccttcccggcatcaagctcggtgagcatgaagatgtgaccgatgaagctgtgttgactacattgaaaagggcaatcagccgtttctctactctccaggcacatgatggacactggcctggggattatggtggtcctatgttccttatgccaggcttgatcataacattgtatgtgactggagcactaaacactgtcttgtcattggaacaccagaaggagatccgccggtatctttataatcaccagaatgaagatggcggctggggcttgcacattgagggtccaagcaccatgttcggctcagcactgacctatgttattttgagattgcttggagagggaccagatagtgaagatggagccatggagaaaggtcgaaactggatattagaccatggtggagcaacatatataacatcgtgggggaagttttggctttcggtactaggtgtatttgaatggtctggtaacaacccggtgccaccagaagtatggctactgccatatctcctcccatttcacccagggaggatgtggtgtcattgtcgaatggtgtatttgccaatgtgctacatttatgggaagaggtttgttggccgaatcacaccacttctgttggaattaaggaaggaacttttcaaagacccttacagcaagattgattgggacaaggcccgcaacctatgtgccaaggaagatctgtactacccacacccatttgttcaagatgtgttatgggccactctccataaattcgttgaaccagttatgatgcattggcctggcagcaaattgagggagaaagctctggaaacagtcatgcaacatgttcactatgaagatgagaacactcgttatatttgcattggtcctgtaaacaaggtattgaatatgcttgcttgctggattgaagatccaaactcggaggccttcaaacttcatatcccacgagtctatgattacttgtggcttgctgaagatggcatgaagatgcagggttataatggcagccaactttgggatacagctttcatagttcaagccattgtggctaccaaccttaccgaagagtttggtcccacccttaaactagcacacaactatatcaagaaatcacaggttcttgacgactgccctggtgatctgaatgactggtaccgccacacatctaaaggcgcatggccattctccaccgcggatcatggttggcctatatctgattgcactgctgaaggactaaaggcttcattattgttatcaaagatttctcctgaaattgttggtggaccgatagaagctaatagattttatgatgctgtcagttgtctgatgtcttatatgaatgataatggtggttttgcgacttatgaactcacaagatcctatgcctggctggagctgatcaatcctgctgagacctttggggatattgtgattgattacccgtatgttgaatgtacatcagcagcaatccaggccctgacatcattcagaaaactataccctgggcaccgcaggaaagaggtggacagctgtatcagcaaagctgctaatttcattgagagcattcagaaaagtgacggttcatggtatggctcttgggctgtttgtttcacgtacggcacttggtttggtgtgaagggactaattgctgctggtagaacatttgagagcagtcctgcaatcagaaaggcatgcggctttctgttatcaaaagagcttccttccggtggctggggagaaagctatttatcgtctcaagaccaggtttacaccaatctcaaaggcaaccgagctcatgcagcgaacactggttgggccatgctggcgctgattgatgcaggacaggcccagagagatcccgcgcctctacaccgagcagcaaaggttttgatcaacttgcagtcagaggacggagaatttccccagcaagagatcataggagtgttcaacaagaactgcatgatcagttactcccagtacaggaacaccttcccgatctgggctctgggagagtaccggtgccgagtcctgggagctggcaagcggtagtgacccggcctggccccgtcaacttgactgaaaggcgctttgttgtcttggtgttcttggtgttctatcttggcacgccgagggctgtcttgccggccgcctagctgtctcatgaatcaatcagcttttttgtgagtagctagctatgtgcggtggttggaataatgcagctatgcttttttttagggttgcgctcctagttctaataatgtactacgtatattggaagcagaataaatgttagattgaactaatggtgccattaaagatgacaatagaactcttccgaagcaaaaaaaaaa

SEQ ID NO: 4480 - protein, 757 aa, Zea mays
MWRLRIAEGGGDPWLRTKNAHVGRQVWEFDAAADPDPAVDAARRAFVATRGHLKHSADLLMRIQFAKENSIELHLPGIKLGEHEDVTDEAVLTTLKRAISRFSTLQAHDGHWPGDYGGPMFLMPGLIITLYVTGALNTVLSLEHQKEIRRYLYNHQNEDGGWGLHIEGPSTMFGSALTYVILRLLGEGPDSEDGAMEKGRNWILDHGGATYITSWGKFWLSVLGVFEWSGNNPVPPEVWLLPYLLPFHPGRMWCHCRMVYLPMCYIYGKRFVGRITPLLLELRKELFKDPYSKIDWDKARNLCAKEDLYYPHPFVQDVLWATLHKFVEPVMMHWPGSKLREKALETVMQHVHYEDENTRYICIGPVNKVLNMLACWIEDPNSEAFKLHIPRVYDYLWLAEDGMKMQGYNGSQLWDTAFIVQAIVATNLTEEFGPTLKLAHNYIKKSQVLDDCPGDLNDWYRHTSKGAWPFSTADHGWPISDCTAEGLKASLLLSKISPEIVGGPIEANRFYDAVSCLMSYMNDNGGFATYELTRSYAWLELINPAETFGDIVIDYPYVECTSAAIQALTSFRKLYPGHRRKEVDSCISKAANFIESIQKSDGSWYGSWAVCFTYGTWFGVKGLIAAGRTFESSPAIRKACGFLLSKELPSGGWGESYLSSQDQVYTNLKGNRAHAANTGWAMLALIDAGQAQRDPAPLHRAAKVLINLQSEDGEFPQQEIIGVFNKNCMISYSQYRNTFPIWALGEYRCRVLGAGKR

SEQ ID NO: 4481 - DNA, 27 bp, Artificial sequence
  primer
atgacagaattttattctgacacaatc

SEQ ID NO: 4482 - DNA, 25 bp, Artificial sequence
  primer
ttaaagcgtatgtgtttcatatgcc

SEQ ID NO: 4483 - protein, 887 aa, Artificial sequence
  consensus sequence
  Variant (3)..(3): Xaa in position 3 is any amino acid
  Variant (5)..(14): Xaa in position 5 to 14 is any amino acid
  Variant (15)..(35): Xaa in position 15 to 35 is any or no amino acid
  Variant (37)..(37): Xaa in position 37 is any amino acid
  Variant (38)..(39): Xaa in position 38 to 39 is any or no amino acid
  Variant (42)..(43): Xaa in position 42 to 43 is any amino acid
  Variant (45)..(55): Xaa in position 45 to 55 is any amino acid
  Variant (56)..(64): Xaa in position 56 to 64 is any or no amino acid
  Variant (66)..(71): Xaa in position 66 to 71 is any amino acid
  Variant (72)..(81): Xaa in position 72 to 81 is any or no amino acid
  Variant (83)..(83): Xaa in position 83 is any amino acid
  Variant (85)..(87): Xaa in position 85 to 87 is any amino acid
  Variant (89)..(107): Xaa in position 89 to 107 is any amino acid
  Variant (108)..(154): Xaa in position 108 to 154 is any or no amino acid
  Variant (156)..(157): Xaa in position 156 to 157 is any amino acid
  Variant (158)..(158): Xaa in position 158 is any or no amino acid
  Variant (164)..(167): Xaa in position 164 to 167 is any amino acid
  Variant (168)..(168): Xaa in position 168 is any or no amino acid
  Variant (170)..(171): Xaa in position 170 to 171 is any amino acid
  Variant (173)..(174): Xaa in position 173 to 174 is any amino acid
  Variant (176)..(181): Xaa in position 176 to 181 is any amino acid
  Variant (182)..(183): Xaa in position 182 to 183 is any or no amino acid
  Variant (185)..(193): Xaa in position 185 to 193 is any amino acid
  Variant (194)..(197): Xaa in position 194 to 197 is any or no amino acid
  Variant (199)..(200): Xaa in position 199 to 200 is any amino acid
  Variant (203)..(203): Xaa in position 203 is any amino acid
  Variant (205)..(205): Xaa in position 205 is any amino acid
  Variant (206)..(206): Xaa in position 206 is any or no amino acid
  Variant (209)..(209): Xaa in position 209 is any amino acid
  Variant (210)..(210): Xaa in position 210 is any or no amino acid
  Variant (216)..(216): Xaa in position 216 is any amino acid
  Variant (218)..(219): Xaa in position 218 to 219 is any amino acid
  Variant (221)..(221): Xaa in position 221 is any amino acid
  Variant (223)..(223): Xaa in position 223 is any amino acid
  Variant (226)..(230): Xaa in position 226 to 230 is any amino acid
  Variant (232)..(234): Xaa in position 232 to 234 is any amino acid
  Variant (236)..(236): Xaa in position 236 is any amino acid
  Variant (239)..(248): Xaa in position 239 to 248 is any amino acid
  Variant (249)..(259): Xaa in position 249 to 259 is any or no amino acid
  Variant (261)..(261): Xaa in position 261 is any amino acid
  Variant (264)..(266): Xaa in position 264 to 266 is any amino acid
  Variant (267)..(267): Xaa in position 267 is any or no amino acid
  Variant (270)..(275): Xaa in position 270 to 275 is any amino acid
  Variant (279)..(279): Xaa in position 279 is any amino acid
  Variant (282)..(283): Xaa in position 282 to 283 is any amino acid
  Variant (286)..(288): Xaa in position 286 to 288 is any amino acid
  Variant (290)..(290): Xaa in position 290 is any amino acid
  Variant (292)..(292): Xaa in position 292 is any amino acid
  Variant (295)..(295): Xaa in position 295 is any amino acid
  Variant (299)..(299): Xaa in position 299 is any amino acid
  Variant (301)..(302): Xaa in position 301 to 302 is any amino acid
  Variant (304)..(306): Xaa in position 304 to 306 is any amino acid
  Variant (307)..(307): Xaa in position 307 is any or no amino acid
  Variant (309)..(309): Xaa in position 309 is any amino acid
  Variant (312)..(312): Xaa in position 312 is any amino acid
  Variant (313)..(314): Xaa in position 313 to 314 is any or no amino acid
  Variant (316)..(318): Xaa in position 316 to 318 is any amino acid
  Variant (320)..(321): Xaa in position 320 to 321 is any amino acid
  Variant (323)..(323): Xaa in position 323 is any amino acid
  Variant (326)..(326): Xaa in position 326 is any amino acid
  Variant (328)..(328): Xaa in position 328 is any amino acid
  Variant (332)..(332): Xaa in position 332 is any amino acid
  Variant (334)..(342): Xaa in position 334 to 342 is any amino acid
  Variant (343)..(343): Xaa in position 343 is any or no amino acid
  Variant (346)..(346): Xaa in position 346 is any amino acid
  Variant (348)..(350): Xaa in position 348 to 350 is any amino acid
  Variant (351)..(351): Xaa in position 351 is any or no amino acid
  Variant (353)..(353): Xaa in position 353 is any amino acid
  Variant (354)..(355): Xaa in position 354 to 355 is any or no amino acid
  Variant (357)..(360): Xaa in position 357 to 360 is any amino acid
  Variant (362)..(364): Xaa in position 362 to 364 is any amino acid
  Variant (366)..(369): Xaa in position 366 to 369 is any amino acid
  Variant (373)..(374): Xaa in position 373 to 374 is any amino acid
  Variant (377)..(380): Xaa in position 377 to 380 is any amino acid
  Variant (382)..(387): Xaa in position 382 to 387 is any amino acid
  Variant (389)..(390): Xaa in position 389 to 390 is any amino acid
  Variant (391)..(392): Xaa in position 391 to 392 is any or no amino acid
  Variant (395)..(397): Xaa in position 395 to 397 is any amino acid
  Variant (398)..(398): Xaa in position 398 is any or no amino acid
  Variant (401)..(402): Xaa in position 401 to 402 is any amino acid
  Variant (403)..(403): Xaa in position 403 is any or no amino acid
  Variant (405)..(414): Xaa in position 405 to 414 is any amino acid
  Variant (415)..(418): Xaa in position 415 to 418 is any or no amino acid
  Variant (422)..(425): Xaa in position 422 to 425 is any amino acid
  Variant (427)..(431): Xaa in position 427 to 431 is any amino acid
  Variant (433)..(433): Xaa in position 433 is any amino acid
  Variant (435)..(437): Xaa in position 435 to 437 is any amino acid
  Variant (438)..(440): Xaa in position 438 to 440 is any or no amino acid
  Variant (442)..(443): Xaa in position 442 to 443 is any amino acid
  Variant (446)..(446): Xaa in position 446 is any amino acid
  Variant (447)..(447): Xaa in position 447 is any or no amino acid
  Variant (449)..(449): Xaa in position 449 is any amino acid
  Variant (451)..(454): Xaa in position 451 to 454 is any amino acid
  Variant (456)..(457): Xaa in position 456 to 457 is any amino acid
  Variant (459)..(460): Xaa in position 459 to 460 is any amino acid
  Variant (462)..(463): Xaa in position 462 to 463 is any amino acid
  Variant (465)..(466): Xaa in position 465 to 466 is any amino acid
  Variant (468)..(469): Xaa in position 468 to 469 is any amino acid
  Variant (474)..(478): Xaa in position 474 to 478 is any amino acid
  Variant (479)..(479): Xaa in position 479 is any or no amino acid
  Variant (481)..(481): Xaa in position 481 is any amino acid
  Variant (483)..(483): Xaa in position 483 is any amino acid
  Variant (486)..(487): Xaa in position 486 to 487 is any amino acid
  Variant (489)..(490): Xaa in position 489 to 490 is any amino acid
  Variant (493)..(500): Xaa in position 493 to 500 is any amino acid
  Variant (501)..(504): Xaa in position 501 to 504 is any or no amino acid
  Variant (506)..(509): Xaa in position 506 to 509 is any amino acid
  Variant (511)..(517): Xaa in position 511 to 517 is any amino acid
  Variant (519)..(519): Xaa in position 519 is any amino acid
  Variant (522)..(531): Xaa in position 522 to 531 is any amino acid
  Variant (532)..(536): Xaa in position 532 to 536 is any or no amino acid
  Variant (539)..(540): Xaa in position 539 to 540 is any amino acid
  Variant (543)..(543): Xaa in position 543 is any amino acid
  Variant (545)..(545): Xaa in position 545 is any amino acid
  Variant (548)..(549): Xaa in position 548 to 549 is any amino acid
  Variant (551)..(551): Xaa in position 551 is any amino acid
  Variant (554)..(555): Xaa in position 554 to 555 is any amino acid
  Variant (562)..(562): Xaa in position 562 is any amino acid
  Variant (565)..(566): Xaa in position 565 to 566 is any amino acid
  Variant (568)..(575): Xaa in position 568 to 575 is any amino acid
  Variant (576)..(579): Xaa in position 576 to 579 is any or no amino acid
  Variant (581)..(586): Xaa in position 581 to 586 is any amino acid
  Variant (587)..(587): Xaa in position 587 is any or no amino acid
  Variant (589)..(589): Xaa in position 589 is any amino acid
  Variant (591)..(591): Xaa in position 591 is any amino acid
  Variant (593)..(595): Xaa in position 593 to 595 is any amino acid
  Variant (597)..(598): Xaa in position 597 to 598 is any amino acid
  Variant (599)..(615): Xaa in position 599 to 615 is any or no amino acid
  Variant (617)..(621): Xaa in position 617 to 621 is any amino acid
  Variant (623)..(627): Xaa in position 623 to 627 is any amino acid
  Variant (628)..(629): Xaa in position 628 to 629 is any or no amino acid
  Variant (632)..(633): Xaa in position 632 to 633 is any amino acid
  Variant (636)..(636): Xaa in position 636 is any amino acid
  Variant (638)..(638): Xaa in position 638 is any amino acid
  Variant (640)..(644): Xaa in position 640 to 644 is any amino acid
  Variant (645)..(647): Xaa in position 645 to 647 is any or no amino acid
  Variant (649)..(649): Xaa in position 649 is any amino acid
  Variant (653)..(658): Xaa in position 653 to 658 is any amino acid
  Variant (660)..(661): Xaa in position 660 to 661 is any amino acid
  Variant (663)..(665): Xaa in position 663 to 665 is any amino acid
  Variant (666)..(666): Xaa in position 666 is any or no amino acid
  Variant (668)..(669): Xaa in position 668 to 669 is any amino acid
  Variant (670)..(670): Xaa in position 670 is any or no amino acid
  Variant (672)..(673): Xaa in position 672 to 673 is any amino acid
  Variant (675)..(678): Xaa in position 675 to 678 is any amino acid
  Variant (680)..(681): Xaa in position 680 to 681 is any amino acid
  Variant (683)..(689): Xaa in position 683 to 689 is any amino acid
  Variant (690)..(696): Xaa in position 690 to 696 is any or no amino acid
  Variant (698)..(698): Xaa in position 698 is any amino acid
  Variant (699)..(699): Xaa in position 699 is any or no amino acid
  Variant (706)..(706): Xaa in position 706 is any amino acid
  Variant (708)..(709): Xaa in position 708 to 709 is any amino acid
  Variant (712)..(712): Xaa in position 712 is any amino acid
  Variant (714)..(716): Xaa in position 714 to 716 is any amino acid
  Variant (718)..(721): Xaa in position 718 to 721 is any amino acid
  Variant (723)..(725): Xaa in position 723 to 725 is any amino acid
  Variant (727)..(735): Xaa in position 727 to 735 is any amino acid
  Variant (736)..(738): Xaa in position 736 to 738 is any or no amino acid
  Variant (741)..(743): Xaa in position 741 to 743 is any amino acid
  Variant (747)..(748): Xaa in position 747 to 748 is any amino acid
  Variant (750)..(752): Xaa in position 750 to 752 is any amino acid
  Variant (753)..(753): Xaa in position 753 is any or no amino acid
  Variant (760)..(761): Xaa in position 760 to 761 is any amino acid
  Variant (763)..(767): Xaa in position 763 to 767 is any amino acid
  Variant (769)..(776): Xaa in position 769 to 776 is any amino acid
  Variant (777)..(782): Xaa in position 777 to 782 is any or no amino acid
  Variant (784)..(784): Xaa in position 784 is any amino acid
  Variant (786)..(786): Xaa in position 786 is any amino acid
  Variant (789)..(791): Xaa in position 789 to 791 is any amino acid
  Variant (794)..(796): Xaa in position 794 to 796 is any amino acid
  Variant (797)..(828): Xaa in position 797 to 828 is any or no amino acid
  Variant (830)..(832): Xaa in position 830 to 832 is any amino acid
  Variant (834)..(835): Xaa in position 834 to 835 is any amino acid
  Variant (837)..(838): Xaa in position 837 to 838 is any amino acid
  Variant (841)..(843): Xaa in position 841 to 843 is any amino acid
  Variant (845)..(847): Xaa in position 845 to 847 is any amino acid
  Variant (849)..(851): Xaa in position 849 to 851 is any amino acid
  Variant (853)..(854): Xaa in position 853 to 854 is any amino acid
  Variant (857)..(857): Xaa in position 857 is any amino acid
  Variant (859)..(860): Xaa in position 859 to 860 is any amino acid
  Variant (861)..(861): Xaa in position 861 is any or no amino acid
  Variant (863)..(863): Xaa in position 863 is any amino acid
  Variant (865)..(870): Xaa in position 865 to 870 is any amino acid
  Variant (871)..(871): Xaa in position 871 is any or no amino acid
  Variant (873)..(874): Xaa in position 873 to 874 is any amino acid
  Variant (877)..(879): Xaa in position 877 to 879 is any amino acid
  Variant (881)..(882): Xaa in position 881 to 882 is any amino acid
  Variant (885)..(886): Xaa in position 885 to 886 is any amino acid
MWXLXXXXXXXXXXXXXXXXXXXXXXXXXXXXXXXNXXXGRXXWXXXXXXXXXXXXXXXXXXXXRXXXXXXXXXXXXXXXXDXLXXXQXXXXXXXXXXXXXXXXXXXXXXXXXXXXXXXXXXXXXXXXXXXXXXXXXXXXXXXXXXXXXXXXXXQXXXDGHWPXXXXXGXXFXXPXXXXXXXXTXXXXXXXXXXXXXEXXRYXYXXQNXXDGGWGXHXXGXSXMFXXXXXYXXXRXLGXXXXXXXXXXXXXXXXXXXXXRXWIXXXXGGXXXXXXWGKXWLXXLGXXXWXGXNPXPPEXWXXPXXXXPXHPXXXWXXXRXXYXPMXYXYGKXFXXXXXXXXXXLRXEXXXXPXXXYXXXXWXXXRXXXXKEDXXYPXXXXQXXXXXXLXXXXEPXXXXWPXXXLXXXXXXXXXXXXXXYEDXXXXYXXXXXVXKXXXXXXMXXCWXXEXPXXXXFXXHXXRXXDXXWXXEDGMXXXXXXGXQXWDXXFXXQAXXXXXXXXXXXXEXXXXLXXXXXXXKXSQXXXXXXXXXXXXXXXRHXXKGXWXFSXXDXGWXXSDCTAEXLKXXLXXXXXXXXXXXXGXXXXXXXLXDXVXXXLXXXXXXXXXXXXXXXXXXXGXXXXXEXXXXXXXLEXXNPXEXFXXXXXXXXYXECTXXXXXXLXXFXXXXPXXXRXXEXXXXIXXAXXXXXXXXXXXXXXQXXDGSWYGXWXXCFXYXXXFXXXXLXXXGXXXXXXXXXXXXRKXXXFLLXXQXXXXGGWGESXXSXXXXXYXXXXXXXXXXXXXXVXTXWAXXXLIXXXXXXXXXXXXXXXXXXXXXXXXXXXXXXXXXXXQXXXDXXPXXRAXXXLXXXQXXXGXXPQXEXXXGXFXXXXXXXYXXYRXXXPXXALXXY

SEQ ID NO: 4484 - protein, 29 aa, Artificial sequence
  protein pattern
  Variant (2)..(3): Xaa in position 2 to 3 is any amino acid
  Variant (4)..(4): Xaa in position 4 is any or no amino acid
  Variant (10)..(13): Xaa in position 10 to 13 is any amino acid
  Variant (14)..(14): Xaa in position 14 is Ala, Asp, Gly or Ser
  Variant (15)..(15): Xaa in position 15 is any amino acid
  Variant (16)..(16): Xaa in position 16 is Ser or Thr
  Variant (17)..(19): Xaa in position 17 to 19 is any amino acid
  Variant (20)..(20): Xaa in position 20 is Ala, Cys, Gly, Ser or Thr
  Variant (21)..(21): Xaa in position 21 is Ser or Thr
  Variant (22)..(24): Xaa in position 22 to 24 is any amino acid
  Variant (26)..(26): Xaa in position 26 is Ala, Ile or Val
  Variant (27)..(27): Xaa in position 27 is any amino acid
  Variant (28)..(28): Xaa in position 28 is Leu or Met
  Variant (29)..(29): Xaa in position 29 is Lys or Arg
HXXXDGGWGXXXXXXXXXXXXXXXYXXXX

SEQ ID NO: 4485 - protein, 26 aa, Artificial sequence
  protein pattern
  Variant (4)..(4): Xaa in position 4 is any amino acid
  Variant (6)..(6): Xaa in position 6 is any amino acid
  Variant (8)..(8): Xaa in position 8 is Ala or Gly
  Variant (9)..(9): Xaa in position 9 is Ile or Val
  Variant (11)..(11): Xaa in position 11 is Phe or Tyr
  Variant (12)..(12): Xaa in position 12 is any amino acid
  Variant (14)..(14): Xaa in position 14 is Ala, Gly or Ser
  Variant (15)..(15): Xaa in position 15 is Ala, Cys, Gly, Ser or Thr
  Variant (16)..(16): Xaa in position 16 is any amino acid
  Variant (18)..(18): Xaa in position 18 is Ala, Gly or Ser
  Variant (19)..(20): Xaa in position 19 to 20 is any amino acid
  Variant (21)..(21): Xaa in position 21 is Ala, Gly or Ser
  Variant (23)..(25): Xaa in position 23 to 25 is any amino acid
GSWXGXWXXCXXYXXXFXXXXLXXXG

SEQ ID NO: 4486 - protein, 20 aa, Artificial sequence
  protein pattern
  Variant (2)..(7): Xaa in position 2 to 7 is any or no amino acid
  Variant (11)..(11): Xaa in position 11 is Ala, Asp, Gly or Ser
  Variant (12)..(12): Xaa in position 12 is Ala or Ser
  Variant (13)..(13): Xaa in position 13 is any amino acid
  Variant (14)..(14): Xaa in position 14 is Ile, Leu, Met or Val
  Variant (15)..(15): Xaa in position 15 is any amino acid
  Variant (16)..(16): Xaa in position 16 is Ala, Cys, Gly, Thr or Val
  Variant (18)..(19): Xaa in position 18 to 19 is any amino acid
VXXXXXXECTXXXXXXLXXF

SEQ ID NO: 4487 - protein, 16 aa, Artificial sequence
  protein pattern
  Variant (2)..(2): Xaa in position 2 is any amino acid
  Variant (3)..(3): Xaa in position 3 is Ala or Gly
  Variant (4)..(5): Xaa in position 4 to 5 is any amino acid
  Variant (6)..(6): Xaa in position 6 is Ala, Pro, Ser or Thr
  Variant (7)..(8): Xaa in position 7 to 8 is any amino acid
  Variant (11)..(11): Xaa in position 11 is any amino acid
  Variant (13)..(13): Xaa in position 13 is any or no amino acid
  Variant (15)..(15): Xaa in position 15 is any or no amino acid
WXXXXXXXPEXWXLXP

SEQ ID NO: 4488 - protein, 14 aa, Artificial sequence
  protein pattern
  Variant (2)..(3): Xaa in position 2 to 3 is any amino acid
  Variant (6)..(7): Xaa in position 6 to 7 is any amino acid
  Variant (8)..(8): Xaa in position 8 is Phe, His or Tyr
  Variant (9)..(11): Xaa in position 9 to 11 is any amino acid
  Variant (14)..(14): Xaa in position 14 is Ala, Gly or Thr
YXXYRXXXXXXALX

SEQ ID NO: 4489 - protein, 13 aa, Artificial sequence
  protein pattern
  Variant (2)..(4): Xaa in position 2 to 4 is any amino acid
  Variant (8)..(8): Xaa in position 8 is Ala, Gly or Ser
  Variant (10)..(12): Xaa in position 10 to 12 is any or no amino acid
QXXXGGWXEXXXS

SEQ ID NO: 4490 - protein, 11 aa, Artificial sequence
  protein pattern
  Variant (2)..(2): Xaa in position 2 is any amino acid
  Variant (4)..(4): Xaa in position 4 is Ala, Gly or Ser
  Variant (5)..(5): Xaa in position 5 is any amino acid
  Variant (7)..(8): Xaa in position 7 to 8 is Ile, Leu, Met or Val
  Variant (9)..(9): Xaa in position 9 is Ala, Gly, Ser, Thr or Val
  Variant (11)..(11): Xaa in position 11 is Ile, Leu, Met or Val
VXTXXAXXXLX

SEQ ID NO: 4491 - DNA, 234 bp, Saccharomyces cerevisiae
  CDS (1)..(234)
atgctggcgaaaacgggcgatgtagtggtacagaaggtgccggttatccgtttgtccgtttttcttcattttttttttgtttttcccttttgtcttttgcaccgcttatatatgggtatgaaacaagttcaagaatttataatggaacccaaaggttcagtctttgtagttcgagcgacattgcgcgtttccttagaaaacgctggaaagatattctttaacgagacggagtaa

SEQ ID NO: 4492 - protein, 77 aa, Saccharomyces cerevisiae
MLAKTGDVVVQKVPVIRLSVFLHFFFVFPFCLLHRLYMGMKQVQEFIMEPKGSVFVVRATLRVSLENAGKIFFNETE

SEQ ID NO: 4493 - DNA, 22 bp, Artificial sequence
  primer
atgctggcgaaaacgggcgatg

SEQ ID NO: 4494 - DNA, 25 bp, Artificial sequence
  primer
ttactccgtctcgttaaagaatatc

SEQ ID NO: 4495 - DNA, 816 bp, Saccharomyces cerevisiae; identical to SEQ ID NO: 4207
  CDS (1)..(816)

SEQ ID NO: 4496 - protein, 271 aa, Saccharomyces cerevisiae
MKRFNVLKYIRTTKANIQTIAMPLTTKPLSLKINAALFDVDGTIIISQPAIAAFWRDFGKDKPYFDAEHVIHISHGWRTYDAIAKFAPDFADEEYVNKLEGEIPEKYGEHSIEVPGAVKLCNALNALPKEKWAVATSGTRDMAKKWFDILKIKRPEYFITANDVKQGKPHPEPYLKGRNGLGFPINEQDPSKSKVVVFEDAPAGIAAGKAAGCKIVGIATTFDLDFLKEKGCDIIVKNHESIRVGEYNAETDEVELIFDDYLYAKDDLLKW

SEQ ID NO: 4497 - DNA, 759 bp, Oryza sativa (japonica cultivar-group)
  CDS (1)..(759)
atggcggccgccactcccaacggcatcccagcttccagacctctggcttcatcagttccaattgaggcagttctgttcgacattgatgggaccttgtgcgactcagatcctcttcatcatgtggccttccaagaaatgcttcttgagattgggtataacaacggtgtgccaatagacgaggagtttttcataaacaatattgctggaaggagtgatgttgaagctgctcagaatttgttccctgattggccccttgagaaggggctgaaattcctcgaggacaaggaagctaaatacagaagtttggcaaaggagcgtttggaacctgtaaagggccttgctaaagtggttcagtgggtcaaagatcatggatacaagcgtgcggctgtaaccaatgcccccaggattaattccgagctcatgatctcccttcttggcctcacagatttcttccaggccgtcatcgttggaggcgaatgtgagaagccgaaacccgccccattcccctacctgaaggctctcaaggagcttcaggtgtctgcggaccacaccttcatctttgaggattctgcttcaggcacacgtgcaggcgttgctgctggaattcctgttgttgctgtggcaacaaggaacccagagaagtccctactggatgcaggagccacgttgatcatcaaggattatgaagaccccaagctttggagcgcacttgaagagatagacagagaggaagccaagctaaagaaagctgatgcatga

SEQ ID NO: 4498 - protein, 252 aa, Oryza sativa (japonica cultivar-group)
MAAATPNGIPASRPLASSVPIEAVLFDIDGTLCDSDPLHHVAFQEMLLEIGYNNGVPIDEEFFINNIAGRSDVEAAQNLFPDWPLEKGLKFLEDKEAKYRSLAKERLEPVKGLAKVVQWVKDHGYKRAAVTNAPRINSELMISLLGLTDFFQAVIVGGECEKPKPAPFPYLKALKELQVSADHTFIFEDSASGTRAGVAAGIPVVAVATRNPEKSLLDAGATLIIKDYEDPKLWSALEEIDREEAKLKKADA

SEQ ID NO: 4499 - DNA, 687 bp, Agrobacterium tumefaciens str. C58; identical to SEQ ID NO: 4133
  CDS (1)..(687): transl_table=11

SEQ ID NO: 4500 - protein, 228 aa, Agrobacterium tumefaciens str. C58; identical to SEQ ID NO: 4134

SEQ ID NO: 4501 - DNA, 651 bp, Streptomyces coelicolor A3(2); identical to SEQ ID NO: 4145
  CDS (1)..(651): transl_table=11

SEQ ID NO: 4502 - protein, 216 aa, Streptomyces coelicolor A3(2); identical to SEQ ID NO: 4146

SEQ ID NO: 4503 - DNA, 666 bp, Streptomyces coelicolor A3(2); identical to SEQ ID NO: 4147
  CDS (1)..(666): transl_table=11

SEQ ID NO: 4504 - protein, 221 aa, Streptomyces coelicolor A3(2); identical to SEQ ID NO: 4148

SEQ ID NO: 4505 - DNA, 735 bp, Magnaporthe grisea 70-15; identical to SEQ ID NO: 4155
  CDS (1)..(735)

SEQ ID NO: 4506 - protein, 244 aa, Magnaporthe grisea 70-15; identical to SEQ ID NO: 4156

SEQ ID NO: 4507 - DNA, 723 bp, Gibberella zeae PH-1; identical to SEQ ID NO: 4157
  CDS (1)..(723)

SEQ ID NO: 4508 - protein, 240 aa, Gibberella zeae PH-1; identical to SEQ ID NO: 4158

SEQ ID NO: 4509 - DNA, 756 bp, Candida glabrata CBS 138; identical to SEQ ID NO: 4159
  CDS (1)..(756)

SEQ ID NO: 4510 - protein, 251 aa, Candida glabrata CBS 138; identical to SEQ ID NO: 4160

SEQ ID NO: 4511 - DNA, 744 bp, Candida glabrata CBS 138; identical to SEQ ID NO: 4161
  CDS (1)..(744)

SEQ ID NO: 4512 - protein, 247 aa, Candida glabrata CBS 138; identical to SEQ ID NO: 4162

SEQ ID NO: 4513 - DNA, 747 bp, Candida glabrata CBS 138; identical to SEQ ID NO: 4163
  CDS (1)..(747)

SEQ ID NO: 4514 - protein, 248 aa, Candida glabrata CBS 138; identical to SEQ ID NO: 4164

SEQ ID NO: 4515 - DNA, 750 bp, Candida glabrata CBS 138; identical to SEQ ID NO: 4165
  CDS (1)..(750)

SEQ ID NO: 4516 - protein, 249 aa, Candida glabrata CBS 138; identical to SEQ ID NO: 4166

SEQ ID NO: 4517 - DNA, 741 bp, Candida glabrata CBS 138; identical to SEQ ID NO: 4167
  CDS (1)..(741)

SEQ ID NO: 4518 - protein, 246 aa, Candida glabrata CBS 138; identical to SEQ ID NO: 4168

SEQ ID NO: 4519 - DNA, 771 bp, Kluyveromyces lactis NRRL Y-1140; identical to SEQ ID NO: 4169
  CDS (1)..(771)

SEQ ID NO: 4520 - protein, 256 aa, Kluyveromyces lactis NRRL Y-1140; identical to SEQ ID NO: 4170

SEQ ID NO: 4521 - DNA, 807 bp, Kluyveromyces lactis NRRL Y-1140; identical to SEQ ID NO: 4171
  CDS (1)..(807)

SEQ ID NO: 4522 - protein, 268 aa, Kluyveromyces lactis NRRL Y-1140; identical to SEQ ID NO: 4172

SEQ ID NO: 4523 - DNA, 762 bp, Debaryomyces hansenii CBS767; identical to SEQ ID NO: 4173
  CDS (1)..(762)

SEQ ID NO: 4524 - protein, 253 aa, Debaryomyces hansenii CBS767; identical to SEQ ID NO: 4174

SEQ ID NO: 4525 - DNA, 726 bp, Debaryomyces hansenii CBS767; identical to SEQ ID NO: 4175
  CDS (1)..(726)

SEQ ID NO: 4526 - protein, 241 aa, Debaryomyces hansenii CBS767; identical to SEQ ID NO: 4176

SEQ ID NO: 4527 - DNA, 795 bp, Debaryomyces hansenii CBS767; identical to SEQ ID NO: 4177
  CDS (1)..(795)

SEQ ID NO: 4528 - protein, 264 aa, Debaryomyces hansenii CBS767; identical to SEQ ID NO: 4178

SEQ ID NO: 4529 - DNA, 711 bp, Aspergillus nidulans FGSC A4; identical to SEQ ID NO: 4179
  CDS (1)..(711)

SEQ ID NO: 4530 - protein, 236 aa, Aspergillus nidulans FGSC A4; identical to SEQ ID NO: 4180

SEQ ID NO: 4531 - DNA, 723 bp, Candida albicans SC5314; identical to SEQ ID NO: 4181
  CDS (1)..(723): transl_table=12

SEQ ID NO: 4532 - protein, 240 aa, Candida albicans SC5314; identical to SEQ ID NO: 4182

SEQ ID NO: 4533 - DNA, 765 bp, Candida albicans SC5314; identical to SEQ ID NO: 4183
  CDS (1)..(765): transl_table=12

SEQ ID NO: 4534 - protein, 254 aa, Candida albicans SC5314; identical to SEQ ID NO: 4184

SEQ ID NO: 4535 - DNA, 849 bp, Ustilago maydis 521; identical to SEQ ID NO: 4185
  CDS (1)..(849)

SEQ ID NO: 4536 - protein, 282 aa, Ustilago maydis 521; identical to SEQ ID NO: 4186

SEQ ID NO: 4537 - DNA, 753 bp, Cryptococcus neoformans var. neoformans B-3501A; identical to SEQ ID NO: 4189
  CDS (1)..(753)

SEQ ID NO: 4538 - protein, 250 aa, Cryptococcus neoformans var. neoformans B-3501A; identical to SEQ ID NO: 4190

SEQ ID NO: 4539 - DNA, 723 bp, Candida albicans; identical to SEQ ID NO: 4203
  CDS (1)..(723): transl_table=12

SEQ ID NO: 4540 - protein, 240 aa, Candida albicans; identical to SEQ ID NO: 4204

SEQ ID NO: 4541 - DNA, 741 bp, Saccharomyces cerevisiae
  CDS (1)..(741)
atggcagaattttcagctgatctatgtctttttgacctagatggtaccatagtgagtacaacagtggccgcagagaaagcatggaccaagttgtgttacgaatacggtgttgatccttccgagttatttaagcattctcatggtgcaagaacacaagaggttttgagaaggtttttccctaaattggatgatacagacaataaaggtgttcttgctctagaaaaagatattgcccatagttacttggacacagtaagccttattcctggtgcagagaacttactgttatcgttagatgtagatactgagactcaaaaaaagttacctgaaaggaaatgggctatcgttacctctggttctccctatttggcattttcatggttcgagacaatattgaaaaatgttggaaagcccaaagttttcattactgggtttgacgtgaagaacggtaagcctgatcccgagggttattcaagagctcgtgatttattgcgtcaagatttgcaattaactggtaaacaggatctgaagtatgttgtctttgaagatgcacccgtgggcataaaggccggtaaagcaatgggcgcaattactgtgggtataacatcctcgtatgataagagcgttttatttgacgcaggagcagattatgtagtctgtgatttgacacaggtttccgtggttaagaacaatgaaaacggtattgtcatccaggtaaacaaccctttgacaagggcctga

SEQ ID NO: 4542 - protein, 246 aa, Saccharomyces cerevisiae; identical to SEQ ID NO: 4132

SEQ ID NO: 4543 - DNA, 741 bp, Saccharomyces cerevisiae; identical to SEQ ID NO: 4205
  CDS (1)..(741)

SEQ ID NO: 4544 - protein, 246 aa, Saccharomyces cerevisiae; identical to SEQ ID NO: 4206

SEQ ID NO: 4545 - DNA, 753 bp, Saccharomyces cerevisiae
  CDS (1)..(753)
atgcctttgaccacaaaacctttatctttgaaaatcaacgccgctctattcgatgttgacggtaccatcatcatctctcaaccagccattgctgctttctggagagatttcggtaaagacaagccttacttcgatgccgaacacgttattcacatctctcacggttggagaacttacgatgccattgccaagttcgctccagactttgctgatgaagaatacgttaacaagctagaaggtgaaatcccagaaaagtacggtgaacactccatcgaagttccaggtgctgtcaagttgtgtaatgctttgaacgccttgccaaaggaaaaatgggctgtcgccacctctggtacccgtgacatggccaagaaatggttcgacattttgaagatcaagagaccagaatacttcatcaccgccaatgatgtcaagcaaggtaagcctcacccagaaccatacttaaagggtagaaacggtttgggtttcccaattaatgaacaagacccatccaaatctaaggttgttgtctttgaagacgcaccagctggtattgctgctggtaaggctgctggctgtaaaatcgttggtattgctaccactttcgatttggacttcttgaaggaaaagggttgtgacatcattgtcaagaaccacgaatctatcagagtcggtgaatacaacgctgaaaccgatgaagtcgaattgatctttgatgactacttatacgctaaggatgacttgttgaaatggtaa

SEQ ID NO: 4546 - protein, 250 aa, Saccharomyces cerevisiae; identical to SEQ ID NO: 4208

SEQ ID NO: 4547 - DNA, 753 bp, Saccharomyces cerevisiae; identical to SEQ ID NO: 4209
  CDS (1)..(753)

SEQ ID NO: 4548 - protein, 250 aa, Saccharomyces cerevisiae; identical to SEQ ID NO: 4210

SEQ ID NO: 4549 - DNA, 651 bp, Escherichia coli
  CDS (1)..(651): transl_table=11
gtgcggtgcaaaggttttctgtttgatcttgatggaacgctggtggattccctgcctgcggtagaacgggcgtggagcaactgggccagacgtcatgggttagcgccggaagaggtgctggctttcattcacggtaaacaggcgatcacctctctgcgccattttatggcgggcaaatccgaggctgatattgccgccgagtttacgcgtctggagcacatcgaggccacggaaaccgaaggtattaccgcgcttccgggggcaatcgccttactcagtcatttgaataaagcaggtattccgtgggccattgtgacttctggctccatgccggtagcgcgagcgcgccataaaatagctgggcttcccgcaccagaggtgtttgtaaccgctgagcgagtgaagcgcggaaaaccagaacctgatgcgtatctgttaggcgcgcagctgctggggcttgcgccgcaggagtgtgtggtggtggaagatgctcccgctggcgtgctttctggcctggcggcgggttgtcatgtcattgcggttaacgctccggcagataccccgcgcctgaatgaggtcgatttggtcctccacagtctggagcaaattactgtgaccaaacagccaaatggcgatgttattattcagtga

SEQ ID NO: 4550 - protein, 216 aa, Escherichia coli
MRCKGFLFDLDGTLVDSLPAVERAWSNWARRHGLAPEEVLAFIHGKQAITSLRHFMAGKSEADIAAEFTRLEHIEATETEGITALPGAIALLSHLNKAGIPWAIVTSGSMPVARARHKIAGLPAPEVFVTAERVKRGKPEPDAYLLGAQLLGLAPQECVVVEDAPAGVLSGLAAGCHVIAVNAPADTPRLNEVDLVLHSLEQITVTKQPNGDVIIQ

SEQ ID NO: 4551 - DNA, 29 bp, Artificial sequence
  primer
atgaaacgtttcaatgttttaaaatatat

SEQ ID NO: 4552 - DNA, 26 bp, Artificial sequence
  primer
ttaccatttcaacaagtcatccttag

SEQ ID NO: 4553 - protein, 229 aa, Artificial sequence
  consensus sequence
  Variant (4)..(4): Xaa in position 4 is any amino acid
  Variant (8)..(10): Xaa in position 8 to 10 is any amino acid
  Variant (12)..(13): Xaa in position 12 to 13 is any amino acid
  Variant (15)..(18): Xaa in position 15 to 18 is any amino acid
  Variant (20)..(28): Xaa in position 20 to 28 is any amino acid
  Variant (29)..(35): Xaa in position 29 to 35 is any or no amino acid
  Variant (37)..(44): Xaa in position 37 to 44 is any amino acid
  Variant (45)..(45): Xaa in position 45 is any or no amino acid
  Variant (48)..(48): Xaa in position 48 is any amino acid
  Variant (50)..(85): Xaa in position 50 to 85 is any amino acid
  Variant (86)..(96): Xaa in position 86 to 96 is any or no amino acid
  Variant (99)..(110): Xaa in position 99 to 110 is any amino acid
  Variant (111)..(122): Xaa in position 111 to 122 is any or no amino acid
  Variant (125)..(126): Xaa in position 125 to 126 is any amino acid
  Variant (129)..(145): Xaa in position 129 to 145 is any amino acid
  Variant (146)..(147): Xaa in position 146 to 147 is any or no amino acid
  Variant (149)..(156): Xaa in position 149 to 156 is any amino acid
  Variant (158)..(158): Xaa in position 158 is any amino acid
  Variant (159)..(159): Xaa in position 159 is any or no amino acid
  Variant (163)..(163): Xaa in position 163 is any amino acid
  Variant (165)..(166): Xaa in position 165 to 166 is any amino acid
  Variant (168)..(173): Xaa in position 168 to 173 is any amino acid
  Variant (175)..(182): Xaa in position 175 to 182 is any amino acid
  Variant (183)..(189): Xaa in position 183 to 189 is any or no amino acid
  Variant (196)..(196): Xaa in position 196 is any amino acid
  Variant (198)..(199): Xaa in position 198 to 199 is any amino acid
  Variant (202)..(202): Xaa in position 202 is any amino acid
  Variant (203)..(204): Xaa in position 203 to 204 is any or no amino acid
  Variant (206)..(220): Xaa in position 206 to 220 is any amino acid
  Variant (221)..(223): Xaa in position 221 to 223 is any or no amino acid
  Variant (225)..(228): Xaa in position 225 to 228 is any amino acid
LFDXDGTXXXSXXAXXXXWXXXXXXXXXXXXXXXXDXXXXXXXXXHGXRXXXXXXXXXXXXXXXXXXXXXXXXXXXXXXXXXXXXXXXXXXXXXXXPGXXXXXXXXXXXXXXXXXXXXXXXXWAXXTSXXXXXXXXXXXXXXXXXXXPXXXXXXXXVXXGKPXPXXYXXXXXXLXXXXXXXXXXXXXXXVFEDAPXGXXAGXXXGXXXXXXXXXXXXXXXXXXGXXXXV

SEQ ID NO: 4554 - protein, 28 aa, Artificial sequence
  protein pattern
  Variant (2)..(2): Xaa in position 2 is any amino acid
  Variant (3)..(4): Xaa in position 3 to 4 is any or no amino acid
  Variant (9)..(9): Xaa in position 9 is any amino acid
  Variant (11)..(11): Xaa in position 11 is any amino acid
  Variant (12)..(12): Xaa in position 12 is any or no amino acid
  Variant (15)..(17): Xaa in position 15 to 17 is any amino acid
  Variant (19)..(21): Xaa in position 19 to 21 is any amino acid
  Variant (22)..(22): Xaa in position 22 is Ile, Leu or Val
  Variant (23)..(23): Xaa in position 23 is Ala, Gly or Val
  Variant (24)..(24): Xaa in position 24 is Ile, Leu or Val
  Variant (25)..(25): Xaa in position 25 is any amino acid
  Variant (26)..(26): Xaa in position 26 is Gly, Ser, Thr or Val
  Variant (27)..(27): Xaa in position 27 is Ser or Thr
  Variant (28)..(28): Xaa in position 28 is Phe, His or Tyr
VXXXEDAPXGXXAGXXXGXXXXXXXXXX

SEQ ID NO: 4555 - protein, 27 aa, Artificial sequence
  protein pattern
  Variant (2)..(3): Xaa in position 2 to 3 is any amino acid
  Variant (4)..(4): Xaa in position 4 is Phe, Leu or Met
  Variant (5)..(5): Xaa in position 5 is Ile or Val
  Variant (6)..(6): Xaa in position 6 is Ala, Cys, Ser, Thr or Val
  Variant (7)..(7): Xaa in position 7 is Ala or Gly
  Variant (8)..(9): Xaa in position 8 to 9 is any amino acid
  Variant (10)..(10): Xaa in position 10 is Ile or Val
  Variant (11)..(12): Xaa in position 11 to 12 is any amino acid
  Variant (16)..(16): Xaa in position 16 is any amino acid
  Variant (18)..(18): Xaa in position 18 is any amino acid
  Variant (19)..(19): Xaa in position 19 is Ala, Cys, Gly or Pro
  Variant (21)..(21): Xaa in position 21 is any amino acid
  Variant (22)..(26): Xaa in position 22 to 26 is any or no amino acid
PXXXXXXXXXXXGKPXPXXYXXXXXXL

SEQ ID NO: 4556 - protein, 26 aa, Artificial sequence
  protein pattern
  Variant (3)..(3): Xaa in position 3 is any amino acid
  Variant (7)..(7): Xaa in position 7 is Ile or Leu
  Variant (8)..(8): Xaa in position 8 is Ile or Val
  Variant (9)..(9): Xaa in position 9 is any amino acid
  Variant (10)..(10): Xaa in position 10 is Ser or Thr
  Variant (11)..(12): Xaa in position 11 to 12 is any amino acid
  Variant (13)..(13): Xaa in position 13 is Ala or Ile
  Variant (14)..(17): Xaa in position 14 to 17 is any amino acid
  Variant (19)..(21): Xaa in position 19 to 21 is any amino acid
  Variant (22)..(22): Xaa in position 22 is Ala, Cys, Gly or Val
  Variant (23)..(25): Xaa in position 23 to 25 is any amino acid
  Variant (26)..(26): Xaa in position 26 is Asp, Gly, Asn or Pro
FDXDGTXXXXXXXXXXXWXXXXXXXX

SEQ ID NO: 4557 - protein, 13 aa, Artificial sequence
  protein pattern
  Variant (3)..(3): Xaa in position 3 is any or no amino acid
  Variant (5)..(5): Xaa in position 5 is any or no amino acid
  Variant (8)..(8): Xaa in position 8 is Ala or Gly
  Variant (9)..(9): Xaa in position 9 is Asn, Ser, Thr or Val
  Variant (10)..(12): Xaa in position 10 to 12 is any amino acid
  Variant (13)..(13): Xaa in position 13 is Ala, Thr or Val
WAXVXTSXXXXXX

SEQ ID NO: 4558 - DNA, 1857 bp, Saccharomyces cerevisiae
  CDS (1)..(1857)
atgaccaaaaaactaccttcagagttgaaacagacgagaaagtctatccagacagcttgtgaattctgtcataccaaacatatacagtgtgacgtagggaggccatgtcaaaactgtttaaaaagaaatattgggaagttttgcagagataagaaaaggaaatcaagaaaacgaattgagaagcatggaacacaaccatacttgaatttggggaagaggctggtaatacatgatgtgccgtcgaagacggtatccccctcaagcgtacatctgcagcgagattttctatcttcagatcaggaaaaaccaggcaaaacacctgcccacaatacgaatatccaatatacgtataatataaatgataactttcaaagcgctggatctattccacgtattacgaacttcaatacgaataaccgccagaccgtcttagaaaatacttctaataatatatcagcttcacaagcagtacatttaatgaatgaccccatcatacccaccgtacggaagagtactctcaatttaaagtcgcatttcctagagcaacataaagcaatgcagcagccgctggctaccaattgtttggttgctacttcaaacgttcctgtgcactctggaatggacgatagtaataagagtgacgatgatgtcgatgacgaaactaatattcactttgatagtatgtggtgcaatgacgaatacatgaaattaaaggatatagtagatatttcaacgccgtttttaccgaataactcccagatattttccctccaagaatcagaatatcccaatcctagcgcatctacacggggaaattcgtcattgcatttaacgaaccttttaaactcgacaaaaagcgtgaatgaccaaaaggactcctcgatcggccattccacttctactttcaatacatatgatgaagtagtgtctaggccctttatatctttagacatgctgcatttgaatcgtggagcaaacgctaatacacacccatcacataacgccaaactggaaagcgaatgtgacagttctagtcactccgatgcagatctggagaaacatgataccgatttcatatcaccttcaaagtttcgtgaattagtaaagactcctcaagacctatatgacaataaatgtttaataaaaccgcataattacaagctcgcatacaccaaactgctaactactttaagaaaaaaatttcttgaaggagctgaaattgataaatctgcctcagtaaaagacgaacacagtacccaaaagcataatttgagatatgatttagaagttataatacgctctatactagaaagatatgctccaattttcatttcgttaacatccaatatgattgaagaggatttgctattacaggaagttaccttgcaaagggctttattagatttggagaacatggcaaaattagtaagctgcacaccgatgtgcatctggagaagatcaggcgagatttgttttgtcagtaacgaattctattctttaacaggttttaacaaaaatttactattagaccgcacctcctttatttttgaatatctggatcataaaagcgtttcgaattactttcaaatatttaacgaattgctggcatttggttacaatgatatcaataaaaggaaaaaactattgatgttgaacgcatgttcttctacctcgtcaaaaattacagaagggttttcttttactacggatggaaaagcaatctttactaagtgcaatttattattaagtaacggtctttatttgaagtgtgcctgttgttggacagtaaaaagggactcgtttaatatcccaattctcgtaatgggacaatttttaccaatttttgaaatggactga

SEQ ID NO: 4559 - protein, 618 aa, Saccharomyces cerevisiae
MTKKLPSELKQTRKSIQTACEFCHTKHIQCDVGRPCQNCLKRNIGKFCRDKKRKSRKRIEKHGTQPYLNLGKRLVIHDVPSKTVSPSSVHLQRDFLSSDQEKPGKTPAHNTNIQYTYNINDNFQSAGSIPRITNFNTNNRQTVLENTSNNISASQAVHLMNDPIIPTVRKSTLNLKSHFLEQHKAMQQPLATNCLVATSNVPVHSGMDDSNKSDDDVDDETNIHFDSMWCNDEYMKLKDIVDISTPFLPNNSQIFSLQESEYPNPSASTRGNSSLHLTNLLNSTKSVNDQKDSSIGHSTSTFNTYDEVVSRPFISLDMLHLNRGANANTHPSHNAKLESECDSSSHSDADLEKHDTDFISPSKFRELVKTPQDLYDNKCLIKPHNYKLAYTKLLTTLRKKFLEGAEIDKSASVKDEHSTQKHNLRYDLEVIIRSILERYAPIFISLTSNMIEEDLLLQEVTLQRALLDLENMAKLVSCTPMCIWRRSGEICFVSNEFYSLTGFNKNLLLDRTSFIFEYLDHKSVSNYFQIFNELLAFGYNDINKRKKLLMLNACSSTSSKITEGFSFTTDGKAIFTKCNLLLSNGLYLKCACCWTVKRDSFNIPILVMGQFLPIFEMD

SEQ ID NO: 4560 - DNA, 1890 bp, Candida glabrata CBS 138
  CDS (1)..(1890)
atggttaaagcgtgtgagttctgccatgaaaagcacttgcactgcgatccgggcagaccgtgcataaactgcgttaagcggaaccgaggccagctgtgtagggataaagagcggaagaagtcaaagaagagcggtgttgaaaaatctgttggtggttcagatgctcaatcatctggaagttcacaaagcaataatacggccgaagtcaatgtgtcagccgattatactgctggtacaatgtttaataatatgggttttgacccattacagcaatcaaactatggttttgatactatgacgaggcagaataacaataatgataacactttattaaacagttctaataataacgctattgatatggggaatagatggagcagtcagccagatgtggtagataatatggtaagtccaaacataacagatggcagtaacactgtggaattcgatagtgcatgggctaataatgaatatatgaaactagatgagttgactaaaaatggtccgccaatgatgttctcctcgtatccgaactctgtcaccgaaaatttggatcaagataatgcagtagaggatctcccgatatcagtattgccaggaagtaagactaagaatggcacggccgaaaacctttcccagtttttaaatatcgggaggcccttacataaaacgcagtcaagaccatatatctctttagatatgatgacagcaggcatgaaggatgacattttacctccagagacatacaacacaacatcactaggcgataattacttatctcctatcaattcggtgggatcatcgacaaatcaactaaacgattatcaagacagcataccgcaccagaagacgatgacttctcctgtgcttccgacacaatctccatcttccgctttcaatccggcaaaacttccaacacaggtttcgatatcggcaatatctcctgatgataataacgaggatgatcagaaatcaagttctgggataccatccaaatctgataaagagaaaaataataaaacgaaaaaggcgaaagagaagatatttaaaacttcgccaaatgatatattaatctctaagaagaatccaaagggtcataaatctaccaagaggaaaaatgagaaagctgacatatcaccttataaatttagacagctggtaaaagtccctgaagacttgtatgaaaaacaatacctgatcaagccgcataactacagacatacatacaagaaacttttagaacaattggagaaaatattcctttcagataatagtcccaagagaaggggtcaattacaaagtattgtgaaatgcatattagaagattatgtaccgacattcatcgcgcttacatcaaatatgattgaatcagacttgtacttgcaagagttgacgttacaaaggacacttttggaactggaaagcatggcaaagcttgtgaactgttctccaatttgtatatggagaaggtcaggagaaatttcatatgttagtgatgagtttttgcagctaactgggtttaaacgtaaggagatattagcaagtaggcgatttatttttgaattcttagatcctacaagcattgtgaactatttcaccaatttccatgaatacttggcatttggatctaagaatcagatgacaagcaatatctcactgataaagcaaggcttattggtaaatggtgctgtggttagaaaaagtaacccaatagtatcatcaagccctatgtgtggaaccaatactgacgggatatttgatgagtgccacctattattgagtaatggttattatttaaaatgcgccacctgctggacagttaaacgagacagtttcaacatcccacttctgattatgggacaatttctgcctgtatttgaaggccagtag

SEQ ID NO: 4561 - protein, 629 aa, Candida glabrata CBS 138
MVKACEFCHEKHLHCDPGRPCINCVKRNRGQLCRDKERKKSKKSGVEKSVGGSDAQSSGSSQSNNTAEVNVSADYTAGTMFNNMGFDPLQQSNYGFDTMTRQNNNNDNTLLNSSNNNAIDMGNRWSSQPDVVDNMVSPNITDGSNTVEFDSAWANNEYMKLDELTKNGPPMMFSSYPNSVTENLDQDNAVEDLPISVLPGSKTKNGTAENLSQFLNIGRPLHKTQSRPYISLDMMTAGMKDDILPPETYNTTSLGDNYLSPINSVGSSTNQLNDYQDSIPHQKTMTSPVLPTQSPSSAFNPAKLPTQVSISAISPDDNNEDDQKSSSGIPSKSDKEKNNKTKKAKEKIFKTSPNDILISKKNPKGHKSTKRKNEKADISPYKFRQLVKVPEDLYEKQYLIKPHNYRHTYKKLLEQLEKIFLSDNSPKRRGQLQSIVKCILEDYVPTFIALTSNMIESDLYLQELTLQRTLLELESMAKLVNCSPICIWRRSGEISYVSDEFLQLTGFKRKEILASRRFIFEFLDPTSIVNYFTNFHEYLAFGSKNQMTSNISLIKQGLLVNGAVVRKSNPIVSSSPMCGTNTDGIFDECHLLLSNGYYLKCATCWTVKRDSFNIPLLIMGQFLPVFEGQ

SEQ ID NO: 4562 - DNA, 1740 bp, Kluyveromyces lactis NRRL Y-1140
  CDS (1)..(1740)
atgacgaagaaacttacagctcaagagaaactgaatcgaaaaccgataccgacagcttgtgtgttttgccatgagaagcatttacaatgtgatcttggtagaccctgccaaaactgctcgaagcgtgggattggtgacacatgtagggataaggagcgtaagcccaggaaacgcggaccgcggaaagttaagaaggaacgtgaggtttcggcgtcgacaaagtcagagatatctaatactattaatcaacaactgatccccgttattaatactgcaactgccgttagcaatagacaaaattcgagtaaaataataaaggccaagcaaactggagtttcgacaaagaagacgaggatctccaagctagctatggattctttaccgttacaaatgcccgttataaattctccatctgatatgtttgggaaacagaagaaagttatgtcgccagagttgccgaagattcccagtctcactcagttattcaacccaactgcagagcccattatctcggatgccttgttgccaagtaatcagaatagtgcagccaatttaccctctctggctgataagactcccttggaggaatttaagaataaaccactttctgagcgagcacctcagcaggggccgcaacaaccagcacagcagctgctgccaatcccagagaagctgaattcagatcatacgagcagcaacagtagcactggggagttcgggagtgtatggactacggaagaatatacaaagctcaatgatatgctatcgacaccaaacctttcccgaaataactcaaagacatacttgaattccaatatagcgtggtctccaagtaacatgatgaaaatggatcctatcactgaatctcaaagacctatcaatactcaggaactgctaaatctcacaagcaatgggttgaaaaggacgcattccaggccgcacatatcgttagatcaaatggcaagtgaatctaaaaggcattctgcaaatgatacgtcaccggaatctcaaggtggtgaaactgtggagaatttgagtccatacaggtttagattactggttaagacacctgaggacttgtacaaacatcaagctttaattcaaccgcataattataagtcagcttatctggaactgttaagatttttgagatggagattcattaattcagataaaccttcctcgggtaaatctcagagggatggccccgagcaattgcaaaatatagcccactctattaaaacacattatgcaccaatattcgttacactaactaatagtttaattgctcaagatttaaaattacaagaaattattctccaaagggcattgttagagtatgaaagcatggccaaacttgtaaattgtaccccaatgtgtatatggagaaggtcaggggagatatgctttgcttctaatgaatttatatcccttaccgggttcaacaaaaaggagattttaaacaaacgaaagtttatcatggaattcatggacaatgaaagcatagtagattactatgatatattccatgagtatttggcatttggttcaactcaaagtgggcccttcaattcatcgaccggaacttctgatggtcaggctatttttagcgaatgtaaccttttgttaaagaatggatgctatctacggtgtgcatgtatttggacagttaaaagagatgcatttaatattccaatgttaataatgggccagttcttaccaattttcgatattgaatga

SEQ ID NO: 4563 - protein, 579 aa, Kluyveromyces lactis NRRL Y-1140
MTKKLTAQEKLNRKPIPTACVFCHEKHLQCDLGRPCQNCSKRGIGDTCRDKERKPRKRGPRKVKKEREVSASTKSEISNTINQQLIPVINTATAVSNRQNSSKIIKAKQTGVSTKKTRISKLAMDSLPLQMPVINSPSDMFGKQKKVMSPELPKIPSLTQLFNPTAEPIISDALLPSNQNSAANLPSLADKTPLEEFKNKPLSERAPQQGPQQPAQQLLPIPEKLNSDHTSSNSSTGEFGSVWTTEEYTKLNDMLSTPNLSRNNSKTYLNSNIAWSPSNMMKMDPITESQRPINTQELLNLTSNGLKRTHSRPHISLDQMASESKRHSANDTSPESQGGETVENLSPYRFRLLVKTPEDLYKHQALIQPHNYKSAYLELLRFLRWRFINSDKPSSGKSQRDGPEQLQNIAHSIKTHYAPIFVTLTNSLIAQDLKLQEIILQRALLEYESMAKLVNCTPMCIWRRSGEICFASNEFISLTGFNKKEILNKRKFIMEFMDNESIVDYYDIFHEYLAFGSTQSGPFNSSTGTSDGQAIFSECNLLLKNGCYLRCACIWTVKRDAFNIPMLIMGQFLPIFDIE

SEQ ID NO: 4564 - DNA, 1716 bp, Debaryomyces hansenii CBS767
  CDS (1)..(1716)
atgagcgaaattaaaaatgaaccaatgtctaactcagactctgttgcgtcaagtaacagtgcaaaaatgagacggaaaaaaaccaacagagcatgtaatcattgtcacaaggctcacatgacctgtgacaccaatagaccttgtcaacgttgtttacagagaggtttggaaagcagctgtcaggatgcacctagaaaacgaaagaaatatttagctgatgtgccaccaaacgtattaagtcgacatgatggattatcgcaatcaccgccttatgaaatgggtaaaaatgacacgattaattatcaaagtggtccgtttcaagagagacctcctctgtctgagtttaatccacctatgcctacggccaacacagacaatgatataaatcaagactttggggcatttggagtgtatcctaatagtcatttgtttccatctaatacaaatcaaacaaatcaagacgcaggtgctgatatgtctcattctcaaggtcaactgaaaccacctataaatcagcatatgcatcaacaggggttaccactgtacaataaaccgagacgaacaaatttcctatcgtcggcagcggatttagaatattcgacactttccagcattcttcaggacaatttcgttcatgtcaataataatacctcagcagaaggtaccccaaattcacttaatttgtcgccatcagtacttcccaacaatgcaccaaacacgaacattactgattcgaggaatacaacatcttctaatagcttgaataactatggccaacagaacaaacctatgaattacacctccggatcatctcatgcatcttctcctaacgattctatttttaatagcaaacaaatgtcatcaataaatggcatcaataaaaataaatattactattcatcgaagtatcccaagtgtgatgaaagtattaatcaatatttcttgggcccaactggctctgatcatgaattgatttacccagatgttataactgctattgaagagatgaaggcactcgatcctgctgtttaccacgaaagaaattccaagctgctgttgtcatttactataggaataattccagaatcaaatgagtatacaaagggcaggaagccacaagaaaataaggaaacttttaaagaacccgatgaaatatatgcaaaggtcaacaagccattctcatatacccctggataccattcgttgattgcttacttacgtaagaggttccccaaagaaatgttagtaaagatggcggaatccattgctgcttaccgtccatcatttattgcttgtacaaattcattaaaagaaagcgacttaattttcatggaacaatgctttcaaaggaccctacttacatacgataacttcattcgtgtcagtggtaccccaactatcgtttggagacgaacaggtgaaattgcatacgtaggaaatgaattttgcgtattgacagggtggaaaaaagaagatcttttgttgaatactaagaagtttatagtggagcttcttgatgataagtctgtagtagagtatttccagttattcctgaagatcgcatttggtgatttcttgggggctacaatgacagaatgtactctattaacaccaaagaaagatgtaaagataagaaccggatgcatgtggacgttgaaaagagatgtattcggtattcctatgatgattatcgggaactttttacccataatatag

SEQ ID NO: 4565 - protein, 571 aa, Debaryomyces hansenii CBS767
MSEIKNEPMSNSDSVASSNSAKMRRKKTNRACNHCHKAHMTCDTNRPCQRCLQRGLESSCQDAPRKRKKYLADVPPNVLSRHDGLSQSPPYEMGKNDTINYQSGPFQERPPLSEFNPPMPTANTDNDINQDFGAFGVYPNSHLFPSNTNQTNQDAGADMSHSQGQLKPPINQHMHQQGLPLYNKPRRTNFLSSAADLEYSTLSSILQDNFVHVNNNTSAEGTPNSLNLSPSVLPNNAPNTNITDSRNTTSSNSLNNYGQQNKPMNYTSGSSHASSPNDSIFNSKQMSSINGINKNKYYYSSKYPKCDESINQYFLGPTGSDHELIYPDVITAIEEMKALDPAVYHERNSKLLLSFTIGIIPESNEYTKGRKPQENKETFKEPDEIYAKVNKPFSYTPGYHSLIAYLRKRFPKEMLVKMAESIAAYRPSFIACTNSLKESDLIFMEQCFQRTLLTYDNFIRVSGTPTIVWRRTGEIAYVGNEFCVLTGWKKEDLLLNTKKFIVELLDDKSVVEYFQLFLKIAFGDFLGATMTECTLLTPKKDVKIRTGCMWTLKRDVFGIPMMIIGNFLPII

SEQ ID NO: 4566 - DNA, 1635 bp, Debaryomyces hansenii CBS767
  CDS (1)..(1635)
atgactaaaaagcttagcccacttgaaaaaaagaacagaaaaccggcttcgaaagcctgtgttttttgtcactcaaagcacttgcaatgctctaatgagaggccttgcaagaattgcatgaagcgaaacctaggtgatcaatgccatgacgctattagaaaacgggcaaagtacttaaatacctctggtgtgaagaagatgaaatcaaggacaaattcaattctgtcaagctacaggtctcccagtgtatcagaatctccccagaatccatatacccatagcattattaaacaggaaccagacttaaacatgagaggagaattacagtcaattcagcaagaaaatacatcacataatcaacctggtccatcaaatgtactgcactacgtagatcagagacccacgatccctacaaataccatgctagacacaacaaacgatgtattgaataaactattatatagcgaaccaatacattcggattctatatcactaagggattcaatatctgagcaacctgaaatggattcgaacaggagaagcatagatactatgttcaattccaattaccttaatcaagaatacctcatgctaggggatataatattgcattcgaagccatcatccccttctccttcaaataccagtgcttctgaatacaatggcgatgcgacgatttccccagcaaatactttgttaaataatactaggttggatttcgataattcaaatgaccatatgtcaaattctaagaggaagcttaataaactaaaagattcaaggccattcatagctttaggcgtttcaaatgatgtgccaataagtttacaacctgaaggtactctaagtttagataatcttagtactaaaaacgaaattatgaataaagacaacatatcatcaaatctgctcaaaaccgactacgtgtctcccttaataagtcatcacatataccagtcagtccaagacatatatatgcacagcattccgaattttgactatccccagtcgtatcacctgttaactaactttctaaagagacggtttctgggaaactctctagcacatgaccaaagacaggctaaacgtaacaatttattaatcatattaaagctaattgctagttataggccaaccttcatttctgcccataaaaacttgttgaaaccctacgacttgttgtttttagaaatgtcttttcaaagatcattaatagactacgaaaaactactactttttaattcttctccatctatcatatggcgtagaacgggtgaaatagtttccatttctaacgatttactaagtatattaggttttaatttgtcagaaattttgtccaaacgaacttttatcatggaattaatgtatgacgacgagtctattattaattacttcaagttgtttaaatcggtggctgttggtaatttacacctgagtattattacgaaatgtaagttaatgaaaaattcatcggctgcatttcataatgaagcgtcagatgttgcagatagagagtatattgaattttgctctgcatggaccgttaagagagacccatttgatatacctatgttaattataggtcagttcttaccaatattaccgggtggagaaggtgtaaggaagtattga

SEQ ID NO: 4567 - protein, 544 aa, Debaryomyces hansenii CBS767
MTKKLSPLEKKNRKPASKACVFCHSKHLQCSNERPCKNCMKRNLGDQCHDAIRKRAKYLNTSGVKKMKSRTNSILSSYRSPSVSESPQNPYTHSIIKQEPDLNMRGELQSIQQENTSHNQPGPSNVLHYVDQRPTIPTNTMLDTTNDVLNKLLYSEPIHSDSISLRDSISEQPEMDSNRRSIDTMFNSNYLNQEYLMLGDIILHSKPSSPSPSNTSASEYNGDATISPANTLLNNTRLDFDNSNDHMSNSKRKLNKLKDSRPFIALGVSNDVPISLQPEGTLSLDNLSTKNEIMNKDNISSNLLKTDYVSPLISHHIYQSVQDIYMHSIPNFDYPQSYHLLTNFLKRRFLGNSLAHDQRQAKRNNLLIILKLIASYRPTFISAHKNLLKPYDLLFLEMSFQRSLIDYEKLLLFNSSPSIIWRRTGEIVSISNDLLSILGFNLSEILSKRTFIMELMYDDESIINYFKLFKSVAVGNLHLSIITKCKLMKNSSAAFHNEASDVADREYIEFCSAWTVKRDPFDIPMLIIGQFLPILPGGEGVRKY

SEQ ID NO: 4568 - DNA, 1680 bp, Yarrowia lipolytica CLIB122
  CDS (1)..(1680)
atggagaaacccgtggtgatttcgcaacggacgggcaagccgaagcgaagaaaggcccaccgagcgtgtatccactgccaacgaacccatctgacatgcgataacaaccgaccctgtgagagatgtgtggcccgaggattcgcagacacctgtgtggacggtgtgcgtaagaaactaaagtatctggacgacaaggaggataataagcccagtaaaggcctgtcacctgcccctggtgtgaacgtacaaccaaaactgagcccagcaactcgaagtgctcgctctagctctgcaggcttccctgatacgaaggggaacatgcagcaacaacatatgggtaatatgcccgtccccaatacccctcagaatggacatccgaacctaggaacacctggcatggcccacacaaacttgcagggaccacagcgacagggtgcccaacaaccacagggaggccagtcaagtactccgtcacaacttcctgcagactaccttatacaccagcagcttctggcgacggaaatcaaccaattaggagacctgggaagaactggagaaggtgacttttcgtcagactggttctcggatctgcaattatcgggacactcgttccagtccgtggctactaatatggagtattccatcctgtcaaacatggtgtactcttctggtcaaccaaactccgcagtaagcaactctttgttgctcggaaacaactctcagtctccaaacactcactcgccacataaccaggaccagcctacgccccaggcagctactccctcagctaagatcaaacaactcattgagtctaacggtttgtcggcaaaggatcttaaccaatacccactggctggagagttcgtcaatgataccttcttaactgtgcctgaaattgttgcgtttaacgaaactaggcgaaatgtgaaggacagcgagctgactactgacgagaagttgaggcctctttcgtttgctgtagcagctggccagccgcaaaacaccaacggcaatggaaacgggagtgaagctccagactcgccaagcaagtccatcttctcttcaggtgctctggaagctgtctactccaacttacctgactacaccgaccctatccaggtctatactaacatcacaaagccattcagctacactcctggataccatggactcatttcttatctgaaaggccgtttcaacaaacagcagctcgtccagatgactaagtatatggctgaatacagaccctcttttattgcctgtaccaactcgctgaaagaggaggacctggtgttcatggaacaatgcttccagcgagccctcctagagtatcaaaagtttatttcgttttctggaacccccactcttgtctggagacgtactggtcaactagctgctgttggaaaagagttctgtcagctctcgggttggtctgaacagcgtctcattggtcagcagaccttcatcgtagagctgctggacgacaattctgtcctcgagtactttgagctcttttctcgaatcgcttttggagactcaagaggagctactatggccgactgtacactacttacaccgaccggtgctaaaatcaaaacatccagtatctggaccctaaaacgggatgtctttggcaaccccatgatgattgttggcaacttcctgcccatcttgagttga

SEQ ID NO: 4569 - protein, 559 aa, Yarrowia lipolytica CLIB122
MEKPVVISQRTGKPKRRKAHRACIHCQRTHLTCDNNRPCERCVARGFADTCVDGVRKKLKYLDDKEDNKPSKGLSPAPGVNVQPKLSPATRSARSSSAGFPDTKGNMQQQHMGNMPVPNTPQNGHPNLGTPGMAHTNLQGPQRQGAQQPQGGQSSTPSQLPADYLIHQQLLATEINQLGDLGRTGEGDFSSDWFSDLQLSGHSFQSVATNMEYSILSNMVYSSGQPNSAVSNSLLLGNNSQSPNTHSPHNQDQPTPQAATPSAKIKQLIESNGLSAKDLNQYPLAGEFVNDTFLTVPEIVAFNETRRNVKDSELTTDEKLRPLSFAVAAGQPQNTNGNGNGSEAPDSPSKSIFSSGALEAVYSNLPDYTDPIQVYTNITKPFSYTPGYHGLISYLKGRFNKQQLVQMTKYMAEYRPSFIACTNSLKEEDLVFMEQCFQRALLEYQKFISFSGTPTLVWRRTGQLAAVGKEFCQLSGWSEQRLIGQQTFIVELLDDNSVLEYFELFSRIAFGDSRGATMADCTLLTPTGAKIKTSSIWTLKRDVFGNPMMIVGNFLPILS

SEQ ID NO: 4570 - DNA, 2109 bp, Aspergillus nidulans FGSC A4
  CDS (1)..(2109)
atggagacggagacaggcaagggcgctactgctccccctgcagaatctagtggggtcgaacaagataccgcagccgttggcgcgcccgccgaccagccgcccaagactaatgcgaacgcgacttcgaatgcgaacggcgaagatcagccggccaacggccagaaagcgaacccgaaggatccgtcaagaccgaggaggaagaaggcgcggcgcgcctgttttgcttgtcagcgggcgcatctaacgtgcggtgatgagagaccatgtcaacgctgcatcaagcgcgggctccaagatgcctgccatgatggggttcgcaagaaggccaagtacctgcatgacgcgccagacggcgctctgatgcctgggatcggcggcaataatttctacaacaacaattcaatgtcgaacggtgtcccatcgggtggcataaatatgaatggcgcgaataccgtcaattcagcggcgagtacgcagaattcgagcgcaaacttctatcctactccgcagtcgaactacagcttataccaggagaatccgatcaaccaccaaaactctttcccatcgcaatcgccggtgtccccgacctttagcttgaagaccaacccaacccctcgcaataccgcacctaacaacaacaataataatgccttaacgtcttcgatgccccaacccgcgaccactggtgtgtcgaatgcacccaaccagagccagaatccgttcgccggcccgttcttcgaccccagtgatccggctcttttcaactttgatctgtcgagtatgaattttgaaaaccgatatggtgcgctggagttcggtatgcttggacacatggctactggggctggcgactctccagactctggcacccacagaggatcgatgggccgcagcggttcgacgcagtttgcgtctacgcctattggaggaactacgacgttcggcgagagcccgcagaatcagcagccattcatgttcggggatccgctattgaacgagtggccgagtggacagacctcgggccaaccgcacgtgaatgtcggcgtatatccgcagtctagccagggcaacgtgataccgggacatctgtctaagcctgatgcgcctcacgctttcgcaattgaaagtggaccgaacaacttcactagcccgggcgcggcgacgagcccgcagatcaacagcggcggatatgaagatgcgaacgcgtttaacaatgttgtgacgaagtctaatggactatctgtgaacggacagcaacgtcctccgaccatttctacaccgagtttgaagcaccaaagcctgcagatgaacaaacgacgtcaccgcaatccatcggcagtctacgaaagcgtcaaggagccgtacgcgtataccagtcgcttccatagcctaacggcgtttattcaacggcgcttctcgccgcagaagacactgcagattgccaaagccctggcatctattcgaccttcatttattgcaacaaccaaaacactaaaccgggatgatcttatctttatggagaagtgctttcagcggacactctgggagtatgaggatttcatcaacgcttgcggcacaccgaccattgtttgccggcgcactggcgaggttgcagctgttgggaaagaatttagcatcttgacgggatggaagaaagaggtattactaggaaaggagccgaattataatgtcaacacaggtggttcatcggccgcaaattcccgaaacatcacgccacgtagctccgttgaaagcactggccgtcctcatccggtgtttctggcggaactgttggacgatgacagcgtggtagaattttacgaagactttgcgcgattagcattcggggattcgcgcggcagcgtgacaacgcgctgcaaattgctcaaatacaaaacaaaagaggacatggaagcggcacagtccgatgacaacgggcagcggtggaacaaccacctgcgtaaggggggaattgcgaacgaggccgggatgaaccagttaggattcaaagatggcaaagtcgagtgcgcctactgctggacagtcaagcgcgacgtgttcgacatccctatgttaatagtgatgaacgtgcgtcttcctcttccctga

SEQ ID NO: 4571 - protein, 702 aa, Aspergillus nidulans FGSC A4
METETGKGATAPPAESSGVEQDTAAVGAPADQPPKTNANATSNANGEDQPANGQKANPKDPSRPRRKKARRACFACQRAHLTCGDERPCQRCIKRGLQDACHDGVRKKAKYLHDAPDGALMPGIGGNNFYNNNSMSNGVPSGGINMNGANTVNSAASTQNSSANFYPTPQSNYSLYQENPINHQNSFPSQSPVSPTFSLKTNPTPRNTAPNNNNNNALTSSMPQPATTGVSNAPNQSQNPFAGPFFDPSDPALFNFDLSSMNFENRYGALEFGMLGHMATGAGDSPDSGTHRGSMGRSGSTQFASTPIGGTTTFGESPQNQQPFMFGDPLLNEWPSGQTSGQPHVNVGVYPQSSQGNVIPGHLSKPDAPHAFAIESGPNNFTSPGAATSPQINSGGYEDANAFNNVVTKSNGLSVNGQQRPPTISTPSLKHQSLQMNKRRHRNPSAVYESVKEPYAYTSRFHSLTAFIQRRFSPQKTLQIAKALASIRPSFIATTKTLNRDDLIFMEKCFQRTLWEYEDFINACGTPTIVCRRTGEVAAVGKEFSILTGWKKEVLLGKEPNYNVNTGGSSAANSRNITPRSSVESTGRPHPVFLAELLDDDSVVEFYEDFARLAFGDSRGSVTTRCKLLKYKTKEDMEAAQSDDNGQRWNNHLRKGGIANEAGMNQLGFKDGKVECAYCWTVKRDVFDIPMLIVMNVRLPLP

SEQ ID NO: 4572 - DNA, 1701 bp, Candida albicans SC5314
  CDS (1)..(1701): transl_table=12
atgactaaaaagttaactccacaagaaaagaaaaatcgaaagccggcagtgagggcgtgtgtgttctgccatcaaaaacatctacagtgttcaaacgaacgaccttgcaagaattgtgtgaaaagaaatattgctcatgggtgtcaagatattgtacgaaaacgagtgaaatatctaactggtgaaagtgtgccaggagcagtttcgaataaacagtccacaccaagaaagaaactaaaaactggtccagtgtcaacatcagtgtccccaatggattccgtcaagtcagaattgacaactccggtggagtcttcaaatcatttcccaccacctatgtcgtcttctgtggatgcgttgcctacaacacaacatagtgcgattgagattccgccaaatgaccaaccaatcagtgacatacttgaagtccccccattattcgatagctcacatatgattagcagtgaagcaccggaaaccaacattactttgacgacacaaaacttgatcacacctgatccactactgtttcatacaaacaccgtttcaaatactacaaccgacgttttgaataagcttttgaatgataactacgaaaccgaatctatgttgagtgctaacaacagcaatggcgaccacttgctagggatggcacacacactgtctggccatctttccaacggacaacaatttcaatcaaattatttgaacgaagaatatatgatgttgggagatatcattttgcaatcgaaacaagctagcccgtcgccatcaaacacgagcacttctgagaacaacaccaacaccttgtcaccttcaagttttggatacatactgaacatcaactttgaggactttaatcaaccgaaaagaaaggtggtacagaaactaaaggattcaagaccgtttatatctttaggatttactgcagatttggctccccatgataataacaacaacaccgattactatgacgacaaaatgaccaacaatataacaggaaagactgaagagggaccagggaacccaattatcaactacaacaccaagttcacaacagattacgttccaccatctattacaaacaatctatacaagacagcaagtgatctctacagcaaggaacttaagaatttttattaccctttaagttatcacgcacttaccaagttgctcaaagtgatatttggtgggaatgatctatcgccagaggagaaacaagaaaaacgatctaaactattaattattttgaaattgatagccagttaccgtcccacatttattgccgctcaccgtgacttgatccaagaggatcttctcatgctagagatgacgttacaacggtctcttttggactacaagaaattggcagaattgaactcatcaccaaccatcatgtggaggaggacgggagaaatcattagtattactgaagacatggcacttcttttggagcacctgctgtttgatttgctaaaggaaagaagatttatttttgaattaatggacgacaatagtattgtcgattatttcaatctttttgctaatattgctgtgggtaatttgaagtcagtaattcaaacagcaattcaaatgaaaaccaaaagcagtaacctaattaaattcacctgtgttttcaccatcaaacgagatatttttgacattcccatgattgttattggccaattcttgccaattgtataa

SEQ ID NO: 4573 - protein, 566 aa, Candida albicans SC5314
MTKKLTPQEKKNRKPAVRACVFCHQKHLQCSNERPCKNCVKRNIAHGCQDIVRKRVKYLTGESVPGAVSNKQSTPRKKLKTGPVSTSVSPMDSVKSELTTPVESSNHFPPPMSSSVDALPTTQHSAIEIPPNDQPISDILEVPPLFDSSHMISSEAPETNITLTTQNLITPDPLSFHTNTVSNTTTDVLNKLLNDNYETESMLSANNSNGDHLLGMAHTSSGHLSNGQQFQSNYLNEEYMMLGDIILQSKQASPSPSNTSTSENNTNTLSPSSFGYISNINFEDFNQPKRKVVQKLKDSRPFISLGFTADLAPHDNNNNTDYYDDKMTNNITGKTEEGPGNPIINYNTKFTTDYVPPSITNNLYKTASDLYSKELKNFYYPLSYHALTKLLKVIFGGNDLSPEEKQEKRSKLLIILKLIASYRPTFIAAHRDLIQEDLLMLEMTLQRSLLDYKKLAELNSSPTIMWRRTGEIISITEDMALLLEHSSFDLLKERRFIFELMDDNSIVDYFNLFANIAVGNLKSVIQTAIQMKTKSSNLIKFTCVFTIKRDIFDIPMIVIGQFLPIV

SEQ ID NO: 4574 - DNA, 2070 bp, Phaeosphaeria nodorum
  CDS (1)..(2070)
atggcctccccagacgccgaggatgcatctccctcgcccgagtacaggagtgacctggacgacgacatggctgccgaacagaagaccgacgacggctccccctctcaaaagagctccaacggccagaagcccgcctccaatgcaaaggatcccttgaggccacgcaggaagaaggcgcgccgagcatgctttgcctgccagcgcgcccatctgacttgtggaacaggcgatgaaaggccatgtactcgttgcatcaagcgcggcctccaggatcattgtatggacggtgtgcgcaagaaggcaaagtaccttcacgatgcgccagatggcgctctgatgcccggagtgggcggacactatccgtacatgaacggcaaccgtccaacaccactcccaagccaggacacgcataatgtccccatggcgccacaaggcaacatgtacacgcaagctccctcaggaaccttctaccaaccgccttcggcacagatacccttaccacaagctcaacacggccggtcttttagcgaccagcaatcccctctctcgccacctttcagccaagcgcaccacgggcccaatgtcaacccgccgagctcaatctcgcaaggtcaacccggccagatgcagcagtttggacctctcttcgatccgagcgaccccgctctcttcaacttcgacatctccagcctcaactttggaaaccactatggcgcactggaattcggcatgctggggcacatgtcctcggcggtcgatgcgcccaacgacaacaccatgatgaacgcaatgaaccagaccgcgaatatgtatgggccccagatggctggtgcgtacggcccaaacaaccctaatgctgcaatgccgtttgcacagaatagcttgcctgcaggcgaatggcaggagtcgcaatcacgacagaacagcatgcacatccatactcccaccagttcagccacagcacttgaccacggcgggcaccgccatgacagcctcaacggcccgcatgcttttgcaattggacaaggcccctccagtcactccacagccagtccagcctccaccgatgcatctgcgttcgagaacgataatccattatcgacggcaaccttctttgccaacaccaaccgtggccagccccaacgttcacctactaccaaccgacaccaccaaggtaacaggccgccaagtacagcactccagccgatccactccaatggagttcgcaaacgccaccgtgatacgaaaagcatttatcaaggcatcaagaagccgttcgactatgtcaagggctaccataggctgttccaaatatgccacaagaaattttcgaaaagcctgcttgcacaagcacagcagtatttgaacttgtaccgcccagtcttgctttcagtgcgcgaagagatggacacggacgacttgattcaccaagagatgggtctgcaacgtaatctgatgacactccaggatcactttacggaagtaggcactccattcttgatctgcaggcgatcaggagagattgtcagctgcaacaaagagttcaccatactcacaggctggcggcaggatgttctgctgggaagggagccgaatctcaatgtcaacctgggcaacagccgggaagcagatgaaagcgagatgtctacgcaaaccaataccacacccaacctcacgggtcaggaggccgagacggggacgccagctgtcaacgccatccagctcatggacgccaagtcggcactcgaatatctgcaaaacttttccgagctgtgctggcaggatcctcacggccatgcaaaacagcgcgccaacatgctgcgctatcagaccaaggcagattttgatcgcatccaggaaatgaaggccaacgccgatcacaagtcggacgcgtttgtgaaaatggaaggtggggccgtgcatcaaggtgaatcggccatgcagcggctcggcgcgaaaaacggtatggtggactgcatgatttggtggcatatcaagcgcgacatctttgagatgcccgttttggtttgcatgtcggttatgccggtgctagacaagggtttgcaatga

SEQ ID NO: 4575 - protein, 689 aa, Phaeosphaeria nodorum
MASPDAEDASPSPEYRSDLDDDMAAEQKTDDGSPSQKSSNGQKPASNAKDPLRPRRKKARRACFACQRAHLTCGTGDERPCTRCIKRGLQDHCMDGVRKKAKYLHDAPDGALMPGVGGHYPYMNGNRPTPLPSQDTHNVPMAPQGNMYTQAPSGTFYQPPSAQIPLPQAQHGRSFSDQQSPLSPPFSQAHHGPNVNPPSSISQGQPGQMQQFGPLFDPSDPALFNFDISSLNFGNHYGALEFGMLGHMSSAVDAPNDNTMMNAMNQTANMYGPQMAGAYGPNNPNAAMPFAQNSLPAGEWQESQSRQNSMHIHTPTSSATALDHGGHRHDSLNGPHAFAIGQGPSSHSTASPASTDASAFENDNPLSTATFFANTNRGQPQRSPTTNRHHQGNRPPSTALQPIHSNGVRKRHRDTKSIYQGIKKPFDYVKGYHRLFQICHKKFSKSLLAQAQQYLNLYRPVLLSVREEMDTDDLIHQEMGLQRNLMTLQDHFTEVGTPFLICRRSGEIVSCNKEFTILTGWRQDVLLGREPNLNVNLGNSREADESEMSTQTNTTPNLTGQEAETGTPAVNAIQLMDAKSALEYLQNFSELCWQDPHGHAKQRANMLRYQTKADFDRIQEMKANADHKSDAFVKMEGGAVHQGESAMQRLGAKNGMVDCMIWWHIKRDIFEMPVLVCMSVMPVLDKGLQ

SEQ ID NO: 4576 - DNA, 2067 bp, Aspergillus oryzae
  CDS (1)..(2067)
atgacggtggatgcacaggatagcaccccggcgcccccagccgatcgcagaggggccgagctagagaccggaggcgtcggggaacagtcagagcagcccaagaacaagagcaatggcgatggtaatgcgcctgcggaaactggccaaaaaccgaacccgaaggatccctcaagaccacgacggaagaaagcacggagggcttgctttgcttgtcaacgggcgcatctgacttgcggtgacgaaaggccttgtcaacggtgtatcaaacgtggtctccaagatgcgtgccacgatggggttcgcaaaaaagccaaatatcttcatgatgcaccagatggagcgttgatgcctggaattggcgggaatttctataataacacgatgcggagtaacttgcccttgtctagaaatggcgccaatgcagttaatgccactacacagccgagttccagtcccaatttctaccccacgccgcagtcgaactcctatagtgtctatcaggaaaatactatgaaccaaaattctttcacctcccagtcccctgtctcgccgacctttaccctgaaagccaacccagccgctcgaaacaacagcctttcatcacaagttaatcagcagccgcccagcaccggcgtgtccggcgcgactaaccccagccaaaacccatttgccgggcccttctttgaccccagtgacccggccctctttaactttgacctgtccagtatgaactttgagaatcgctatggtgcgttggagtttggcatgcttggacatatggctactggggctggtgactcacccagtgattccgctacccagcgaggctcaatgggacgtagtggctcggctcaattctccggcacgccgatcactggcgctgcagctttcggcgagagccctggaggtcaacagccattcattttcggcgacccccttctgaatgaatggtccagcgggcaacccacgggccaaactcatgtaaatgttggaggcgtttacccacagtccggccaaggaagtgtaatcccgggacacttgaccaaggcagatgcgccacatgcctttgcgatcgaaagcggccctggcagctttgcaagccccaatgcaacgactagtcctcaaataacgacgggctttgatgatgctacgttcagcagtgcggtgacagcaaagtcaaatggcctctctgcgaacggaccacgacctacgattacgacaccgagtttaaagcaccaaaacttacaggtcggggttagacgacgccaacggaacccctcatccatatatgagaacgtcaaggagccgtatgcctacaccaatcgtttccataatctgaccgcatttattcaacgacgcttttcgccacagaagactttacaaatcgccaaggcgctggcgtcgatccgcccgtctttcattgcgacgaccaagactctgaaccgggacgacctaatattcatggagaaatgtttccagcgaaccttgttcgaatatgaagacttcatcaatgcgtgtggcaccccaaccatcgtttgtcgacgcacgggggaaatcgcggctgtgggaaaggagtttagtatccttaccggatggaaaaaagacgtccttttaggtaaggagcccaacctgaatgtcaatacaggtggctctgttccgggctcgggaacatcatcgcggagctttactccacgaggctccgtggcggaaagcactcctggtcgcccgcaaccagtgttcttggccgagctgcttgatgacgacagtgtggtggaattctacgaagatttcgcccgacttgcctttggggactcacgtggtagtgtcatgacgacatgcaaactgttgaaatacaaaacgaaggaggacatggagaatcagtcagatgataaccaacggtggaacagccatctgcgcaaagggggcatcgccagcgaggcgggcatgaatcaactgggctttaaagacggcaaaattgaatgcgcatactgctggacagtaaaacgagacgtattcgacattcctatgcttattgtgatgaatgcaagttcgactaatctaagatga

SEQ ID NO: 4577 - protein, 688 aa, Aspergillus oryzae
MTVDAQDSTPAPPADRRGAELETGGVGEQSEQPKNKSNGDGNAPAETGQKPNPKDPSRPRRKKARRACFACQRAHLTCGDERPCQRCIKRGLQDACHDGVRKKAKYLHDAPDGALMPGIGGNFYNNTMRSNLPLSRNGANAVNATTQPSSSPNFYPTPQSNSYSVYQENTMNQNSFTSQSPVSPTFTLKANPAARNNSLSSQVNQQPPSTGVSGATNPSQNPFAGPFFDPSDPALFNFDLSSMNFENRYGALEFGMLGHMATGAGDSPSDSATQRGSMGRSGSAQFSGTPITGAAAFGESPGGQQPFIFGDPLLNEWSSGQPTGQTHVNVGGVYPQSGQGSVIPGHLTKADAPHAFAIESGPGSFASPNATTSPQITTGFDDATFSSAVTAKSNGLSANGPRPTITTPSLKHQNLQVGVRRRQRNPSSIYENVKEPYAYTNRFHNLTAFIQRRFSPQKTLQIAKALASIRPSFIATTKTLNRDDLIFMEKCFQRTLFEYEDFINACGTPTIVCRRTGEIAAVGKEFSILTGWKKDVLLGKEPNLNVNTGGSVPGSGTSSRSFTPRGSVAESTPGRPQPVFLAELLDDDSVVEFYEDFARLAFGDSRGSVMTTCKLLKYKTKEDMENQSDDNQRWNSHLRKGGIASEAGMNQLGFKDGKIECAYCWTVKRDVFDIPMLIVMNASSTNLR

SEQ ID NO: 4578 - DNA, 1857 bp, Saccharomyces cerevisiae
  CDS (1)..(1857)
atgaccaaaaaactaccttcagagttgaaacagacgagaaagtctatccagacagcttgtgaattctgtcataccaaacatatacagtgtgacgtagggaggccatgtcaaaactgtttaaaaagaaatattgggaagttttgcagagataagaaaaggaaatcaagaaaacgaattgagaagcatggaacacaaccatacttgaatttggggaagaggctggtaatacatgatgtgccgtcgaagacggtatccccctcaagcgtacatctgcagcgagattttctatcttcagatcaggaaaaaccaggcaaaacacctgcccacaatacgaatatccaatatacgtataatataaatgataactttcaaagcgctggatctattccacgtattacgaacttcaatacgaataaccgccagaccgtcttagaaaatacttctaataatatatcagcttcacaagcagtacatttaatgaatgaccccatcatacccaccgtacggaagagtactctcaatttaaagtcgcatttcctagagcaacataaagcaatgcagcagccgctggctaccaattgtttggttgctacttcaaacgttcctgtgcactctggaatggacgatagtaataagagtgacgatgatgtcgatgacgaaactaatattcactttgatagtatgtggtgcaatgacgaatacatgaaattaaaggatatagtagatatttcaacgccgtttttaccgaataactcccagatattttccctccaagaatcagaatatcccaatcctagcgcatctacacggggaaattcgtcattgcatttaacgaaccttttaaactcgacaaaaagcgtgaatgaccaaaaggactcctcgatcggccattccacttctactttcaatacatatgatgaagtagtgtctaggccctttatatctttagacatgctgcatttgaatcgtggagcaaacgctaatacacacccatcacataacgccaaactggaaagcgaatgtgacagttctagtcactccgatgcagatctggagaaacatgataccgatttcatatcaccttcaaagtttcgtgaattagtaaagactcctcaagacctatatgacaataaatgtttaataaaaccgcataattacaagctcgcatacaccaaactgctaactactttaagaaaaaaatttcttgaaggagctgaaattgataaatctgcctcagtaaaagacgaacacagtacccaaaagcataatttgagatatgatttagaagttataatacgctctatactagaaagatatgctccaattttcatttcgttaacatccaatatgattgaagaggatttgctattacaggaagttaccttgcaaagggctttattagatttggagaacatggcaaaattagtaagctgcacaccgatgtgcatctggagaagatcaggcgagatttgttttgtcagtaacgaattctattctttaacaggttttaacaaaaatttactattagaccgcacctcctttatttttgaatatctggatcataaaagcgtttcgaattactttcaaatatttaacgaattgctggcatttggttacaatgatatcaataaaaggaaaaaactattgatgttgaacgcatgttcttctacctcgtcaaaaattacagaagggttttcttttactacggatggaaaagcaatctttactaagtgcaatttattattaagtaacggtctttatttgaagtgtgcctgttgttggacagtaaaaagggactcgtttaatatcccaattctcgtaatgggacaattgttaccaatttttgaaatggactga

SEQ ID NO: 4579 - protein, 618 aa, Saccharomyces cerevisiae
MTKKLPSELKQTRKSIQTACEFCHTKHIQCDVGRPCQNCLKRNIGKFCRDKKRKSRKRIEKHGTQPYLNLGKRLVIHDVPSKTVSPSSVHLQRDFLSSDQEKPGKTPAHNTNIQYTYNINDNFQSAGSIPRITNFNTNNRQTVLENTSNNISASQAVHLMNDPIIPTVRKSTLNLKSHFLEQHKAMQQPLATNCLVATSNVPVHSGMDDSNKSDDDVDDETNIHFDSMWCNDEYMKLKDIVDISTPFLPNNSQIFSLQESEYPNPSASTRGNSSLHLTNLLNSTKSVNDQKDSSIGHSTSTFNTYDEVVSRPFISLDMLHLNRGANANTHPSHNAKLESECDSSSHSDADLEKHDTDFISPSKFRELVKTPQDLYDNKCLIKPHNYKLAYTKLLTTLRKKFLEGAEIDKSASVKDEHSTQKHNLRYDLEVIIRSILERYAPIFISLTSNMIEEDLLLQEVTLQRALLDLENMAKLVSCTPMCIWRRSGEICFVSNEFYSLTGFNKNLLLDRTSFIFEYLDHKSVSNYFQIFNELLAFGYNDINKRKKLLMLNACSSTSSKITEGFSFTTDGKAIFTKCNLLLSNGLYLKCACCWTVKRDSFNIPILVMGQLLPIFEMD

SEQ ID NO: 4580 - DNA, 25 bp, Artificial sequence
  primer
atgaccaaaaaactaccttcagagt

SEQ ID NO: 4581 - DNA, 27 bp, Artificial sequence
  primer
tcagtccatttcaaaaattggtaaaaa

SEQ ID NO: 4582 - protein, 690 aa, Artificial sequence
  consensus sequence
  Variant (3)..(5): Xaa in position 3 to 5 is any amino acid
  Variant (6)..(6): Xaa in position 6 is any or no amino acid
  Variant (9)..(10): Xaa in position 9 to 10 is any amino acid
  Variant (12)..(14): Xaa in position 12 to 14 is any amino acid
  Variant (16)..(17): Xaa in position 16 to 17 is any amino acid
  Variant (19)..(21): Xaa in position 19 to 21 is any amino acid
  Variant (22)..(23): Xaa in position 22 to 23 is any or no amino acid
  Variant (27)..(28): Xaa in position 27 to 28 is any amino acid
  Variant (30)..(30): Xaa in position 30 is any amino acid
  Variant (33)..(37): Xaa in position 33 to 37 is any amino acid
  Variant (39)..(39): Xaa in position 39 is any amino acid
  Variant (41)..(42): Xaa in position 41 to 42 is any amino acid
  Variant (45)..(314): Xaa in position 45 to 314 is any amino acid
  Variant (315)..(398): Xaa in position 315 to 398 is any or no amino acid
  Variant (400)..(404): Xaa in position 400 to 404 is any amino acid
  Variant (405)..(406): Xaa in position 405 to 406 is any or no amino acid
  Variant (408)..(409): Xaa in position 408 to 409 is any amino acid
  Variant (411)..(413): Xaa in position 411 to 413 is any amino acid
  Variant (415)..(416): Xaa in position 415 to 416 is any amino acid
  Variant (418)..(424): Xaa in position 418 to 424 is any amino acid
  Variant (426)..(439): Xaa in position 426 to 439 is any amino acid
  Variant (440)..(462): Xaa in position 440 to 462 is any or no amino acid
  Variant (464)..(464): Xaa in position 464 is any amino acid
  Variant (466)..(466): Xaa in position 466 is any amino acid
  Variant (469)..(477): Xaa in position 469 to 477 is any amino acid
  Variant (478)..(478): Xaa in position 478 is any or no amino acid
  Variant (481)..(483): Xaa in position 481 to 483 is any amino acid
  Variant (485)..(487): Xaa in position 485 to 487 is any amino acid
  Variant (490)..(490): Xaa in position 490 is any amino acid
  Variant (492)..(503): Xaa in position 492 to 503 is any amino acid
  Variant (504)..(504): Xaa in position 504 is any or no amino acid
  Variant (506)..(509): Xaa in position 506 to 509 is any amino acid
  Variant (512)..(512): Xaa in position 512 is any amino acid
  Variant (516)..(520): Xaa in position 516 to 520 is any amino acid
  Variant (523)..(524): Xaa in position 523 to 524 is any amino acid
  Variant (526)..(526): Xaa in position 526 is any amino acid
  Variant (528)..(532): Xaa in position 528 to 532 is any amino acid
  Variant (533)..(533): Xaa in position 533 is any or no amino acid
  Variant (535)..(538): Xaa in position 535 to 538 is any amino acid
  Variant (539)..(577): Xaa in position 539 to 577 is any or no amino acid
  Variant (579)..(580): Xaa in position 579 to 580 is any amino acid
  Variant (582)..(583): Xaa in position 582 to 583 is any amino acid
  Variant (585)..(586): Xaa in position 585 to 586 is any amino acid
  Variant (587)..(587): Xaa in position 587 is any or no amino acid
  Variant (589)..(591): Xaa in position 589 to 591 is any amino acid
  Variant (593)..(595): Xaa in position 593 to 595 is any amino acid
  Variant (597)..(627): Xaa in position 597 to 627 is any amino acid
  Variant (628)..(670): Xaa in position 628 to 670 is any or no amino acid
  Variant (673)..(673): Xaa in position 673 is any amino acid
  Variant (677)..(677): Xaa in position 677 is any amino acid
  Variant (679)..(679): Xaa in position 679 is any amino acid
  Variant (682)..(689): Xaa in position 682 to 689 is any amino acid
RKXXXXACXXCXXXHXXCXXXXXRPCXXCXKRXXXXXCXDXXRKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXXXXXPXXYXXXYXXLXXXXXXXFXXXXXXXXXXXXXXXXXXXXXXXXXXXXXXXXXXXXXYXPXFIXXXXXXXXXXDLXXXEXXXQRXLXXXXXXXXXXXXXPXXXXRRXGEIXXXXXEFXXLXGXXXXXXLXXXXXXXXXXXXXXXXXXXXXXXXXXXXXXXXXXXXXXXXXXXFXXEXXDXXXSXXXYXXXFXXXXXXXXXXXXXXXXXXXXXXXXXXXXXXXXXXXXXXXXXXXXXXXXXXXXXXXXXXXXXXXXXXXXXXXXXXWTXKRDXFXIPXXXXXXXXP

SEQ ID NO: 4583 - protein, 24 aa, Artificial sequence
  protein pattern
  Variant (4)..(4): Xaa in position 4 is any amino acid
  Variant (5)..(5): Xaa in position 5 is Asn or Arg
  Variant (7)..(7): Xaa in position 7 is any amino acid
  Variant (10)..(10): Xaa in position 10 is Gly or Asn
  Variant (11)..(11): Xaa in position 11 is any amino acid
  Variant (12)..(12): Xaa in position 12 is Ala, Gly or Gln
  Variant (13)..(14): Xaa in position 13 to 14 is any amino acid
  Variant (16)..(16): Xaa in position 16 is any amino acid
  Variant (18)..(19): Xaa in position 18 to 19 is any amino acid
  Variant (22)..(23): Xaa in position 22 to 23 is any amino acid
RPCXXCXKRXXXXXCXDXXRKXXK

SEQ ID NO: 4584 - protein, 25 aa, Artificial sequence
  protein pattern
  Variant (3)..(3): Xaa in position 3 is Ser or Thr
  Variant (5)..(5): Xaa in position 5 is Glu or Gln
  Variant (6)..(6): Xaa in position 6 is Ile, Leu or Val
  Variant (7)..(7): Xaa in position 7 is Ala, Cys, Ser or Val
  Variant (8)..(8): Xaa in position 8 is any amino acid
  Variant (9)..(9): Xaa in position 9 is Ala, Cys or Val
  Variant (10)..(10): Xaa in position 10 is Gly, Asn or Ser
  Variant (11)..(11): Xaa in position 11 is any amino acid
  Variant (14)..(15): Xaa in position 14 to 15 is any amino acid
  Variant (17)..(17): Xaa in position 17 is Ser or Thr
  Variant (19)..(23): Xaa in position 19 to 23 is any amino acid
  Variant (24)..(24): Xaa in position 24 is any or no amino acid
RRXGXXXXXXXEFXXLXGXXXXXXL

SEQ ID NO: 4585 - protein, 21 aa, Artificial sequence
  protein pattern
  Variant (2)..(2): Xaa in position 2 is any amino acid
  Variant (3)..(4): Xaa in position 3 to 4 is any or no amino acid
  Variant (6)..(6): Xaa in position 6 is any amino acid
  Variant (7)..(7): Xaa in position 7 is Ile, Leu or Val
  Variant (11)..(11): Xaa in position 11 is any amino acid
  Variant (13)..(13): Xaa in position 13 is Asp, Glu, Gly or Asn
  Variant (14)..(14): Xaa in position 14 is Ile or Met
  Variant (16)..(16): Xaa in position 16 is Ile, Leu, Met or Val
  Variant (17)..(17): Xaa in position 17 is Leu or Met
  Variant (18)..(18): Xaa in position 18 is Ile or Val
  Variant (19)..(20): Xaa in position 19 to 20 is any amino acid
  Variant (21)..(21): Xaa in position 21 is Asn, Gln or Ser
CXXXWXXKRDXFXXPXXXXXX

SEQ ID NO: 4586 - protein, 18 aa, Artificial sequence
  protein pattern
  Variant (3)..(6): Xaa in position 3 to 6 is any amino acid
  Variant (9)..(10): Xaa in position 9 to 10 is any amino acid
  Variant (12)..(14): Xaa in position 12 to 14 is any amino acid
  Variant (16)..(16): Xaa in position 16 is Ile, Leu or Met
  Variant (17)..(17): Xaa in position 17 is Gln or Thr
RKXXXXACXXCXXXHXXC

SEQ ID NO: 4587 - protein, 26 aa, Artificial sequence
  protein pattern
  Variant (2)..(2): Xaa in position 2 is Ile or Val
  Variant (3)..(3): Xaa in position 3 is Ala, Ser or Thr
  Variant (4)..(6): Xaa in position 4 to 6 is any amino acid
  Variant (7)..(7): Xaa in position 7 is Asp, Asn, Ser or Thr
  Variant (8)..(8): Xaa in position 8 is Leu or Met
  Variant (9)..(10): Xaa in position 9 to 10 is any amino acid
  Variant (11)..(11): Xaa in position 11 is Asp, Glu, Gln or Ser
  Variant (14)..(14): Xaa in position 14 is any amino acid
  Variant (15)..(15): Xaa in position 15 is Phe, Leu or Met
  Variant (16)..(16): Xaa in position 16 is any amino acid
  Variant (18)..(19): Xaa in position 18 to 19 is any amino acid
  Variant (20)..(20): Xaa in position 20 is Phe or Leu
  Variant (23)..(23): Xaa in position 23 is Ala, Ser or Thr
  Variant (25)..(25): Xaa in position 25 is any amino acid
  Variant (26)..(26): Xaa in position 26 is Asp, Glu or Thr
FXXXXXXXXXXDLXXXEXXXQRXLXX

SEQ ID NO: 4588 - protein, 19 aa, Artificial sequence
  protein pattern
  Variant (2)..(3): Xaa in position 2 to 3 is any or no amino acid
  Variant (5)..(6): Xaa in position 5 to 6 is any amino acid
  Variant (8)..(8): Xaa in position 8 is Ile or Val
  Variant (9)..(9): Xaa in position 9 is any amino acid
  Variant (10)..(10): Xaa in position 10 is Asp, Glu or Asn
  Variant (11)..(12): Xaa in position 11 to 12 is Phe or Tyr
  Variant (13)..(13): Xaa in position 13 is Asp, Glu, Asn, Gln or Thr
  Variant (14)..(14): Xaa in position 14 is any amino acid
  Variant (16)..(18): Xaa in position 16 to 18 is any amino acid
  Variant (19)..(19): Xaa in position 19 is Ala or Leu
EXXDXXSXXXXXXXFXXXX

SEQ ID NO: 4589 - DNA, 1143 bp, Saccharomyces cerevisiae
  CDS (1)..(1143)
atggccaagaaagttgccatctgtacattgctgtattcacgggactatttacctggcgcattgactttagcgtaccaattacaaaaactcttgaaacacgctgtagtggaagatgagataaccttatgcctgctaattgaaaaaaaattgtttggagatgagtttaaacctcaggaaatagctttaattagaagtctttttaaagagattatcattattgaaccgctaaaggatcaagagaagagcatagagaagaataaggcaaatcttgaactgttgaaaaggcctgagctatctcatactttactcaaggctagactgtgggaactggtgcagttcgatcaggttttatttttagatgctgatactttaccattaaataaagaattttttgaaatcctacgattataccctgaacaaacaagattccagattgctgcggttccagacatcggatggcctgacatgttcaacaccggtgtactactactaattcctgatttagatatggcaacaagtttacaagattttttgattaaaactgtatcgattgatggtgctgatcaaggaatcttcaatcaattttttaatcctatttgcaactacagcaaagaggttttgcataaggtgtctccactcatggaatggatacgcctccccttcacctacaacgtaaccatgcccaactacggataccagtcttcaccagccatgaattttttccaacaacacatcagacttattcacttcattggaacgtttaagccatggtcccgtaatacaactgactatgacgaccactattaccagctgtggagaagtacacagcgtgaactttatagtgaatgccacttaagtaactacttcacacacttgcaattgggcaatattgaaacagagacaaatttttaccacgaacctccttgtcttcaagacctgttgaatcatggtaaaagagaaaatcaaaagcacgttgacctggatataacctcagtagatcgaaatgcttcgcagaagagtactgcagagaaacatgatattgagaaaccgacatctaagccgcaatctgcttttaaatttgattgggagtctacggattatttagaccgcgtccaaagagcattcccaaagcctgatacctga

SEQ ID NO: 4590 - protein, 380 aa, Saccharomyces cerevisiae
MAKKVAICTLLYSRDYLPGALTLAYQLQKLLKHAVVEDEITLCLLIEKKLFGDEFKPQEIALIRSLFKEIIIIEPLKDQEKSIEKNKANLELLKRPELSHTLLKARLWELVQFDQVLFLDADTLPLNKEFFEILRLYPEQTRFQIAAVPDIGWPDMFNTGVLLLIPDLDMATSLQDFLIKTVSIDGADQGIFNQFFNPICNYSKEVLHKVSPLMEWIRLPFTYNVTMPNYGYQSSPAMNFFQQHIRLIHFIGTFKPWSRNTTDYDDHYYQLWRSTQRELYSECHLSNYFTHLQLGNIETETNFYHEPPCLQDLLNHGKRENQKHVDLDITSVDRNASQKSTAEKHDIEKPTSKPQSAFKFDWESTDYLDRVQRAFPKPDT

SEQ ID NO: 4591 - DNA, 1851 bp, Saccharomyces cerevisiae
  CDS (1)..(1851)
atgtataagaagctggctattgccacattgctctattccgcagattatttaccaggtgtgtttgcccttggtcaccaagtgaataaattgttagaggaagcaggcaaaaaaggcgacattgaaacatgccttattgtgacgacctctctatttaatggcactttaagcgagctagccaagaatattttacaatcaatatacaccaaaattgtgttggtagagcctttaaattgccaagaagaaagcatacagaagaatagtgagaatttagctcttttggaaagacctgaattatcctttgccttaatcaaagcaagactatgggaattaactcagttcgaacaagttctttacttggattccgacactttacctctgaataaagaatttttaaagttgtttgacattatgtctaaacaaaccacgtcacaagtgggtgctattgctgatatcggctggcctgatatgttcaatagcggtgtcatgatgctaataccggatgctgatactgcatccgttttacaaaattatatttttgaaaacacttcaattgatggttctgaccagggcattttaaaccagttcttcaatcaaaattgttgcactgatgagctagttaaagacagtttctctcgagaatgggtacagttatcatttacgtataacgtaactattcctaatttaggctaccaatcttcacctgctatgaattactttaaacctagcattaagttgattcatttcattgggaaacacaagccatggtcattgtggtcccaaaagaatttcattaaaaacgagtatcatgatcaatggaatgaggtatacgaggaatttaaggaagaacatcaattaaataacgaagtttcgaagccaaagattagtgattccgataaaactgagactcctgaaacgataaccccagtggatgcccctccatcgaacgaacccactacgaatcaagagatcgacacaattagtacagtggaagaaaacgtggacaaccagaacgccgagcctgttcctaactcggatcatagccctgctcctaaccctgtcccattggattttaccaagtggttaacaacctttattaacaaagatcacttgactaatcagccagtaaatgaaagcagagaatattcgaaagagaatgataacaatataatcaatagcagttcaaaccgcgaccaagaaagtcctccaaatagtactcaggaactaaacagctcttatagcgttgtgagtactcaagctgatagcgatgagcaccaaaatgcagaagaggaggatagtacgacagataacgcttcaaattctggagaagaaagccacctcgatgatataagcacggccgcttcttccaataacaatgtaagtaatcaaccagatggcaaaaattttagcaattctaaagaaaataatatcagtgtcgaatctagcccttcaaatccagaacagaaaaggtcaactgacaatatacaaaaaccaagtgtttctactaatgacttaccagacgacgtagaaccacatacctctgttgatgacaatatacagtacttagaaaaagacaaggaaggttatgaagaatttcttccggacgtgtacgagtcaaatgcaatcgataacgaagaagaattttttgatgacgatgcaagagatgctaccgaaggagaaacgaagacgagtgcagttgcagataaacaggaggatatgaaacttacagcagaggaaaccaaccaaccgcaacaagaaatgcccaacttcaaatttgactgggaggactctgattatctatccaaagtagagaggtgtttccctgatgatatttttgagtatgcagtagagtaa

SEQ ID NO: 4592 - protein, 616 aa, Saccharomyces cerevisiae
MYKKLAIATLLYSADYLPGVFALGHQVNKLLEEAGKKGDIETCLIVTTSLFNGTLSELAKNILQSIYTKIVLVEPLNCQEESIQKNSENLALLERPELSFALIKARLWELTQFEQVLYLDSDTLPLNKEFLKLFDIMSKQTTSQVGAIADIGWPDMFNSGVMMLIPDADTASVLQNYIFENTSIDGSDQGILNQFFNQNCCTDELVKDSFSREWVQLSFTYNVTIPNLGYQSSPAMNYFKPSIKLIHFIGKHKPWSLWSQKNFIKNEYHDQWNEVYEEFKEEHQLNNEVSKPKISDSDKTETPETITPVDAPPSNEPTTNQEIDTISTVEENVDNQNAEPVPNSDHSPAPNPVPLDFTKWLTTFINKDHLTNQPVNESREYSKENDNNIINSSSNRDQESPPNSTQELNSSYSVVSTQADSDEHQNAEEEDSTTDNASNSGEESHLDDISTAASSNNNVSNQPDGKNFSNSKENNISVESSPSNPEQKRSTDNIQKPSVSTNDLPDDVEPHTSVDDNIQYLEKDKEGYEEFLPDVYESNAIDNEEEFFDDDARDATEGETKTSAVADKQEDMKLTAEETNQPQQEMPNFKFDWEDSDYLSKVERCFPDDIFEYAVE

SEQ ID NO: 4593 - DNA, 1650 bp, Candida glabrata CBS 138
  CDS (1)..(1650)
atgggtaaggagaatgttgctgtagcgactctgttatattcggcggattatctgcctggtgtgtttacgttggggtttcaattgcggaaacttatcgatgctggcggttgtggatgtgttaagacgtgtattgtggtgaccaagttgctgtacaatgacatactgagcgatatcagtaagaacttgctgaattgtttgtacgatgatattgtgctcgtggatcctttggattaccagcatattacccaggacatgaacaaggagaacttgaaaatgctggagagacctgaactgtcctttgctctgattaaagcgaggatctttgagctaacccagtatgagcaagtactttacttggacgctgacaccttgcctctgaactctggcatatttgacttatttgaccagttggccgaccagactagcgaacaagtcgccgctgtcccagatatcggctggccagacattttcaacagtggtgttatgatgattgtccctaacagggacgttgtcgccgaactaaacaactacattttaaatgtggtgtccattgatggttctgaccaaggtatcctaaatcaatttttcaatcagaacatgagattgaatgattttgggagaatagccaattactccactaaggaatggattaggttgccatacctttacaacgttactacgccaaattacggctacgagtgccctccagctatgaaattctttggcccacatattcgtttagtgcatttcattggtaaacataaaccatggagcaaatggtctcaagagcaattccaaaagagctcatatgccgctcaatggagagcagcgtacttggatttccaaatacagtatgatctggttgatctattagcccatactaccatcaaggacgaggatgagcacattgaacctcaacaggatgagtgtgaagaacacatagaagagaaccaacctgatgaataccaccatgagcaaacgcaatacaatgagcgtctggagaagattgacgaaatcaacgaggacgagtgcgatattattgaggaggaacaacaaccaatagaaaaacccccaactccaatccaacttcctctagatttcaaagaatggttaacaacatttatatcgaaggaagatgaagagcaacaacataacgaagagccttccgttgaggaatcccaaggaaatgagccagaagaaacacattttagaggtgttcattatgaggagcatatgattcaacatcatgaagaggaaaccataaatagacaggtatcgcatccaaaagaagacgccgcaaacgaggcagcaagagaaattgaacaaccaaaagatagatatgatagaaaggttgagattatagaggaagaagacataaaggatcatgaactggatgatttaattgatgatgaatcgtcaaccaataaacaagaggatgacgatgaaatagtagatgagcaagaagagtctagacttgcttcggagctggaagtaaaggactccaagatggatgtacaagaatcaaggtcacataatattcacaaccaaaataataataataattacaggtttgaatgggaaaatacaaattatttgaacactgtggaaagatcattccctgaagatatttttgaatattctgtagagtga

SEQ ID NO: 4594 - protein, 549 aa, Candida glabrata CBS 138
MGKENVAVATLLYSADYLPGVFTLGFQLRKLIDAGGCGCVKTCIVVTKLLYNDILSDISKNLLNCLYDDIVLVDPLDYQHITQDMNKENLKMLERPELSFALIKARIFELTQYEQVLYLDADTLPLNSGIFDLFDQLADQTSEQVAAVPDIGWPDIFNSGVMMIVPNRDVVAELNNYILNVVSIDGSDQGILNQFFNQNMRLNDFGRIANYSTKEWIRLPYLYNVTTPNYGYECPPAMKFFGPHIRLVHFIGKHKPWSKWSQEQFQKSSYAAQWRAAYLDFQIQYDLVDLLAHTTIKDEDEHIEPQQDECEEHIEENQPDEYHHEQTQYNERLEKIDEINEDECDIIEEEQQPIEKPPTPIQLPLDFKEWLTTFISKEDEEQQHNEEPSVEESQGNEPEETHFRGVHYEEHMIQHHEEETINRQVSHPKEDAANEAAREIEQPKDRYDRKVEIIEEEDIKDHELDDLIDDESSTNKQEDDDEIVDEQEESRLASELEVKDSKMDVQESRSHNIHNQNNNNNYRFEWENTNYLNTVERSFPEDIFEYSVE

SEQ ID NO: 4595 - DNA, 1233 bp, Kluyveromyces lactis NRRL Y-1140
  CDS (1)..(1233)
atgttaggtgttgttacattgttgtactcgttggattatttgccaggtgctttgacattagcatatcaattgaggaaattactacctaaaggttcaaaagagaagcagttatgtttgattctttctaaggaattgattgaagaaggacagttaagcgacgacgccttgaaagtgcttgaaatcttattcgatgatattatagaaatagaccccatcgacttaagcgacccggtcataagacaaaaccaagtgaaccttatgatgttggagaatcgatcagagttagcgttcacatttatgaaattacatttatgggagttgacacaatatgagaaagttctgtaccttgatagtgatgtgctaccccttgattcagatatattcaaaatttttgatcatgtttccaatcaaaccagcgatcaaattgctgctgtaccagattgtggctggcccgatttgttcaacagtggtgtaatggtcattaagcccagtaaggaaaagtaccaggaattgcacgaattggcaacaaaagaattatctatagatggtgcggaccaagggatcttgaaccaatttttcaaccctatgtgtcacgatggggatagactgacggagtggatcagattaccttttttctacaacgtgacgtctcctaacgctggatatcaatactctccagctatcaagttttttgccaacaagctaaagttggtccatttcatcggtaaaaacaagccatggaagcatgggtcaactggtggtcaatacaacgataaatataggaaccaatggtggtcattgtacatggaactatgtcatgaatatttccagtccgaacttgatattgacattgaccacatatgtcgcggtgtgaaggacgtagatttgtcagacatcgatttggaagatgtaaaacctacaccggtatggaatccagctaaggaagcaccatccgatgagttacctgccgaagctccgcatttaaatatatccaactcttacacttgggaatcagaactcgtagtaattccagatgacactccagcacaagaaaaagtaacggtaccatctgaagatggcgctgatattactgctgatcatgatactattgttgaggcagaactgccagtgacggaacatcgtcataagacttacacaagaccaaagccaattttcccatgggaactagacacaaactacaaagccacccgtgttttcccggaagatgaataa

SEQ ID NO: 4596 - protein, 410 aa, Kluyveromyces lactis NRRL Y-1140
MLGVVTLLYSLDYLPGALTLAYQLRKLLPKGSKEKQLCLILSKELIEEGQLSDDALKVLEILFDDIIEIDPIDLSDPVIRQNQVNLMMLENRSELAFTFMKLHLWELTQYEKVLYLDSDVLPLDSDIFKIFDHVSNQTSDQIAAVPDCGWPDLFNSGVMVIKPSKEKYQELHELATKELSIDGADQGILNQFFNPMCHDGDRLTEWIRLPFFYNVTSPNAGYQYSPAIKFFANKLKLVHFIGKNKPWKHGSTGGQYNDKYRNQWWSLYMELCHEYFQSELDIDIDHICRGVKDVDLSDIDLEDVKPTPVWNPAKEAPSDELPAEAPHLNISNSYTWESELVVIPDDTPAQEKVTVPSEDGADITADHDTIVEAELPVTEHRHKTYTRPKPIFPWELDTNYKATRVFPEDE

SEQ ID NO: 4597 - DNA, 1740 bp, Debaryomyces hansenii CBS767
  CDS (1)..(1740)
atgactcaaggggtattcactcttttatataacgaagaatatttggcaggggcccttgttctagccattgcgctccgtaagatcctcgaacgccagcccgaggttaatatttcattgggggttattattgataaagaacggttgaacgactctcaggtatcacttttgcggggtttgtacgatgatataattgaagtagaacaattggagtccgatatggatcacaggttgacctacgacttagggagacctgaattgaagcagacatttaccaaaatccagctttggtcgttgacaaagtacgacaatatattgtacttggatgctgacactttgcctaatgtccccaaggatgaatcgcaggggtcaattctcgatttgttgaagttagacttcgcttccaataagattctcgcagctcctgatagtgggtttccagatatcttcaactcaggggtcatgttgttgaagccgaacatgtccgactacactaatctattgaacttaatagaggaatcgagagttgatcgcaagctttcgttcgatggggcggaccagggtctcctaaacgagtatttcaacctgcagccagattgggttcgagatttagtgtcttctaaccagacggaggttgcggctgcttatggtgccaaatcgtcgaattggattccattgccatttttatataacgtaactccgtccaccgaatacgaatatttgcccgcatacaagcattttgccagtactgggtggttgagcactatatacggcagtctgggtagagggtattcgaatttattgcctcatttcaatggagaaaaatcccaaataaaacttgttcattttattggacccatgaaaccatggaaagcagaacttcccattggtatttatggccagtggtgggacacatggtatgggtattttggtaatgtcacagttgaggaagttgtttatcatggtgggggcgatttagttgttgaatctagatcgttcgaagatcaaagggaaactcaaatacagccggtagaaactccaccgacgaactcaaaacagggtgagaaattcgatccgtcgtatctctgcgatccaacaaactaccagcacattcccagcaacattgtccccagtgttgacgcttcgtgggatcctgcaaacgaaccacctcctgcggccaagcccgttaatcatgaaactgtagagctcgagaaaggcatgagatcattcacaaatgcatgggactctagcgatgaaaagtccacccatgaggattcgcatgcaccagaatatgaaggtgttcaactttctatggaagctcaacgtccttccgatggacatcctacagttgaacataacaaagacgaacatcctacagtagagcagcctacagacaacgactccacagcgcacccatttggccaccacacctctcagagaccagaaagagtatttgctgacgacaacgttgttcttccccatccatatatgcctcgagccatctccgataacgcagatccggtccctagctcaacaccacccggatccggtcaattggagcatgaagaaatctacaaaacgttagctaacctccaaatagaccagacccacccagcaaacttggatcaagacctgttccaacggacagaacaagactcacctcaaaatgatacccccattgccaaattatttccctgggagttcaacaaggaacaatatgttccacagagaacgttcgattag

SEQ ID NO: 4598 - protein, 579 aa, Debaryomyces hansenii CBS767
MTQGVFTLLYNEEYLAGALVLAIALRKILERQPEVNISLGVIIDKERLNDSQVSLLRGLYDDIIEVEQLESDMDHRLTYDLGRPELKQTFTKIQLWSLTKYDNILYLDADTLPNVPKDESQGSILDLLKLDFASNKILAAPDSGFPDIFNSGVMLLKPNMSDYTNLLNLIEESRVDRKLSFDGADQGLLNEYFNLQPDWVRDLVSSNQTEVAAAYGAKSSNWIPLPFLYNVTPSTEYEYLPAYKHFASTGWLSTIYGSLGRGYSNLLPHFNGEKSQIKLVHFIGPMKPWKAELPIGIYGQWWDTWYGYFGNVTVEEVVYHGGGDLVVESRSFEDQRETQIQPVETPPTNSKQGEKFDPSYLCDPTNYQHIPSNIVPSVDASWDPANEPPPAAKPVNHETVELEKGMRSFTNAWDSSDEKSTHEDSHAPEYEGVQLSMEAQRPSDGHPTVEHNKDEHPTVEQPTDNDSTAHPFGHHTSQRPERVFADDNVVLPHPYMPRAISDNADPVPSSTPPGSGQLEHEEIYKTLANLQIDQTHPANLDQDLFQRTEQDSPQNDTPIAKLFPWEFNKEQYVPQRTFD

SEQ ID NO: 4599 - DNA, 1212 bp, Debaryomyces hansenii CBS767
  CDS (1)..(1212)
atgacagttgcatacattactctattagtgaatgaagtttatttgccaggagcattaaccgtggcaaaaatattgaagaatgactacaaaacgagccatcctttagttatattgctagatacaagccaaattagtgagaagtcgacgaaattaattgaagacgtctacgatgaaattattcctattgatggtggcttaataacgtctccaatagacaaattagtttcccaattgaatagacttgaattagcggtcacattcaccaagatcttgctttggaagcaaatacagtacaccaaattggtatatctcgattgtgatatcttaccgatgcaaggaatagacgatttatttgagatagagattagctcaaaccaagttgcagcttctcctgatagtggatggcccgatatttttaattctggggtgatggttttgaaaccaagcatgattgtttacaataagttaagcgaatttgtcgagaccgaggataatacttttgatggggccgaccagggactatttaacgagttcttcaatatcgcttctaaaggattgaattgggttagattaccatttctatacaatgtgaccttttcgcagtcatatcagtacttgccagcatttgatcgcttttttaaggatatcaggattttgcattttataggtctgcaaaagccatggatgtttgggggatacgacaagttcaaggagtactggtggagtgcatttaataagcattattcgcctgatgtagtccaatatgtcttacaaactactgggtcaggatccaataagggtgaggcaagtgcgttgaatattgagccttcccccaacgtctgggacatagaatctgtcgataacaaagtacaagaatcgcccgtcgacaccccatcaatttttccatgggaggagagaaaggagaatgcgccacccacaagagtatttacttcgttctcgactcaccactcatcaattagaccgacagaaaagctgcctaagggaaaggagttcaacaaggtgcccctgagctataaggatgatatcgagacctcaaccagtagcaccaggtcaaggactggacaacctatgttcagacaatatgaatttaccgaaagtttcgatccagaagaatcattcgacaaggtatccaaaatacccatcaatttgttgaagaagaagctagagcaggagaagcaaaacaatccatag

SEQ ID NO: 4600 - protein, 403 aa, Debaryomyces hansenii CBS767
MTVAYITLLVNEVYLPGALTVAKILKNDYKTSHPLVILLDTSQISEKSTKLIEDVYDEIIPIDGGLITSPIDKLVSQLNRLELAVTFTKILLWKQIQYTKLVYLDCDILPMQGIDDLFEIEISSNQVAASPDSGWPDIFNSGVMVLKPSMIVYNKLSEFVETEDNTFDGADQGLFNEFFNIASKGLNWVRLPFLYNVTFSQSYQYLPAFDRFFKDIRILHFIGLQKPWMFGGYDKFKEYWWSAFNKHYSPDVVQYVLQTTGSGSNKGEASALNIEPSPNVWDIESVDNKVQESPVDTPSIFPWEERKENAPPTRVFTSFSTHHSSIRPTEKLPKGKEFNKVPLSYKDDIETSTSSTRSRTGQPMFRQYEFTESFDPEESFDKVSKIPINLLKKKLEQEKQNNP

SEQ ID NO: 4601 - DNA, 1644 bp, Yarrowia lipolytica CLIB122
  CDS (1)..(1644)
atggcctactgcaccttgctatccagcgacaattacttgcctggagccattgttcttggtcatcgtctcaaaaccctcgactcatcacgcgaccgtctgtgtctcatcaccaaggccgtttcgccgcacatcaaacaggaactcgcccagtactactcgtctgtgtttctggtggacgacattctaccctacaatgactcgtccagagctgcacaacagctgctagggcgtccggagctcggcaccacgctggccaagattgctgtgtggaacctcacccaatacaggcagattctctttctggattcagatgttcttccgctcaaggacattagtattctgttcaaggtgctccagaatcagagcaacagcggaaaacccgttctggtggcttcgcctgacgtcggatggcctgacgtgttcaattccggcgtttttgccaccgttccggaccaaaatgtgtactctacgcttgtcgaacttgcccagtctggcatttcttttgacggaggagatcagggcctgctgaacgagtatttccgagaagtaaacccgttttctacctcgtctgagcccgacggatcgtgggttcgagcccccttcaccttcaacgtgcctgctaatggcgctggggtcggttctggagttgcttctggagctggtgcaggccctggagccggactgggatctggagcagccggctatgagcccgcttatacccgtttcaagaatgaagtgtccgctgtgcactttctgggccctggaaacaaaccctggatgtcttcaagaggcagtttcaacgactaccatgtggcgtggaaccgtgcgtacaacgagctgtatccgtacgtgaagccctctgagctggctgactctttgcgaaacaaacgaacaattggagccgatattaacagatgggatccctccattatgccccctcctgcacgaggtgtgggagaagctgtcaaattgcagcagacggagtttcgaaacgtttgggatgctaatcacactgctccttcccctgcgccttctcacgaacaccaccatcatcatccccctcatcatcactctggtagccatcatcatcatcaccactcggacaagtctcaaaagcacgcaccaagcgcaccccctcccatctttccatgggaacgaaaaaaccgagtagtcacccgagtgtttgacgactatgtggtgcctccatatgcggaatttgttgctcctgaagaaatcgtcgacgacgaggaagaagacgaatatgagtacgtggaagacgacgtggtggaggtagacggtgaagtcgacgatattgtcgaaggcatgtcgttctcgctgaatgacatttcagaagatgatgacgagtatacgccctctggaggcaagaagattgcttaccctgtgactccctttgcttctattcgaggtagacgacctaccggccttccaggcgtcgctcccgagtttgaagatgacgaggaggaaggaggcgaagttgtgaacgacattcgcatgcgacgaacttccgaagacgagtatggaagcaccgatgagtgggaccctagtctgaagctggaggagctcagacgggcctctgatcgtctcagttcctctcagacgtcgtacgtccctgatgatatttga

SEQ ID NO: 4602 - protein, 547 aa, Yarrowia lipolytica CLIB122
MAYCTLLSSDNYLPGAIVLGHRLKTLDSSRDRLCLITKAVSPHIKQELAQYYSSVFLVDDILPYNDSSRAAQQLLGRPELGTTLAKIAVWNLTQYRQILFLDSDVLPLKDISILFKVLQNQSNSGKPVLVASPDVGWPDVFNSGVFATVPDQNVYSTLVELAQSGISFDGGDQGLLNEYFREVNPFSTSSEPDGSWVRAPFTFNVPANGAGVGSGVASGAGAGPGAGLGSGAAGYEPAYTRFKNEVSAVHFLGPGNKPWMSSRGSFNDYHVAWNRAYNELYPYVKPSELADSLRNKRTIGADINRWDPSIMPPPARGVGEAVKLQQTEFRNVWDANHTAPSPAPSHEHHHHHPPHHHSGSHHHHHHSDKSQKHAPSAPPPIFPWERKNRVVTRVFDDYVVPPYAEFVAPEEIVDDEEEDEYEYVEDDVVEVDGEVDDIVEGMSFSLNDISEDDDEYTPSGGKKIAYPVTPFASIRGRRPTGLPGVAPEFEDDEEEGGEVVNDIRMRRTSEDEYGSTDEWDPSLKLEELRRASDRLSSSQTSYVPDDI

SEQ ID NO: 4603 - DNA, 1086 bp, Candida albicans SC5314
  CDS (1)..(1086): transl_table=12
atgtcttttgcttatgccactcttttaataggggaatcctatttaccaggtgtattaactttgggtaacagattaaaacagttgggcacaaaacataaattattgatcttattagatgtcagttcaatttcattacaaagtaaacaattgattgagtcaatttatgatgaattgattcctatcgataatcaattgattttatctccattgcagaagttgagtgaacaattacaacgtcaagaattatcaattagttattcaaagattttattatggaatcaattagattatgattcgattgtttatcttgatgccgatgtattaccattacaaaatttagatcgattgtttattgattatgatgttgatgataatcaaattggtgctgcttctgattctggatggccagatatttttaattccggggtgtttaaattgaaacctaacaaacaaacatttgaacaattattggaatttagtgttgatccaaacaatacttttgatggaggcgatcaaggattgtttaatgaatatttcaagttggagaattggataaggttaccttatttatataacgtgacacctaactatcgtcaagattatcaatatttaccagcattcaatagatttttcaaggatattaaagtattacattttattggtcaagtgaaaccttggcactatgaaaatgtcttagcaagtgatttggccaactttcatcagtattggtgggacgaatttaataagcttattggagatgatgttgcattgaaatatacattgttgaatttacctagaggtgaagcaacaaagttgaaatttggtaaaactgtgaatgcatgggataaaaaagatattgaacaagacactgaattggtagaagaagaagaagaggaagaagaagtagtcagtcacagtccaattttcccttgggaacatcgtcaagagaaaagacagcctactcgtgttttccaaaatattcctactacttctactgtaggtaatgtatcgggaaaatctggtacaaaggaggaacaagagttggatagaagtactgaaactttgaaaagaactcatatctcctaa

SEQ ID NO: 4604 - protein, 361 aa, Candida albicans SC5314
MSFAYATLLIGESYLPGVLTLGNRLKQLGTKHKLLILLDVSSISLQSKQLIESIYDELIPIDNQLILSPLQKLSEQLQRQELSISYSKILLWNQLDYDSIVYLDADVLPLQNLDRLFIDYDVDDNQIGAASDSGWPDIFNSGVFKLKPNKQTFEQLLEFSVDPNNTFDGGDQGLFNEYFKLENWIRLPYLYNVTPNYRQDYQYLPAFNRFFKDIKVLHFIGQVKPWHYENVLASDLANFHQYWWDEFNKLIGDDVALKYTLLNLPRGEATKLKFGKTVNAWDKKDIEQDTELVEEEEEEEEVVSHSPIFPWEHRQEKRQPTRVFQNIPTTSTVGNVSGKSGTKEEQELDRSTETLKRTHIS

SEQ ID NO: 4605 - DNA, 4137 bp, Ustilago maydis 521
  CDS (1)..(4137)
atgaatgatcatctgacccattccttatatgatccacagcgtcagcatggcgaacaacggttcaagtcgagcgacgttgcaagccaagtcatgtccacagatgcagtctgtgggagcagtactgcgtccatgattcgaaaacagcctgtcccaaccacgaatgtagatcatgcaacaatcacgaatcacgaatcacgaatcgtgaaggaattggtcctgctaacgaaatccgaaaatcaagaatcgcgtcgaattcaggaaagcaggccactcagactgcagcgcacacaggtgctcgcgctgtggagttcccgcattttttggggaggttttctcttctggtcaaatcataacacgcaccctgtgcgcagtctggagagtggcacggagtgggcgaagctgaagcgactcatcactgcaaacacggaaatggttcagatgcacaccttggagatcgccacacagcgacacgcgcagaaagagaaagagagagcgccgacaccttccgattcacttgttcgcatcggatgcatgatgctgaggcatctctgtttcttgtcacctcgttttgacatcgctcctcatctccgtggccgcgttcgatttcccagatcttcttgggtcacgcctcccatcgtaccattcgcgaccatcactctttctcgacttggccttgtattttcaccctggcaccccttatttaataccttgccaccaaccatcgcctcactccgcagcctgttctcccacctacaactgtttctttctactgcacgtttatcgactttattgccttgccttgcatctcaacagcccgtttcggtccttttcgagctgcgtcactttggagcgaccctaggaccggttcatcagcgcgcgtgccggcatctgctctggacgtcacgttccacagcctatcggttccacacgctgatgagttcctcatctaagcccaccaccagcaatgcatttgtcaccctcttgacttccgatcactacctgccaggcgctctcgtcttggcagagtctttgcgcctcagccatggcattaccaaaaagggcaagcacagggctgctgcttccactcccccggctgccgaatttcaagtggtcgctctcatcacgccagacacactctctgtccagtccatcaaggcattgcgccgtagcggtttgtttgactggatcgtgggagtagaacctattggcttccgccagatcctcgccacttcgccacatagcgataatccagcacccgctttagcagacgatgccaaatccgccgctcttcctgtcgtgctcgattcggagctcgatgccatgatccgagagatggagcacaatctaggtcttttgggccgtcctgatcttaccaacacgctcacaaaactgcatgcttggaggctgggccgcgattcagctcacctcattgctcacggtgccactgccactcacgatgcaactcatcgatggcaaggttttgacaagcttgtctttctcgatgcagacaccttggtgctccgccccatcgaccatcttttccacctagcaagcaatgtcaccttcgccgctgcgccagacacgggctggccagatgccttcaacagtggtgtcatggtcctcacaccctcaaatcacaccttcgaagccatccggtcctttgcccgcaccacaggctcttgggatggtgcagaccaaggtcttcttaacgacttttttggtcctgaagatggctccgatgagtctgctgctgactctcaacgtgctgcctcagctccaggccgcggctggaagagactcagcttccgctacaacgtcaccagtcacggtggctacacattcgcgccagcctatcagcgctacgggcagtcgatcaacattgtccatttcatcggtcaacacaagccatggaatcgtactcggccatcgggtatcccccagcccaatccactcggtggtcctcgtgagctcaacagcgaaaccatttcgcctgaccagccggactatttgctcgccctctggcacagcgcattcgcttccctttaccccgcctccggctccacatcacccgacagcgagattgagattgttcacaccgaacgcggcgttgaggtcgtcgagcgtcgcaaatttaccgttcctactttccacgctgtatgggatgctgaggcgcgccaggaagattcgccaaccaacaaactcgacgttgtatatacacctgcgcctgaaagaccaccagtttgggaagcagcgtatgccagtctgcctttggacgggagaaactcgttgatcgcgccggcgcccgaggtcgcacgcgtaccttctccgccgacaccgacgcagaagagcatcgacgccgaggccagggctagggaagcgactgttggaccaaactctgctcctgtggcaattcctggtcgggctacggccgacaagaaagacgagagcgacgactcgcctcagcacttttcgccgccaaagctgtcatggaatccggctcatgaagctcctccaaccggatccgatgcttcgctctaccagatgcgaatccccatcgacgccttctattcaaatatctgggatgccggccaaaaaaccccacgcacgctagccgagcaaaaggcagcattctttgtgccgcaggctgctgcacctcaacaacctggcgctcgtccacatggcggtcccggatatatccctgctcaacttcgacgcgatcgtgtgttcgacaatcttggatcgcacaagcccgacccaagcaaagtcaagcccattttcccctgggagaccaaacagcaaacggccaacgccccatccagagtattccctgatgagcctcgccagccctccccatcgccggatgccgacaaaactcccacgctcgggagttcgaaggacggctccttccgtgctcctgctcctcctaccgctcccgctcccgctccagtgccagcgccgccacccgtgcagcgcccacgaggcttgcctacgaacctgtcgtatgtcaatgcatgggacaaggtgggtgctattgtcaattttgccaacgcctggaatcgacgcacgcgccctccttgccccgagaagcgaaggttgcatacagatcagccgagcgacaacagggccagctcgagggatcccggctctgtacgccttgtcgatgcacgaaagaatggaggaggctccgcagtgtctgccgggtctcgcggagcaagcttgcccggaaacactttgcgccctttgcccacgacaaagctggagcgcagatcgagcgtgcaagaaggcgacgatgcgcttgacgacgaagcatcggacagccgggatggcgatgacgagtcctccgatggcgaggagtcctctggcaacgaagacacatcgcaggtggcgaccgagcgcggtgcgacgccctctcccgtcaaagtgcgtcaaccagcttggccgcgcgaggggccgggacgagggtacatgaagaaagcggaaaactctgtgcatgctcagatgcatgcgacgccgcgaagtcccagaatgagctcacgcgtgctctcgtatgcgtccacggcgaccgagggcgagggaaagagcggtgggcgattctcgtcatccagtagcgcgtccaactccaccatcacgagcgaaggcgcggccgcggcgagacagaaggctaaggacaggatccgtccgaacggatggatcccgaccggctcagcaggctcggggatgagttctccaccacctggctaccgctctgcatccagcttgcgcgggatcccgggtgtgactggcggttcgtctcgatctgctttcacccccgcctactaccagggcatgatgggcagacgacgcgaaaccaactcatccaacgattcgcaatcgggcgagtccggagccaactctcccaccgctctactcagcccgtctctcggcaacccaggtgcaggcatgcccatcatgatcagtagcacatcgcgcgtctcttcgcatcctaccgacacgagactcacgcaaacattgccgtccgctttggacgagcctttcagctcgagcccggtcaatctcaagtctgagctctctaggcaggcaaggatgcatcagtacgccaaattctccacttcaaattgggctcatccgccctcgtaa

SEQ ID NO: 4606 - protein, 1378 aa, Ustilago maydis 521
MNDHLTHSLYDPQRQHGEQRFKSSDVASQVMSTDAVCGSSTASMIRKQPVPTTNVDHATITNHESRIVKELVLLTKSENQESRRIQESRPLRLQRTQVLALWSSRIFWGGFLFWSNHNTHPVRSLESGTEWAKLKRLITANTEMVQMHTLEIATQRHAQKEKERAPTPSDSLVRIGCMMLRHLCFLSPRFDIAPHLRGRVRFPRSSWVTPPIVPFATITLSRLGLVFSPWHPLFNTLPPTIASLRSLFSHLQLFLSTARLSTLLPCLASQQPVSVLFELRHFGATLGPVHQRACRHLLWTSRSTAYRFHTLMSSSSKPTTSNAFVTLLTSDHYLPGALVLAESLRLSHGITKKGKHRAAASTPPAAEFQVVALITPDTLSVQSIKALRRSGLFDWIVGVEPIGFRQILATSPHSDNPAPALADDAKSAALPVVLDSELDAMIREMEHNLGLLGRPDLTNTLTKLHAWRLGRDSAHLIAHGATATHDATHRWQGFDKLVFLDADTLVLRPIDHLFHLASNVTFAAAPDTGWPDAFNSGVMVLTPSNHTFEAIRSFARTTGSWDGADQGLLNDFFGPEDGSDESAADSQRAASAPGRGWKRLSFRYNVTSHGGYTFAPAYQRYGQSINIVHFIGQHKPWNRTRPSGIPQPNPLGGPRELNSETISPDQPDYLLALWHSAFASLYPASGSTSPDSEIEIVHTERGVEVVERRKFTVPTFHAVWDAEARQEDSPTNKLDVVYTPAPERPPVWEAAYASLPLDGRNSLIAPAPEVARVPSPPTPTQKSIDAEARAREATVGPNSAPVAIPGRATADKKDESDDSPQHFSPPKLSWNPAHEAPPTGSDASLYQMRIPIDAFYSNIWDAGQKTPRTLAEQKAAFFVPQAAAPQQPGARPHGGPGYIPAQLRRDRVFDNLGSHKPDPSKVKPIFPWETKQQTANAPSRVFPDEPRQPSPSPDADKTPTLGSSKDGSFRAPAPPTAPAPAPVPAPPPVQRPRGLPTNLSYVNAWDKVGAIVNFANAWNRRTRPPCPEKRRLHTDQPSDNRASSRDPGSVRLVDARKNGGGSAVSAGSRGASLPGNTLRPLPTTKLERRSSVQEGDDALDDEASDSRDGDDESSDGEESSGNEDTSQVATERGATPSPVKVRQPAWPREGPGRGYMKKAENSVHAQMHATPRSPRMSSRVLSYASTATEGEGKSGGRFSSSSSASNSTITSEGAAAARQKAKDRIRPNGWIPTGSAGSGMSSPPPGYRSASSLRGIPGVTGGSSRSAFTPAYYQGMMGRRRETNSSNDSQSGESGANSPTALLSPSLGNPGAGMPIMISSTSRVSSHPTDTRLTQTLPSALDEPFSSSPVNLKSELSRQARMHQYAKFSTSNWAHPPS

SEQ ID NO: 4607 - DNA, 2121 bp, Phaeosphaeria nodorum
  CDS (1)..(2121)
atggcgcgacctttggaagatgtgtactgcacgcttcttatgagcgattcatacctccctggtgccgccgtcctcgcacattctctccgcgatgcaggtacgaagaagaagctcgccgtgctcatcactctggagactctgtctgccgacaccatcacgcagctgaaggagctctacgactacttgattccggtggagcgcatacgaacaccaagtcccgcgaacttgtatcttatgggccgtcctgatctgtccttcgccttcaccaagattgctttgtggagacagacccagtttcgcaagatcgtatacctcgatgccgatgtcgttgcactccgagctctcgatgagctgttcgatatcgaggcacccttcgctgccgcacctgacattggctggcctgacgccttcaacagtggtgtcatggtgatatcaccagacatgggcgaatactgggcgctgcagaccatggcagccacaggggacagcttcgatggcgctgatcaaggtctcttgaatcagtacttcgagcatcgtccatggcagcgactgaagttcacgtacaattgtacaccgaacgccgagtaccagtgggagccggcgtatcgttactataaaagagacatcagcgctgtacacttcattggcaaagagaagccatggtcgagtagccgtacaagtggaccaggtgtctatggcgagctcttgagtcggtggtggcaagtgcatgacaggcatttgagaagagacgcttcaggtacaacgcacctccagatccaatcatcagctcctgttcccaatattgttatcgagccagaggcctcagtcacaaccactgagccacccatgaccgaccccggtgaagtggtcgagaatattgaccagggtgttttagaacctgtcccgactacagagctgcgcaaattctctgcgccggatatggagtgggatgcaacaaaattcgagcctcctgcgcaatcgaggcccgaagctgccaatttcccaaccgcccaatacaccttcagtgacagccgtcagttgttccaggcaccccatgcctacccagcaccaccaagggatatgtggtatcaagtacctgaacatcgacccaagccagcagaggcgcccaagccgattttcccttgggagcaacaagctgataggccgaagcctactcgtgtctttgctgaagatatccagccccagccaacccgtgaacctccgtcaccgactcacgcattttccactgtgcattacgataacagcgagctagaagcgtctgcgggctcaagtgacggggtcacaagtcctgaagctttaggatctccaaagtctgctgaccagcaatggcaatctttccagcagaacaacgccaatgcctgggataacatgccaggtatcgagaactatgtacgggcgatcatgggttcgcaaggtggtaagcggaccaacacccagatacttcaacaaacgactggcactgaggagctacactcaccgctacttgaacgtaagaaccgacgcgaaagcctcatcctcactgattttccctctgccatagagagaccaagcttgcccgtcacaccggcgcctatcaggcggcctactttctggggcgaggaacgaaacgagacgggcgagctacctgccgccaagggcgtcccggatcaaaccgaatggaatcctgaagcgaggctcgagcagctacgacggtcgtctctcgtcgagattgaacacatgactaaagacccacatcctgatcctcctctaagagcgctacctgaacattcaattctcgatgacgaaccagcaacgcaacaccccagcggcctcagtggagttgcctcacctcatggcctcgatggtactgcgaaccaaaccagcacgtcccaaccccacacagttactggcacatcaagggtcgattttgcgcagagcatgggagcaagcaccgagacaagaaccgaaagcagtgaacaacaaattcgatctggcaacatgacgttcaaattgcccgactttaagcaagaagatgcaagtgtggctgccacccgcgaagacgtattgagcccaactcagccacaagacgagcagcctgccccaggtacagccccttcatag

SEQ ID NO: 4608 - protein, 706 aa, Phaeosphaeria nodorum
MARPLEDVYCTLLMSDSYLPGAAVLAHSLRDAGTKKKLAVLITLETLSADTITQLKELYDYLIPVERIRTPSPANLYLMGRPDLSFAFTKIALWRQTQFRKIVYLDADVVALRALDELFDIEAPFAAAPDIGWPDAFNSGVMVISPDMGEYWALQTMAATGDSFDGADQGLLNQYFEHRPWQRLKFTYNCTPNAEYQWEPAYRYYKRDISAVHFIGKEKPWSSSRTSGPGVYGELLSRWWQVHDRHLRRDASGTTHLQIQSSAPVPNIVIEPEASVTTTEPPMTDPGEVVENIDQGVLEPVPTTELRKFSAPDMEWDATKFEPPAQSRPEAANFPTAQYTFSDSRQLFQAPHAYPAPPRDMWYQVPEHRPKPAEAPKPIFPWEQQADRPKPTRVFAEDIQPQPTREPPSPTHAFSTVHYDNSELEASAGSSDGVTSPEALGSPKSADQQWQSFQQNNANAWDNMPGIENYVRAIMGSQGGKRTNTQILQQTTGTEELHSPLLERKNRRESLILTDFPSAIERPSLPVTPAPIRRPTFWGEERNETGELPAAKGVPDQTEWNPEARLEQLRRSSLVEIEHMTKDPHPDPPLRALPEHSILDDEPATQHPSGLSGVASPHGLDGTANQTSTSQPHTVTGTSRVDFAQSMGASTETRTESSEQQIRSGNMTFKLPDFKQEDASVAATREDVLSPTQPQDEQPAPGTAPS

SEQ ID NO: 4609 - DNA, 3573 bp, Pleurotus djamor
  CDS (1)..(3573)
atggcaactccttatgccttcgtcaccctcgtaacttcagatccttacctcccaggggctctcgcgctcgtcgctgctctcaacgatgtccacaaggcctcagacatccccttcgacaccgtctgtctcgtcaccccagagaccgtcgacgtggcctccatcaagctcctcagaaaggccttccgtctcgttgtcggcatagaactcatcgtgcagccagatccctcaggtttaaaccttttaggccgcccagacctcgacactgtccttactaaattacacgttttccgcttggtccaatactctaaaattattttcctcgatgccgacgttttgccaatcaggcctctctcccatttgttctctctccctcacgaattctctgccgtgcccgacgtcggttggcccgatatattcaactccggtgttctcgtattatccccgggagaagacaagttcacccaactcaatcaattattaaagtctaaaggaagctgggacggcggcgatcagggtatccttaacgaatggcgcggagacgactggaacaggctcagtttcacctataatacaacacccacggctgcgtacacttatgccccagcatatgaacgttatggctctcaaatctctgctatccatttcataggccccaataaaccatggaaggcctatgattacaactccttggtcgaccgttggttttccgtctacgataagcactatcgcgctcctatcgtcgttccaaagacaccttttgaagtgagatactacgctccggcttgggacgcacccccacctccaagggacgaatctggccgcccctcaggcggagccctcagcttggacgatctccgtgaaatggctattcggggtctaaacgcatcttcatcatcttatggttattctggaccatcagatcagacgcctggggaaggggaatataggagtttgcctctagatggccgagttgacttgatccgtcctcgaattccacaacaagaggccatccccgaatcctcaccatcgccccctccggacgcaacagatacatcccatcccgttttgcaaacgctgcctacccccggtccaaacgagattcctccgtccccacacctaccgcctcggtcttggcccccgtttacccctggaccaccccacgacgatagtggcgctcagtattcttatttccaacaggaacaaggtcagggttcacggcaccatattgtcgcggaggattcttcgcaatggtcacctccgcataatcttccgtgggacgacgacggacgccatcatgctgtcgatgaaggtagttttgaccaaagtagtgggggtgaatactgggactctgcgcgtggtcaggctcagcaccagcaccatcataatcatcaccaacagcagccgcacgtcgcagatcggcgcgtatctgagtacaggctcactccagctgccagcgaaaacgagcaccccaagtttgagtatcagccctccccggaagcgagacaacccgccgctgaaagccatcactatcataaccctcctcagtcaggtgcacgacctcaagcagaacaattccgtcagccatctcgccggacatcatgggtagaacaaccttcgtcgcatgaacgaggagcgacctttcctcctgttcattatcgacatggcggtcaccacacggtacaccatcctaaaccccactttgagcggcattctccccctcaaacccgacgttacgacattcagcctcagcggtcgactcacgaacatcgtccccaagaacagtcgcatcagtcacatcaacatcacccacagcagcccttccatgatgcacgcccaccccacgtcgaacaagcacctccacccccgcaggaaagaccccggcccgcgtcgcccccattgctactctggaatccatcagttgacccgccgcctaatgatcctccgaaacaggatgctttcccgtctgacacttactttccgaacgcatgggactctgctggtagccccaacaaggtccaaagtcctggagatcaccccatcaacgaagatggatttttccgaccgccacctgcgtcggacatcccgaattcacttttggagcaaggtcattacaggcaggttactggtgaaagcgaaacaggttcagctcctcagcctgatgcgacgaaggtcaagcatatctttccctgggagaacaagcctcgttacatgcctggcagggccttccctgaaggggagaagccctctccaacacaatttgtccagccattaaaaccagaacccctgtcacccaagccagataccgccgttccttctacggcctccctcccattgttcgctcaacctcccgttccatctgctgtttacggcttgccaactaacctggctttcgcaaacgcttgggatacagtccctagtattcaacgctacgctactaagcttgttcgacctgctcctgcgccccactctatgcccgcgcctgaatatccttcctcttcgtcaaggcggcgacgtgattcggctcgtagctgggacgaacgcgttgcggaacagggaagtcaagatggtgacgatgaagacgaaggcgatgaggttgacaataccgaaccgattgctggaaaatggagggatgatagcgatcctgagcatagctctcgctcttcgtcctcccgtatccgttcacgcagtggatctatctctgcgagctacatcatcaagggcaagcgcaaggaatatcgcgttcgaggcgttcaaactgttccaccggaaacaaggaatcaggctgttcaagtgtctatcgcaacagatccccctaaaatcctcacaccgacgccgaaggaaaggaaggtgtcgcgtcaaggttcaggctcgggcctcgggaagaggcattggaatcccgcaacctcgaatgttctgccaccactgtctgttcacgatgctgtcactggaaccgatcctcccgttgatcaactcgctgagtctccgacggtcttttccccccaggtcaattcatcgggtgctatccctccaggagtgcgctctcccagggaattccatttccctacatctccgcctccaggccgcatcacaccgcgaggtgcccaaacgccacctgtgagaactgttccaacaaaaggcaaggcttcttcaccacctgctcaggtcgtttcacccgatccggtaccctcgagcaagacccccggtgcttcgcgcaggggttcatcgacaccagtcaataacagtcgcccggctctgcccgtcgatccagagacgccaccgtctaggccacgcaaagccaactcgcgcagagcgtcgaattcttctactacctcgacaccgtcgtcagctgggccgatttcaccccctgattcgcagcaaatggcacttccccctaccgcgatcgcctcaccaacggcgtcgacctcttccaccattagaagagcgggaagggtctgggaccctgctaggggtgtggatgtgtttaagaaaaattctgaggaggttctggctcgattcttgcggatgggctcttgggaggagggtgcggacgcccgtaggtcccccgtcgcttga

SEQ ID NO: 4610 - protein, 1190 aa, Pleurotus djamor
MATPYAFVTLVTSDPYLPGALALVAALNDVHKASDIPFDTVCLVTPETVDVASIKLLRKAFRLVVGIELIVQPDPSGLNLLGRPDLDTVLTKLHVFRLVQYSKIIFLDADVLPIRPLSHLFSLPHEFSAVPDVGWPDIFNSGVLVLSPGEDKFTQLNQLLKSKGSWDGGDQGILNEWRGDDWNRLSFTYNTTPTAAYTYAPAYERYGSQISAIHFIGPNKPWKAYDYNSLVDRWFSVYDKHYRAPIVVPKTPFEVRYYAPAWDAPPPPRDESGRPSGGALSLDDLREMAIRGLNASSSSYGYSGPSDQTPGEGEYRSLPLDGRVDLIRPRIPQQEAIPESSPSPPPDATDTSHPVLQTLPTPGPNEIPPSPHLPPRSWPPFTPGPPHDDSGAQYSYFQQEQGQGSRHHIVAEDSSQWSPPHNLPWDDDGRHHAVDEGSFDQSSGGEYWDSARGQAQHQHHHNHHQQQPHVADRRVSEYRLTPAASENEHPKFEYQPSPEARQPAAESHHYHNPPQSGARPQAEQFRQPSRRTSWVEQPSSHERGATFPPVHYRHGGHHTVHHPKPHFERHSPPQTRRYDIQPQRSTHEHRPQEQSHQSHQHHPQQPFHDARPPHVEQAPPPPQERPRPASPPLLLWNPSVDPPPNDPPKQDAFPSDTYFPNAWDSAGSPNKVQSPGDHPINEDGFFRPPPASDIPNSLLEQGHYRQVTGESETGSAPQPDATKVKHIFPWENKPRYMPGRAFPEGEKPSPTQFVQPLKPEPLSPKPDTAVPSTASLPLFAQPPVPSAVYGLPTNLAFANAWDTVPSIQRYATKLVRPAPAPHSMPAPEYPSSSSRRRRDSARSWDERVAEQGSQDGDDEDEGDEVDNTEPIAGKWRDDSDPEHSSRSSSSRIRSRSGSISASYIIKGKRKEYRVRGVQTVPPETRNQAVQVSIATDPPKILTPTPKERKVSRQGSGSGLGKRHWNPATSNVLPPLSVHDAVTGTDPPVDQLAESPTVFSPQVNSSGAIPPGVRSPREFHFPTSPPPGRITPRGAQTPPVRTVPTKGKASSPPAQVVSPDPVPSSKTPGASRRGSSTPVNNSRPALPVDPETPPSRPRKANSRRASNSSTTSTPSSAGPISPPDSQQMALPPTAIASPTASTSSTIRRAGRVWDPARGVDVFKKNSEEVLARFLRMGSWEEGADARRSPVA

SEQ ID NO: 4611 - DNA, 1995 bp, Neurospora crassa
  CDS (1)..(1995)
atggcgatcaccaaaggagaggatgtttatgctagtcttctcttgaatgacgcataccttcccggtgctctggttcttgcgcactcgctgcgtgattccggcacccacaagaagctcgctatcttgatcacccccgaaaatatctccaacgaggttgtggaacagctccaaaccgtttatgactatgtcattcccgtcgaaaccattcaaaatgaccgaccggctaacctgttcctcatgaaccgccctgatctgcactcggccttcaccaagatcaacctctggaagcagacccagttccgcaagatcgtctatatcgatgccgacgttgtagcttacagagctcccgatgaactcttcgaccttccccacgccttctccgccgctcccgatatcggttggcccgacctgttcaacactggtgtcatggtcttgtctcccaacatgggtgattactacgccatgttggctatggctgagaggggaatttcttttgacggtgccgatcagggtctcttgaacatgcatttcaggaacacctataaccgcctcagcttcacctacaatgtcacgccctccgcccactaccagtacatcccggcctacaaacactttcaatcgagcatcaatttgcttcacttcattggctcagagaaaccgtgggttcagggtcgcacccagaccaccgggagcagcacctacgacgagatgatcggtagatggtgggctgtttatgatcgccactaccgcggcaactcgaacaagactaccgacgttgtccagaagttcgtaaagggtgaacaacaacaacagcaacaacagcaacagcgcaacgtctctttccaactcccttccagccagagccataagacgcagagccaccagacgcagagccagaatacccatagcacctacaccagtcacggagcatcctgggatgcttcaagacactctcctccggctggctccaagccagaagctgccaacttcccacagacgcactatacgatgtcctccaacactcaacagttcgtcccacctgcccggtatcccagtccgcccaaggatatgtggtacaaggtgcccgaggcggcgcccactcaaaagcccgctccgatcttcccctgggagaaacaagcacccgaacccactagggttttcccggaaccacctcctgagcagggaaagctctcggctgcgtcaactgcgacgccgtccgctgtggcgtcagctacagcatcgcccacccttgagccgaagagcgaggctgtcaccccgacaactcccgcaagtgctaacccctggacctctttcacaactagaggaaatgcgtgggatgatgtacccgaaatcaaccgctatgtcgacgctttgcagaagcaccgccgctccggaagcaagggctcggcagcggccacgtcgagaccgaccagtcctggtcgcgctcagagcagatctaggaagagctctagggtgactgacttcccgaccgaggatgaccgtccaagtcttactgtcacccccgcgcccatccaaggaccgagatcctcgagaggtgagaatgagcggcagttccctgctgccgccggcgtaccagcgcaatccgaatggaatcccgcagtccagcttgagaagctggcgatacaccagcaagaaacgttgcagaagctcggtgagcgtcctgcttttggtggattggcaattgggacagcgggtaaagagatcccggctcgcgcacttccctttgggtccgaagatgcaagatcgccaacttatgttacccagtacccgtcggtgcttagtccgaagcccttgagagcgaacacaaccggaacgaactcgaccccgagcccgctgccgacgcagccaagcgtgaccaccgccccaccgagctatcagggaccaggtgtggcttttgagaagggggaagacttcccaactcatgagacgcctgcgcttccgacggaggaggagagagatgtccttgagacgtaa

SEQ ID NO: 4612 - protein, 664 aa, Neurospora crassa
MAITKGEDVYASLLLNDAYLPGALVLAHSLRDSGTHKKLAILITPENISNEVVEQLQTVYDYVIPVETIQNDRPANLFLMNRPDLHSAFTKINLWKQTQFRKIVYIDADVVAYRAPDELFDLPHAFSAAPDIGWPDLFNTGVMVLSPNMGDYYAMLAMAERGISFDGADQGLLNMHFRNTYNRLSFTYNVTPSAHYQYIPAYKHFQSSINLLHFIGSEKPWVQGRTQTTGSSTYDEMIGRWWAVYDRHYRGNSNKTTDVVQKFVKGEQQQQQQQQQRNVSFQLPSSQSHKTQSHQTQSQNTHSTYTSHGASWDASRHSPPAGSKPEAANFPQTHYTMSSNTQQFVPPARYPSPPKDMWYKVPEAAPTQKPAPIFPWEKQAPEPTRVFPEPPPEQGKLSAASTATPSAVASATASPTLEPKSEAVTPTTPASANPWTSFTTRGNAWDDVPEINRYVDALQKHRRSGSKGSAAATSRPTSPGRAQSRSRKSSRVTDFPTEDDRPSLTVTPAPIQGPRSSRGENERQFPAAAGVPAQSEWNPAVQLEKLAIHQQETLQKLGERPAFGGLAIGTAGKEIPARALPFGSEDARSPTYVTQYPSVLSPKPLRANTTGTNSTPSPLPTQPSVTTAPPSYQGPGVAFEKGEDFPTHETPALPTEEERDVLET

SEQ ID NO: 4613 - DNA, 24 bp, Artificial sequence
  primer
atggccaagaaagttgccatctgt

SEQ ID NO: 4614 - DNA, 23 bp, Artificial sequence
  primer
tcaggtatcaggctttgggaatg

SEQ ID NO: 4615 - protein, 477 aa, Artificial sequence
  consensus sequence
  Variant (4)..(7): Xaa in position 4 to 7 is any amino acid
  Variant (12)..(14): Xaa in position 12 to 14 is any amino acid
  Variant (16)..(18): Xaa in position 16 to 18 is any amino acid
  Variant (20)..(29): Xaa in position 20 to 29 is any amino acid
  Variant (30)..(47): Xaa in position 30 to 47 is any or no amino acid
  Variant (49)..(87): Xaa in position 49 to 87 is any amino acid
  Variant (88)..(128): Xaa in position 88 to 128 is any or no amino acid
  Variant (130)..(131): Xaa in position 130 to 131 is any amino acid
  Variant (133)..(137): Xaa in position 133 to 137 is any amino acid
  Variant (139)..(141): Xaa in position 139 to 141 is any amino acid
  Variant (143)..(152): Xaa in position 143 to 152 is any amino acid
  Variant (153)..(174): Xaa in position 153 to 174 is any or no amino acid
  Variant (177)..(177): Xaa in position 177 is any amino acid
  Variant (179)..(179): Xaa in position 179 is any amino acid
  Variant (181)..(196): Xaa in position 181 to 196 is any amino acid
  Variant (197)..(206): Xaa in position 197 to 206 is any or no amino acid
  Variant (208)..(208): Xaa in position 208 is any amino acid
  Variant (211)..(211): Xaa in position 211 is any amino acid
  Variant (216)..(216): Xaa in position 216 is any amino acid
  Variant (222)..(225): Xaa in position 222 to 225 is any amino acid
  Variant (227)..(233): Xaa in position 227 to 233 is any amino acid
  Variant (235)..(242): Xaa in position 235 to 242 is any amino acid
  Variant (243)..(247): Xaa in position 243 to 247 is any or no amino acid
  Variant (249)..(249): Xaa in position 249 is any amino acid
  Variant (252)..(252): Xaa in position 252 is any amino acid
  Variant (256)..(257): Xaa in position 256 to 257 is any amino acid
  Variant (259)..(260): Xaa in position 259 to 260 is any amino acid
  Variant (262)..(264): Xaa in position 262 to 264 is any amino acid
  Variant (265)..(289): Xaa in position 265 to 289 is any or no amino acid
  Variant (291)..(291): Xaa in position 291 is any amino acid
  Variant (294)..(294): Xaa in position 294 is any amino acid
  Variant (296)..(296): Xaa in position 296 is any amino acid
  Variant (301)..(304): Xaa in position 301 to 304 is any amino acid
  Variant (305)..(326): Xaa in position 305 to 326 is any or no amino acid
  Variant (328)..(330): Xaa in position 328 to 330 is any amino acid
  Variant (333)..(339): Xaa in position 333 to 339 is any amino acid
  Variant (340)..(366): Xaa in position 340 to 366 is any or no amino acid
  Variant (368)..(370): Xaa in position 368 to 370 is any amino acid
  Variant (375)..(376): Xaa in position 375 to 376 is any amino acid
  Variant (377)..(377): Xaa in position 377 is any or no amino acid
  Variant (381)..(391): Xaa in position 381 to 391 is any amino acid
  Variant (392)..(476): Xaa in position 392 to 476 is any or no amino acid
TLLXXXXYLPGXXXLXXXLXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXRXXLXXXXXKXXXWXXXXXXXXXXXXXXXXXXXXXXXXXXXXXXXXLDXDXLXXXXXXXXXXXXXXXXXXXXXXXXXXAXPDXGWPDXFNSGVXXXXPXXXXXXXLXXXXXXXXXXXXXSXDGXDQGXXNXXFXXXXXXXXXXXXXXXXXXXXXXXXXXXXWXRLXFXYNVTXXXXXXXXXXXXXXXXXXXXXXXXXXYXXXPAXXXXXXXXXXXXXXXXXXXXXXXXXXXXXXXXXXIXXXHFIGXXXKPWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXW

SEQ ID NO: 4616 - protein, 28 aa, Artificial sequence
  protein pattern
  Variant (2)..(2): Xaa in position 2 is Ala, Ser or Val
  Variant (5)..(5): Xaa in position 5 is any amino acid
  Variant (7)..(7): Xaa in position 7 is Phe or Trp
  Variant (10)..(10): Xaa in position 10 is any amino acid
  Variant (13)..(13): Xaa in position 13 is Ser or Thr
  Variant (16)..(16): Xaa in position 16 is Phe, Leu or Met
  Variant (17)..(19): Xaa in position 17 to 19 is any amino acid
  Variant (21)..(21): Xaa in position 21 is Asp, Gly, Asn or Ser
  Variant (22)..(27): Xaa in position 22 to 27 is any amino acid
  Variant (28)..(28): Xaa in position 28 is Ile, Leu or Met
AXPDXGXPDXFNXGVXXXXPXXXXXXXX

SEQ ID NO: 4617 - protein, 26 aa, Artificial sequence
  protein pattern
  Variant (2)..(2): Xaa in position 2 is Glu, Gln or Thr
  Variant (3)..(4): Xaa in position 3 to 4 is any amino acid
  Variant (7)..(9): Xaa in position 7 to 9 is any amino acid
  Variant (10)..(10): Xaa in position 10 is Phe or Tyr
  Variant (11)..(13): Xaa in position 11 to 13 is any amino acid
  Variant (14)..(14): Xaa in position 14 is Ile or Leu
  Variant (15)..(15): Xaa in position 15 is any amino acid
  Variant (16)..(16): Xaa in position 16 is Ala, Ile, Leu or Val
  Variant (17)..(17): Xaa in position 17 is Ile, Leu or Val
  Variant (22)..(23): Xaa in position 22 to 23 is any amino acid
YXXXPAXXXXXXXXXXXHFIGXXKPW

SEQ ID NO: 4618 - protein, 28 aa, Artificial sequence
  protein pattern
  Variant (2)..(2): Xaa in position 2 is any amino acid
  Variant (3)..(3): Xaa in position 3 is Asp or Glu
  Variant (5)..(6): Xaa in position 5 to 6 is any amino acid
  Variant (7)..(7): Xaa in position 7 is Ala, Ser, Thr or Val
  Variant (8)..(9): Xaa in position 8 to 9 is any amino acid
  Variant (11)..(11): Xaa in position 11 is Ala, Ile or Leu
  Variant (12)..(12): Xaa in position 12 is any amino acid
  Variant (13)..(13): Xaa in position 13 is Ile, Leu or Val
  Variant (14)..(14): Xaa in position 14 is Phe or Trp
  Variant (15)..(18): Xaa in position 15 to 18 is any amino acid
  Variant (19)..(19): Xaa in position 19 is Phe or Tyr
  Variant (20)..(21): Xaa in position 20 to 21 is any amino acid
  Variant (22)..(23): Xaa in position 22 to 23 is Ile, Leu or Val
  Variant (24)..(24): Xaa in position 24 is Phe or Tyr
  Variant (27)..(27): Xaa in position 27 is Ala, Cys or Ser
RXXLXXXXXKXXXXXXXXXXXXXXLDXD

SEQ ID NO: 4619 - protein, 19 aa, Artificial sequence
  protein pattern
  Variant (4)..(7): Xaa in position 4 to 7 is any or no amino acid
  Variant (10)..(10): Xaa in position 10 is Ala or Pro
  Variant (12)..(12): Xaa in position 12 is Ala or Val
  Variant (13)..(13): Xaa in position 13 is any amino acid
  Variant (14)..(14): Xaa in position 14 is Ala, Thr or Val
  Variant (15)..(15): Xaa in position 15 is Leu or Val
  Variant (16)..(16): Xaa in position 16 is Ala or Gly
  Variant (17)..(18): Xaa in position 17 to 18 is any amino acid
  Variant (19)..(19): Xaa in position 19 is Leu or Val
TLLXXXXYLXGXXXXXXXX

SEQ ID NO: 4620 - protein, 13 aa, Artificial sequence
  protein pattern
  Variant (2)..(2): Xaa in position 2 is any amino acid
  Variant (5)..(5): Xaa in position 5 is Ala, Gly or Ser
  Variant (9)..(9): Xaa in position 9 is Ile or Leu
  Variant (10)..(10): Xaa in position 10 is Phe or Leu
  Variant (12)..(12): Xaa in position 12 is any amino acid
  Variant (13)..(13): Xaa in position 13 is Phe, His, Trp or Tyr
SXDGXDQGXXNXX

SEQ ID NO: 4621 - protein, 8 aa, Artificial sequence
  protein pattern
  Variant (2)..(2): Xaa in position 2 is Pro or Ser
  Variant (3)..(3): Xaa in position 3 is Phe or Tyr
  Variant (4)..(4): Xaa in position 4 is any amino acid
  Variant (7)..(7): Xaa in position 7 is Thr or Val
LXXXYNXT

SEQ ID NO: 4622 - DNA, 1299 bp, Saccharomyces cerevisiae
  CDS (1)..(1299)
atgaacaaaagaacacaggaatacaagaacacaagagcgataatgtctgccactctgttcaataacatcgaattgctgccccctgatgccctttttggtattaagcaaaggtacgggcaagatcaacgtgctaccaaggtcgacttgggtatcggggcctacagagacgacaacggtaaaccatgggtcttgccaagtgttaaagccgccgaaaagctaattcataacgacagctcctacaaccatgaatacctcggtattaccggtctgccaagtttgacatctaacgccgccaagatcatcttcggtacgcaatccgatgcctttcaggaagacagagtaatctcagtacaatcactgtctggtacgggtgctcttcatatatctgcgaagtttttttcaaaattcttcccagataaactggtctatttgtctaagcctacttgggccaaccacatggccatttttgagaatcaaggcttgaaaacggcgacttacccttactgggccaacgaaactaagtctttggacctaaacggctttctaaatgctattcaaaaagctccagagggctccattttcgttctgcactcttgcgcccataacccaactggtctggaccctactagtgaacaatgggttcaaatcgttgatgctatcgcctcaaagaaccacatcgccttatttgacaccgcctaccaagggtttgccactggagatttggacaaggatgcctatgctgtgcgtctaggtgtggagaagctttcaacggtctctcccgtctttgtctgtcagtcctttgccaagaacgccggtatgtacggtgagcgtgtaggttgtttccatctagcacttacaaaacaagctcaaaacaaaactataaagcctgctgttacatctcaattggccaaaatcattcgtagtgaagtgtccaacccacccgcctacggcgctaagattgtcgctaaactgttggaaacgccagaattaacggaacagtggcacaaggatatggttaccatgtcctccagaattacgaaaatgaggcacgcattaagagaccatttagtcaagttgggcactcctggcaactgggatcatatagtaaatcaatgcgggatgttctcctttacaggattgactcctcaaatggttaaacgacttgaagaaacccacgcagtttacttggttgcctcaggtagagcttctattgctggattgaatcaaggaaacgtggaatacgtggctaaagccattgatgaagtggtgcgcttctatactattgaagctaaattgtaa

SEQ ID NO: 4623 - protein, 432 aa, Saccharomyces cerevisiae
MNKRTQEYKNTRAIMSATLFNNIELLPPDALFGIKQRYGQDQRATKVDLGIGAYRDDNGKPWVLPSVKAAEKLIHNDSSYNHEYLGITGLPSLTSNAAKIIFGTQSDAFQEDRVISVQSLSGTGALHISAKFFSKFFPDKLVYLSKPTWANHMAIFENQGLKTATYPYWANETKSLDLNGFLNAIQKAPEGSIFVLHSCAHNPTGLDPTSEQWVQIVDAIASKNHIALFDTAYQGFATGDLDKDAYAVRLGVEKLSTVSPVFVCQSFAKNAGMYGERVGCFHLALTKQAQNKTIKPAVTSQLAKIIRSEVSNPPAYGAKIVAKLLETPELTEQWHKDMVTMSSRITKMRHALRDHLVKLGTPGNWDHIVNQCGMFSFTGLTPQMVKRLEETHAVYLVASGRASIAGLNQGNVEYVAKAIDEVVRFYTIEAKL

SEQ ID NO: 4624 - DNA, 1389 bp, Arabidopsis thaliana
  CDS (1)..(1389)
atggcttctttaatgttatctctcggttccacttctctgttaccgcgcgagattaacaaggataagctaaagcttggaacttctgcttcgaacccgttcctaaaagcaaagtcttttagcagagtgactatgacggttgcagtgaagccttctcgtttcgagggtataactatggctccaccagaccctattcttggagtcagtgaagcattcaaagctgacactaacgggatgaaactcaatcttggtgttggtgcttatcgtactgaggaactccagccttatgtgcttaatgttgttaaaaaggcggagaatttgatgttggagagaggagataacaaagagtatcttccaattgaggggttggcagcattcaacaaggctactgctgagttgctatttggagctggtcatcctgttattaaggaacaaagagtagcaacaattcagggtctttcgggaacaggttcactgcgattagcagcggctcttatagagcgttatttccctggagcaaaagttgtgatctcatcaccaacctggggtaatcacaagaatatcttcaatgatgccaaagttccgtggtccgaataccgctactatgatccaaaaacaattggtttggattttgagggaatgatagcagatataaaggaagctccagaaggatccttcatcttgcttcacggatgtgctcacaacccaactggaattgacccaacaccagaacagtgggtaaaaattgctgatgtcattcaggaaaagaaccatatcccatttttcgatgttgcataccagggctttgctagtggaagccttgatgaagatgcagcatctgtgagattatttgctgagcggggaatggagttttttgttgctcagtcatatagtaaaaatttaggtttgtatgcagaaagaattggggcaatcaatgtcgtgtgctcctcagctgatgctgctacaagggtcaagagccagttgaaaaggattgctcggcctatgtactcgaatccaccagttcatggggcgagaatcgtggccaatgtagtgggtgatgtaactatgttcagtgaatggaaagcagagatggaaatgatggcaggaagaataaagacggttagacaagagctgtatgatagcctcgtttcaaaagacaagagcgggaaggactggtccttcattctgaagcaaattggcatgttctctttcaccggcctaaacaaagctcagagcgataacatgacggacaaatggcatgtgtatatgactaaagacgggaggatatcattggccggattatctctggccaaatgcgagtatcttgctgatgcgatcatcgactcataccataacgccttgttgtattgggagactcccatcgagttatag

SEQ ID NO: 4625 - protein, 462 aa, Arabidopsis thaliana
MASLMLSLGSTSLLPREINKDKLKLGTSASNPFLKAKSFSRVTMTVAVKPSRFEGITMAPPDPILGVSEAFKADTNGMKLNLGVGAYRTEELQPYVLNVVKKAENLMLERGDNKEYLPIEGLAAFNKATAELLFGAGHPVIKEQRVATIQGLSGTGSLRLAAALIERYFPGAKVVISSPTWGNHKNIFNDAKVPWSEYRYYDPKTIGLDFEGMIADIKEAPEGSFILLHGCAHNPTGIDPTPEQWVKIADVIQEKNHIPFFDVAYQGFASGSLDEDAASVRLFAERGMEFFVAQSYSKNLGLYAERIGAINVVCSSADAATRVKSQLKRIARPMYSNPPVHGARIVANVVGDVTMFSEWKAEMEMMAGRIKTVRQELYDSLVSKDKSGKDWSFILKQIGMFSFTGLNKAQSDNMTDKWHVYMTKDGRISLAGLSLAKCEYLADAIIDSYHNALLYWETPIEL

SEQ ID NO: 4626 - DNA, 1383 bp, Oryza sativa (japonica cultivar-group)
  CDS (1)..(1383)
atgccatccgctaacgtgcgcggggcgcagcctagcgccgaccgcaggttaagtacgctggtgcgccacctactgccttcctccgcacgaacagcaaccaccaccagcacctcctcctccgccgccgacgccgactcctccctccaagctttccccaccatggcgtcgtcgtccgtcttcgctggcctcgcgcaggcgccggaggaccccatcctcggggtgacggtcgcgtacaacaaggatcccagccccgtgaaggtcaatctcggcgtcggcgcctaccggaccgaggaagggaagcccctggtgctgaatgtggtcaggcgcgctgagcagatgctgatcaacaacccgtcacgtgttaaggagtatttgccgatcactggactggccgatttcaataagctgagtgctaagcttatttttggtgctgacagtcctgccattcaagagaatagggtggctacagttcagtgcttgtcaggaactggttctttaagggtgggaggtgaatttcttgcaaggcattatcatgaacgcactatatacatcccacagccaacctgggggaatcaccccaaagtgttcactttagctggcctgactgttaggagttaccgctactatgatcctgcaacccgtggactggatttccaagggctgttagaagatctcggttcagctccttcaggtgcaattgtactgcttcatgcttgtgcccacaaccctactggagtagacccaactttggaccagtgggaacagatcaggcagttgatgagatcaaaagcattgctgccattctttgatagcgcttatcagggatttgcaagtggaagtcttgaccaagatgctcaatcagtgcgcatgtttgttgctgatggtggtgaattgctcatggctcagagctacgctaagaacatgggattgtatggagagcgtgtcggtgctttaagcatagtttgtggaagtgctgatgtagctgtcagggttgaaagtcaacttaagcttgtaattaggcctatgtattcaaaccctcctattcatggtgcatctatcgtggctaccatacttaaggacagtgcaatgttcaatgaatggactgtggagctgaagggcatggctgataggattattagcatgaggcaacagctttttgatgctctgaaaacgagagaaactcctggagactggagtcacatcattaagcagatcggaatgttcactttcactgggctcaacagtgatcaagtggctttcatgaggcaggaataccacatttacatgacatctgatgggaggatcagtatggctggtttgagcgggaggaccattccgcatcttgcagatgcaatccatgccgcagtcacaaaactgaagtga

SEQ ID NO: 4627 - protein, 460 aa, Oryza sativa (japonica cultivar-group)
MPSANVRGAQPSADRRLSTLVRHLLPSSARTATTTSTSSSAADADSSLQAFPTMASSSVFAGLAQAPEDPILGVTVAYNKDPSPVKVNLGVGAYRTEEGKPLVLNVVRRAEQMLINNPSRVKEYLPITGLADFNKLSAKLIFGADSPAIQENRVATVQCLSGTGSLRVGGEFLARHYHERTIYIPQPTWGNHPKVFTLAGLTVRSYRYYDPATRGLDFQGLLEDLGSAPSGAIVLLHACAHNPTGVDPTLDQWEQIRQLMRSKALLPFFDSAYQGFASGSLDQDAQSVRMFVADGGELLMAQSYAKNMGLYGERVGALSIVCGSADVAVRVESQLKLVIRPMYSNPPIHGASIVATILKDSAMFNEWTVELKGMADRIISMRQQLFDALKTRETPGDWSHIIKQIGMFTFTGLNSDQVAFMRQEYHIYMTSDGRISMAGLSGRTIPHLADAIHAAVTKLK

SEQ ID NO: 4628 - DNA, 1299 bp, Oryza sativa (japonica cultivar-group)
  CDS (1)..(1299)
atggcgatgtcgtcgtcccgctcggcggccgcgatccgggggcggcgggtcggggcgctggcgagggcgaggaggcacgcgacgagggcgatggcgtcgctgttcggccacgtcgagccggcttccaaggaccccatcctcggcgtcaccgaggccttcctcgccgacccctcccccgacaaagtcaacgtcggcgtcggcgcctaccgggacgacaacggcaagcccgtcgtgctcgagtgcgtgcgcgaggccgagcgccggatcgccggcaacctcaacatggagtaccttccaatgggaggaagtataaagatgattgaagagtcactaaagctggcatatggtgaggattctgatttcatcaaagataagaggattgctgcggtgcaggctctttcaggcacaggtgcatgccggctctttgccgatttccagaggcgtttcttgccaaattcacagatctacatacctacacctacatggtccaatcatcataacatttggagggatgctcaagtacctcaaaggacattcacctattaccatccagagtcaagagggcttgatttcgcaggactgatggatgatattaagaacgctccaaatggttcattctttttgcttcatgcttgtgcccataatcctactggagttgatcctacagaagaacaatggagagagatatcctaccaattcaagataaagaatcatttcccattctttgacatggcataccaaggatttgccagcggtgatccagagagagatgctaaggcaatccgaatcttccttgaagatgggcatcaaattggatgtgctcagtcatatgcaaagaacatgggactgtatgggcaaagggcagggtgcttgagtattctgtgtgaggatgagatgcaagcagtttctgttaagagccaattgcaacagattgcaaggccaatgtacagcaacccacctgttcatggtgcactggttgtctccataatccttaatgatccagaattaaagagtttatggttgaaagaggtcaagggtatggctgatcgaatcattggaatgcggaaggcactccgggaaaatctcgaaggcctaggttcaccattgtcatgggatcacatcaccaatcagattggaatgttctgctacagtgggatgacacctgaacaggtggatcgcttaaccaatgaataccatatttacatgacccgtaatggcagaataagcatggctggtgtaacaacaggaaatgtggcgtatttggctaatgctattcatgaggtcactaaaacgaaatga

SEQ ID NO: 4629 - protein, 432 aa, Oryza sativa (japonica cultivar-group)
MAMSSSRSAAAIRGRRVGALARARRHATRAMASLFGHVEPASKDPILGVTEAFLADPSPDKVNVGVGAYRDDNGKPVVLECVREAERRIAGNLNMEYLPMGGSIKMIEESLKLAYGEDSDFIKDKRIAAVQALSGTGACRLFADFQRRFLPNSQIYIPTPTWSNHHNIWRDAQVPQRTFTYYHPESRGLDFAGLMDDIKNAPNGSFFLLHACAHNPTGVDPTEEQWREISYQFKIKNHFPFFDMAYQGFASGDPERDAKAIRIFLEDGHQIGCAQSYAKNMGLYGQRAGCLSILCEDEMQAVSVKSQLQQIARPMYSNPPVHGALVVSIILNDPELKSLWLKEVKGMADRIIGMRKALRENLEGLGSPLSWDHITNQIGMFCYSGMTPEQVDRLTNEYHIYMTRNGRISMAGVTTGNVAYLANAIHEVTKTK

SEQ ID NO: 4630 - DNA, 1377 bp, Oryza sativa (japonica cultivar-group)
  CDS (1)..(1377)
atggcttccgcccccttcgccgtctcctcctcaccggcggcttccgccgtggccgcgcgctccaaggtgttgcgaggagggaggagcgaggcgaggactggatgccgcctggggatcacgaggaagaattttggacgtgtcatgatggcccttgcagtagatgtctctcgttttgaaggagtgccgatggcccctccagacccaattctcggggtttcagaagcatttaaggcagatcaaaatgatctgaagctcaaccttggtgttggtgcctatagaacagaagagttacagccttatgtcctcaatgtggtcaagaaggctgaaactcttatgttggagaaaggagaaaacaaggagtatctgccaattgaaggcttagctgcatttaacaaagcaactgcagaactattgtttggagctgataatccagtactcaagcaaggacgtgttgctactcttcagtctctctcaggaaccgggtcgctgcgccttgctgcagcatttatacaaagatatttccctgaagcaaaagtactgatatcatctcccacttggggcaatcacaagaacattttcaatgatgcaaaggtaccttggtcagagtaccgttattacgaccccaagactgttggcttggattttgagggaatgatagctgacatacaggctgccccagatggatcttttgttctgctgcatggttgcgctcacaacccaactggaatagacccaactccggaacaatgggagaaaattgcagatgtcattcaagagaagaaacacatgcctttctttgatgttgcatatcagggttttgccagtggaagccttgatgaagatgcatcttctgtcaggctttttgttcaacggggactggaagtgtttgttgcgcagtcttatagcaaaaaccttggtttatatgcagaaagaattggagcaataaatgttgtctgctcaacacctgaagtcgcaaacagggtgaagagccagctgaaacgattggcacggcccatgtattcgaatccccctattcatggtgctaggatagttgccaacgttgttggggatccaaccatgtttggtgaatggaaacaggagatggaagaaatggcagggcgtatcaagaatgtaagacagaagctttatgatagtttgtctgcaaaggacgacagtggcaaggactggtctttcattctgaggcagataggcatgttctcctacacgggcttgaacaaaactcagagtgataatatgaccgacaaatggcacatatacatgacaaaggatgggagaatttcgttggctggattgtccctggctaaatgcgagtacctagctgacgccatcatcgactccttccataacgttagctag

SEQ ID NO: 4631 - protein, 458 aa, Oryza sativa (japonica cultivar-group)
MASAPFAVSSSPAASAVAARSKVLRGGRSEARTGCRLGITRKNFGRVMMALAVDVSRFEGVPMAPPDPILGVSEAFKADQNDLKLNLGVGAYRTEELQPYVLNVVKKAETLMLEKGENKEYLPIEGLAAFNKATAELLFGADNPVLKQGRVATLQSLSGTGSLRLAAAFIQRYFPEAKVLISSPTWGNHKNIFNDAKVPWSEYRYYDPKTVGLDFEGMIADIQAAPDGSFVLLHGCAHNPTGIDPTPEQWEKIADVIQEKKHMPFFDVAYQGFASGSLDEDASSVRLFVQRGLEVFVAQSYSKNLGLYAERIGAINVVCSTPEVANRVKSQLKRLARPMYSNPPIHGARIVANVVGDPTMFGEWKQEMEEMAGRIKNVRQKLYDSLSAKDDSGKDWSFILRQIGMFSYTGLNKTQSDNMTDKWHIYMTKDGRISLAGLSLAKCEYLADAIIDSFHNVS

SEQ ID NO: 4632 - DNA, 1392 bp, Oryza sativa (japonica cultivar-group)
  CDS (1)..(1392)
atgcacacacgcagccgtcggcttggtttcccccccctgaatccaagtcacctcctcctcacacctcaccttccccctctctcctccgatcgcgcgcgcatggcgatgtcacgagccgccgccgctgccgcggggactcccgtggcgcggcggcgattgatgggggccgtggcggcgaggtcgatggcgtcgtggttcggccacgtggaaccggccgccaaggaccccatcctcggcgtcaccgaggcgttcctcgccgacccctccccggacaaagtcaacgtcggcgtcggcgcgtaccgggacgacagcgggaagcccgtggtgctggagtgcgtgcgcgaggcggagcggcggatcgccgggagcatgaacatggagtaccttccaatgggtggaagcataaagatgattgaagaatcacttaaactggcctatggggagaactgtgagttcatcaaggacaagaggatcgcagcagtgcaggctctttcaggaactggtgcatgtcgcctctttgcagatttccagaagcgtttcttgccagattcacagatttatatacccacacctacatgggccaaccatcacaatatttggagggatgcccaagtaccacaaaagacatttacctattaccatccagagtcaagaggacttgactttgcaggcctaatggatgatatcaagaatgctccagatggttcattctttttgcttcatgcttgtgcgcataatcccactggagtagatccttcagaagaacaatggagggagatatctcatcagttcaaggtgaagaaacattttccattcttcgacatggcataccaaggatttgctagtggtgatccagagagagatgccaaggcaattcgaatatttcttgaagatggacatcaaattggatgtgcacagtcatatgcgaaaaacatgggactttatggacaaagagcaggatgccttagtattctatgtgatgatgagatgcaagcagttgctgttaagagccagttacaacagattgctagacctttgtacagcaacccacccgttcatggtgcattaattgtttcaactattcttggtgatccggagttgaaaagtttatggctgaaagaggtcaagggtatggctgatcgtatcattggaatgcgaacagcactcaaagagaaccttgaaaagttgggttcaccaatgtcatgggaacatatcactaatcagattggaatgttctgctacagtggtatgacacctgaacaagtcgatcgcttgacaaaagagttccatatctacatgactcgtaacgggcggataagcatggctggagtaacaacaggaaatgttgcctatctggctaatgctattcatgaggttaccaagacaaagtga

SEQ ID NO: 4633 - protein, 463 aa, Oryza sativa (japonica cultivar-group)
MHTRSRRLGFPPLNPSHLLLTPHLPPLSSDRARMAMSRAAAAAAGTPVARRRLMGAVAARSMASWFGHVEPAAKDPILGVTEAFLADPSPDKVNVGVGAYRDDSGKPVVLECVREAERRIAGSMNMEYLPMGGSIKMIEESLKLAYGENCEFIKDKRIAAVQALSGTGACRLFADFQKRFLPDSQIYIPTPTWANHHNIWRDAQVPQKTFTYYHPESRGLDFAGLMDDIKNAPDGSFFLLHACAHNPTGVDPSEEQWREISHQFKVKKHFPFFDMAYQGFASGDPERDAKAIRIFLEDGHQIGCAQSYAKNMGLYGQRAGCLSILCDDEMQAVAVKSQLQQIARPLYSNPPVHGALIVSTILGDPELKSLWLKEVKGMADRIIGMRTALKENLEKLGSPMSWEHITNQIGMFCYSGMTPEQVDRLTKEFHIYMTRNGRISMAGVTTGNVAYLANAIHEVTKTK

SEQ ID NO: 4634 - DNA, 1185 bp, Mesorhizobium loti MAFF303099
  CDS (1)..(1185): transl_table=11
atgttcgaagacctgcagccagctcccgccgacaagatcctggccctcatcggcctctatcgcgccgatccgcgtcccaacaaggtcgacctcggcgtcggcgtctacaaggatcgcgacggcaagaccccagtgatgcgcgccgtgcgtgaggctgaaaagcggctgctgaacagccaggacaccaagacctatctcgggctcgccggcgacaccggcttcaacgcggtgatggccaagctcgccttcggcccgggcgcggacatgacgcgcattcgggcggcccaggcgcctggcggctccggtgcgcttcgcctggtggcggagctgctcaagcggacccgttcggacgccacgatctggctgtcggacccaacctggccgaaccatatgccggtgatgcgcgctgccggcctgcagatccgcgaatatccctatttcgacgcggcctccggtgctgttcgcttcgacgacatgctggcggcgttgcggacggccaagagcggcgacgtggtgctgctgcacggctgctgccacaatccaaccggcgccaatctggatgcggcgcagtggcaggccgtcaccgatctgatggtcgagcgcggcctgctgccattcgtcgacatcgcctatcagggctttggcgacggcctcgaggccgacgctcttggcctgcgcctgctggcggcgaaagttccggaaatggttgttgcctcgagctgctcgaagaatttcgccgtctaccgcgaccgtgtcggcgcagcgatggttttggccagggacagcgcgcaggctgacgtggcgatgagccagatgctgtcggcggcgcgcgccatgtattcgatgccgccggaccatggtgccgcggcggtgcgcatcgtgctcgaagacgcaagcctgcgcgccgactgggaagccgaattggaagagatgcgcctgcgcatgctgaggcttcgcgtggctttcgccgaggcgctgcgccggcagtccaactccgaccgcttcgacttcgtcgccagccaccgcggcatgttctcacggcttggcctgacggaagcgcaggtcgagcggctgcgcgccgagcacggcgtgtacatggtcggcgatagccgcatcaacgtcgctggactgccggaggatggcatggacgcgctcgccaaggcgatcgtctccgtgctcgactga

SEQ ID NO: 4635 - protein, 394 aa, Mesorhizobium loti MAFF303099
MFEDLQPAPADKILALIGLYRADPRPNKVDLGVGVYKDRDGKTPVMRAVREAEKRLLNSQDTKTYLGLAGDTGFNAVMAKLAFGPGADMTRIRAAQAPGGSGALRLVAELLKRTRSDATIWLSDPTWPNHMPVMRAAGLQIREYPYFDAASGAVRFDDMLAALRTAKSGDVVLLHGCCHNPTGANLDAAQWQAVTDLMVERGLLPFVDIAYQGFGDGLEADALGLRLLAAKVPEMVVASSCSKNFAVYRDRVGAAMVLARDSAQADVAMSQMLSAARAMYSMPPDHGAAAVRIVLEDASLRADWEAELEEMRLRMLRLRVAFAEALRRQSNSDRFDFVASHRGMFSRLGLTEAQVERLRAEHGVYMVGDSRINVAGLPEDGMDALAKAIVSVLD

SEQ ID NO: 4636 - DNA, 1203 bp, Chlamydia trachomatis D/UW-3/CX
  CDS (1)..(1203): transl_table=11
gtgagtctttttgaacagttaccttccttttctccggattctattcttggtttagcgcaggctttccaagaggatcctcgtgaggataagattaatttattactaggtacttacgaacgggaaaagaaacgttatggtggtttctcgagcgttagaaaggctcagtctgttttttttgacgatgagaaagataaaaattatctacccatcaaaggatcgtctacctttttagaagaaatggcagctctttgttttggagaagtggatgctagtcgatgggttggtgtgcaggcaattggaggtacaggagccttacatttaggggcttctgtatatgccaacgcatctttagcgggtaaggtgtatattccttctcaaacatgggggaaccattctaggatttttgctcatcaagggttagctttagagtattatccttactatgatcaggagaccaaagaactggatttacagggattgaaagctattttgcgatctgctcctgagacttcattagttctgttgcattgttgctgtcataatcctacagggaaagatattcctctttccgagtggccagaaatcattacgattattaaggagcgggatcttattcctttctttgatatggcttatttaggttttgctagtgggatagaagaagatcgtcgtcctgtgcgactgtgtatagaagctggggttactacttttgtagcaggaggcgctagtaaaattttttcgttatatggttctcgtgtaggattttttggagctatccatcaagataaactggatttaaaccgtattctatcctttttagaagaacagattcgtggggagtactcatctccggctagagaaggagttgctatcgtgacttctatattaagcaatccttacttacggcaagaatgggagcttgaattgaatggcattcggcagtctttggaagagattcgttcgagttttgtgattgccatgcgaaatgtagcggggcactctttcgatttcatagcttctcagaaaggattttttgggtatccaggtttttcaaaggaacaagtgctgttccttagagaagagcttggtatttacacaaccgcaggcgggagattcaatttaaatggcattacggataaaaatataaatcgtgttactcacggttttgctcaggcttatgaataccctcggtccgtatcataa

SEQ ID NO: 4637 - protein, 400 aa, Chlamydia trachomatis D/UW-3/CX
MSLFEQLPSFSPDSILGLAQAFQEDPREDKINLLLGTYEREKKRYGGFSSVRKAQSVFFDDEKDKNYLPIKGSSTFLEEMAALCFGEVDASRWVGVQAIGGTGALHLGASVYANASLAGKVYIPSQTWGNHSRIFAHQGLALEYYPYYDQETKELDLQGLKAILRSAPETSLVLLHCCCHNPTGKDIPLSEWPEIITIIKERDLIPFFDMAYLGFASGIEEDRRPVRLCIEAGVTTFVAGGASKIFSLYGSRVGFFGAIHQDKLDLNRILSFLEEQIRGEYSSPAREGVAIVTSILSNPYLRQEWELELNGIRQSLEEIRSSFVIAMRNVAGHSFDFIASQKGFFGYPGFSKEQVLFLREELGIYTTAGGRFNLNGITDKNINRVTHGFAQAYEYPRSVS

SEQ ID NO: 4638 - DNA, 1242 bp, Vibrio cholerae O1 biovar eltor str. N16961
  CDS (1)..(1242): transl_table=11
ttgatgagttcaatcatcccttcccaccctaacttgacatggatgtgctttatgttcgaaaaagtcgttgccgctcccgctgaccctatcctaggtttaactgaagagttcaaaaaagaccctcgtaccgacaaaattaacctcggtgtaggtatttataagaatgaagcaggtgaaaccccggttctcgctactgtaaagaaagcagaagccgcactgcttgagtcagagaaaaccaaatcttatctcacgatcgaagggacagctgagtacggtttagcagtacaaaaactgctgttcggcgcgaattcggacatagtgacacaaaaactggcaaaaacagcgcaagcccctggtggcactggtgcgctgcgtgtggcgggtgaatttattaagcgtcaactgggcgatgtgaaagtctggatcagtaacccaacttgggctaaccatcacggtgtgttcaatgccgctggcttggaaactacgcaatacgcttattatgatgccaaagccaaagacaaagattttgccgctatgctggcagatttagagcaggcagagaaaggcgatgtggttttactgcatggctgctgccacaatccaacgggtattgacccaacagagcaagagtgggaagtactggcgaaattggtggctgacaaaggcttactgcctctgtttgactttgcttaccaaggctttgcttcaggtgtggaagaagacgcggctggcctacgtatttttgcgaaatacaactctgagattctggttgccagctctttctcaaagaactttggcttgtacaacgaacgtgtcggtgccttcacgctggttgcaccttcaacaaccgttgcagaaacggcgttctcacaagttaaagcgattatccgctctatctactcaaacccaccagctcacggtgctgccgttgtcacttatattctgaacaacccagaattacgcgcagaatgggaagccgaagtcgcggaaatgcgtgaacgtattcaagagatgcgcgtacttttcgttaacacattgaaagaagtgggtgtagacgctgactttagctttatcgagcgtcaaaacggcatgttctctttctctggcctaagcaaagagcaagttgcacgcctcaaatcagagttgggtatctatatcgtcggctctggccgcatcagcgtagcggggatgaccaaatcaaacatgctacccttgtgccaaggcattgctgcggtgatgtaa

SEQ ID NO: 4639 - protein, 413 aa, Vibrio cholerae O1 biovar eltor str. N16961
MMSSIIPSHPNLTWMCFMFEKVVAAPADPILGLTEEFKKDPRTDKINLGVGIYKNEAGETPVLATVKKAEAALLESEKTKSYLTIEGTAEYGLAVQKLLFGANSDIVTQKLAKTAQAPGGTGALRVAGEFIKRQLGDVKVWISNPTWANHHGVFNAAGLETTQYAYYDAKAKDKDFAAMLADLEQAEKGDVVLLHGCCHNPTGIDPTEQEWEVLAKLVADKGLLPLFDFAYQGFASGVEEDAAGLRIFAKYNSEILVASSFSKNFGLYNERVGAFTLVAPSTTVAETAFSQVKAIIRSIYSNPPAHGAAVVTYILNNPELRAEWEAEVAEMRERIQEMRVLFVNTLKEVGVDADFSFIERQNGMFSFSGLSKEQVARLKSELGIYIVGSGRISVAGMTKSNMLPLCQGIAAVM

SEQ ID NO: 4640 - DNA, 1191 bp, Pasteurella multocida subsp. multocida str. Pm70
  CDS (1)..(1191): transl_table=11
atgtttgaaaatattaccgccgcgccagctgatccgattttaggtttaggggaatcatttaaagcggaaacgcgcgataataaaatcaatcttggcattggtgtatataaagatgcgaaaggcaatacaccaattatgcgtgcggtcaaagaggcagaaaagcgcttatttgatcttgaaatgagcaaaaattatttagctattgacggggtcgcagaattcaatgcctgtacgaaagaattgttatttggcgcagattcagagatagttaaacaaggtcgtgcaaaaaccgttcaaagtttaggtggtactggtgcattacgtatcgcagcagagtttattaaacgccaaactaaatcacaaaatgtttggattagcacaccaacttggccaaaccataatgcgatttttaatgctgtcggcatgacgattcgtgaataccgctattatgatgcagaaaataaatgcttagattgggataacttaattgctgatttaagcaatgcgggggaaggcgatgttgttttactacatggttgctgtcataacccgactggaattgaccctactccagcacaatggcaacaattagccaagatgtcggaagaaaaaggttggttaccgttatttgactttgcttaccaaggttttgcaaatggtctcgaagaagatgcgtttggtttacgtacctttgccaaaaatcataaagaattattagtcgcaagttcttattctaaaaactttggtctttatagcgagcgcgttggtgctttcacgttagtggcagaaacagagcaaatagccgcgacggcactcacgcaagtcaaaaccattattcgtacgctctattctaacccagcatcacatggcgcaacgacagtttctatggtattaaaagacagtcagttacgtgccgagtgggaaaacgaattaaccgaaatgcgtgaacgtattaagcaaatgcgtagccaatttgttgaattattgaaagcatttgcttcagaacaagattttagttttattattgatcaaaatgggatgttctctttctgtggcttaaatccagcacaaatggatcgtttaaaagaggaatttgccatttatgccgtgcgttctggtcggattaatgtcgcaggcattactgaacagaatattcgttatctgtgtgaaagtattgcgaaagtcctttaa

SEQ ID NO: 4641 - protein, 396 aa, Pasteurella multocida subsp. multocida str. Pm70
MFENITAAPADPILGLGESFKAETRDNKINLGIGVYKDAKGNTPIMRAVKEAEKRLFDLEMSKNYLAIDGVAEFNACTKELLFGADSEIVKQGRAKTVQSLGGTGALRIAAEFIKRQTKSQNVWISTPTWPNHNAIFNAVGMTIREYRYYDAENKCLDWDNLIADLSNAGEGDVVLLHGCCHNPTGIDPTPAQWQQLAKMSEEKGWLPLFDFAYQGFANGLEEDAFGLRTFAKNHKELLVASSYSKNFGLYSERVGAFTLVAETEQIAATALTQVKTIIRTLYSNPASHGATTVSMVLKDSQLRAEWENELTEMRERIKQMRSQFVELLKAFASEQDFSFIIDQNGMFSFCGLNPAQMDRLKEEFAIYAVRSGRINVAGITEQNIRYLCESIAKVL

SEQ ID NO: 4642 - DNA, 1194 bp, Neisseria meningitidis MC58
  CDS (1)..(1194): transl_table=11
atgttcttcaagcacatcgaagccgcccccgccgatccgattctcggtttgggcgaagcgttcaaagccgaaacccgccccgaaaaagtcaacctcggcatcggcgtttataaagacgcatccggcgcgacacccctcgtcaaagccgtcaaagaagccgaaaaacgcctgttggaaagcgaaaccaccaaaaactacctcaccatcgacggcgttgccgactacaacgcgcaaacccaaatcctgctgttcggcaaagaccacgaaatcatcgccagccgtcgcgccaaaacagcgcaaagcctcggcggtacgggcgcattgcgtattgcggccgagtttgccaaacgccagttgaacgcgcaaaccatctggatttccaatccgacttggcccaaccacaacgccatcgccaaagcggtcggtatccaagacaaaccttatcgttactatgatgccgccaaacacggtttggattgggacggcatgattgaggacttgagccaagcgcaaaaaggcgacatcgtcctgctgcacggctgctgccacaatcctaccggcatcgaccctacgcccgaacaatgggaaactttggcaaaactttctgccgaaaaaggctggttgccgctgtttgactttgcctaccaaggcttcggcaatggtttggaagaagatgcctacggcttgcgcgtgttcttgaaacacaatacagaattgctgattgccagctcttattccaaaaacttcggtatgtacaacgagcgcgtcggcgcgttcactttggtggccgaagatgaagaaacagcagcccgcgcccacagccaagtcaaaaccatcatccgtaccttgtattccaacccggcttcacacggtgcgaacaccattgcgctggtgttgaaaaatgatgatttgaaagcacaatggattgccgaactcgatgaaatgcgcggccgcatcaaagccatgcgccaaaaatttgtcgggttgctcaaagccaaaggtgcaagccaaaactttgatttcattatcaaacaaaacggtatgttctctttcagcggcttgactcccgaacaagtcgaccgcctgaaaaacgagtttgccatttatgccgtccgctccggccgcatcaacgtcgccggcattaccgacaacaacatcgattatctgtgcgaaagcatcgtgaaagtactgtaa

SEQ ID NO: 4643 - protein, 397 aa, Neisseria meningitidis MC58
MFFKHIEAAPADPILGLGEAFKAETRPEKVNLGIGVYKDASGATPLVKAVKEAEKRLLESETTKNYLTIDGVADYNAQTQILLFGKDHEIIASRRAKTAQSLGGTGALRIAAEFAKRQLNAQTIWISNPTWPNHNAIAKAVGIQDKPYRYYDAAKHGLDWDGMIEDLSQAQKGDIVLLHGCCHNPTGIDPTPEQWETLAKLSAEKGWLPLFDFAYQGFGNGLEEDAYGLRVFLKHNTELLIASSYSKNFGMYNERVGAFTLVAEDEETAARAHSQVKTIIRTLYSNPASHGANTIALVLKNDDLKAQWIAELDEMRGRIKAMRQKFVGLLKAKGASQNFDFIIKQNGMFSFSGLTPEQVDRLKNEFAIYAVRSGRINVAGITDNNIDYLCESIVKVL

SEQ ID NO: 4644 - DNA, 1194 bp, Neisseria meningitidis MC58
  CDS (1)..(1194): transl_table=11
atgtaccgacacatcgaatactatcctggcgacccgattttgagtttggtcgaaaccttcaaaaacgacccgcgccccgaaaaagtcaatttgagcataggcatttatttcgacgacgaaggcaaaatgcccgtgttggaatccgtgagccgagccgaaaccgcccgtgccgccgcgcctgcgccgtcgccctacctgccgatggaaggcttggacacttaccgcagcgcggtgcagcatttattgttcggcaaagacaatcccgcgcttgcgcaagggcgcatcgttaccgtacaaaccttgggcggctcgggcgcgctcaaagtcggggcggacttcctgcaccgctggtttcccgaagcgcgcgcctacgtcagcgacccgacttgggacaaccatcgcggcatttttgaaggcgcaggtttcgaggtcggcacttacccatattacgaccctgccactgtcggcgtgaaattcgacgaaatgaccgcgtttttcaacaccctgcccgaaaacagcgtcctgatcctccatccctgctgccacaacccgaccggcgtggatatgtcggaacggcaatgggacgaagtgttgcacatcatcaaaacgcgcaaactgattccgtttatggacattgcctaccaaggattcggcggcgatttggacagcgatgcctacgccgtccgcaaagcggtggaaatggaattgcccttgttcgtcagcaattccttctcaaaaaacctgtcgctctacggcgagcgcgtcggcggcttaagcgtggtttgcccgaataaggaagaagcggatttggtgttcggacagctcaaattcaccgtccgccgcatctactccagcccgcccgcgcacggcgcgtatatcgccgccgacgtgatgaacagccccgaactttacgccttgtggcaaaacgaggtttatatgatgcgcgaccgcatccgtgcgatgcggcagaaactttatgatgtcttaactgcgcaaatccccaatcgcgatttcacttatttcatcaaacagcgcggcatgttcggctacacaggattgagcgtggaacaagtccgcaggctgcgcgacgaatttgccgtttacctgctggattccggcaggatgtgcgtcgccggactgaatacgtcgaataccgactatgttgcccgcgcatttgcggaagtcttgaaataa

SEQ ID NO: 4645 - protein, 397 aa, Neisseria meningitidis MC58
MYRHIEYYPGDPILSLVETFKNDPRPEKVNLSIGIYFDDEGKMPVLESVSRAETARAAAPAPSPYLPMEGLDTYRSAVQHLLFGKDNPALAQGRIVTVQTLGGSGALKVGADFLHRWFPEARAYVSDPTWDNHRGIFEGAGFEVGTYPYYDPATVGVKFDEMTAFFNTLPENSVLILHPCCHNPTGVDMSERQWDEVLHIIKTRKLIPFMDIAYQGFGGDLDSDAYAVRKAVEMELPLFVSNSFSKNLSLYGERVGGLSVVCPNKEEADLVFGQLKFTVRRIYSSPPAHGAYIAADVMNSPELYALWQNEVYMMRDRIRAMRQKLYDVLTAQIPNRDFTYFIKQRGMFGYTGLSVEQVRRLRDEFAVYLLDSGRMCVAGLNTSNTDYVARAFAEVLK

SEQ ID NO: 4646 - DNA, 1194 bp, Neisseria meningitidis Z2491
  CDS (1)..(1194): transl_table=11
atgttcttcaagcacatcgaagccgcccccgccgatccgattctcggtttgggcgaagcattcaaagccgaaacccgccccgaaaaagtcaacctcggcatcggcgtgtacaaagacgcatccggcgcgacacctattgtcaaagccgtcaaagaagccgaaaaacgcctgttggaaagcgaaacaactaaaaactacctcaccatcgacggcgttgccgactacaacgagcaaacccaaattctgctgttcggcaaagaccacgaaatcatcgccagccgtcgcgccaaaacagcgcaaagccttggcggtacaggcgcattgcgtattgcggccgagtttgccaaacgtcagttgaacgcgcaaaccatctggatttccaatccgacttggcccaaccacaacgccatcgccaaagcggtcggtatccaagaccaaccttatcgctactatgatgccgccaaacacggtttggattgggacggtatgattgaagacttgagccaagcgcaaaaaggcgacatcgtcctgctgcacggctgctgccacaaccctaccggtatcgaccctacgcccgaacaatgggaaactctggcaaaactttctgccgaaaaaggctggttaccgctgtttgactttgcctaccaaggcttcggcaatggtttggaagaagatgcctacggcctgcgcgtgttcttgaaacacaatacagaattgctgattgccagctcttattccaaaaacttcggtatgtacaacgagcgcgtcggcgcgttcactttggtggccgaagatgaagcaaccgccgcccgcgcccacagccaagtcaaaaccattatccgtaccttgtattccaaccctgcttcacacggcgcgaacactattgcgctggtgttgaaaaatgatgatttgaaagcacaatggattgccgaactcgatgaaatgcgcggccgtatcaaagccatgcgccaaaaatttgtcgagttgctcaaagccaaaggtgcaactcaagactttgatttcattatcgaacaaaacggcatgttctccttcagcggcttgactcccgaacaagtcgaccgtttaaaaaacgagtttgccatttatgccgtccgctccggccgcatcaacgtcgccggcattaccgacgacaacatcgattatctgtgcgaaagtatcgtaaaagtactgtaa

SEQ ID NO: 4647 - protein, 397 aa, Neisseria meningitidis Z2491
MFFKHIEAAPADPILGLGEAFKAETRPEKVNLGIGVYKDASGATPIVKAVKEAEKRLLESETTKNYLTIDGVADYNEQTQILLFGKDHEIIASRRAKTAQSLGGTGALRIAAEFAKRQLNAQTIWISNPTWPNHNAIAKAVGIQDQPYRYYDAAKHGLDWDGMIEDLSQAQKGDIVLLHGCCHNPTGIDPTPEQWETLAKLSAEKGWLPLFDFAYQGFGNGLEEDAYGLRVFLKHNTELLIASSYSKNFGMYNERVGAFTLVAEDEATAARAHSQVKTIIRTLYSNPASHGANTIALVLKNDDLKAQWIAELDEMRGRIKAMRQKFVELLKAKGATQDFDFIIEQNGMFSFSGLTPEQVDRLKNEFAIYAVRSGRINVAGITDDNIDYLCESIVKVL

SEQ ID NO: 4648 - DNA, 1194 bp, Neisseria meningitidis Z2491
  CDS (1)..(1194): transl_table=11
atgtaccgacacatcgaatactatcccggcgacccgattttgagtttggtcgaaaccttcaaaaacgacccgcgccccgaaaaagtcaatttgagcataggcatttatttcgacgacgaaggcaaaatgcccgtgttggaatccgtgagccgagccgaaaccgcccgtgccgccgcgcctgcgccgtcgccctacctgccgatggaaggcttggacacttaccgcagcgcggtgcagcatttattgttcggcaaagacaaccctgcgctcgcgcaaggacgcatcgctaccgtacaaaccttgggcggctcgggcgcgctcaaagtcggagcagatttcctgcaccgctggtttcctgaagcgcgcgcctacgtcagcgacccgacttgggacaaccattgcggcatttttgaaggcgcaggtttcgaggtcggcacttacccatattacgaccctgccactgtcggcgtgaaattcgacgaaatgaccgcgtttttcaacaccctgcccgaaaacagcgtcctgatcctccatccctgctgccacaacccgaccggcgtggatatgtcggaacaacaatgggacgaagtgttgcacatcatcaaaacgcgcaaactgattccgtttatggacatcgcctaccaaggcttcggcggcgatttggacagcgatgcctacgccgtccgtaaagcggtggaaatggaattgcccttgttcgtcagcaattccttctcaaaaaacctgtcgctctacggcgagcgcgtcggcggcttaagcgtggtttgcccgaataaggaagaagcggatttggtgttcggacagctcaaattcaccgtccgccgcatctactccagcccgcccgcgcacggcgcgtatatcgccgccgacgtgatgaacagccccgaactttacgccttgtggcaaaacgaggtttatatgatgcgcgaccgcatccgtgcgatgcggcagaaactttatgatgtcttaactgcgcaaatccccgatcgcgatttcacttatttcatcaaacagcgcggcatgttcggctacacaggattgagcgtggaacaagtccgcaggctgcgcgacgaatttgccgtttacctgctggattccggcaggatgtgcgtcgccggactgaatacgtcgaataccgactatgttgcccgcgcatttgcggaagtcttgaaataa

SEQ ID NO: 4649 - protein, 397 aa, Neisseria meningitidis Z2491
MYRHIEYYPGDPILSLVETFKNDPRPEKVNLSIGIYFDDEGKMPVLESVSRAETARAAAPAPSPYLPMEGLDTYRSAVQHLLFGKDNPALAQGRIATVQTLGGSGALKVGADFLHRWFPEARAYVSDPTWDNHCGIFEGAGFEVGTYPYYDPATVGVKFDEMTAFFNTLPENSVLILHPCCHNPTGVDMSEQQWDEVLHIIKTRKLIPFMDIAYQGFGGDLDSDAYAVRKAVEMELPLFVSNSFSKNLSLYGERVGGLSVVCPNKEEADLVFGQLKFTVRRIYSSPPAHGAYIAADVMNSPELYALWQNEVYMMRDRIRAMRQKLYDVLTAQIPDRDFTYFIKQRGMFGYTGLSVEQVRRLRDEFAVYLLDSGRMCVAGLNTSNTDYVARAFAEVLK

SEQ ID NO: 4650 - DNA, 1203 bp, Chlamydia muridarum Nigg
  CDS (1)..(1203): transl_table=11
gtgagtctttttgaacagttaccttctttctctccggattctattcttggtttagcacaagcttttcaagaagatcctcgtgaggataaaattaatttattactgggtacttacgagcgagaaaaaagccgatacggaggattctcaagcgtcagaaaggctcaaacagtgttttttggtgatgagaaagataaaaactatcttcccatcagaggatcctcagtttttttagaccagatggctgctctatgttttggcgagattgatgctaatcgatggactggagtgcaagctgttggtgggactggagccttacatttgggcgccttagtgtatgctaaatcttctcttgcaggtaaagtctatatcccagctcaaacttgggggaaccactctagaattttttctcgtctaggattgtccctagaacattatccctactatgatcaagaaaaaaaagatctcgatttgcaaggattaaaagcatctcttcgggatgctcctgaggcttctttaattcttttacattgttgttgtcataaccctacagggaaggatattcccctttctgaatggcctgaaattattgctattataaaggacagaggcctcattcctttctttgatatggcttatttaggttttgctaacggaatagtagaggatcgccgacctgttcggctttgcatagaggctggagttgctacttttgttgcaggaagttgtagtaaaaacttctcattatatggttctcgggtaggattttttggggttgttcaccaagataaaacggatttgagcaggatactttctttcttggaagagcagatccgtggggaatactcttctcctgctagagaaggtgttgcaatcgttacctctatattagagaatccctacttgcgacaagagtgggggcttgaactgaatggtattcgccagtctttggaagaaattcgagcgaattttgttattgcaatgagagaagtagcgggacattcttttgatttcatcgcgtctcagaaaggattttttgggtatccaggtttttcaaaagagcaggttgtgttccttagagaagagcttggtatttatacaacagctggtggaagattcaatttaaatggcattacagataaaaatataaatcgtgttatccacggttttgctaaggcctatgaatactctcggtccgtatcataa

SEQ ID NO: 4651 - protein, 400 aa, Chlamydia muridarum Nigg
MSLFEQLPSFSPDSILGLAQAFQEDPREDKINLLLGTYEREKSRYGGFSSVRKAQTVFFGDEKDKNYLPIRGSSVFLDQMAALCFGEIDANRWTGVQAVGGTGALHLGALVYAKSSLAGKVYIPAQTWGNHSRIFSRLGLSLEHYPYYDQEKKDLDLQGLKASLRDAPEASLILLHCCCHNPTGKDIPLSEWPEIIAIIKDRGLIPFFDMAYLGFANGIVEDRRPVRLCIEAGVATFVAGSCSKNFSLYGSRVGFFGVVHQDKTDLSRILSFLEEQIRGEYSSPAREGVAIVTSILENPYLRQEWGLELNGIRQSLEEIRANFVIAMREVAGHSFDFIASQKGFFGYPGFSKEQVVFLREELGIYTTAGGRFNLNGITDKNINRVIHGFAKAYEYSRSVS

SEQ ID NO: 4652 - DNA, 1203 bp, Xylella fastidiosa 9a5c
  CDS (1)..(1203): transl_table=11
gtgcccttatttacagatgtggaattggttccaggtgatcccattctgagcctcaacgatacttataacgccgatacacgtaccaacaaggtcaatttgggtattggcatttattgtgacgagagcggttgtatcccgctgttgcgggctgtccagcaggttgaagagcaacttgcgaagcatccgaaaccgcgcggttatctgccgattgatggtttgccagcctatatcaaagccacacaacaattgttgtttggagtcgactcccccttgttgacggctggccgtgtggcgacctcacagactattggaggttctggggcattgcgggtgactgctgaggtactgaagcaggtgctaccacatgccactgtggccattagccgtccaagctgggagaaccaccgtgctttgttcaccgctgctggcttcaagattgaggactatacctatttcgatacgctcggccacgcggtggactttactggaatggtggcggacttggcgaagctgcaaccaaagaccgtggtattacttcatggttgctgtcataacccaacgggtgccgatctcagcagggatcagtggaagcagcttgttgccttgttccaggaacgtcaattgctgccatgtattgatctggcttaccaaggattcaatcagggcattgatgcggatgcttatgccatacgtttgcttgccgaagaaggtattagtaactatgtagttgccaactcgtactccaaatcgttctcgttgtatggcgagcgtgttggggggctgtcgatcgttgcttccaatacggagcaagcccaagcaatccagtcacaagtaaagcgtattatccgtacgatttattccagtccgtcggcacacggcgcctacttggtcgcaggtgtgctcaacagtcatgagctgcggacgctgtgggagcaggagttaacccagatgcgtgaacgtatccacgggttgcgtgcgggtttggttgctcgattgacggcgctgggtgcgccggagtttgatttcatacaacgtcaagcaggcatgttttcgtattcggggctgagcaagatccaggtggatcgtttgcgcgacgagttcgggatttatgcggtcagtagtggacgtatctgtgtggctgcgttgagtcagcacaaattggaatacgtggcgcaggctgtggtgaaggtgcatcaaggctga

SEQ ID NO: 4653 - protein, 400 aa, Xylella fastidiosa 9a5c
MPLFTDVELVPGDPILSLNDTYNADTRTNKVNLGIGIYCDESGCIPLLRAVQQVEEQLAKHPKPRGYLPIDGLPAYIKATQQLLFGVDSPLLTAGRVATSQTIGGSGALRVTAEVLKQVLPHATVAISRPSWENHRALFTAAGFKIEDYTYFDTLGHAVDFTGMVADLAKLQPKTVVLLHGCCHNPTGADLSRDQWKQLVALFQERQLLPCIDLAYQGFNQGIDADAYAIRLLAEEGISNYVVANSYSKSFSLYGERVGGLSIVASNTEQAQAIQSQVKRIIRTIYSSPSAHGAYLVAGVLNSHELRTLWEQELTQMRERIHGLRAGLVARLTALGAPEFDFIQRQAGMFSYSGLSKIQVDRLRDEFGIYAVSSGRICVAALSQHKLEYVAQAVVKVHQG

SEQ ID NO: 4654 - DNA, 1191 bp, Yersinia pestis CO92
  CDS (1)..(1191): transl_table=11
atgtttgaaaaaattactgctgcacctgcggatcctattttaggtttgaccgatatcttccgcgcggatgaccgcgctcataaaatcaatctggggatcggtgtctacaaagacgaaaccggtaaaaccccagtgctgaccagcgtgaagaaagctgagcagtatttactggaaaatgaagctaccaaaaattatctgggtattgacggcctgcctgtttttgccagttgcacccaagaactgctgttcggtgctaatagtgcaattattgcggataaacgtgctcgtaccgctcaaacgccaggtggtaccggtggtttgcgcattgccgctgattttatcgcccatcagaccagcgctaaacgtgtctgggtcagtaacccaagctggccaaaccataaaaacgtcttcgaagccgcagggctggaagtggtggagtacgcttattatgatgctgctaaccatgcattggacttcgatggcttgttaaatagcctgtcagaagctcaggcgggtgatgtggtgttgttccacggctgctgccataacccaacgggtatcgacccaacagaaactcagtggagccaactggcggagttatcggttgctaaaggctggttgccactgtttgatttcgcttatcaaggctttgccaacggtttggaagaagatgctcagggcctgcgtattttcgcggcaacacatcaagagttgatcgtttgcagctcttattcgaaaaactttggtttgtacaatgaacgtgttggggcttgtacccttgtcgccgccgacagtaacgttgccgataccgcattcagccaagttaaagcggttatccgagccaactactctaacccaccggcacatggtgcatcagtcgttgccactattctgagtaatgccgcactacgggcgatttgggaacaagaactgaccgatatgcgtcagcgcatccaacgtatgcgtcagttgtttgttaataccttgcaggaaaaaggcgctcaacaagattttagctttatcattaaccagaatgggatgttctcgttcagtggtctgaccaaagaacaagtgctgcgcctgcgtgatgagttcgccgtctatgcggtaaattctggccgggttaacgtggcggggatgacaccagacaatatggcgccgttatgtgaagctatcgttgcggtgctctaa

SEQ ID NO: 4655 - protein, 396 aa, Yersinia pestis CO92
MFEKITAAPADPILGLTDIFRADDRAHKINLGIGVYKDETGKTPVLTSVKKAEQYLLENEATKNYLGIDGLPVFASCTQELLFGANSAIIADKRARTAQTPGGTGGLRIAADFIAHQTSAKRVWVSNPSWPNHKNVFEAAGLEVVEYAYYDAANHALDFDGLLNSLSEAQAGDVVLFHGCCHNPTGIDPTETQWSQLAELSVAKGWLPLFDFAYQGFANGLEEDAQGLRIFAATHQELIVCSSYSKNFGLYNERVGACTLVAADSNVADTAFSQVKAVIRANYSNPPAHGASVVATILSNAALRAIWEQELTDMRQRIQRMRQLFVNTLQEKGAQQDFSFIINQNGMFSFSGLTKEQVLRLRDEFAVYAVNSGRVNVAGMTPDNMAPLCEAIVAVL

SEQ ID NO: 4656 - DNA, 1194 bp, Salmonella enterica subsp. enterica serovar Typhi str. CT18
  CDS (1)..(1194): transl_table=11
gtgtttcaaaaagttgacgcctatgccggcgatccgattctttcactgatggagcgttttaaagacgactcccgtcacgacaaagtaaatctgagcattggcctgtattacaacgaagacgggattatcccacagctcaaaacggtggccgaagccgaagcccggcttaacgcgcagccgcatggcgcctcgctgtacctgccgatggaaggactcaatacttatcgccatactatcgcgcctttgctctttggcgccgatcacccggttcttcagcaacagcgcgtggccactatccagacattaggtggttcaggcgcgctgaaagtgggcgcggattttctgaagcgttatttccccgacgcaggcgtatgggtgagcgaccctacctgggaaaaccatattgcgatatttgccggggcaggattcgaagtgagtacttacccctggtatgacgacgcgactaacggcatccgttttaacgatctgctggccacgctgaatacgttacctgcgcgcagtatcgtgctgctgcacccctgttgtcacaacccgaccggggcggatttaacgccttcgcaatgggatgcggtgattgagatagtgaaagcgcgcgatctgattccgttccttgatattgcctatcaggggtttggcgcaggcatggacgaggatgcttacgctattcgcgccattgccagcgccgggttacctgcgttagtcagtaattctttttcgaagattttctcgctgtatggcgagtgcgtcggcggcctgtcggtggtgtgtgaagatgccgaaatcgccgcgcgggttctgggacagctaaaagcgacggtgcgccgaatttactccagtccgccgtgtttcggcgctcaggtggtcgctacggtcctgggcgatgaggcgttaaaagcgagctggctggcggaagtcgacgcgatgcgtacccgcattatatcgatgcgccagacgctggtgaaagagctgaaggcggagatgcctgaccgcaacttcgattacttgttacagcagcgtggtatgttcagctataccgggttaagcgcggagcaggtcgatcggttgcgcgatgagtttggcgtttacctgattgccagtggccgcatgtgtgtcgctgggcttaatgcttcaaatgtacaccgcgtggcgaaggcatttgccgctgtcatgtaa

SEQ ID NO: 4657 - protein, 397 aa, Salmonella enterica subsp. enterica serovar Typhi str. CT18
MFQKVDAYAGDPILSLMERFKDDSRHDKVNLSIGLYYNEDGIIPQLKTVAEAEARLNAQPHGASLYLPMEGLNTYRHTIAPLLFGADHPVLQQQRVATIQTLGGSGALKVGADFLKRYFPDAGVWVSDPTWENHIAIFAGAGFEVSTYPWYDDATNGIRFNDLLATLNTLPARSIVLLHPCCHNPTGADLTPSQWDAVIEIVKARDLIPFLDIAYQGFGAGMDEDAYAIRAIASAGLPALVSNSFSKIFSLYGECVGGLSVVCEDAEIAARVLGQLKATVRRIYSSPPCFGAQVVATVLGDEALKASWLAEVDAMRTRIISMRQTLVKELKAEMPDRNFDYLLQQRGMFSYTGLSAEQVDRLRDEFGVYLIASGRMCVAGLNASNVHRVAKAFAAVM

SEQ ID NO: 4658 - DNA, 1197 bp, Ralstonia solanacearum GMI1000
  CDS (1)..(1197): transl_table=11
atgtcgcttttttccgccgtcgagctggccccgcgcgaccccatcctggggctgaatgaagctttcaacgccgatgcccgcagcaccaaagtcaacctgggcgtgggcgtgtacttcaccgacgaaggaaaaatcccggtactgcgcgccgtgcaggaagccgagaaggcccgcctggccatggccgcgccgcgcggctacctgccgatcgaaggcatcgccgcctacgaccaggccgtgcagaagctgctgttcggcgccgattcgccgctgctggccgaaggccgcgtggtgacggcccaggcactgggcggcaccggcgcactgaagatcggcgccgatttcctcaaacgcctgtacccggacgccaaggtcgccatctccgacccgagctgggaaaaccaccgcgcgctgttcgaggccgccggcttcccggtcgtgaactatccgtactacgacgccccgacgcacggcctgaacttcgccgccatgctcgaagcgctcaacggctacgcgcccaacaccatcgtcgtgctgcacgcctgctgccacaacccgaccggcgtggacctgaccaccgagcagtggaagcaggtggtcgaagtcatcaaggccaagcagctgatcccgttcctcgacatggcctaccagggcttcgccgacggcatcgcccaggacggcctggccgtgagcctgttcgccgaatcgggcctgcagttcttcgtgtcgagctcgttctccaagtcgttctcgctgtacggcgagcgcgtcggcgctctgtcgatcgtcaccaccagcaaggacgaggcagcccgcgtgatgtcgcaggtcaagcgcgtgatccgcaccaactactccaacccgccgacgcacggcggcacggtggtcgccagcgtgctgaccagccccgagctgcgcgcgatgtgggagcaggaactgggcgagatgcgcgaccgcatcaagtcgatgcgccacgcgctggtcgacaagcttgccgccaagggcgtgaagaccgacttctcgttcgtgaaggcgcagcgcggcatgttctcgtattcgggcctgtccgccgcccaggtggaccgcctgcgcaacgagcacggcatctacgcggtgtcgaccggccgcatctgcgtggccgcgctgaactcgcacaacatcgacgccgtggtcaacgccatcgccgaagtgctctga

SEQ ID NO: 4659 - protein, 398 aa, Ralstonia solanacearum GMI1000
MSLFSAVELAPRDPILGLNEAFNADARSTKVNLGVGVYFTDEGKIPVLRAVQEAEKARLAMAAPRGYLPIEGIAAYDQAVQKLLFGADSPLLAEGRVVTAQALGGTGALKIGADFLKRLYPDAKVAISDPSWENHRALFEAAGFPVVNYPYYDAPTHGLNFAAMLEALNGYAPNTIVVLHACCHNPTGVDLTTEQWKQVVEVIKAKQLIPFLDMAYQGFADGIAQDGLAVSLFAESGLQFFVSSSFSKSFSLYGERVGALSIVTTSKDEAARVMSQVKRVIRTNYSNPPTHGGTVVASVLTSPELRAMWEQELGEMRDRIKSMRHALVDKLAAKGVKTDFSFVKAQRGMFSYSGLSAAQVDRLRNEHGIYAVSTGRICVAALNSHNIDAVVNAIAEVL

SEQ ID NO: 4660 - DNA, 1230 bp, Schizosaccharomyces pombe 972h-
  CDS (1)..(1230)
atgtcagactacgggtttgcaaatattgaggaagctaaggcagatgcaatttttaaattaaatgctcaataccatcaggatgaagatcccaagaaggttaacatgagtgttggcgcctatcgtgacgatactggtaagccttggattttgcctgcagttaaaaaagcatctaaaatagtggaagaacaggcaagcttcaaccatgaatatttaccaattgctggattgcctcgtttcactaaggctgcggctgaagttcttttcagacccaatcctcatttattgtccgaggaccgtgttgcatctatgcagtcagtctctggtactggtgccaattttcttgctgctagtttcattgagactttctatgtaaagcacactggagcccatgtatacatctccaaccctacttggcctgtccatcgcactttgtgggaaaaattgggagtcactgtagatacatatccttattgggatgccaagaatagatcttttgattacgaaggcatgctaagtaccattaaatctgctcccgaaggaagtatatttttacttcatgcttgtgctcacaatcctactggtattgaccccactagggaacaatggctttctatattcgagagtctgctttctcgcaagcatctggtagtttttgacattgcttatcaaggttttgccagtggtgatctgaatcgtgactcttgggctctaaacgagtttgtcaaatataacaaggactttttcgtttgtcagtcatttgctaaaaatatgggtctttatggtgaacgtactggttgcatgcattacgttgcaaaggacgcttccactaaaaacaaggtcttatctcaattgtgtattgttcaacgtaacaccatttctaaccctcccgcttacggtgcacgtattgctgccgaaattcttaacagtcctcaattgtttgctgaatgggaacaagatttaaagactatgtcttctagaatcattgagatgaggaaacgtcttcgcgattctcttgttgcactcaaaacccccggttcttgggatcatattacacaacaaattggaatgttttcttttaccggtttaacgcctgcacaagtccaattttgccaggagcggtaccatctttatttcagtgcaaatggtcgtatttctatggctggtttgaacaattctaatgtagagcatgttgcacaggcatttaaccatgctgttcgcgagttgccttaa

SEQ ID NO: 4661 - protein, 409 aa, Schizosaccharomyces pombe 972h-
MSDYGFANIEEAKADAIFKLNAQYHQDEDPKKVNMSVGAYRDDTGKPWILPAVKKASKIVEEQASFNHEYLPIAGLPRFTKAAAEVLFRPNPHLLSEDRVASMQSVSGTGANFLAASFIETFYVKHTGAHVYISNPTWPVHRTLWEKLGVTVDTYPYWDAKNRSFDYEGMLSTIKSAPEGSIFLLHACAHNPTGIDPTREQWLSIFESLLSRKHLVVFDIAYQGFASGDLNRDSWALNEFVKYNKDFFVCQSFAKNMGLYGERTGCMHYVAKDASTKNKVLSQLCIVQRNTISNPPAYGARIAAEILNSPQLFAEWEQDLKTMSSRIIEMRKRLRDSLVALKTPGSWDHITQQIGMFSFTGLTPAQVQFCQERYHLYFSANGRISMAGLNNSNVEHVAQAFNHAVRELP

SEQ ID NO: 4662 - DNA, 1314 bp, Schizosaccharomyces pombe 972h-
  CDS (1)..(1314)
atgttggccaggaatttgcgttgtttgcatccaaatacatttgcatcgttaaaaaccaacgtttcctaccatggagtaaaatgcttggcaagtcagagcaagcgtggattcaaggtttgggcagatgtacctatgggaccaccggatcccatctttggtattacagaggcctataaaaaggatggagatgttaagaaaatgaacttgggtgctggtacatatcgtgatgatgccggaaagccttatgttctgcccagtgttcgtcaggcagaaactgagctgttgagtcagaaactcgacaaagaatatgcacccatcacaggaattcccagtttccgtgtgcaagcaacaaaattggcttatggcgatgtttacgagtctataaaggataggctggtttctgctcaatccattagtggtaccggtgccttgtgtatagcagctaatttccttgcttcattttatccatcaaagactatttacgtatctgaccctacttggggaaatcacaagaatgtattttctcgagctggcttgaccgttaagtcctacaagtattatgatcctgctactcgtgggttggacattaaaggcatgttgtccgatttaacttcagctcctgatggctctattatattattgcatgcttgtgctcacaatccaactggtgtagatcctacgaaagctcagtgggatgatatcctcaaaacaatgcaaaagaaaaaccattttgctcttttagacatggcttaccaaggatttgccagtggtgattttgctcgtgatgcttatgccactcgtctgttcgcctccagcaatgtccccatgttactctgccaatcctttgctaaaaacatgggtctatatggtgaacgtgctggctgctttagcattttagccaacgatgctgaggaagccgctcgtatcgaaagccaaactaagattctcattcgtgctttgtattccaaccctcccgtcaatggggccagaattgccaaccatatattgagcaaccctgcacttcgtgaacagtgggctggtgaagttgtaggcatgtccgaacgtcttaagagtatgcgtaaggctcttcgcaacatccttgaaaaggaccttaagaataaacacagctggaagcatatcactgaccaaattggtatgttttgttatactggtttaaatccccagcaagttgatgttttggctaaacagtatcacatttacctcactaagaatggtcgtattagcatctccggtctcaacacttccaatgtaagatactttgccgaagctatcaatgccgttacttcgaattag

SEQ ID NO: 4663 - protein, 437 aa, Schizosaccharomyces pombe 972h-
MLARNLRCLHPNTFASLKTNVSYHGVKCLASQSKRGFKVWADVPMGPPDPIFGITEAYKKDGDVKKMNLGAGTYRDDAGKPYVLPSVRQAETELLSQKLDKEYAPITGIPSFRVQATKLAYGDVYESIKDRLVSAQSISGTGALCIAANFLASFYPSKTIYVSDPTWGNHKNVFSRAGLTVKSYKYYDPATRGLDIKGMLSDLTSAPDGSIILLHACAHNPTGVDPTKAQWDDILKTMQKKNHFALLDMAYQGFASGDFARDAYATRLFASSNVPMLLCQSFAKNMGLYGERAGCFSILANDAEEAARIESQTKILIRALYSNPPVNGARIANHILSNPALREQWAGEVVGMSERLKSMRKALRNILEKDLKNKHSWKHITDQIGMFCYTGLNPQQVDVLAKQYHIYLTKNGRISISGLNTSNVRYFAEAINAVTSN

SEQ ID NO: 4664 - DNA, 1203 bp, Xanthomonas axonopodis pv. citri str. 306
  CDS (1)..(1203): transl_table=11
gtgtccttctttgcaaacgtggaacaggttccaggcgaccccatcctgggcctgaccgaggcctacaacgccgacagccgccccaacaaggtcaacctgggcgtgggcatctattacgacgaaaacgggcgcatcccgctgttgcgcgccgtgcacaagatcgagcagcagctcgcgcaggacgccaaaccgcggggttatctgcccatcgacggcctggccgcgtacgacaaggccacccaggagctgctgtttggcgccgactctgcgctggtgacctccggccgcgtggcgacctcgcagaccgtcggcggcagcggcgcattgcgcgtgggcgcggacctgctcaagaagctgctgcccaccgccaccatcgccatcagcaaccccagctgggaaaaccatcgcgcggtgttcggcgcggccggcttcgaggttgtcgattacacctacttcgatgccgccatccatggcctgaacttcgacggcatgctcgccgacctggccaagctcgaaccgggcaccgtggtgctgctgcacgcctgctgccacaaccccaccggcgccgacctgagcaaggaacagtggaagcaggtggccggcctgttgaaggaacgcaacctgttcccgttcgtcgacatcgcctaccagggcttcgacaagggcatcgaggccgatgcctatgcggtgcgcctgctggctgccgaaggcatcgacagctacgtggtcgccagttcctattccaagtcgttctcgctgtatggcgagcgcgtgggcgcgctgtcggtggtctcggccaccgccgccgaagccaaggcggtgcagtcgcaggtcaagcgcatcatccgcacgatctactccagcccgtccacgcacggcgccgccctggtggccggcgtgctgaccagcccggagctgcgcgatctgtgggagcaggaactgaccgagatgcgcgagcgcatccattccctgcgcgccgggctggtggaaaaactcgccacgctgggtgcgccggagttcgacttcatccagcgccaggccggcatgttctcgtactcgggcctgaccaagacccaggtggaccgcctgcgcgacgagttcgcgatctacgcggtcggcaccggccgcatctgcgtggcagcactgagccagcgtaacctggactacgtggcccaggccgtggccactgtcagccgggtgtag

SEQ ID NO: 4665 - protein, 400 aa, Xanthomonas axonopodis pv. citri str. 306
MSFFANVEQVPGDPILGLTEAYNADSRPNKVNLGVGIYYDENGRIPLLRAVHKIEQQLAQDAKPRGYLPIDGLAAYDKATQELLFGADSALVTSGRVATSQTVGGSGALRVGADLLKKLLPTATIAISNPSWENHRAVFGAAGFEVVDYTYFDAAIHGLNFDGMLADLAKLEPGTVVLLHACCHNPTGADLSKEQWKQVAGLLKERNLFPFVDIAYQGFDKGIEADAYAVRLLAAEGIDSYVVASSYSKSFSLYGERVGALSVVSATAAEAKAVQSQVKRIIRTIYSSPSTHGAALVAGVLTSPELRDLWEQELTEMRERIHSLRAGLVEKLATLGAPEFDFIQRQAGMFSYSGLTKTQVDRLRDEFAIYAVGTGRICVAALSQRNLDYVAQAVATVSRV

SEQ ID NO: 4666 - DNA, 1194 bp, Shewanella oneidensis MR-1
  CDS (1)..(1194): transl_table=11
atgattttctctcaggtagtgctcgctccagcagatcccatccttggtttaaccgatacttttaaagctgatccacgtcaagataaagtcaaccttggtgtcggcatttataaggatgaagcagggcagactccggtattgcaatcggttaagaaagcagaagccatactgctagaacaagagaagactaaaaactatttaggcatagaaggggtccaaacctacaaccgcgttgtacaagagttgttatttggtgaaggtagtgagctagtggcttctggccgtgccgcaaccgcccaagcgcctggtggtacaggggcattgcgtatagccgccgagtttttattgagaaacacgccatctcgcactatttgggtaagtaatcccacttgggctaaccatcaaaatatttttgaaactgcagggttaacggttaaagagtttggatattacaacgccagtgctcacgatatcgatttcgatggcatgatgaccgatctcgccaatgcacaggcgggtgacattattctactgcacggctgctgtcataacccaacgggtattgacttgactttagcgcaatgggatttagtggctaacctctgtgctgacaaacaattagtgcctttgtttgactttgcttaccaaggttttggaacaggtattgaagaagatgctgcaggcctgcgtttagtcgcttcaaaagttcctgagctgttagtcgcaaattctttctctaaaaactttgggctttataatgaacgtatcggtgctgtgactgtggttgctcacaatgcagatgaagctgttcgcgcttttagccaagtgaaacgtacaattcgggcaaactattcaaatcccccagcccatggtgcgttaattgttagcaccattttaagtgatgcagctttgaaagccctttgggtacaagagctgaccgaaatgcgtgagcgtatagcccttatgcgtactctatttgtgcagagcttaaaagatgagggtgtgactcaagattttagctttatttcgcgccaaaatggtatgtttagcttctctggcttgaataagtcgcaagtggcccgtttaaaagacgaatttggagtttatattgtcggttctggtcgtattagtgtggcgggtatgacgaaagccaatatgcctgcgatctgtaaagcgattgctcaggtcgtataa

SEQ ID NO: 4667 - protein, 397 aa, Shewanella oneidensis MR-1
MIFSQVVLAPADPILGLTDTFKADPRQDKVNLGVGIYKDEAGQTPVLQSVKKAEAILLEQEKTKNYLGIEGVQTYNRVVQELLFGEGSELVASGRAATAQAPGGTGALRIAAEFLLRNTPSRTIWVSNPTWANHQNIFETAGLTVKEFGYYNASAHDIDFDGMMTDLANAQAGDIILLHGCCHNPTGIDLTLAQWDLVANLCADKQLVPLFDFAYQGFGTGIEEDAAGLRLVASKVPELLVANSFSKNFGLYNERIGAVTVVAHNADEAVRAFSQVKRTIRANYSNPPAHGALIVSTILSDAALKALWVQELTEMRERIALMRTLFVQSLKDEGVTQDFSFISRQNGMFSFSGLNKSQVARLKDEFGVYIVGSGRISVAGMTKANMPAICKAIAQVV

SEQ ID NO: 4668 - DNA, 1191 bp, Shewanella oneidensis MR-1
  CDS (1)..(1191): transl_table=11
atgtttaactcactcatcgcaatgcctgcggatccgatccttggcttgttgacccagtaccgcgaagacacacatccacagaaagtagacttaggtgtcggcgtttataaagatcccgcgggaaacacccccattctcaattgtgtaaaaaaagccgagaaatttcgtttagaaaccgagacgacaaaggtctatatcggtccaactggttcgcctcagtttaataccctgatgacagagttagcctttggcagtgatcatagcgcgattatcgctaaccgtattcgtactgtttccacacctggcggtacgggcgctctgcgtgttgcgggtgactttattaagcgttgcaatcctaatgcggtgttgtgggtaagcgatcccacatgggctaatcatacaggtttattcgaagctgctgggatcacagttaaaacttatccctattatgactacgatagtaaatcgttgaaatttgacgagatgcttgctgcattatcgcaagtgagtcctgatgacgtagtgttattacacgcctgctgccataacccaagtgggatggatttgaccactgatcaatgggataaagtcgtcaccctcaccaaagagcaaggttttaccccgcttatcgacatggcttaccaaggttttggtgacggtgtcgatatcgatgcctacggcgtgcgtaaaatggctgcagcggtcgataatatgatcctgtgtagctcttgctcgaagaacttcggtctgtaccgtgagcgtatcggttcctgctctgtggttgcaaaggatgcgaacacggcaaacattgcgcaatctgtactgctttatgtggttcgctgcctctactctatgccacctgcccatggcgcggcgattgttgagacgattttaggatcaaaagaattaacccaagaatggcttgatgagctcaaagtgatgcgcgaccgtatcaatggtaaccgcgcgattttagttgaaaaactcaaagccaatggtgttgctcgcgactttagctttattgctcgccaaaaaggcatgttctctttccttggtgtaaatcctgagcaagtggcgcgtctgcaaaaagaatttagcatctacatggtgggttcaagccggatcagtatcgcggggatcagtgaagataacgtcgattatctcgcccaatcgatcgccaaagtgctttga

SEQ ID NO: 4669 - protein, 396 aa, Shewanella oneidensis MR-1
MFNSLIAMPADPILGLLTQYREDTHPQKVDLGVGVYKDPAGNTPILNCVKKAEKFRLETETTKVYIGPTGSPQFNTLMTELAFGSDHSAIIANRIRTVSTPGGTGALRVAGDFIKRCNPNAVLWVSDPTWANHTGLFEAAGITVKTYPYYDYDSKSLKFDEMLAALSQVSPDDVVLLHACCHNPSGMDLTTDQWDKVVTLTKEQGFTPLIDMAYQGFGDGVDIDAYGVRKMAAAVDNMILCSSCSKNFGLYRERIGSCSVVAKDANTANIAQSVLLYVVRCLYSMPPAHGAAIVETILGSKELTQEWLDELKVMRDRINGNRAILVEKLKANGVARDFSFIARQKGMFSFLGVNPEQVARLQKEFSIYMVGSSRISIAGISEDNVDYLAQSIAKVL

SEQ ID NO: 4670 - DNA, 1197 bp, Pseudomonas putida KT2440
  CDS (1)..(1197): transl_table=11
atgagcctgttttccgctgtcgagctggcaccccgcgaccctattctgggcctcaacgaagcattcaacgccgacccacgtaccgacaaggtcaacctgggcgtaggcgtgtattgcaatgaggaaggccgcattccgctgctgcgcgccgtgatcgaagccgaaacccagcgtgccgcccagcacgcttcgcgcggctacctgccgatcgacggcatcgccacctacgaccaggctgtgcagaagctgctgttcggcgccgagtcgccactgctggccgccggccgcgtggtcaccgtgcaggccgtcggtggtaccggcgcgctgaagatcggtgccgacttcctcaagcgcctctcgcccaatgccgtggttgccatcagcgaccctagctgggaaaaccaccgtgcgctgttcgaatcggccggcttcccggtgcagacctaccgctactacgatgcgccgaccaacgacgtcaaccgcgctggcatgctcgaagacctcaacgccctgccatccggttcgatcgtggtgctgcacgcctgctgccacaacccgaccggtgtcgacctgaacctggacgactggaagaacgtcctggaagtggtcaaggccaagggccacgtgccgttcctcgacatggcctaccagggctttggtgacggtatcgccgaagacgccttcgccgtgcgcctgttcgccgagtcgggcctggagttcttcgtttccagctcgttctccaaatcgttctcgctgtacggcgagcgcgtcggcgcactgtcgatcgtcaccgcctccaaggacgagagcacccgcgtgctgtcgcaggtcaagcgcgtgatccgcaccacctactccaacccgccaacccacggcgcaaccattgttgccaccgtgctgaacagcgcagaactgcgccagatgtgggaaaccgaactggccgaaatgcgcgagcgcatccacggcatgcgcaagcagatggtatcgctgctggccgaatacggtgcaaaccgcgacttcagcttcgttggccgccaggtcggcatgttctcctactcgggcctgaccgttgaacaggtcacccgcctgaagaacgacttcggcatctatgccctggacaccggccgtatcgcggtggccgcgctgaaccagagcaacatccacgtggtgaccaaagcgatcgtggaagtgctgtaa

SEQ ID NO: 4671 - protein, 398 aa, Pseudomonas putida KT2440
MSLFSAVELAPRDPILGLNEAFNADPRTDKVNLGVGVYCNEEGRIPLLRAVIEAETQRAAQHASRGYLPIDGIATYDQAVQKLLFGAESPLLAAGRVVTVQAVGGTGALKIGADFLKRLSPNAVVAISDPSWENHRALFESAGFPVQTYRYYDAPTNDVNRAGMLEDLNALPSGSIVVLHACCHNPTGVDLNLDDWKNVLEVVKAKGHVPFLDMAYQGFGDGIAEDAFAVRLFAESGLEFFVSSSFSKSFSLYGERVGALSIVTASKDESTRVLSQVKRVIRTTYSNPPTHGATIVATVLNSAELRQMWETELAEMRERIHGMRKQMVSLLAEYGANRDFSFVGRQVGMFSYSGLTVEQVTRLKNDFGIYALDTGRIAVAALNQSNIHVVTKAIVEVL

SEQ ID NO: 4672 - DNA, 1197 bp, Pseudomonas putida KT2440
  CDS (1)..(1197): transl_table=11
gtgttcaaacatgtcgatgcctatgccggcgacccgatcctctcgttgatggaaaccttcaaggccgacccgcgcgccgacaaggtcaacctgagtattggcctgtactacgatgaggccggcgtggtgccgcaactggcggcggtggatgcggtggaaaaacgcattgccggtcaggaccacgaagcctccctgtacctgccaatggaaggcctggccagctaccgccaagccatccaggcgctgctgttcggtgctgatcacccggccgtgaccggcggtcgtgtggccaccgtacagaccgtgggtggctccggcgccctgaaagtcggtgccgatttcctcaagcgctacttcccgcagtccgaagtctgggtcagcaacccgacctgggacaaccaccgcgccatcttcgaaggtgcaggcttcaaggtgcacacctatccgtactttgaccaggccacccgtggcgtggacttcgacggcatgctggccaccttgcagagcctgccggccaacagcgtggtactgctgcacccgtgctgccacaaccctaccggtgccgatctgcagcagcaccagtggcaacaagtggtcgaagtggtcaaggcacgccagctgatcccgttcctcgacatcgcttatcaaggcttcgccgaaggcctggtggaagatgcctacgccatccgcgaaatggcccgtgccggcgtgccgtgcctggtcagcaactccttctcgaaaatcttctcgctgtatggcgagcgggtgggcggcctgtcggtggtgtgcgatgacgaggccactgcccagagcgtgcttggccagctgaaggccaccgtgcgccgcaactactccagcccgcccaacttcggcgcccagctggttgccggcgtactgagcgatgctggcctgaatgcccagtgggccgaagaagtcgaagtgatgcgcaagcgtattctcgacatgcgccaggcgctggtcgatgccctggccgtgctgctgccgggccaggacttccagttcttcctgcgccagcgcggcatgttcagctacaccggctttagcgtcgagcaggtacgtcgcctgcgtgacgagttcggcgtgtacctgatcgacagcggccgtgtgtgcatgtccggcctgcgcccggccaacctgcaacgggttgccgaagcgttcgctgccgttcagaagtaa

SEQ ID NO: 4673 - protein, 398 aa, Pseudomonas putida KT2440
MFKHVDAYAGDPILSLMETFKADPRADKVNLSIGLYYDEAGVVPQLAAVDAVEKRIAGQDHEASLYLPMEGLASYRQAIQALLFGADHPAVTGGRVATVQTVGGSGALKVGADFLKRYFPQSEVWVSNPTWDNHRAIFEGAGFKVHTYPYFDQATRGVDFDGMLATLQSLPANSVVLLHPCCHNPTGADLQQHQWQQVVEVVKARQLIPFLDIAYQGFAEGLVEDAYAIREMARAGVPCLVSNSFSKIFSLYGERVGGLSVVCDDEATAQSVLGQLKATVRRNYSSPPNFGAQLVAGVLSDAGLNAQWAEEVEVMRKRILDMRQALVDALAVLLPGQDFQFFLRQRGMFSYTGFSVEQVRRLRDEFGVYLIDSGRVCMSGLRPANLQRVAEAFAAVQK

SEQ ID NO: 4674 - DNA, 1191 bp, Escherichia coli CFT073
  CDS (1)..(1191): transl_table=11
atgtttgagaacattaccgccgctcctgccgacccgattctgggcctggccgatctgtttcgtgccgatgaacgtcccggcaaaattaacctcgggattggtgtctataaagatgagacgggtaaaaccccggtactgaccagcgtgaaaaaggctgaacagtatctgctcgaaaatgaaaccaccaaaaattacctcggcattgacggcctccctgaatttggtcgctgcactcaggaactgctgtttggtaaaggtagcgccctgatcaatgacaaacgtgctcgcacggcacagactccgggtggcactggcgcactacgcgtggctgccgatttcctggcaaaaaataccagcgttaagcgtgtgtgggtgagcaacccaagctggccgaaccataagagcgtctttaactctgcaggtctggaagttcgtgaatacgcttattatgatgcggaaaatcacactcttgacttcgatgcactgattaacagcctgaacgaagctcaggctggcgacgtagtgctgttccatggctgctgccataacccaaccggcatcgaccctacgctggaacaatggcagacactggcacaactctccgttgagaaaggctggttaccgctgtttgacttcgcttaccagggttttgcccgtggtctggaagaagatgctgaaggactgcgcgctttcgcggctctgcataaggagctgattgttgccagttcctactctaaaaactttggcctgtacaacgagcgtgttggcgcttgtactctggttgctgctgacagtgaaactgttgaacgcgcattcagccaaatgaaagcggcgattcgtgctaactactctaacccaccagcacacggcgcttctgttgttgccaccatcctgagcaacgatgcgttacgtgcgatttgggaacaagaactgactgatatgcgccagcgtattcagcgtatgcgtcagttgttcgtcaatacgctgcaggaaaaaggcgcaaatcgcgacttcagctttatcatcaaacagaacggcatgttctccttcagtggcctgacaaaagaacaagtgctgcgtctgcgccaagagtttggcgtatatgctgttgcttctggtcgcgtaaacgtagctgggatgacaccagataacatggcgccgctgtgcgaagcgattgtggcagtgctgtaa

SEQ ID NO: 4675 - protein, 396 aa, Escherichia coli CFT073
MFENITAAPADPILGLADLFRADERPGKINLGIGVYKDETGKTPVLTSVKKAEQYLLENETTKNYLGIDGLPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAALHKELIVASSYSKNFGLYNERVGACTLVAADSETVERAFSQMKAAIRANYSNPPAHGASVVATILSNDALRAIWEQELTDMRQRIQRMRQLFVNTLQEKGANRDFSFIIKQNGMFSFSGLTKEQVLRLRQEFGVYAVASGRVNVAGMTPDNMAPLCEAIVAVL

SEQ ID NO: 4676 - DNA, 1236 bp, Escherichia coli CFT073
  CDS (1)..(1236): transl_table=11
ttgtgttttaaccaccagcccgtaaacctggagaaccatcgcgtgtttcaaaaagttgacgcctacgctggcgacccgattcttacgcttatggagcgttttaaagaagaccctcgcagcgacaaagtgaatttaagtatcggtctgtactacaacgaagacggaattattccacaactgaaagccgtggcggatgcggaagcgcgcctgaatgcgcagcctcatggtgcttcgctttatttaccgatggaagggcttaacagctatcgccatgccattgcgccgctgctgtttggtgcggaccatccggtactgcaacaacagcgcgtagcaaccattcaaacccttggcggctcaggggcattgaaagtgggtgcagatttcctgaaacgctacttcccggaatcaggcgtctgggtcagcgatcctacctgggaaaaccacgtagcaatattcgccggggctggattcgaagtgagcacttacccctggtatgacgaagcgactaacggcgtgcgctttaatgacctgttggcgacgctgaaaacattacctgcccgcagtattgtgttgctgcatccatgttgccacaacccaacgggtgccgatctcactaatgaccagtgggattccgtgattgaaattctcaaagcccgcgagcttattccattcctcgatattgcctatcaaggatttggtgccggtatggaagaggatgcctacgccattcgcgccattgccagcgctggattacccgctctggtgagcaattcgttctcgaaaattttctccctttacggcgagcgcgtcggcggactttctgttctgtgtgaagatgccgaagccgcaggccgcgtactggggcaattgaaagcaaccgttcgccgcaactactccagcccgccgaattttggtgcgaaggtggtggctgcggtgctgaatgacgaggcattgaaagccagctggctggcggaagtagaagagatgcgaactcgcattctggcaatgcgtcaggaactggtgaaggtattgagcacagagatgccagagcgcaatttcgattatctgcttaatcagcgcggcatgttcagttataccggtttaagaaccgctcaggttgaccgactacgtgaagaatttggtgtctatctcatcgccagcggtcgcatgtgtgtcgccgggcttaacgcgcaaaatgtgcatcgcgtggcaaaggcgtttgctgcggtgatgtga

SEQ ID NO: 4677 - protein, 411 aa, Escherichia coli CFT073
MCFNHQPVNLENHRVFQKVDAYAGDPILTLMERFKEDPRSDKVNLSIGLYYNEDGIIPQLKAVADAEARLNAQPHGASLYLPMEGLNSYRHAIAPLLFGADHPVLQQQRVATIQTLGGSGALKVGADFLKRYFPESGVWVSDPTWENHVAIFAGAGFEVSTYPWYDEATNGVRFNDLLATLKTLPARSIVLLHPCCHNPTGADLTNDQWDSVIEILKARELIPFLDIAYQGFGAGMEEDAYAIRAIASAGLPALVSNSFSKIFSLYGERVGGLSVLCEDAEAAGRVLGQLKATVRRNYSSPPNFGAKVVAAVLNDEALKASWLAEVEEMRTRILAMRQELVKVLSTEMPERNFDYLLNQRGMFSYTGLRTAQVDRLREEFGVYLIASGRMCVAGLNAQNVHRVAKAFAAVM

SEQ ID NO: 4678 - DNA, 1200 bp, Vibrio vulnificus CMCP6
  CDS (1)..(1200): transl_table=11
atgaagattatgtttgaaaaagtagttgccgctcccgcggacccgattcttggcctaactgaagaattcaaaaaagaccctcgcgcagaaaaaattaaccttggcgtgggtatctacaaaacagaacaaggtgaaactcctgttcttgctacggtaaagaaagcggaagcagcgcttgttgaaaccgagaaaaccaaatcttacctaaccatcgaaggaacagcagaatacgcattagcggttcaaaaactactgtttggtgcggatgctgagctaatcaatgcgcaacgtgcaaaaacagcacaagcacctggcggtactggcgcactgcgcgttgcaggcgaattcatcaaacgccaactcggcgatgtaaaaatctggatcagcaacccaacttgggctaaccaccatggtgtgttccgcgcagcaggcctagaaacggttgagtacgcttactacaacccagaaaccaaagacaaagactttgccgctatgctggccgaccttgaaaaagcgtccgctggtgatgtggtactgctgcacggatgttgccataacccaacaggcatcgacccaacggcacaagagtgggaagcgcttgctaaactggttgccgacaagggcctacttccactatttgactttgcctaccaaggtttcgcgaaaggtgttgaagaagatgcgcaaggcctacgtaccttcgctaaattcaacaaagagatcctcgtagcaagttcattctcgaaaaactttggtctgtacaacgagcgtgtaggcgcattcacgttagtggctgaaagccaagagatcgcagaaacggcattctcacaagtgaaagcgatcattcgctctatctactcaaacccaccagcgcacggcagtgcggtagtgactcacatccttaacgatgccgcgcttcgtgcagagtgggaagcggaagtggcagagatgcgcgatcgcatccaagagatgcgcgaactttttgttacgacactgaaagaagaaggcgttgcggctgactttagctttatccaacgtcaaaacggcatgttctctttctctggcttgaacaaagatcaagtggctcgcctaaaagaagagtttgcgatctacatcgtcggttctggtcgcatcagcgttgcgggcatgaccaaatccaacatgggtccgctttgtaaagccatcgctgcggtactgtaa

SEQ ID NO: 4679 - protein, 399 aa, Vibrio vulnificus CMCP6
MKIMFEKVVAAPADPILGLTEEFKKDPRAEKINLGVGIYKTEQGETPVLATVKKAEAALVETEKTKSYLTIEGTAEYALAVQKLLFGADAELINAQRAKTAQAPGGTGALRVAGEFIKRQLGDVKIWISNPTWANHHGVFRAAGLETVEYAYYNPETKDKDFAAMLADLEKASAGDVVLLHGCCHNPTGIDPTAQEWEALAKLVADKGLLPLFDFAYQGFAKGVEEDAQGLRTFAKFNKEILVASSFSKNFGLYNERVGAFTLVAESQEIAETAFSQVKAIIRSIYSNPPAHGSAVVTHILNDAALRAEWEAEVAEMRDRIQEMRELFVTTLKEEGVAADFSFIQRQNGMFSFSGLNKDQVARLKEEFAIYIVGSGRISVAGMTKSNMGPLCKAIAAVL

SEQ ID NO: 4680 - DNA, 1203 bp, Xylella fastidiosa Temecula1
  CDS (1)..(1203): transl_table=11
gtgcccttatttacagatgtggaattggttccgggtgatcccattctgagcctcaacgatgcttataacgccgatacgcgtaccaacaaggtcaatttgggtattggtatttattgtgacgagagcggttgtatcccgctgttgcgggctgtccagcaggttgaagagcaacttgcgaagcatccgaaaccgcgcggttatctgccgattgatggtttgccagcctatatcaaagccacacaacaattgttgtttggagttgactccctcttgttgacggctggccgtgtggcgacttcacagactgttggaggttctggtgcattgcgggtggctgctgaggtactgaagcaggtgctaccgcatgccactgtggccattagccgtccaagctgggagaaccaccgtgctttgttcaccgctgctggcttcaagattgaggactatacctatttcgatacgctcggccacgcggtggactttactggaatggtggcggacttggcgaagctgcaaccaaagaccgtggtattacttcatggttgctgtcataacccaacgggtgccgatctcagcagggatcagtggaagcagcttgttgccttgttccaggaacgtcaattgctgccatgtatcgatctggcttaccaaggattcaatcagggcattgatgcggatgcttatgccatacgtttgcttgccgaagaaggtattagtaactatgtagttgccaactcgtactccaaatcgttctcgttgtatggcgagcgtgttggagggctgtcgatcgttgcttccaatactgagcaagcccaagcaatccagtcacaagtaaagcgtatcatccgtacgatttattccagtccgccggcacacggtgcctacttggtcgcgggtgtgctgaacagtcatgaattacgcacgctgtgggagcaggagttaactcagatgcgtgaacgtatccacgggttgcgtgcgggtttggttgctcgattgaaggcgctgggtgcgccggagtttgatttcatacaacgtcaagcaggcatgttttcgtattcggggttgagcaagatccaggtggatcgtttacgcgacgagttcgggatttatgcggtcagtagtggacgtatctgtgtggctgcgttgagtcagcacaaattggaatacgtggcccaggctgtggtgaaggtgcatcaaggctga

SEQ ID NO: 4681 - protein, 400 aa, Xylella fastidiosa Temecula1
MPLFTDVELVPGDPILSLNDAYNADTRTNKVNLGIGIYCDESGCIPLLRAVQQVEEQLAKHPKPRGYLPIDGLPAYIKATQQLLFGVDSLLLTAGRVATSQTVGGSGALRVAAEVLKQVLPHATVAISRPSWENHRALFTAAGFKIEDYTYFDTLGHAVDFTGMVADLAKLQPKTVVLLHGCCHNPTGADLSRDQWKQLVALFQERQLLPCIDLAYQGFNQGIDADAYAIRLLAEEGISNYVVANSYSKSFSLYGERVGGLSIVASNTEQAQAIQSQVKRIIRTIYSSPPAHGAYLVAGVLNSHELRTLWEQELTQMRERIHGLRAGLVARLKALGAPEFDFIQRQAGMFSYSGLSKIQVDRLRDEFGIYAVSSGRICVAALSQHKLEYVAQAVVKVHQG

SEQ ID NO: 4682 - DNA, 1179 bp, Ruegeria sp. PR1b
  CDS (1)..(1179): transl_table=11
gtgcttagtgaccttggcagcgtgccatcagatgaaatcctgacgctcatgcaaatgcaccgggaagatccccggcgcgacaagatcgaccagacggttggcgtctaccgcaatgaacttggccagacgccagtcatgcaggccgtcaaggcggcggaatacaagatctggcaggatcagacgagcaaatcctacaccggattgctgggggaccccgagtttctcgaggtcatgcaggcgctggtgcttggtccggaggcgccgccctgtaccgctgctgccgtgcccggcggctctggcgcgtgtcggcaggcctttgaactgatccgccaggccacgccgggggcccgtgtctacgtctccgatccgacttgggcaaaccacacgaccatgctggcgcataccgggctggcccgggaaacctaccgctttcgagacccggcgacggggggcttgaactttgacggcatgatgcaggatctcggaacggctcgggccggtgacgtggtcctgctgcacggctgctgtcacaatcccacgggcatttcgctgacccggacccagtggcgcgccctggcagaccgcatggcgaaaaacggcctggtcggcatgattgacctggcctacctgggctttggggacgggctcgaagaggacgcctggggcacgcgccatctagcggaaacgctggatgaatgcctgatcgccgtgtcctgttccaagaacttcggtctttaccgcgaaagggcaggcgccctgttggtcacggcacgcaacccggcgctgctggcccacacgcgtgaggtcctggcctatctcaatcgacaggcctactcctttccgcccgatcatggagcgcgcatcgtcaccagcatcctcaaggacccggccctgcgcgaagtctggacccaggagctgcatggcatccgcaattcgatcgcggccctgcgcctgcagctgtgcaatgcctttgccgagaaaaccgggacccggcggtttgactacatccgggagcacaaaggcatgttttcctgcctcggtgccacccccgagcaagtccggaccctgcgcgcgaaacacggcatctacatggtcacggacagccggttgaactttgccagtctgagccagcaaaacgtcgaacgcatcgtggacgcggtgaccgacgtaggaatttag

SEQ ID NO: 4683 - protein, 392 aa, Ruegeria sp. PR1b
MLSDLGSVPSDEILTLMQMHREDPRRDKIDQTVGVYRNELGQTPVMQAVKAAEYKIWQDQTSKSYTGLLGDPEFLEVMQALVLGPEAPPCTAAAVPGGSGACRQAFELIRQATPGARVYVSDPTWANHTTMLAHTGLARETYRFRDPATGGLNFDGMMQDLGTARAGDVVLLHGCCHNPTGISLTRTQWRALADRMAKNGLVGMIDLAYLGFGDGLEEDAWGTRHLAETLDECLIAVSCSKNFGLYRERAGALLVTARNPALLAHTREVLAYLNRQAYSFPPDHGARIVTSILKDPALREVWTQELHGIRNSIAALRLQLCNAFAEKTGTRRFDYIREHKGMFSCLGATPEQVRTLRAKHGIYMVTDSRLNFASLSQQNVERIVDAVTDVGI

SEQ ID NO: 4684 - DNA, 1197 bp, Pseudomonas syringae pv. tomato str. DC3000
  CDS (1)..(1197): transl_table=11
atgagcctgttctccgctgtcgaaatggcaccccgcgatccgatcctgggtatcaacgaagccttcaacgccgacacccgtaccaccaaggtcaaccttggcgtgggcgtctactgtgatgaagacgggcgcattcctctgctgcgtgccgtggctgaagctgaaaagattcgtgtcgcccagcacgcgccgcgcggctacctgccgatcgacggcattgccgcctacgaccaggccgtgcaaaaactgttgctgggtgccgattcaccgctgatcgcctcgggccgggtgctaaccactcaatcggtgggcggcacgggtgctttgaagatcggtgccgacttcctcaagcaactgctgcccaatgcggtggtggccatcagcgacccaagctgggaaaaccatcgcgcgctgttcgaaaccgccggtttcccggtgcagaactatcgttactacgacgccgccacgcatgacgtgaaccgcgccggcatgctcgaagacctgcacaacctgccgaacaactcggtggtggtgctgcacgcctgctgccacaacccgactggcgtcgatctgagcctggacgactggaaaaaagtgctggaagtggtcaaggccaagggccacgtaccgtttctggacatggcttaccagggctttggccaaggcattcaggaagacgcgctggcggtgcgcctgttcgccgagtcgggcctgaccttcttcgcttccagctcgttctccaaatcgctgtcgctgtatggcgagcgcgtcggtgcgctgtcgatcatcacagaatccaaggaagaaaccgcccgcgttctgtcgcaggtcaagcgtgtgatccgcaccaactactccaacccgccgacccacggcgcgatcatttccgccgccgtcctcaacgacccggccctgcgcgcgatgtgggaagaagaactcggcgagatgcgcgtgcgcattcagggcatgcgcaaggcgatggtcgagcgtctggccgacaacccggccggccaggatttcagcttcgtcggccgtcagtgcggcatgttctcctactccggcctgaccgccgcccaggcccagcgcctacgcagtgaattcggcatctacgcgctggacaccggccgtatctgcgtggccgcgctgaatcagaaaaatatcgatgcggtgtgtgaggcgatcaagaaggttctttaa

SEQ ID NO: 4685 - protein, 398 aa, Pseudomonas syringae pv. tomato str. DC3000
MSLFSAVEMAPRDPILGINEAFNADTRTTKVNLGVGVYCDEDGRIPLLRAVAEAEKIRVAQHAPRGYLPIDGIAAYDQAVQKLLLGADSPLIASGRVLTTQSVGGTGALKIGADFLKQLLPNAVVAISDPSWENHRALFETAGFPVQNYRYYDAATHDVNRAGMLEDLHNLPNNSVVVLHACCHNPTGVDLSLDDWKKVLEVVKAKGHVPFLDMAYQGFGQGIQEDALAVRLFAESGLTFFASSSFSKSLSLYGERVGALSIITESKEETARVLSQVKRVIRTNYSNPPTHGAIISAAVLNDPALRAMWEEELGEMRVRIQGMRKAMVERLADNPAGQDFSFVGRQCGMFSYSGLTAAQAQRLRSEFGIYALDTGRICVAALNQKNIDAVCEAIKKVL

SEQ ID NO: 4686 - DNA, 1200 bp, Pseudomonas syringae pv. tomato str. DC3000
  CDS (1)..(1200): transl_table=11
atgctagcccacgtggagtcgtacgccggtgatccgatcctttcgctgatggaagcctttggcaaggatccacgcgcagacaaggtcaatctgagcatcggtctgtattacgacgcgcagggacgtatcccgcagttggcatgcgtggcaactgcgcaacaacaattggccgaaggcgagcaggcggcttctgtctatttgccgatggaaggcctggcggcttaccggcaggcggtgcaaaccctgttgttcggcgccgaccatccgctggtgcaggccggtcgcgtggcgactatccaaaccgtgggcggctcgggcgcgcttaaagtgggggccgacttcctcaaatatgcattccccgattctcaggtgtgggtcagtgatccgacctgggaaaaccaccttgcgctgttcggcggtgcgggcttcaaggtcaatacttacccctacttcgatgcccagactggcggcgtcaggttcgaggctatgctcgacaccgtgcagggtctgccggcgcaaagcatccttttgctgcacccgtgctgccacaacccgactggcgcggatttgtccgtcgagcagtgggaccggttgatcgaagtgatcaaggatcgccagctcatcgcgtttctggatatcgcctatcagggcttcggcaaaggcatcgacgaagacgcctacgctatccgcgcgatggccgacgcgggcatcaccacgctggtcagcaactcgttctcgaaaatcttctcgctgtatggcgagcgggtcggcgggctatcggtggtctgcgaagacaccgcatcggccgccaatgtattcggccagctcaaggccacagtacgccgcaactattccagtccgcctgcgcatggcgcgtttctggtgtccagagtgctcaacacaccgcaactgcgtgatcagtggctgagcgaggtcgaaaccatgcgcctgcgcatcatcgacatgcgcagccgtctggtttcggtgctggcgcagaaagttgccgggcgcgatttcagctttatcctcaggcagagcggcatgttcagctacaccggattgacgccgcagcaggttgacgagctgaaagatgttcacggtatttacatgctgcgcagtggccgggtgtgcatggcgggcttgaatgaaagaaatatcgacaaggtgtgtgacgcgattgcgagcctctttgcccactaa

SEQ ID NO: 4687 - protein, 399 aa, Pseudomonas syringae pv. tomato str. DC3000
MLAHVESYAGDPILSLMEAFGKDPRADKVNLSIGLYYDAQGRIPQLACVATAQQQLAEGEQAASVYLPMEGLAAYRQAVQTLLFGADHPLVQAGRVATIQTVGGSGALKVGADFLKYAFPDSQVWVSDPTWENHLALFGGAGFKVNTYPYFDAQTGGVRFEAMLDTVQGLPAQSILLLHPCCHNPTGADLSVEQWDRLIEVIKDRQLIAFLDIAYQGFGKGIDEDAYAIRAMADAGITTLVSNSFSKIFSLYGERVGGLSVVCEDTASAANVFGQLKATVRRNYSSPPAHGAFLVSRVLNTPQLRDQWLSEVETMRLRIIDMRSRLVSVLAQKVAGRDFSFILRQSGMFSYTGLTPQQVDELKDVHGIYMLRSGRVCMAGLNERNIDKVCDAIASLFAH

SEQ ID NO: 4688 - DNA, 1245 bp, Vibrio parahaemolyticus RIMD 2210633
  CDS (1)..(1245): transl_table=11
ttgctgaaaggtataaatacgagcagaccccttcgattaacatggatgaagattatgtttgaaaaagtagttgccgctccggccgaccctatccttggccttactgaagaatttaaaaaagatcctcgcgctgaaaagattaaccttggcgttggtatttacaaaaacgaacaaggcgaaacacctgttcttgctaccgtaaagaaagccgaagcagcactgattgaaacggaaaaaaccaaatcatacctaaccatcgaagggactgctgagtacggtctggcggtacaaaaactacttttcggtgcagacgctgaaatcgtagcggaaaaacgcgcgaaaacagctcaagcgcctggtggtacaggtgcattacgcgtggcgggtgaatttattaaacgccaacttggtaacgtaaaaatctggatcagcaacccaacttgggcaaaccacaacggcgtgtttaccgctgcaggtctagaaacggctcaatacacttactacaacgcagaaactaaagacaaagacttcgatgcaatgctaaacgatcttcaagctgcatctgaaggtgacatcgttcttctacacggctgctgccacaacccaactggcatcgatccaactgctgaagaatgggaaacactagcgaagctgattgctgagaagaaactgcttcctctgttcgactttgcataccagggctttgctaagggtgtagaagaagacgcagctggcctacgtattttcgcgaaatacaacaaagaaattctcgttgcgagctcgttctcgaaaaacttcggcctatacaatgaacgtgtaggcgcattcacgcttgttgctgaatctgaagaagtggcaacaacagcattctctcaagtaaaagcgatcatccgctctatctactctaacccaccagctcacggtagtgctgttgttactcatattctaaacaacaaagaactgcgtgccgaatgggaagcggaagtacaagaaatgcgtgaccgtattcaagagatgcgcgagctgttcgtagcaactctgaaagaagaaggtgtggatgcagatttcagctttatcgaacgtcaaaacggcatgttctcgttctctggtctatctaaagagcaagttaaccgtctgaaagatgagttcgcaatttacatcgttggttctggccgtatcagcgtagctggtatgacaaaatcaaacatgggcccactatgtaaaggtatcgcagcggttctataa

SEQ ID NO: 4689 - protein, 414 aa, Vibrio parahaemolyticus RIMD 2210633
MLKGINTSRPLRLTWMKIMFEKVVAAPADPILGLTEEFKKDPRAEKINLGVGIYKNEQGETPVLATVKKAEAALIETEKTKSYLTIEGTAEYGLAVQKLLFGADAEIVAEKRAKTAQAPGGTGALRVAGEFIKRQLGNVKIWISNPTWANHNGVFTAAGLETAQYTYYNAETKDKDFDAMLNDLQAASEGDIVLLHGCCHNPTGIDPTAEEWETLAKLIAEKKLLPLFDFAYQGFAKGVEEDAAGLRIFAKYNKEILVASSFSKNFGLYNERVGAFTLVAESEEVATTAFSQVKAIIRSIYSNPPAHGSAVVTHILNNKELRAEWEAEVQEMRDRIQEMRELFVATLKEEGVDADFSFIERQNGMFSFSGLSKEQVNRLKDEFAIYIVGSGRISVAGMTKSNMGPLCKGIAAVL

SEQ ID NO: 4690 - DNA, 1197 bp, Vibrio parahaemolyticus RIMD 2210633
  CDS (1)..(1197): transl_table=11
atgactttcatgttttctaatctaccaactcccgtattagatccaattttatctttatccgttgcataccgtaacgatgaacgtccaaacaaggttgaccttggtattggcgtatacaaaaacagcgcaggcgaaacgccgatcatgaaagccattcaaatggctcaagatgtcgttgttgaaactcaaaaaaccaaatcttacgttggtcttgctggttgtgaagagttcaaccaaagcatgattgatcttctactgacgggaacgtcagcgatggatcgtgttgctgcaattcaaacgccaggagcaagtggtgcactgcgtatgctgggtgacctaatgaaggtcgcacaaccagatacaacggtttggatttcgaatccaagctatgtgaaccacaagccagtaatggaagctgctgggcttaaagttaagttctaccattatttctcgccagaaacgaaacaagtcgacaccgcaaaaatgctggatgatcttgctaaagcagggccgacagatgtggttctactgcatggttgttgtcacaacccaacaggcgcagacatcgacttttccgcatggcaagctattacagaactttctcaaaagaacggttttacgccatttgttgatatcgcgtatcaaggttttggtgacggcttagaagctgacgcaaaaggtcttcgttacatggcggataatgtcgaagagatgttgattacaacttcttgttctaaaaactttggcttgtaccgcgaacgtactggtgcagctattgttgtgggtaagaacacgcaagacatcactaacgcgaaaggcaaattgttaacgttagcgcgctctacgtacacgatgccacccgatcatggtgctgctttagtgaaaaccattctgcaagatgcgaacctgacttctgtctggaagcaagagttgagcgaaatgcaacaacgtttggtcagccttcgtcaaagtttgtgtaacgaattgagaaacaaccataatacagatcaatttgacttcattgagagtcacaaaggcatgtttactgtgctaggctttagtgaaaaccaaatggcgcaactgcgtgaagattatggcatttatggtgttggcgatggtcgaattaacatcgctggcttaaccgaaactcatattccatacgtagctgacgcaattaagaaaatatctcaaccttaa

SEQ ID NO: 4691 - protein, 398 aa, Vibrio parahaemolyticus RIMD 2210633
MTFMFSNLPTPVLDPILSLSVAYRNDERPNKVDLGIGVYKNSAGETPIMKAIQMAQDVVVETQKTKSYVGLAGCEEFNQSMIDLLLTGTSAMDRVAAIQTPGASGALRMLGDLMKVAQPDTTVWISNPSYVNHKPVMEAAGLKVKFYHYFSPETKQVDTAKMLDDLAKAGPTDVVLLHGCCHNPTGADIDFSAWQAITELSQKNGFTPFVDIAYQGFGDGLEADAKGLRYMADNVEEMLITTSCSKNFGLYRERTGAAIVVGKNTQDITNAKGKLLTLARSTYTMPPDHGAALVKTILQDANLTSVWKQELSEMQQRLVSLRQSLCNELRNNHNTDQFDFIESHKGMFTVLGFSENQMAQLREDYGIYGVGDGRINIAGLTETHIPYVADAIKKISQP

SEQ ID NO: 4692 - DNA, 1194 bp, Salmonella enterica subsp. enterica serovar Typhi Ty2
  CDS (1)..(1194): transl_table=11
gtgtttcaaaaagttgacgcctatgccggcgatccgattctttcactgatggagcgttttaaagacgactcccgtcacgacaaagtaaatctgaacattggcctgtattacaacgaagacgggattatcccacagctcaaaacggtggccgaagccgaagcccggcttaacgcgcagccgcatggcgcctcgctgtacctgccgatggaaggactcaatacttatcgccatactatcgcgcctttgctctttggcgccgatcacccggttcttcagcaacagcgcgtggccactatccagacattaggtggttcaggcgcgctgaaagtgggcgcggattttctgaagcgttatttccccgacgcaggcgtatgggtgagcgaccctacctgggaaaaccatattgcgatatttgccggggcaggattcgaagtgagtacttacccctggtatgacgacgcgactaacggcatccgttttaacgatctgctggccacgctgaatacgttacctgcgcgcagtatcgtgctgctgcacccctgttgtcacaacccgaccggggcggatttaacgccttcgcaatgggatgcggtgattgagatagtgaaagcgcgcgatctgattccgttccttgatattgcctatcaggggtttggcgcaggcatggacgaggatgcttacgctattcgcgccattgccagcgccgggttacctgcgttagtcagtaattctttttcgaagattttctcgctgtatggcgagtgcgtcggcggcctgtcggtggtgtgtgaagatgccgaaatcgccgcgcgggttctgggacagctaaaagcgacggtgcgccgaatttactccagtccgccgtgtttcggcgctcaggtggtcgctacggtcctgggcgatgaggcgttaaaagcgagctggctggcggaagtcgacgcgatgcgtacccgcattatatcgatgcgccagacgctggtgaaagagctgaaggcggagatgcctgaccgcaacttcgattacttgttacagcagcgtggtatgttcagctataccgggttaagcgcggagcaggtcgatcggttgcgcgatgagtttggcgtttacctgattgccagtggccgcatgtgtgtcgctgggcttaatgcttcaaatgtacaccgcgtggcgaaggcatttgccgctgtcatgtaa

SEQ ID NO: 4693 - protein, 397 aa, Salmonella enterica subsp. enterica serovar Typhi Ty2
MFQKVDAYAGDPILSLMERFKDDSRHDKVNLNIGLYYNEDGIIPQLKTVAEAEARLNAQPHGASLYLPMEGLNTYRHTIAPLLFGADHPVLQQQRVATIQTLGGSGALKVGADFLKRYFPDAGVWVSDPTWENHIAIFAGAGFEVSTYPWYDDATNGIRFNDLLATLNTLPARSIVLLHPCCHNPTGADLTPSQWDAVIEIVKARDLIPFLDIAYQGFGAGMDEDAYAIRAIASAGLPALVSNSFSKIFSLYGECVGGLSVVCEDAEIAARVLGQLKATVRRIYSSPPCFGAQVVATVLGDEALKASWLAEVDAMRTRIISMRQTLVKELKAEMPDRNFDYLLQQRGMFSYTGLSAEQVDRLRDEFGVYLIASGRMCVAGLNASNVHRVAKAFAAVM

SEQ ID NO: 4694 - DNA, 1191 bp, Chlamydophila caviae GPIC
  CDS (1)..(1191): transl_table=11
atgagttttttcaatcaattacccacgttctcacctgattctattttaggtttgcaaaaactatttttagaagatgagcgagaggaaaaggtgaatcttgttataggtgtctatgaagatcctagcaaggcatatggtggtttttctagcgtccgtaaggcgcaatttctttttttagaagatgagatgaataaggggtatttacccatcagtggcttatcttcttttaatcaagaaatggaaaagctggtttttggtgatgtaaattctagttttgttgttggtgctcaggcgctagggggaactggagctttgcatttaggggctaagattttttctatggcctatacctcaggcaaagtatacattcccgagcaaacttggggaaaccacgtaagaatatttgctcaacaaggtttagaggttcttaaatacccttattatagctcagaaagcaaaagtttgctttttgatgagatgctttctgtattgaaagccgctccaaaaaattctttggtgcttttgcagtgttgttgtcataatcctacgggaatggatcttaatgaagatatgtggacacgtcttgctgaagttatgaaagaacatcagcttcttccattttttgataccgcttatttaggttttgggcgaggcatcaaagaagataggcgtcctatagagattttcatagaagttggtaatcccgtatttgtagcagcatgcgcaagtaaaaatttttctctttatggagagagggtaggctacttcgcagttcatagcaaaattactgaggatttagataagatttctagctgtctcgaagagaaagcccgtggagaatattcttcacctcctagacatggagctaaaattgtttcaacgattttatccgacgcttctttgaagaaagaatggttgtcagaattagatacgattcgtagttctttagggaaaactcgcgcaagacttgttcaagctatgcgaaatcacgtcggtcattcgtttgactttatcttgtctcagaagggattttttggttatcccggattttctgtagaacaggtgctctttttaagatcagagaagggtatctatacgacgagtggagcaagatttaacttaaacggaattactgataaaaatatcgaccacgtctctcagagttttgctgaggcgtatcagttgtcttag

SEQ ID NO: 4695 - protein, 396 aa, Chlamydophila caviae GPIC
MSFFNQLPTFSPDSILGLQKLFLEDEREEKVNLVIGVYEDPSKAYGGFSSVRKAQFLFLEDEMNKGYLPISGLSSFNQEMEKLVFGDVNSSFVVGAQALGGTGALHLGAKIFSMAYTSGKVYIPEQTWGNHVRIFAQQGLEVLKYPYYSSESKSLLFDEMLSVLKAAPKNSLVLLQCCCHNPTGMDLNEDMWTRLAEVMKEHQLLPFFDTAYLGFGRGIKEDRRPIEIFIEVGNPVFVAACASKNFSLYGERVGYFAVHSKITEDLDKISSCLEEKARGEYSSPPRHGAKIVSTILSDASLKKEWLSELDTIRSSLGKTRARLVQAMRNHVGHSFDFILSQKGFFGYPGFSVEQVLFLRSEKGIYTTSGARFNLNGITDKNIDHVSQSFAEAYQLS

SEQ ID NO: 4696 - DNA, 1191 bp, Shigella flexneri 2a str. 2457T
  CDS (1)..(1191): transl_table=11
atgtttgagaacattaccgccgctcctgccgacccgattctgggcctggccgatctgtttcgtgccgatgaacgtcccggcaaaattaacctcgggattggtgtctataaagatgagacgggcaaaaccccggtactgaccagcgtgaaaaaggctgaacagtatctgctcgaaaatgaaaccaccaaaaattacctcggcattgacggcatccttgaatttggtcgctgcactcaggaactgctgtttggtaaaggtagcgccctgatcaatgacaaacgtgctcgcacggcacagactccgggtggcactggcgcactacgcgtggctgccgacttcctggcaaaaaataccagcgttaagcgtgtgtgggtgagcaacccaagctggccgaaccataagagcgtctttaactctgcaggtctggaagttcgtgaatacgcttattatgatgcggaaaatcacacccttgacttcgatgcactgattaacagtctgaacgaagctcaggctggcgacgtagtgctgttccatggctgctgccataacccaaccggtatcgaccctacgctggaacaatggcagacactggcacaactctccgttgagaaaggctggttaccgctgtttgacttcgcttaccagggttttgcccgtggtctggaagaagatgctgaaggactgcgcgctttcgcggctatgcataaagagctgattgttgccagttcctactctaaaaactttggcctgtacaacgagcgtgttggcgcttgtactctggttgctgccgacagtgaaatcgttgatcgcgcattcagccaaatgaaagcggcgattcgcgctaactactctaaccctccagcacacggcgcttctgttgttgccaccatcctgagcaacgatgcattacgtgcgatttgggaacaagagctgactgatatgcgccagcgtattcagcgtatgcgtcagttgttcgtcaatacgctgcaggaaaaaggtgcaaaccgcgacttcagctttatcatcaaacagaacggcatgttctccttcagtggtctgacaaaagaacaagtgctgcgtctgcgcgaagagtttggcgtatatgctgttgcttctggtcgcgtaaatgtggccgggatgacaccagataacatggctccgctgtgcgaatcgattgtggcagtgctgtaa

SEQ ID NO: 4697 - protein, 396 aa, Shigella flexneri 2a str. 2457T
MFENITAAPADPILGLADLFRADERPGKINLGIGVYKDETGKTPVLTSVKKAEQYLLENETTKNYLGIDGILEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSEIVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCESIVAVL

SEQ ID NO: 4698 - DNA, 1194 bp, Shigella flexneri 2a str. 2457T
  CDS (1)..(1194): transl_table=11
gtgtttcaaaaagttgacgcctacgctggcgacccgattcttacgcttatggagcgttttaaagaagaccctcgcagcgacaaagtgaatttaagtatcggtctgtactacaacgaagacggaattattccacaattgaaagccgtggcggaggcggaagcgcgcctgaatgcgcagccccatggcgcttcgctttatttaccgatggaagggcttaacagctatcgccatgccattgcgccgctgctgtttggtgcggaccatccggtactgcaacaacagcgcgtagcaaccattcaaacccttggcggctcaggggcattgaaagtgggcgcggatttcctgaaacgctacttcccggaatcaggcgtctgggtcagcgatcctacttgggaaaaccacgtagcaatattcgccggggctggattcgaagtgagtacttacccctggtatgacgaagtgactaacagcgtgcgctttaatgacctgttggcgacgctgaaaacattacctgcccgcagtattgtgttgctgcatccatgttgccacaacccaacgggtgccgatctcactaatgatcagtgggatgcggtgattgaaattctcaaagcccgcgagcttatcccattcctcgatattgcctatcaaggatttagtgccggtatggaagaggatgcctacgctattcgcgccattgccagtgctggattacccgctctggtgagcaattcgttctcgaaaattttctccctttacggcgagcgcgtcggcggactttctgttctgtgtgaagatgccgaagccgctggccgcgtactggggcaattgaaagcaacagttcgccgcaactactccagcccgccgaattttggtgcgcaggtggtggctgcagtgctgaatgacgaggcattgaaagccagctggctggcggaagtagaagagatgcgtactcgcattctggcaatgcgtcaggaattggtgaaggtattaagcacagagatgccagaacgcaatttcgattatctgcttaatcagcgcggcatgttcagttataccggtttaagtgccgctcaggttgaccgactacgtgaagaatttggtgtctatctcatcgccagcggtcgcatgtgtgtcgccgggttaaatacggcaaatgtacaacgtgtggcaaaggcgtttgctgcggtgatgtaa

SEQ ID NO: 4699 - protein, 397 aa, Shigella flexneri 2a str. 2457T
MFQKVDAYAGDPILTLMERFKEDPRSDKVNLSIGLYYNEDGIIPQLKAVAEAEARLNAQPHGASLYLPMEGLNSYRHAIAPLLFGADHPVLQQQRVATIQTLGGSGALKVGADFLKRYFPESGVWVSDPTWENHVAIFAGAGFEVSTYPWYDEVTNSVRFNDLLATLKTLPARSIVLLHPCCHNPTGADLTNDQWDAVIEILKARELIPFLDIAYQGFSAGMEEDAYAIRAIASAGLPALVSNSFSKIFSLYGERVGGLSVLCEDAEAAGRVLGQLKATVRRNYSSPPNFGAQVVAAVLNDEALKASWLAEVEEMRTRILAMRQELVKVLSTEMPERNFDYLLNQRGMFSYTGLSAAQVDRLREEFGVYLIASGRMCVAGLNTANVQRVAKAFAAVM

SEQ ID NO: 4700 - DNA, 1218 bp, Arabidopsis thaliana
  CDS (1)..(1218)
atgaattccatcttgtcaagcgtccttcctgctcccgaagatcctgttctcagtgtaatttttgcttgtagagatgatcctagtccggttaagttgaatttgagcgcaggtacctatcgaactgaggaaggaaagcctcttgttcttgatgttgtgagaagagcagagcaacagttagccaacgacctgtctagggacaaggaatatcttcccctcaatggacttcctgaatttaataaattaagtaccaagctcatcttaggtgatgatagtcctgcattgaaagagaatagagttgttacaacccaatgtttgtctggtactggttctttgagagttggagctgagtttctagcaacacacaacaaagaaagtgtcattttcgttccaaacccaacgtgggggaaccatccccgtatttttactttggcgggtttgtctgtccagtatttccgttattatgatccgaagagccgaggactcgacttcaaaggcatgctcgaggatcttggcgctgcacctcctggagctatagtggtacttcaagcttgtgcgcataaccccacaggagttgacccaacattcgaacaatgggaaaagattcgacgactagtgagatcgaaaagcttattacctttctttgatagtgcatatcagggttttgctagtggtagccttgacgcagatgcacaagcggttcgtatgtttgtagccgatggaggtgaatgtttgatagctcaaagttatgccaaaaatatgggcctttatggggagcgtattggctctcttacgatcgtatgcacatcagaagatgtcgctaagaaagttgagaaccaagtgctacttgttgtgaggcctatgtatcttacaccacctattcatggtgcatctattgttgccacaattctaaaaaacagtgatatgtacaatgactggaccattgagctgaaaggaatggctgaccgcataattagcatgcgtcaacagttatatgcagctctagaagctagaggaacacctggtgattggagtcacattattaaacatattgggatgtttacttttaccggattgagtgaggagcaagttcgcttgatggccaaagaatatcacatttacatgacttatgatgggaggataagcatggcaagtctaagttcgaagacagtgcctcaactcgctgatgctatacatgctgttgttactcgcatcgcctaa

SEQ ID NO: 4701 - protein, 405 aa, Arabidopsis thaliana
MNSILSSVLPAPEDPVLSVIFACRDDPSPVKLNLSAGTYRTEEGKPLVLDVVRRAEQQLANDLSRDKEYLPLNGLPEFNKLSTKLILGDDSPALKENRVVTTQCLSGTGSLRVGAEFLATHNKESVIFVPNPTWGNHPRIFTLAGLSVQYFRYYDPKSRGLDFKGMLEDLGAAPPGAIVVLQACAHNPTGVDPTFEQWEKIRRLVRSKSLLPFFDSAYQGFASGSLDADAQAVRMFVADGGECLIAQSYAKNMGLYGERIGSLTIVCTSEDVAKKVENQVLLVVRPMYLTPPIHGASIVATILKNSDMYNDWTIELKGMADRIISMRQQLYAALEARGTPGDWSHIIKHIGMFTFTGLSEEQVRLMAKEYHIYMTYDGRISMASLSSKTVPQLADAIHAVVTRIA

SEQ ID NO: 4702 - DNA, 1194 bp, Rhodopirellula baltica SH 1
  CDS (1)..(1194): transl_table=11
gtgcaccgattcgactccatctccgttgccccgcccgacgccattttgggactgaccgaagcgttcaaagccgatgaacgcgaaaccaaaatgaatttgtccgtgggcgtgtaccaagacgcttccggcaccacccccgtgcttcgctgcgtcaaagaagccgaaaaacggctgttggatacagaatcgaccaagggatacctctcgatcgacggcctgccggactaccgcgaagccgcccgccgattgatcttctccgaccaaatcgctgccgagcgagtggcagcggttcagacgccgggcggaaccggagccctccgtgtggcggcagaattcctggccactcagtgcggaccgctacgaattttcttgcccacgccaacctgggccaaccacaacgcgatcatggccgcggccggactgccggtggaaacgtattcctacctggcgtctgacaaaaagacgctggacttcgacgcactcatcgaagacctgaagaccaaacccaaggccggcgatgcggttctgctgcatgcgtgctgccacaacccaaccggagtcgacccgacaccggaacagtgggaacaaatcgcgagcgtggtctccgaaaagaaactgatcccattgctggactttgcctaccaagggttcggcgaaggcctggacgaagacgccatcggtgtgcgcacgattctgcgacagatggatgaagccatcgtctgctcgtcattcagcaaaaactttggcctgtacagcgaacgagttggaacagcgtgcttggtatccgggtcagccgaaacgaccaaagccgctctcagccaactcaaacgagtcgtccgagccaactacagcaacccacctcggcacggcggcgcgatcgtggccactgtgttggccgatgagggactgacccaaatgtggcacgaagagctcgccgaaatgcgaactcggatcgcctccctacgaaaacaattcgttgatggaatggccgcgacgggagtcgaccaagacttctcgttcttgctggaccaaaaaggcatgttctctttcagtggtttgtcaccgatgcaggtcgaccaactgcgaagcgaacatggcgtgtatctggtcggtagcggtcgaatcaacgtcgccggaatgaacgaatcgaagatggaatggttgtgcaatgccgtggcggcggtattgcgatag

SEQ ID NO: 4703 - protein, 397 aa, Rhodopirellula baltica SH 1
MHRFDSISVAPPDAILGLTEAFKADERETKMNLSVGVYQDASGTTPVLRCVKEAEKRLLDTESTKGYLSIDGLPDYREAARRLIFSDQIAAERVAAVQTPGGTGALRVAAEFLATQCGPLRIFLPTPTWANHNAIMAAAGLPVETYSYLASDKKTLDFDALIEDLKTKPKAGDAVLLHACCHNPTGVDPTPEQWEQIASVVSEKKLIPLLDFAYQGFGEGLDEDAIGVRTILRQMDEAIVCSSFSKNFGLYSERVGTACLVSGSAETTKAALSQLKRVVRANYSNPPRHGGAIVATVLADEGLTQMWHEELAEMRTRIASLRKQFVDGMAATGVDQDFSFLLDQKGMFSFSGLSPMQVDQLRSEHGVYLVGSGRINVAGMNESKMEWLCNAVAAVLR

SEQ ID NO: 4704 - DNA, 1197 bp, Wigglesworthia glossinidia endosymbiont of Glossina brevipalpis
  CDS (1)..(1197): transl_table=11
atgtttgaattaacagagctttctcctttagatccagtattaggaatgatcgatattattaaaaatgataaaagagatggtttaataaatttaggaattggagtttataaagatataaaaggtaacactcctatattagatagtgtaaaaaaagcagaaaatattttaatagaatcagaaaaaacaaaaaattatttaaatattgaaggactagaatcatttatacaacattcaaaaagtttaatttttggcaaagaaaatttatctgagttaaatgattttattgcttcagtacaatgcccaggaggaacttctgctttaaaaattgctgcagagtttttaattagacatacaaaaatacgtaaaatttggatcagtgatccaagttggcctaatcatgaaaagttattttcatttgccggatttaaagtacataaatatccttattttaataaggaaaaaaatcaattagatttttataatatgaaaaaatgcttagaaaatattaaagatgactctgctgttatttttcacagctcttgtcataatccaacaggaatagatcctagttttgaacaatggttagaattagctaaaatttctagaaataaaaaatggattccaatatttgattctgcatatcaaggtttttccaatggattaaaagatgatgtatttggtataaaaatttttttaaaatatattaatgaatttgtagtttgcaattcattttctaaaaattttagtttgtataatgaaagagttgggacatgcaattttataacaaaaaacaaaaaacatgccagtaatgttttcagtcaattaagatctattatacgtgtaaattactctaatcctccagctcatggagcaaatattataaatgtaattttctctaaaaaagatttatttaatttatggaaatctgaattaaatgaaatgagaaatagaattaaacaaataagatctttatttgcagatacattatttaaaataaataataaaaaaaatttcaattttattaaaaatcagcatggaatgttttcttttattggattaaatagaaaaaatgtaatggatcttagaaataattttagaatatatgttattgattctggaagattaaatttcgcagcaataacaaataaaaatatttatgaggtgtgtagatcaattaattgtgttttaaataattga

SEQ ID NO: 4705 - protein, 398 aa, Wigglesworthia glossinidia endosymbiont of Glossina brevipalpis
MFELTELSPLDPVLGMIDIIKNDKRDGLINLGIGVYKDIKGNTPILDSVKKAENILIESEKTKNYLNIEGLESFIQHSKSLIFGKENLSELNDFIASVQCPGGTSALKIAAEFLIRHTKIRKIWISDPSWPNHEKLFSFAGFKVHKYPYFNKEKNQLDFYNMKKCLENIKDDSAVIFHSSCHNPTGIDPSFEQWLELAKISRNKKWIPIFDSAYQGFSNGLKDDVFGIKIFLKYINEFVVCNSFSKNFSLYNERVGTCNFITKNKKHASNVFSQLRSIIRVNYSNPPAHGANIINVIFSKKDLFNLWKSELNEMRNRIKQIRSLFADTLFKINNKKNFNFIKNQHGMFSFIGLNRKNVMDLRNNFRIYVIDSGRLNFAAITNKNIYEVCRSINCVLNN

SEQ ID NO: 4706 - DNA, 1191 bp, Haemophilus ducreyi 35000HP
  CDS (1)..(1191): transl_table=11
atgttcaatcatatcgaggccgctctaaccgatccaattttaggtttaaatgatgccttccgagcagatattcgaaaaacaaaaactaatttgggcattggtgtgtatatgaatgccgaaggtcagacaccgattatgaatgccgtaaaattagcagaaacgcgtttacttgctgaagaatcacaaaagaattatcttcagattgatggtatcgcacactttaatagttatacgcaaaccttattatttgggcaagatgccgatgttattcaaacggggcgagtaaaaacagcacaaagtttaggtggcacaggcgcattacgtatagcaatggagtttattaagcgccaaactgacgcaaagactatttggatatcaaacccaacttggcctaatcataatgcaattgctgaagcggttggcttaacgataaaaaactaccgctattataatcccgaaactaacggcttagattgggataatctgttggctgacttgcaacaagctgaacgtggcgatgtagtgttattacacggttgttgccataacccgaccggtatcgatccaacagcagaacagtgggataaactcgctatactttcagctgaaaaaggctggttacctttatttgatttcgcttatcaaggattagccaatggcttagatgaagatgcttacggtttacgtgcatttgctaaaaaccataaagaattattaatcgcgagttcttattcaaaaaattttggtttatataatgaacgcgtgggcgcttttactttagtggcagaaaatgcagaaatagcaaataatgcatttactcaaattaaatcgattattcgagtgctctattctaatccagcggcacacggtgctcataccgtaaccaccgtattggctgatgatcaattacgcgcaaattggatcgctgaattaagtgagatgcgtgatcggattaaaacgatgcgaactaaaatggttcaattactagctgaaaaaggcgcgaaaaaagatttctcatttatttctgatcagaatggtatgttttcattcagcggtttaaccgctacacaagtcgaccgtttacgtgatgaatttgcaatttatgcggttcgttctgggcgaataaatgtagccggacttactgatgataatatcgaagcgttttgcgatgctgtagtaaaagtactttag

SEQ ID NO: 4707 - protein, 396 aa, Haemophilus ducreyi 35000HP
MFNHIEAALTDPILGLNDAFRADIRKTKTNLGIGVYMNAEGQTPIMNAVKLAETRLLAEESQKNYLQIDGIAHFNSYTQTLLFGQDADVIQTGRVKTAQSLGGTGALRIAMEFIKRQTDAKTIWISNPTWPNHNAIAEAVGLTIKNYRYYNPETNGLDWDNLLADLQQAERGDVVLLHGCCHNPTGIDPTAEQWDKLAILSAEKGWLPLFDFAYQGLANGLDEDAYGLRAFAKNHKELLIASSYSKNFGLYNERVGAFTLVAENAEIANNAFTQIKSIIRVLYSNPAAHGAHTVTTVLADDQLRANWIAELSEMRDRIKTMRTKMVQLLAEKGAKKDFSFISDQNGMFSFSGLTATQVDRLRDEFAIYAVRSGRINVAGLTDDNIEAFCDAVVKVL

SEQ ID NO: 4708 - DNA, 1188 bp, Chlamydophila pneumoniae TW-183
  CDS (1)..(1188): transl_table=11
atgagtttttttaatcacataccaacattttctccggatgctattttaggtttgcagaacgttttctttgcagataagcgtcccgaaaaggttaaccttgtgattggtgtttatgagcatccgcaaaagcgttacggcggcttgtcttgtatacgtaaggcacaaactgtcattttggaagaagaacaaaataagagttatcttcctatttcagggttgcaaatatttttagatgagatgcgtgagctggtttttggtgctgtagatccgagtgctatagtcgggtttcagtctttaggaggtacaggagcgctacacttgggagcccggcttctttccgtggcaaaaggatctggtaaggtttatgttcccgagcagacttggagcaatcatatacgcattttctctcaagagggtcttgaggtaatccgatatccttattatagcaaagaacaaaaacagctgttatttgaacccctgatcgcatttttgaaggaagtagaaaagaattccgttatcttattgcatggttgttgtcacaaccctacaggtgtagattttactgaagatatgtggaaagaactcgccatcttaatgaaagaaagagagttaattccattttttgataccgcataccaaggttttgctcacggcatagagttggatagaaaacctatagaaatttttatatcagagggaaatacggttcttgtcgctgcttcatcaagcaaaaactttgctctttatggtgagcgtgtaggatattttgctgttcacagtacttttactgatgagttggttaaaattcacagtttcttagaagaaaaaattcgaggggaatactcttcaccacaacgttggggtgtagaaattgtttctacaattttgagtaatccatatttgaaagaagaatggcaatcagaactcaattttataagagagtctttgggtaaaatgagaacaagatttgttcaagctttgcgtaaggttgccggtcatacatttgactttttattgtcccaacatggattctttgcataccctgggttttccgataaacaggtgctctttttaagagaacaacacgctgtttatacaacagcgggaggaagaatgaatttaaatggaattacggaaaaaaatatagatcatgtagtgcaaagttttattcaagcttatgagctatag

SEQ ID NO: 4709 - protein, 395 aa, Chlamydophila pneumoniae TW-183
MSFFNHIPTFSPDAILGLQNVFFADKRPEKVNLVIGVYEHPQKRYGGLSCIRKAQTVILEEEQNKSYLPISGLQIFLDEMRELVFGAVDPSAIVGFQSLGGTGALHLGARLLSVAKGSGKVYVPEQTWSNHIRIFSQEGLEVIRYPYYSKEQKQLLFEPLIAFLKEVEKNSVILLHGCCHNPTGVDFTEDMWKELAILMKERELIPFFDTAYQGFAHGIELDRKPIEIFISEGNTVLVAASSSKNFALYGERVGYFAVHSTFTDELVKIHSFLEEKIRGEYSSPQRWGVEIVSTILSNPYLKEEWQSELNFIRESLGKMRTRFVQALRKVAGHTFDFLLSQHGFFAYPGFSDKQVLFLREQHAVYTTAGGRMNLNGITEKNIDHVVQSFIQAYEL

SEQ ID NO: 4710 - DNA, 1221 bp, Candidatus Blochmannia floridanus
  CDS (1)..(1221): transl_table=11
atgtttaaatcaatgataatggctccaccagacccaattcttggattatcaaaaatttatcattctgacactaaaaaaaacaaaattaatcttggtattggagtatatatagaaaaatttcatgcagctccaattttagaaagcgttaaacaagctgaagatttattactcaaaaaagaaattagtaaaaattatcttgctattgaaggttctaatgactttaataatgccaatcaaacattattatttggaccaaatgactcaataatatcaaaaaataggattagaactgttcaagctcctggaggaactggagcattgagaatagccgcggaatgtattgcaaaatatgataatactataaataaaaaaagacgaatatggattagcgaacctagctgggtaaatcataaaaatattttttttgctgctggattagaagtatgtacttatccatattatcaaaaatctacacactccattgaatttgataaactgattgatactttcaacaatatagtaaaacctggagatatagttttattacacggttgttgtcataatccaaccggaatggatcctactatagaacaatggaaaatgttatctgaatgtgcagaaaaaaatagatggatacctttgtttgatctggcatatcaaggatttgataatggattacaagaagacttgataggattacatatgttttgtaaaaacaatccagaattaatagtctgtaattcttactccaaaaattttggtttgtataacgaacgtgtaggagcatgtactataattactgaaaacaataatcatgctgattgtgtgctaagccaactacgagcgaccattagggcaatttattctaatccaccagcacatggagctgccattgtatctacaattttacaaaataaaacactacgtttcatttgggaaaaagaattaaaaaatatgagagatcatattaaaaatatgcgtaaattgttatttaatacactgaataaatataaaaatagtaaagtaataaatcaagattttagttttattaataatcaaaaaggtatgtttgcctatataggattaaactctaatcaagtaattaaattacgtgaagaattaggaatttatttagtagattctggtaggctaaacttagcaggtttatcacacaaaaatatcgattacatatgtaatgcaatatgtaacttatacatttaa

SEQ ID NO: 4711 - protein, 406 aa, Candidatus Blochmannia floridanus
MFKSMIMAPPDPILGLSKIYHSDTKKNKINLGIGVYIEKFHAAPILESVKQAEDLLLKKEISKNYLAIEGSNDFNNANQTLLFGPNDSIISKNRIRTVQAPGGTGALRIAAECIAKYDNTINKKRRIWISEPSWVNHKNIFFAAGLEVCTYPYYQKSTHSIEFDKLIDTFNNIVKPGDIVLLHGCCHNPTGMDPTIEQWKMLSECAEKNRWIPLFDLAYQGFDNGLQEDLIGLHMFCKNNPELIVCNSYSKNFGLYNERVGACTIITENNNHADCVLSQLRATIRAIYSNPPAHGAAIVSTILQNKTLRFIWEKELKNMRDHIKNMRKLLFNTLNKYKNSKVINQDFSFINNQKGMFAYIGLNSNQVIKLREELGIYLVDSGRLNLAGLSHKNIDYICNAICNLYI

SEQ ID NO: 4712 - DNA, 1203 bp, Bordetella pertussis Tohama I
  CDS (1)..(1203): transl_table=11
atgagcactcttttcgcttccgtcgaactcgcgccgcgcgaccccattcttggcctgaacgaacagtacaacgccgatacccgtcccggcaaagtgaacctgggcgtgggcgtgtactacgacgacgaaggccgcatcccgctgcttcaggccgtgcgcaaggccgaggtggcccgcatcgaagccgccgccgcccgcggctatctgccgatcgaaggcatcgcggggtacaacaagggtgcgcaggcgctgctgctgggcgccgactcgccgctggccgccgaaggccgcgtgctgaccgcgcaggccctgggcggcaccggcgcgctgaagatcggcgccgacttcctgcgccagctgctgccgcagtccaaggtcctcatcagcgaccccagctgggaaaaccaccgcgccctgttcgagcgcgccggcttcccggtcgagacctacgcttattacgatgccgccacccatggcctgaacttcgaagccatgctggccgccctgcaggccgcgcccgaacagaccatcgtggtgctgcacgcctgctgccacaacccgaccggcgtcgatcccacgccgcaacagtgggaacagatcgccgccgtggtcaaggcgcgcaacctggtgccgttcctcgacatcgcctaccagggcttcggcgaaggcctggagcaggacgccgccgtggtgcgcatgttcgccgcgctcgacctgaccatgttcatcagctcgtcgttctccaagtccttctcgctgtatggcgagcgggtcggggccctgaccgtggtggccggcagcaaggacgaggccgcccgcgtgctcagccagctcaagcgcgtgatccgcaccaactactccaacccgcccacccacggcggcaccgtggtgtccacggtcctgaacacacccgagctgttcgcgctctgggaaaatgaactggccggcatgcgcgaccgcatccgcctgatgcgcaaggagctggtcgagaagatcaagacccagggcgtggcgcaggacttcagcttcgtgctggcgcagcgcggcatgttctcgtactcgggcctgaccgccgcccaggtcgatcgcctgcgcgaagagcacggcatctacgcggtctccagcggccgcatctgcgtggccgcgctcaacagccgcaacatcgacgcggtcgcggccggcatcgccgcggtgctgaagtag

SEQ ID NO: 4713 - protein, 400 aa, Bordetella pertussis Tohama I
MSTLFASVELAPRDPILGLNEQYNADTRPGKVNLGVGVYYDDEGRIPLLQAVRKAEVARIEAAAARGYLPIEGIAGYNKGAQALLLGADSPLAAEGRVLTAQALGGTGALKIGADFLRQLLPQSKVLISDPSWENHRALFERAGFPVETYAYYDAATHGLNFEAMLAALQAAPEQTIVVLHACCHNPTGVDPTPQQWEQIAAVVKARNLVPFLDIAYQGFGEGLEQDAAVVRMFAALDLTMFISSSFSKSFSLYGERVGALTVVAGSKDEAARVLSQLKRVIRTNYSNPPTHGGTVVSTVLNTPELFALWENELAGMRDRIRLMRKELVEKIKTQGVAQDFSFVLAQRGMFSYSGLTAAQVDRLREEHGIYAVSSGRICVAALNSRNIDAVAAGIAAVLK

SEQ ID NO: 4714 - DNA, 1200 bp, Bordetella pertussis Tohama I
  CDS (1)..(1200): transl_table=11
atgttcgagcacgtccaagcctatccgggcgaccccatcctcagcctgaacgaggatttccagaaagatccccgtgtcggcaaggtcaacctgaccatcggcatctatttcgacgaagccggccgcatccccgtcatggccgccgcccgcgaggccgaggccgcgctgctggccgacatcgggccgcgcccctacctgccgatggccggcctgccggcctatcgcgacctggtgcaggaactggtgttcggcgccggcagcgccgcgcgccgcgccggccgcatcgccaccgtgcagacgctgggcgggtcgggcgcgctgaaagtgggcgccgatttcctcaagcgctattttcccaagtcggaagtctgggtcagcgacccgagctgggaaaaccatcgcaccattttcgagggcgccggcttcgcggtgcacacatatccctattacgacgacgccagcggcggcctgcgctttgacgagatgctggccacggtgggcggcctgccggccggcagcgtcgtgctgctgcacgcctgctgccacaacccgaccggcgtggacctcgatcgcgcccagtgggacgcgctgattccggtgctgcgcgagcgcggcctgatcgccttcgtcgacatggcctaccagggcttcggcgatggcctggacgacgacgcctatgctgtgcgggccctggccgaggcgggcgtgacctgtgtggtggccaactcgttctcgaagaatttctcgctgtacggcgagcgctgcggcgggctgagcgtggtctgcgaaaccgccgagcaggccggctgcgtgctgggccagctgaccagcaccatccgcgccatctacagcaacccgcctacccatggcgcgcgcatcgtcgcccaggtgctgggcacgccggcgctgcggcaatcgtgggaggccgagctgggcgccatgcgcgagcgcatccaggcgatgcggcgcgccatccacgacggcctggccggccgcgtcgagccgcgcatgctgcagcgctacctgtcgcagcgcggcatgttcacctacaccggcctgggcgcggagcaggtcgagaccttgcggcgcgaccagggcgtgtatctgctgcgctcgggccgcatgtgcgtggcgggcctgaaccgcgacaacgtggcggtggccgctgacgccatcgccagcgtgctggcgcgcggctag

SEQ ID NO: 4715 - protein, 399 aa, Bordetella pertussis Tohama I
MFEHVQAYPGDPILSLNEDFQKDPRVGKVNLTIGIYFDEAGRIPVMAAAREAEAALLADIGPRPYLPMAGLPAYRDLVQELVFGAGSAARRAGRIATVQTLGGSGALKVGADFLKRYFPKSEVWVSDPSWENHRTIFEGAGFAVHTYPYYDDASGGLRFDEMLATVGGLPAGSVVLLHACCHNPTGVDLDRAQWDALIPVLRERGLIAFVDMAYQGFGDGLDDDAYAVRALAEAGVTCVVANSFSKNFSLYGERCGGLSVVCETAEQAGCVLGQLTSTIRAIYSNPPTHGARIVAQVLGTPALRQSWEAELGAMRERIQAMRRAIHDGLAGRVEPRMLQRYLSQRGMFTYTGLGAEQVETLRRDQGVYLLRSGRMCVAGLNRDNVAVAADAIASVLARG

SEQ ID NO: 4716 - DNA, 1203 bp, Bordetella parapertussis 12822
  CDS (1)..(1203): transl_table=11
atgagcactcttttcgcttccgtcgaactcgcgccgcgcgaccccattcttggcctgaacgaacagtacaacgccgatacccgtcccggcaaagtgaacctgggcgtgggcgtgtactacgacgacgaaggccgcatcccgctgcttcaggccgtgcgcaaggccgaggtggcccgcatcgaagccgccgccgcccgcggctatctgccgatcgaaggcatcgcggggtacaacgagggtgcgcaggcgctgctgctgggcgccgactcgccgctggccgccgaaggccgcgtgctgaccgcgcaggccctgggcgggaccggcgcgctgaagatcggcgccgacttcctgcgccagttgctgccgcagtccaaggtcctcatcagcgaccccagctgggaaaaccaccgcgccctgttcgagcgcgccggcttcccggtcgagacctacgcttattacgacgccgccacccatggcctgaacttcgaagccatgctggccgccctgcaggccgcgcccgaacagaccatcgtggtgctgcacgcctgctgccacaacccgaccggcgtcgaccccacgccgcagcagtgggaacagatcgccgccgtggtcaaggcgcgcaacctggtgccgttcctcgacatcgcctaccagggcttcggcgaaggcctggagcaggacgccgccgtggtgcgcatgttcgccgcgctcgacctgaccatgttcatcagctcgtcgttctccaagtccttctcgctgtatggcgagcgggtcggggccctgaccgtggtggccggcagcaaggacgaggccgcccgcgtgctcagccagctcaagcgcgtgatccgcaccaactactccaacccgcccacccacggcggcacggtggtgtccacggtcctgaacacgcccgagctgttcgcgctctgggaaaatgaactggccggcatgcgcgaccgcatccgcctgatgcgcaaggaactggtcgagaagatcaaggcccagggcgtggcgcaggacttcagcttcgtgctggcgcagcgcggcatgttctcgtactcgggcctgaccgccgcccaggtcgatcgcctgcgcgaagagcacggcatctacgcggtctccagcggccgcatctgcgtggccgcgctcaacagccgcaacatcgacgcggtcgcggccggcatcgccgcggtgctgaagtag

SEQ ID NO: 4717 - protein, 400 aa, Bordetella parapertussis 12822
MSTLFASVELAPRDPILGLNEQYNADTRPGKVNLGVGVYYDDEGRIPLLQAVRKAEVARIEAAAARGYLPIEGIAGYNEGAQALLLGADSPLAAEGRVLTAQALGGTGALKIGADFLRQLLPQSKVLISDPSWENHRALFERAGFPVETYAYYDAATHGLNFEAMLAALQAAPEQTIVVLHACCHNPTGVDPTPQQWEQIAAVVKARNLVPFLDIAYQGFGEGLEQDAAVVRMFAALDLTMFISSSFSKSFSLYGERVGALTVVAGSKDEAARVLSQLKRVIRTNYSNPPTHGGTVVSTVLNTPELFALWENELAGMRDRIRLMRKELVEKIKAQGVAQDFSFVLAQRGMFSYSGLTAAQVDRLREEHGIYAVSSGRICVAALNSRNIDAVAAGIAAVLK

SEQ ID NO: 4718 - DNA, 1200 bp, Bordetella bronchiseptica RB50
  CDS (1)..(1200): transl_table=11
atgttcgagcacgttcaagcctatccgggcgaccccatcctcagcctgaacgaggatttccagaaagatccccgggccggcaaggtcaacctgaccatcggcatctatttcgacgaagccggccgcatccccgtcatggccgccgcccgcgaggccgaggccgcgctgctggccgacatcgggccgcgcccctacctgccgatggccggcctgccggcctatcgcgacctggtgcaggagctggtgttcggcgccggcagcgccgcgcgccgcgccggccgtatcgccacggtgcagacgctgggcgggtcgggcgcgctgaaagtgggcgccgacttcctcaagcgctattttcccaagtcggaagtctgggtcagcgacccgagctgggaaaaccatcgcaccattttcgagggcgccggcttcgcggtgcacacctatccctattacgacgacgccagcggcggcctgcgctttgacgaaatgctggccacggtgggcggcctgccggccggcagcgtcgtgctgctgcacgcctgctgccacaacccgaccggcgtggacctcgatcgcgcccagtgggacgcgctgattccggtgctgcgcgagcgcggcctgatcgccttcgtcgacatggcctaccagggcttcggcgatggcctggacgacgacgcctatgccgtgcgggccatcgccgaggcgggcgtgacctgtgtggtggccaactcgttctcgaagaatttctcgctgtacggcgagcgctgcggcgggctgagcgtggtgtgcgaaaccgccgagcaggctggctgcgtgctgggccagctgaccagcaccatccgcgccatctacagcaacccgcctacccatggcgcgcgcatcgtcgcccaggtgctgggcacgccggcgctgcggcaatcgtgggaggccgagctgggcgccatgcgcgagcgtatccaggcgatgcggcgcgccatccatgacggcctggccggccgcgtcgagccgcgcatgctgcagcgctacctgtcgcagcgcggcatgttcacctacaccggcctgggcgccgagcaggtcgagaccttgcggcgcgaccagggcgtgtatctgctgcgctcgggccgcatgtgcgtggcgggcctgaaccgcgacaacgtggcggtggccgccgacgccatcgccagcgtgctggcgcgcggctag

SEQ ID NO: 4719 - protein, 399 aa, Bordetella bronchiseptica RB50
MFEHVQAYPGDPILSLNEDFQKDPRAGKVNLTIGIYFDEAGRIPVMAAAREAEAALLADIGPRPYLPMAGLPAYRDLVQELVFGAGSAARRAGRIATVQTLGGSGALKVGADFLKRYFPKSEVWVSDPSWENHRTIFEGAGFAVHTYPYYDDASGGLRFDEMLATVGGLPAGSVVLLHACCHNPTGVDLDRAQWDALIPVLRERGLIAFVDMAYQGFGDGLDDDAYAVRAIAEAGVTCVVANSFSKNFSLYGERCGGLSVVCETAEQAGCVLGQLTSTIRAIYSNPPTHGARIVAQVLGTPALRQSWEAELGAMRERIQAMRRAIHDGLAGRVEPRMLQRYLSQRGMFTYTGLGAEQVETLRRDQGVYLLRSGRMCVAGLNRDNVAVAADAIASVLARG

SEQ ID NO: 4720 - DNA, 1203 bp, Bordetella bronchiseptica RB50
  CDS (1)..(1203): transl_table=11
atgagcactcttttcgcttccgtcgaactcgcgccgcgcgaccccattcttggcctgaacgaacagtacaacgccgatacccgtcccggcaaagtgaacctgggcgtgggcgtgtactacgacgacgaaggccgcatcccgctgcttcaggccgtgcgcaaggccgaggtggcccgcatcgaagccgccgccgcccgcggctatctgccgatcgaaggcatcgcggggtacaacaagggtgcgcaggcgctgctgctgggcgccgactcgccgctggccgccgaaggccgcgtgctgaccgcgcaggccctgggcggcaccggcgcgctgaagatcggcgccgacttcctgcgccagctgctgccgcagtccaaggtcctcatcagcgaccccagctgggaaaaccaccgcgccctgttcgagcgcgccggcttcccggtcgagacctacgcttattacgatgccgccacccatggcctgaacttcgaagccatgctggccgccctgcaggccgcgcccgaacagaccatcgtggtgctgcacgcctgctgccacaacccgaccggcgtcgatcccacgccgcaacagtgggaacagatcgccgccgtggtcaaggcgcgcaacctggtgccgttcctcgacatcgcctaccagggcttcggcgaaggcctggagcaggacgccgccgtggtgcgcatgttcgccgcgctcgacctgaccatgttcatcagctcgtcgttctccaagtccttctcgctgtatggcgagcgggtcggggccctgaccgtggtggccggcagcaaggacgaggccgcccgcgtgctcagccagctcaagcgcgtgatccgcaccaactactccaacccgcccacccacggcggcaccgtggtgtccacggtcctgaacacacccgagctgttcgcgctctgggaaaatgaactggccggcatgcgcgaccgcatccgcctgatgcgcaaggagctggtcgagaagatcaaggcccagggcgtggcgcaggacttcagcttcgtgctggcgcagcgcggcatgttctcgtactcgggcctgaccgccgcccaggtcgatcgcctgcgcgaagagcacggcatctacgcggtctccagcggccgcatctgcgtggccgcgctcaacagccgcaacatcgacgcggtcgcggccggcatcgccgcggtgctgaagtag

SEQ ID NO: 4721 - protein, 400 aa, Bordetella bronchiseptica RB50
MSTLFASVELAPRDPILGLNEQYNADTRPGKVNLGVGVYYDDEGRIPLLQAVRKAEVARIEAAAARGYLPIEGIAGYNKGAQALLLGADSPLAAEGRVLTAQALGGTGALKIGADFLRQLLPQSKVLISDPSWENHRALFERAGFPVETYAYYDAATHGLNFEAMLAALQAAPEQTIVVLHACCHNPTGVDPTPQQWEQIAAVVKARNLVPFLDIAYQGFGEGLEQDAAVVRMFAALDLTMFISSSFSKSFSLYGERVGALTVVAGSKDEAARVLSQLKRVIRTNYSNPPTHGGTVVSTVLNTPELFALWENELAGMRDRIRLMRKELVEKIKAQGVAQDFSFVLAQRGMFSYSGLTAAQVDRLREEHGIYAVSSGRICVAALNSRNIDAVAAGIAAVLK

SEQ ID NO: 4722 - DNA, 1194 bp, Chromobacterium violaceum ATCC 12472
  CDS (1)..(1194): transl_table=11
gtgttccaacatgtagacgcctacgccggcgatcccatcctgtcgctggtggaagctttcggcaaagacccgcgcgagcagaaggtcaacctcagcatcggcctgtattacgacgaggcaggccgcatcccgcggctgaaggcggtggagcaggccgaggcgctgctggccagccagccgcagccgccgtgcacctatctgccgatggacggcatgccggcttaccgcagcgccatccagacgctactattcggcgccgagcatccggcggtgaaagacggccgcatcgccacgctgcagacgctgggcggctccggcgcgctgaaagtgggcgccgacttcctcaagcgctatttcccggcatccggcgtctgggtcagcgacccgacctgggacaaccacgtcgccatcttcgaaggcgcgggcctggccgtggagcgctacccgtatttcgacccggccacccgcggcgtggatttcccggccatgctggccaagctgcagacgctgccggccaagagcatcgtgctgctgcacccgtgttgccacaaccccaccggcgcggacctcaccgacgcgcagtgggaccaggtggtggaagtggccaaggcgcgccagctgattcccttcctggacattgcctaccagggcttcggcgccggtctggaggaagacgcctacgccatccgcgcgatggcagacgccggcatcgccttcctggtcagcaactccttctccaagatcttctcgttgtacggcgaacgctgcggcggcctgtccgtggtgtgcgaaaccgccgccgaggcggcgctggtgtccggccagctcaaggccaccgtgcgccgcaactactccagcccgccgacgcacggcgccagggtgatcgccaccgtgctgaacgatccggagctgaaggcgctgtgggtgtccgaggtgaacgagatgcgcgagcgcatccaggcgatgcgcggcgtgctggtgcaagtgctgaaggaagcgctgcccgagcgcgacttcggctacctggtgaaccagcgcggcatgttcagctacaccggcttcagccaggcgcaggtggacaagctgcgcgagcagttcgccgtctacctggtgggcagcggccgcatgtgcgtggccggcctcaacgccgccaacgcgccctacgtggcccaggccttcgcccaggtgcagtaa

SEQ ID NO: 4723 - protein, 397 aa, Chromobacterium violaceum ATCC 12472
MFQHVDAYAGDPILSLVEAFGKDPREQKVNLSIGLYYDEAGRIPRLKAVEQAEALLASQPQPPCTYLPMDGMPAYRSAIQTLLFGAEHPAVKDGRIATLQTLGGSGALKVGADFLKRYFPASGVWVSDPTWDNHVAIFEGAGLAVERYPYFDPATRGVDFPAMLAKLQTLPAKSIVLLHPCCHNPTGADLTDAQWDQVVEVAKARQLIPFLDIAYQGFGAGLEEDAYAIRAMADAGIAFLVSNSFSKIFSLYGERCGGLSVVCETAAEAALVSGQLKATVRRNYSSPPTHGARVIATVLNDPELKALWVSEVNEMRERIQAMRGVLVQVLKEALPERDFGYLVNQRGMFSYTGFSQAQVDKLREQFAVYLVGSGRMCVAGLNAANAPYVAQAFAQVQ

SEQ ID NO: 4724 - DNA, 1209 bp, Chromobacterium violaceum ATCC 12472
  CDS (1)..(1209): transl_table=11
atgacctcttcgatcttcgccggcgtggagctggcgccgcgcgaccccatcctcggactcaatgaggcgttcaacgccgatacccgcagcaccaaggtcaatcttggcgtgggcgtgtattccgacgacaacggcaagattccactgctggccgcggtgcaggcggccgagaaagctcgcctcgaagcattgccggcgcgcggctaccagccgatcgaaggccccgccgcttacgatgtcgccgtgcagaagctgctgttcggcgagagcagcgaactgctggccgccggccgcgtggtgaccgcccaggcgctgggcggcaccggcgcgctgaagatcggcgcggacttcctgaaacgcctgaatccggccgccaaggtgtacatcagcgacccgtcctgggaaaaccaccgcgcgctgttcgagtccgccggctttgccgtggaaaactacccgtattatcacgcagccagccgcggcgtggatttcgccgcgatgaaggcgcatttgtcctcgctggatgcgggctccatcatcgtgctgcatgcctgctgccacaatcccaccggcgccgacctgtccgccgcgcaatgggaagaagtggtgtcgatctgccgcgagcgcagcctggtgcccttcctggacatggcctaccagggcttcgccgacggcatcgacgccgatgcgctggcggtgcgcctgttcgccgcctcgaatctgcagttcttcgtcgccagctccttctccaagagcttctcgctgtacggagagcgtgtcggcgcgctgtccatcatcacggcagccaaggacgagtcggtccgcgtcttgtcccagctgaagcgcgtgatccgcaccaactactccaatccgcccatccatggcgcggccatcgtcgccgccgtgctgtccagcccggcgctgcgcgcgcaatgggaggaagagctggcgggcatgcgcgatcgcattcgcgacatgcgattggccttgctggaggcgatcaaggcgcaaggcgtggccgtcgacttttccttcatcacggcccagcgcggcatgttctcctacaccggcctgagcgccgcccaggtggaccgcctgcgcgaggagttcggcatttacgcggtatccactggccgcatctgcctggcggccctgaacagcaagaacgtaggctatgtggcctccgccatcgccaaggtggttcaggcctga

SEQ ID NO: 4725 - protein, 402 aa, Chromobacterium violaceum ATCC 12472
MTSSIFAGVELAPRDPILGLNEAFNADTRSTKVNLGVGVYSDDNGKIPLLAAVQAAEKARLEALPARGYQPIEGPAAYDVAVQKLLFGESSELLAAGRVVTAQALGGTGALKIGADFLKRLNPAAKVYISDPSWENHRALFESAGFAVENYPYYHAASRGVDFAAMKAHLSSLDAGSIIVLHACCHNPTGADLSAAQWEEVVSICRERSLVPFLDMAYQGFADGIDADALAVRLFAASNLQFFVASSFSKSFSLYGERVGALSIITAAKDESVRVLSQLKRVIRTNYSNPPIHGAAIVAAVLSSPALRAQWEEELAGMRDRIRDMRLALLEAIKAQGVAVDFSFITAQRGMFSYTGLSAAQVDRLREEFGIYAVSTGRICLAALNSKNVGYVASAIAKVVQA

SEQ ID NO: 4726 - DNA, 1191 bp, Photorhabdus luminescens subsp. laumondii TTO1
  CDS (1)..(1191): transl_table=11
atgtttgagaaaatcaccgcagcgcctgccgaccctattcttggcttagccgatagtttccgttctgatcctcgtacaaataaaatcaaccttggtatcggtgtctataaagacgaaacaggaaaaaccccggttctgaccagtgttaaaaaagctgaacaatatttactggaaaacgaaacaacaaagaattatctgccgattagcggcttagccgaatttggccgcgtaactcaagaattactgtttggcaaagatcacccagttgtcacagataaacgcgcccgcacagcacaaagcccaggcggtaccggtgctttacgtattgctgcggatttcattgccaaacagactaatgctaaacgagtttggatcagcaacccaacctggccaaaccataaaaacgttttttccgccgctggtctggaagtctgtgaatataaatactatgacgctgaaaaacacgcgctgaatttcgaagacatgctggcaagcctgtccgaagctcaggctggtgatgttgttctgttccacggctgctgccacaatccgacaggcatcgatccaaccccggcacaatgggctaaactggcagaaatgtctgcggagaaaggctggttgcctatttttgatttcgcttaccaaggatttgccaagggcctaaacgaagatgcagagggcctacgtatttttgcgaaaaatcataatgaactgattgttgccagctcttactccaaaaactttggcctgtacaatgaacgtgtcggtgcctgtactattgttgctagtgacagtgatacagcagaaaaagcgttcagccaagctaaagcgattatccgtgctaactattccaacccacccgctcatggtgcatctattgtcactaccattttgtcaaatgaagacctgaaagcagcttgggaacaggaactgaccaccatgcgcgaacgtatccagcgtatgcgtcaactgtttgtcaataccttgcaggaaaaaggggcaaaacaggatttcagctttattattagccaaaatggtatgttctcattcagtggcctgacaaaagaacaagtagaacgtctgcgtgatgagtttggtatatacgctgtcagttccggtcgtattaacgtcgctggcttgacgttagaaaacatggctccactatgtgaagccattgttgcagtactctaa

SEQ ID NO: 4727 - protein, 396 aa, Photorhabdus luminescens subsp. laumondii TTO1
MFEKITAAPADPILGLADSFRSDPRTNKINLGIGVYKDETGKTPVLTSVKKAEQYLLENETTKNYLPISGLAEFGRVTQELLFGKDHPVVTDKRARTAQSPGGTGALRIAADFIAKQTNAKRVWISNPTWPNHKNVFSAAGLEVCEYKYYDAEKHALNFEDMLASLSEAQAGDVVLFHGCCHNPTGIDPTPAQWAKLAEMSAEKGWLPIFDFAYQGFAKGLNEDAEGLRIFAKNHNELIVASSYSKNFGLYNERVGACTIVASDSDTAEKAFSQAKAIIRANYSNPPAHGASIVTTILSNEDLKAAWEQELTTMRERIQRMRQLFVNTLQEKGAKQDFSFIISQNGMFSFSGLTKEQVERLRDEFGIYAVSSGRINVAGLTLENMAPLCEAIVAVL

SEQ ID NO: 4728 - DNA, 1200 bp, Photorhabdus luminescens subsp. laumondii TTO1
  CDS (1)..(1200): transl_table=11
atgttccagaatgttgatgcttatgctggtgatccgattctttcgctggctgaagaatttaaaaaagatcctcgtgcggaaaaaattaatctgagcatcgggctttattacgatgagcagggagtgactccgcaattgcaggcagtggctaccgcagaagaacaacttagagcgttgtcacagactgcttctctttatctgccaatggagggattggaatcctatcgtcttgcggttcaggaactgttatttggtaaagatcatccggtgttgaaacagcgggtggtggcaacgattcaatcattaggtggttctggcgctcttaaaattggtgctgactttttgcatcgttatttccctgattcagaagtgtggtgcagtgatccaacttgggaaaaccacgcagctatttttgcgggggcaggtattaaggtgaactattacccttattttgatacacagaccaaaggggtaaaattcagtgaaatgctggaaacattcaggaaactgccggcaaaaagcattattgtgatgcacccttgttgccataacccaaccggatcggatctgacctatgatcaatgggatcaagttgttcaaattgttaaagagagagagctcctgccattccttgatattgcttatcaggggcttgcggatgggatggaaaaagatgcttatgccattcgtgctatggcgacagccggtttgccttgtctggtgagcaactctttctccaagatattttctatgtatggtgagcgagtgggtggcttgtctgttatttgtgatgatgagcagaccaaagaacgggtattggggcagttgaaagcaggtgtgcgtcgcgtttactctagcccaccgagttttggtgcacaggttgtggcgaaagtactgactgatcctgctttgaaggcacaatggttaacagaagttgagcatatgcgcttgcgtattttggaaatgcgcacggtgctggtggatgctctgaaaacggcattaccagagaaaaactttgagtattttctgaaacagcgcgggatgttcagctataccggttttagccagaaacaggtggatcgcttgcgccaagaatttgctgtttatctggtcggtaatggccgagtctgtatggcgggcgtcaaccatcgtaatgttgcacgtattgctgaaacatttgcggcggtaaataagtcataa

SEQ ID NO: 4729 - protein, 399 aa, Photorhabdus luminescens subsp. laumondii TTO1
MFQNVDAYAGDPILSLAEEFKKDPRAEKINLSIGLYYDEQGVTPQLQAVATAEEQLRALSQTASLYLPMEGLESYRLAVQELLFGKDHPVLKQRVVATIQSLGGSGALKIGADFLHRYFPDSEVWCSDPTWENHAAIFAGAGIKVNYYPYFDTQTKGVKFSEMLETFRKLPAKSIIVMHPCCHNPTGSDLTYDQWDQVVQIVKERELLPFLDIAYQGLADGMEKDAYAIRAMATAGLPCLVSNSFSKIFSMYGERVGGLSVICDDEQTKERVLGQLKAGVRRVYSSPPSFGAQVVAKVLTDPALKAQWLTEVEHMRLRILEMRTVLVDALKTALPEKNFEYFLKQRGMFSYTGFSQKQVDRLRQEFAVYLVGNGRVCMAGVNHRNVARIAETFAAVNKS

SEQ ID NO: 4730 - DNA, 1200 bp, Vibrio vulnificus YJ016
  CDS (1)..(1200): transl_table=11
atgaagattatgtttgaaaaagtagttgccgctcccgcggacccgattcttggcctaactgaagaattcaaaaaagaccctcgcgcagagaaaattaaccttggcgtgggtatctacaaaacagaacaaggtgaaacgcctgttcttgctacggtaaagaaagcggaagcagcgcttgttgaaaccgagaaaaccaaatcttacctaaccatcgaaggaacagcagaatacgcattagcggttcaaaaactgctgtttggtgcagatgctgagctaatcaatgcgcaacgtgcaaaaacagcacaagcacctggcggtactggcgcactgcgcgttgcaggcgaattcatcaaacgccaactcggcgatgtaaaaatctggatcagcaacccaacttgggctaaccaccatggtgtgttccgcgcagcaggcctagaaacggttgagtacgcttactacaacccagaaaccaaagacaaagactttgccgctatgctggccgaccttgaaaaagcgtccgctggtgatgtggtactgctgcacggatgttgccataacccaacaggcatcgacccaacagcacaagagtgggaagcgcttgctaaactggttgccgacaagggcctacttccactatttgactttgcctaccaaggtttcgcgaaaggtgttgaagaagatgcgcaaggcctacgtaccttcgctaaattcaacaaagagatccttgtagcaagttcattctcgaaaaactttggtctgtacaacgagcgtgtaggcgcattcacgttagtggctgaaagccaagagatcgctgaaacggcattctcacaagtgaaagcgatcattcgctctatctactcaaacccaccagcgcacggcagtgcggtagtgactcacatccttaacgatgcagcgcttcgtgcagagtgggaagcggaagtggcagagatgcgcgatcgcatccaagagatgcgcgagctttttgtggcaacactgaaagaagaaggcgtagcggctgactttagctttatcgagcgtcaaaacggcatgttctctttctctggtttgaacaaagatcaagtggctcgtctaaaagaagagtttgcgatctacatcgtgggttctggtcgcatcagcgttgcgggcatgaccaaatccaacatgggtccgctttgtaaagccatcgctgcggtactgtaa

SEQ ID NO: 4731 - protein, 399 aa, Vibrio vulnificus YJ016
MKIMFEKVVAAPADPILGLTEEFKKDPRAEKINLGVGIYKTEQGETPVLATVKKAEAALVETEKTKSYLTIEGTAEYALAVQKLLFGADAELINAQRAKTAQAPGGTGALRVAGEFIKRQLGDVKIWISNPTWANHHGVFRAAGLETVEYAYYNPETKDKDFAAMLADLEKASAGDVVLLHGCCHNPTGIDPTAQEWEALAKLVADKGLLPLFDFAYQGFAKGVEEDAQGLRTFAKFNKEILVASSFSKNFGLYNERVGAFTLVAESQEIAETAFSQVKAIIRSIYSNPPAHGSAVVTHILNDAALRAEWEAEVAEMRDRIQEMRELFVATLKEEGVAADFSFIERQNGMFSFSGLNKDQVARLKEEFAIYIVGSGRISVAGMTKSNMGPLCKAIAAVL

SEQ ID NO: 4732 - DNA, 1374 bp, Magnaporthe grisea 70-15
  CDS (1)..(1374)
atgtcggcaaaagccacccggggcagcacctcttcgagcaccccacagaacagctcttcctcatcccaatctcagtcccaatccaccgcagtttcgaggatacggaatattgcaaaccacatgatggcatcaccaagcacaatcttcacggccgatgtcgttcctcaggccccagaagaccctctctttgggttgatggccgcctacagggccgatgaaagccccgacaaggtcgacttgggaattggtgcatacagggacgacaacgcaaagccgtgggtgcttcctgttgtcaagaaggccgatgaaatcatccgcaacgaccccagcgccaaccatgaatatctcccgatcaccggtctggcctccttcaccagcaaggctggcgagctgatgctcggcgccgatacacctgccaaaggccgcgtcacatctgtgcagaccatctccggcactggagctctgcacctcggagccctcttcctccagaagttctatcgcaaggtctatagcaactcggtcgtgcacctgtcgaaccccacctgggccaaccacaaccagatcttctccaacgtccaagtgccgacgacgacgtacccatactttgacaagggcaccaagggccttgacttcgaaggcatgaaggctacgttgaacaatgccgcagaacactccatcatccttctgcacgcttgtgcacacaatcccaccggtgttgaccccacgcagggccagtggcgcgagattgccgagatcatgaaggccaaaaagcacttcccgtttttcgactgtgcttaccaaggcttcgcttcgggcgatctggaccgcgatgcctgggccgttcgctactttgtggagcagggattcgagctcgtaattgcccagtctttcgccaaaaacttcggcttgtacggtgagcgggcgggctgcttccactacgtgtcggcgcctgcagccgaggctgccgaaacgaccaagagggttgcatcacaactcgccatcctccagcgctccgaaatctcgaacccaccaatctacggcgcccgcgtcgccagcatcgtgctcaacgacccggcgctcatgtccgaatggagagaaaatctgaggaccatgtcgggccgcatcattactatgcgcaacgagcttcgggcaaagctcgaagcgctgggcacccccggcacatggaaccacatcacggaccagatcgggatgttcagcttcacgggtctgaccgaggcacaggtcctgaagatccggagcgactaccacgtttacatgacgaagaatggtcgtatcagcatggcgggactcaactcgcgcaacattgactactttgctaaggcagttgataaggtggtgagggagacgcaataa

SEQ ID NO: 4733 - protein, 457 aa, Magnaporthe grisea 70-15
MSAKATRGSTSSSTPQNSSSSSQSQSQSTAVSRIRNIANHMMASPSTIFTADVVPQAPEDPLFGLMAAYRADESPDKVDLGIGAYRDDNAKPWVLPVVKKADEIIRNDPSANHEYLPITGLASFTSKAGELMLGADTPAKGRVTSVQTISGTGALHLGALFLQKFYRKVYSNSVVHLSNPTWANHNQIFSNVQVPTTTYPYFDKGTKGLDFEGMKATLNNAAEHSIILLHACAHNPTGVDPTQGQWREIAEIMKAKKHFPFFDCAYQGFASGDLDRDAWAVRYFVEQGFELVIAQSFAKNFGLYGERAGCFHYVSAPAAEAAETTKRVASQLAILQRSEISNPPIYGARVASIVLNDPALMSEWRENLRTMSGRIITMRNELRAKLEALGTPGTWNHITDQIGMFSFTGLTEAQVLKIRSDYHVYMTKNGRISMAGLNSRNIDYFAKAVDKVVRETQ

SEQ ID NO: 4734 - DNA, 1272 bp, Magnaporthe grisea 70-15
  CDS (1)..(1272)
atgctttcaaccatgagaattgcctcgcggcaggtcgccggtaggcggatggctgtccgccctcttgctgctttgcgcccagcttcaacttgggccaacgtccagatgggccctccagtacgtatcactgaagctttcaaggccgacagcaacaacaagaagatcaacctcggtgttggcgcctaccgcgatgacgctggcaagccctacgtgctgccgtcagtcaggcaagccgaggagaaggttattgcagctcgcatgaacaaggagtacgccggaatcactggtgtgcctgaattcacttcaggagctcttaccctggcctacggcaaggactcgaccgccctcgaccgcactgccatcacccagtccatttctggcactggtgctctgcgcatcggcgccgagttcctttccaagttctaccctggcgcgaagaacatctacatccccaccccgtcatgggccaaccacggcgccgtcttcacacaggccggcctgaaggttgagaagtaccgctactacaacaaggacaccatcggcctcgactttgagggtctggtcgccgacgtcaaggccgcacccaagggctccatcttcctcttccacgcctgcgcccacaaccccaccggtgtcgaccctactcctgagcagtggcgcgagattgagactgtcgtcaagtcggccggtcactacgccttcttcgacatggcttaccagggattcgcttcaggtgacatccacaaggacgcttttgcgctgcgccacttcgtcgcccagggtcacaacgtctgcttggcccagtccttcgccaagaacatgggtctgtacggcgagcgcgtcggtgctttctccatcgtgtgcgactcggccgaggagaagaagcgcgttgactcgcagctcaagatcctcgtgcgccccatgtactcgaaccccccaatccacggtgccaggatcgccgcccagatcctcaacaccccggccctctacgaccagtggctggctgaggtcaagggcatggctgaccgcatcattaccatgagggctctgcttaaggagaaccttgagaagctcggcagcaagcacgactggtcccacatcaccagccagattggcatgttcgcctacaccggtctgacccccgagcagatggagcagctcgccaagagccactcggtctacgccaccaaggacggccgtatctcggtcgctggtatcaccagcgagaacgttggccgtcttgctgaggctatcttcaagatcaagggttag

SEQ ID NO: 4735 - protein, 423 aa, Magnaporthe grisea 70-15
MLSTMRIASRQVAGRRMAVRPLAALRPASTWANVQMGPPVRITEAFKADSNNKKINLGVGAYRDDAGKPYVLPSVRQAEEKVIAARMNKEYAGITGVPEFTSGALTLAYGKDSTALDRTAITQSISGTGALRIGAEFLSKFYPGAKNIYIPTPSWANHGAVFTQAGLKVEKYRYYNKDTIGLDFEGLVADVKAAPKGSIFLFHACAHNPTGVDPTPEQWREIETVVKSAGHYAFFDMAYQGFASGDIHKDAFALRHFVAQGHNVCLAQSFAKNMGLYGERVGAFSIVCDSAEEKKRVDSQLKILVRPMYSNPPIHGARIAAQILNTPALYDQWLAEVKGMADRIITMRALLKENLEKLGSKHDWSHITSQIGMFAYTGLTPEQMEQLAKSHSVYATKDGRISVAGITSENVGRLAEAIFKIKG

SEQ ID NO: 4736 - DNA, 1137 bp, Gibberella zeae PH-1
  CDS (1)..(1137)
atgggatcctattcaccaacttcgcggtttaaggaccttgacactatccctcttgacccccattatgcgctcaaagaaacctttcaagccgatccagacccaagaaaggtaatccttgggtcgggtttatatcgcgacgacgattcaaagccttgggtgctcccagtagtcaaaaaggtactctttggtccacaaagcctcaatgaaagtcgtctggtctcaatccaaaccatctcaggaacgggagccaactttcttggggcacgcttcctggctgaaaccctgaagccatctgctgtgtggctttcagaccccagctgggtcaatcatgccaacatttgggggctcgttaatgtcaacgttaaacgatacccttactggaatgcaaagaccaagagtctagacttcaataacatgattgagaagcttcagactgacgctattgctggagatgttatactgctccacgcttgtgctcacaaccccactggtgtcgatcctaacaaggagcaatggagaaagattgctgacgtttgtgaacgaaaacaactttttccgctcttcgactgtgcctaccagggattcgcgacaggaaatcttgatgatgacgcatgggcaattcgccattttattgaccgtggtaccatggaactcgccgtttgccagtctttctccaagaacatgggcttatacggggagcgtgttggcgcattgcacatgttttgcgcaacatctacagacgctgaaaaggttcgtggccatctctgtcgtctccagcgaggtcagatctctcagcctcccacaaacggagcgagaattgcagcaaccatactctcagactccaagttgttccaagattgggtcacagaccttggagaaatgagcagccggatcaaggagatgcgaaaatctctctatgataacctcatgattcttgacacgccaggaaaatgggatcatatcgtttcgcagattggcatgttttcatacacgggattgactccagagcaagttgcttctattcaacaagatagccacgtttacattttgaaatcaggccgtatctcggtcgcaggactcaactctaagaatgttgacaaatcagttgtcgaattcgcaatagttgggatgaagtag

SEQ ID NO: 4737 - protein, 378 aa, Gibberella zeae PH-1
MGSYSPTSRFKDLDTIPLDPHYALKETFQADPDPRKVILGSGLYRDDDSKPWVLPVVKKVLFGPQSLNESRLVSIQTISGTGANFLGARFLAETLKPSAVWLSDPSWVNHANIWGLVNVNVKRYPYWNAKTKSLDFNNMIEKLQTDAIAGDVILLHACAHNPTGVDPNKEQWRKIADVCERKQLFPLFDCAYQGFATGNLDDDAWAIRHFIDRGTMELAVCQSFSKNMGLYGERVGALHMFCATSTDAEKVRGHLCRLQRGQISQPPTNGARIAATILSDSKLFQDWVTDLGEMSSRIKEMRKSLYDNLMILDTPGKWDHIVSQIGMFSYTGLTPEQVASIQQDSHVYILKSGRISVAGLNSKNVDKSVVEFAIVGMK

SEQ ID NO: 4738 - DNA, 1245 bp, Gibberella zeae PH-1
  CDS (1)..(1245)
atggtttctactacaaatttccctgccgaagtcgtgccccaggcacccgaagatcctctctttggtcttgcacgagagtacaaggccgacgacagccccaacaagattgatcttggtattggcgcatacagagacgagaatgcaaagccctgggtgttgcccgtcgtcaagaaggccgatgagatcctccgaaacgaccctgagctcaaccacgagtacgcccccatcgcgggtattgccagcttcacatccaaggctgccgagctagtctttggccccgattcttctgccatccaagacaagcgctcaacaacactacagacaatctctggtaccggtgccgtgcacttgggagctcttttccttgccaagttctacaagggcaaccagactgtctacctctcaaatcccacatgggcgaaccaccaccagatcttcaagaatgttggcatgtcgatcgacacatacccctacttccacaaggagactaagggtctcgattttgaggggttcaagaagactctgcaatccgctcccgagggttccgtctttgtgcttcacgcatgcgcacacaaccctaccggtgtcgaccctacgcaagatcagtggactgagattgcttcaatcatgaaggagaagaaccacttccccttctttgacaccgcctaccaaggatttgcctctggcgatcttgtcaaggatgcatgggccatccgctactttgtcgatcagggctttgagcttgttgttgctcagagtttcgccaagaactttggtctctacggagagcgtgccggttgcttccacgccgtcacatctcccgctcctgaggcttcaaacacaatcactcgcattggctctcaattggctatcctccagcgatcggagatctccaaccctcctctgtacggtgcccgtatcgtcagcactgttctcaacgatcgcgacctcttcgctgagtgggaagagaacctgcgcaccatgtctggccgcatcatcagcatgcgcgacgtcctccgagccaagcttgaagagctcgagacccctggtacctggaaccacatcaccgaccagatcggcatgttcagcttcactggcttgagcgagaagcaagtacttcagcttcgagaagaattccacgtctacatgaccaagaacggtcgtatcagcatggctggtctcaacgaaaacaacgttgagtactttgcaaaggctgttgataaggttgttcgtgacgctgcttag

SEQ ID NO: 4739 - protein, 414 aa, Gibberella zeae PH-1
MVSTTNFPAEVVPQAPEDPLFGLAREYKADDSPNKIDLGIGAYRDENAKPWVLPVVKKADEILRNDPELNHEYAPIAGIASFTSKAAELVFGPDSSAIQDKRSTTLQTISGTGAVHLGALFLAKFYKGNQTVYLSNPTWANHHQIFKNVGMSIDTYPYFHKETKGLDFEGFKKTLQSAPEGSVFVLHACAHNPTGVDPTQDQWTEIASIMKEKNHFPFFDTAYQGFASGDLVKDAWAIRYFVDQGFELVVAQSFAKNFGLYGERAGCFHAVTSPAPEASNTITRIGSQLAILQRSEISNPPLYGARIVSTVLNDRDLFAEWEENLRTMSGRIISMRDVLRAKLEELETPGTWNHITDQIGMFSFTGLSEKQVLQLREEFHVYMTKNGRISMAGLNENNVEYFAKAVDKVVRDAA

SEQ ID NO: 4740 - DNA, 1275 bp, Gibberella zeae PH-1
  CDS (1)..(1275)
atgctgtccaccctccgagtcgccagccgccgggctgcccgccctgcccagtacaacctggctgccattcgcgctgcctccaactgggccaacgtccctcaaggtcctcctgatgccattcttggtatcactgaagccttcaaggccgacaagttcgacaagaagatcaacctgggtgttggtgcctaccgtgacgatgctggcaagccctacgtgctcccttccgttcgtgaggccgagatgaaggtcgtcgagtccaagttgaacaaggagtacgccggcatcactggtgttcctgagttccctcccgccgccgccaagctggcctacggcgccaacagccccgccctggatcgcatcaccatcacccagaccatctctggtaccggtgctctccgtgtcggtgccgctttcctcgccaagttcttccctggcgaaaagaagatctacatcccccagccttcgtgggcaaaccacaaggccgtcttcaaccacgccggcctcgaggttgagcagtaccgctactacgacaagaagaccatcggccttgacttcgagggcttgattgctgatgtcaagtctgcccccaacggcagtgtcttccttttccacgcctgtgctcacaaccccactggtgttgaccctacccaggagcagtggaagcagatctctgacgtcgtcaaggagaagggtcacttcgccttcttcgacatggcttaccagggctttgccagtggtgacaccgacaaggatgctttcgctgttcgctacttcgttgagcagggccacaacattgctctttgccagtctttcgccaagaacatgggtctctatggtgagcgtattggtgccttctccatggtatgtgccgatgccgacgagaagaagcgcgtcgactctcagctcaagattctcattcgacctctgtactccaaccctcccatccacggtgcccgcatcgccgccgagattctgaacagccccactctctacaagcagtggctcggtgaggtcaaggagatggctgaccgcatcatcaccatgcgtgctctcctcaaggataaccttgagaagctcggctccaagcacgactggtctcacatcaccagccagatcggcatgttcgcctacactggtcttacttccgaggagatgactcgcctcgctgaggagttctccgtttatgccaccaaggacggccgtatctctgttgctggtatcacctctgaaaacgttggccgcctcgctgaggccatctacaaggtcaagggttaa

SEQ ID NO: 4741 - protein, 424 aa, Gibberella zeae PH-1
MLSTLRVASRRAARPAQYNLAAIRAASNWANVPQGPPDAILGITEAFKADKFDKKINLGVGAYRDDAGKPYVLPSVREAEMKVVESKLNKEYAGITGVPEFPPAAAKLAYGANSPALDRITITQTISGTGALRVGAAFLAKFFPGEKKIYIPQPSWANHKAVFNHAGLEVEQYRYYDKKTIGLDFEGLIADVKSAPNGSVFLFHACAHNPTGVDPTQEQWKQISDVVKEKGHFAFFDMAYQGFASGDTDKDAFAVRYFVEQGHNIALCQSFAKNMGLYGERIGAFSMVCADADEKKRVDSQLKILIRPLYSNPPIHGARIAAEILNSPTLYKQWLGEVKEMADRIITMRALLKDNLEKLGSKHDWSHITSQIGMFAYTGLTSEEMTRLAEEFSVYATKDGRISVAGITSENVGRLAEAIYKVKG

SEQ ID NO: 4742 - DNA, 1272 bp, Gibberella zeae PH-1
  CDS (1)..(1272)
atgtcgtgcttctcatccctgccaccacagcctacagacgagatctttgatcttctcggtgcttacaggaaagactctaaccctgaccgcgtcaacctcggtgtcggcgtctactgcaccgacgaaggcaaatcctggcctcttgacgttgtcacccgcgtggagaaggatctcttcgaagaggctagcttgaccagacacgattatcttcccatcgagggagaccagcagttcctcaagcttgcgagggatcttgtttttgcccatcaggatgagttgagcgtcgcttccgtacagaccgtctccggaaccggagcgaaccatatcggtgctcgtttcgtcgcggattaccttcgaccgcaaaatatctgggtgtcggaccctacctgggcgaaccaccacatgatctgggagtctgttggactcaagcccaagctgtatccctactacaaaaagtcggattgttcgttggactttgagggtatgatcaagactcttgaggaagaagctcaacctcgcgatgccgtcttgttgcacgcatgtgcacacaaccctaccggtcttgatcccacaaaggagcagtggaagatcatcgctgaggtctgtcagcgaaagcaactgttcccctttttcgacgccgcctaccaaggcttcgcatccggcagtcccgcggaagacgcctgggccatccgctacttttaccaacagcagccacgacctgacatgattgtcgcgcaatccttttccaagaactttggtctttacggtcatagaacaggagcaattcatttggtgcttgcggagccctccaaggagatcagggacaacgcttactccaccctttcgtatcttttgcgatctgaaatctccatggctcccaagtatggttctacaattgtcaagacggttttggatagtgaggagttgactgctgcttggatggctgatttgcaagtcatgagcagtcgtatcaagagcatgcgccaggctctgtatgatgagttggtgcgcttggagacacctggcacatggaaccacatcattgaccagattggcatgttctcatacactggcttgaccccctttgaggtaaaggtccttcgggagcgcttccacatctacctgctcaagtcgggacgtatttccatttctggcttgaacaagagaaatgtcaactacgttgccaaggccatccacgatgtccgagtaaatggccatgagctcaatggcaccaacggaacaaatggaacaaacggtgtcaacggacactag

SEQ ID NO: 4743 - protein, 423 aa, Gibberella zeae PH-1
MSCFSSLPPQPTDEIFDLLGAYRKDSNPDRVNLGVGVYCTDEGKSWPLDVVTRVEKDLFEEASLTRHDYLPIEGDQQFLKLARDLVFAHQDELSVASVQTVSGTGANHIGARFVADYLRPQNIWVSDPTWANHHMIWESVGLKPKLYPYYKKSDCSLDFEGMIKTLEEEAQPRDAVLLHACAHNPTGLDPTKEQWKIIAEVCQRKQLFPFFDAAYQGFASGSPAEDAWAIRYFYQQQPRPDMIVAQSFSKNFGLYGHRTGAIHLVLAEPSKEIRDNAYSTLSYLLRSEISMAPKYGSTIVKTVLDSEELTAAWMADLQVMSSRIKSMRQALYDELVRLETPGTWNHIIDQIGMFSYTGLTPFEVKVLRERFHIYLLKSGRISISGLNKRNVNYVAKAIHDVRVNGHELNGTNGTNGTNGVNGH

SEQ ID NO: 4744 - DNA, 1257 bp, Candida glabrata CBS 138
  CDS (1)..(1257)
atgtctgccaccatatttaacaacatcgaagaacttcctgctgatgcccttttcggtatcaagcaaaggtacaatcaagataccagagccaccagagttgacttgggtattggtgcgtaccgtgatgaccaaggcaaaccatgggtgttgccttcggttagaatggctgaaagggcaatccaagaggatccaagctacaatcatgaatacttgggtatcaatggtcttccaagtttgtcttccgctgctgctaatgttatatttggtgaagactccccagctttgaaagaaggcagaaccatctcagttcaatctttgtctggtacaggtgctttgcacattgctgccaagtttatctctaagttcgctgctgacaagaagatttatttgtctcagccaacttgggctaaccacaacgccatcttcaaggcacaaggtttagagactgcttcttatccatactggaagagttctaccaagtcccttgacttggaaggtttcatctcagccatcgaaagtgcgccaaagggttctatattcctgctgcatgcatgtgcacacaacccaactggtttggacccatctgagaagcaatggcccgttatcctggatgctctggtcaagggcgatcacttggccttattcgactccgcttaccaaggttttgcctccggtgacttggacaaggacgcctttgctgtgcgtttgggtgtcgaaaagttggcctccacttcaccaatctttgtatgccagtctttcgccaagaacgtcggtatgtatggtgaaagagtcggttgtttccacttgatcctacctaagcagaatgccaatctcgcaccaatcaagtctgctatcacatctcaaatatctagtattatcagaagtgaagtgtccaactccccagcttatggtgccaagatcgtttctaagattttgaacacaccagagcttactaagcaatggcacgaagacatggttaccatgtcatctagaatcaaggagatgagaatcgcattgagagaccatctagttaagttgggaactccaggtacttgggaccacatcgtcgagcaatgcggtatgttctctttcacaggcttgaccccagagatggttaagagactggaggtccagcacgctgtctacttggtctccagtggtagagcctctattgccggcctaaactccggcaacgttgagtacaccgcaaaggccatcgacgaagtagtccgtcactactcaacttccaagttgtga

SEQ ID NO: 4745 - protein, 418 aa, Candida glabrata CBS 138
MSATIFNNIEELPADALFGIKQRYNQDTRATRVDLGIGAYRDDQGKPWVLPSVRMAERAIQEDPSYNHEYLGINGLPSLSSAAANVIFGEDSPALKEGRTISVQSLSGTGALHIAAKFISKFAADKKIYLSQPTWANHNAIFKAQGLETASYPYWKSSTKSLDLEGFISAIESAPKGSIFLLHACAHNPTGLDPSEKQWPVILDALVKGDHLALFDSAYQGFASGDLDKDAFAVRLGVEKLASTSPIFVCQSFAKNVGMYGERVGCFHLILPKQNANLAPIKSAITSQISSIIRSEVSNSPAYGAKIVSKILNTPELTKQWHEDMVTMSSRIKEMRIALRDHLVKLGTPGTWDHIVEQCGMFSFTGLTPEMVKRLEVQHAVYLVSSGRASIAGLNSGNVEYTAKAIDEVVRHYSTSKL

SEQ ID NO: 4746 - DNA, 1260 bp, Candida glabrata CBS 138
  CDS (1)..(1260)
atggtaaaaatttcagctacggtgtacaacgatgtcgaaccgatcaagaccgacatattatttgcaacaaagcaaaggtacttgaaggataccagaggtttcaaagttgatttgggtgttggagcatatcgcgctgacaatggtaagccatggattcttccctcggtacgtaaggctgaaaggttggtacaagaggaagatgattatgaccacgaatatctaaatatttgtggtcttgacagtttaacaaacagcgctgctaaagttatacttggggaggattgtccagcattgagagaaagtagggttatctctgtacaatctctgtcaggtgcaggtgccttacatgtggctgctaaatttattaaaaagtacacacctgaaaagaaaatttacttgtcaaacccaacttggcctattcatcagtcaatatttgaaaatgtggatttagagactgattcctacccatattgggatgctaccaataaaagcttggattttgagggtttcataaaggcaattgatcatgccccaagaggatccatatttgttctgcatgcttgtgcacacaacccaacgggacttgatccaacgcaagagcaatggcatcaaattattgaatccattcagaaaggtgatcacatcccactatttgactctgcttatcaaggctttgcgtccggcgatcttgaaagagatgcatatgctatacgctacaccataaatcaattaagagactgtgcacctatatttgtagcacaatcatttgctaaaaatgttggaatgtatggtgagagagttggttgtctgcacttagttctaccggcgcagaaggaggatattgtaccaataaaggatgctataacctcccaactttcgagaattatcagaagtgaaatttcaactccaccagcatacggtgctaaggttgtatcaaaaatatttactacaccagaactgaaggagcaatggtatcaagatttggtgaccatgtcaagtagaatcatatcggttaggacacgtttacgtgacctattagctgagtacaatacacctggaaactgggatcatattgttcagcagtgtggtatgttctcatttacaggactaactcctgagatgaccaagcgattggaaactgaacatgcagtttatatggtgcctactggtagggcatctgttgcaggcctaaatactgggaatgtacaacatgttgctaaggctataaatgaagtggttaatcactttatgaaagattag

SEQ ID NO: 4747 - protein, 419 aa, Candida glabrata CBS 138
MVKISATVYNDVEPIKTDILFATKQRYLKDTRGFKVDLGVGAYRADNGKPWILPSVRKAERLVQEEDDYDHEYLNICGLDSLTNSAAKVILGEDCPALRESRVISVQSLSGAGALHVAAKFIKKYTPEKKIYLSNPTWPIHQSIFENVDLETDSYPYWDATNKSLDFEGFIKAIDHAPRGSIFVLHACAHNPTGLDPTQEQWHQIIESIQKGDHIPLFDSAYQGFASGDLERDAYAIRYTINQLRDCAPIFVAQSFAKNVGMYGERVGCLHLVLPAQKEDIVPIKDAITSQLSRIIRSEISTPPAYGAKVVSKIFTTPELKEQWYQDLVTMSSRIISVRTRLRDLLAEYNTPGNWDHIVQQCGMFSFTGLTPEMTKRLETEHAVYMVPTGRASVAGLNTGNVQHVAKAINEVVNHFMKD

SEQ ID NO: 4748 - DNA, 1362 bp, Candida glabrata CBS 138
  CDS (1)..(1362)
atgactctgaactacgcgagtgtgcaatgtgtgctgaggatgcgaagcgccgtgatgttaggccgcaggcggttgtcgcggaaagcattaaaacaaagtactttatttgatatccccatggcgccaccggatggtgttttggggctgacggaaactttcaatgcagacgagaacccaaataagattaatttgacagttggggtatataaagatggatggggtcaggtgacaaccttcccttcagtggctcaagctcaaaagattatagacatggatgtgggaatgaacactgatctatcatatttaccgataagtgggtgtgaggatttcaagaagcatacaattaattttctgtatagggacagctgcccgcaagacggccctgcattgattaagaatgatcgaatcagttttatacaaacgctaagtggaactggtgcattagctgtcgcatctaggcttttatcatcttttatttcgagaaagatatggatacccaaaccgtcttggcctaatcacaccaatatatttacccaaaacggttttaccaatcctagattttatagctactatgacagaggcgatttgacgattggaagatggttacaggaattgaggcatgaagttggtaaagactcaaataccaaaacaccacattgtattgttttacatgcctgctgccataatccgaccggccttgatccgacaaaaaagcaatgggaggatataatggatactatttatgaattaggaatgattccaattatagacatggcataccaaggtttagaatcgggcaagctgatagatgacgcatatttactaagactatgtctggacaccagcaggtacaggtcctgggataacggtctatatctgtgccaatcttttgccaaaaacatgggattgtatggagaaagagttggatctttaagtattgtggcacctgaacatgttcctggtgtgaaagaggtcctggactcacaacttaaacagattatcagaagtatgtattcctcccctcctggatatggttcaagagtcgctaaattagtcttatcgaatgataagctcaagtatcaatggtattctgatgttgagacaatggtgaatagactaaaatcggtgagggaaatgatacatgagaggttacaatgggaagagatagttaattttgagcaacaacatggtatgttctatttcacaaaattaggacctgatattgtaaaaaaactcagggaacaatactctatatatttaacgaacgatggcagaatgtccttaagtggcgttaataagagcaatgttgactacttatgcaattccatcaaggctgtgacatctagtaaaacattactgtaa

SEQ ID NO: 4749 - protein, 453 aa, Candida glabrata CBS 138
MTLNYASVQCVLRMRSAVMLGRRRLSRKALKQSTLFDIPMAPPDGVLGLTETFNADENPNKINLTVGVYKDGWGQVTTFPSVAQAQKIIDMDVGMNTDLSYLPISGCEDFKKHTINFLYRDSCPQDGPALIKNDRISFIQTLSGTGALAVASRLLSSFISRKIWIPKPSWPNHTNIFTQNGFTNPRFYSYYDRGDLTIGRWLQELRHEVGKDSNTKTPHCIVLHACCHNPTGLDPTKKQWEDIMDTIYELGMIPIIDMAYQGLESGKLIDDAYLLRLCLDTSRYRSWDNGLYLCQSFAKNMGLYGERVGSLSIVAPEHVPGVKEVLDSQLKQIIRSMYSSPPGYGSRVAKLVLSNDKLKYQWYSDVETMVNRLKSVREMIHERLQWEEIVNFEQQHGMFYFTKLGPDIVKKLREQYSIYLTNDGRMSLSGVNKSNVDYLCNSIKAVTSSKTLL

SEQ ID NO: 4750 - DNA, 1257 bp, Kluyveromyces lactis NRRL Y-1140
  CDS (1)..(1257)
atgagaataccaacgcgaagagggctgtcggccttgtcaagagtaactagggctcctgctgataagattctaggtttaacagagaagtttaacgttgacagacatccaaacaagataaatctgaccgttgggatctataaggacaaccggggccgtgtgaccaccttccctagtgtagcttctgcccaatcattacttgagacgagtctcgatctgaataatgatttatcgtatttgcctatcactgggtcgcaggattaccaaaacaatgtgttaaatttcttgtatcgagagtcaagtgacgggagtgaattattggagaacaacagaatcacgtttgtgcaaactttgagtggtaccggtgcattagctgtagcttcaaaactcttggcaacgtttgtgtcgaaaaccgtatggataccaaatccatcttgggctaatcattcgaacgttttccaatggaacggattcaatcagatcaaatattatacgtactacgaggatgggaaattgagtatcgataaatggctcaaggaactcaaggagagttgtagttctagggaccccgactggcccccctctatagtgttacacgcttgctgtcataatccaacaggagtggaccctacgttggaacaatggcaacagatattgccagtgatccatgatttaggaataactcccataatagacatggcgtaccaaggaatggaatcagggaaccttatacaggatgcttatctattaagaatgtgtctagaatacgaatggcccaacggtctatttgtgtgccaatcgtttgctaagaacatgggcttatacggtgaacgtgtaggttcgttaagtgtcgttgtcccaccaaatcccttggatctcaaatcaaccatcgactctcaactaaagaagattgtaagaggtatatactcttctccaccgggatatgggtctcgtgtagcgaacttggtgctaagcaatccaaaattgaagcagcaatggttcgtagacgttaagaatatgtctgatagactatggaacgttagaattcaaatgcatgagagattgaattggcccaatcttgttgattttaaaacacaacatgggatgttttattacacagggttaaacccatatcaggttcaaattctgcaggagaggtacggtatttatttaactgaagacggcaggatgtcgttatctggagttaacgacggtaatattgattatttatgcgattctttgcgccaagtggttcaataa

SEQ ID NO: 4751 - protein, 418 aa, Kluyveromyces lactis NRRL Y-1140
MRIPTRRGLSALSRVTRAPADKILGLTEKFNVDRHPNKINLTVGIYKDNRGRVTTFPSVASAQSLLETSLDLNNDLSYLPITGSQDYQNNVLNFLYRESSDGSELLENNRITFVQTLSGTGALAVASKLLATFVSKTVWIPNPSWANHSNVFQWNGFNQIKYYTYYEDGKLSIDKWLKELKESCSSRDPDWPPSIVLHACCHNPTGVDPTLEQWQQILPVIHDLGITPIIDMAYQGMESGNLIQDAYLLRMCLEYEWPNGLFVCQSFAKNMGLYGERVGSLSVVVPPNPLDLKSTIDSQLKKIVRGIYSSPPGYGSRVANLVLSNPKLKQQWFVDVKNMSDRLWNVRIQMHERLNWPNLVDFKTQHGMFYYTGLNPYQVQILQERYGIYLTEDGRMSLSGVNDGNIDYLCDSLRQVVQ

SEQ ID NO: 4752 - DNA, 1266 bp, Kluyveromyces lactis NRRL Y-1140
  CDS (1)..(1266)
atgtccagaaccatacttaacaacatccaagaattgccaggcgatgctttattcgctatcaaacaacgtttagctgaagaccctagatctgctaaggtcgatttgggtattggtgcctatagagatgaggatggtaaaccatgggtattaccagctgttcgtaaagctgaaacattgatccattctgacgcatctttcaaccatgaatatttgggtattgccggtttacctgctttgacttcaggtgcagccaaagtgatcttgggcgatgattcatctgctttggctgagaaaagagttgtttctgctcagtctctatccggtactggtgccttacacattgcagctaaattcatccaaaagttcttacctgggaagttgttgtatgtttctgatccaacctgggctaaccatgtctctatctttgagtcacaaggtgtcaaaactgctacgtatccttactgggatgctgctaccaaatctttggatttggaaggatttatcaaggctatagaatcaagtccaagaggctccgtgttcttgcttcatgcttgtgctcataatccaactggtttggatccaaccgaagctcaatgggagaaaattctcagtgcctgtgtgaagaatgatatcatcccattgttcgactctgcctaccagggtttcgcatctggtagtctaacgaatgatgcttttgccgtcagacttggtgtgaagaaattcgctgaatctgctccaattttcatctgtcaatcatttgccaagaatgttggtatgtacggtgaacgttgtggatgcattcatttgattgttccaagacaagaatctaacgttaatgtttccactattaccaaagctgttgcatctcaaatcagtaaaatcaccagatcagaggtttctaaccctcctgcttacggtgccaagatcgttgccaaaattttgaacaatgctgaattgactgaacaatggcataaggatatggttacaatgtctcaaagaatcaccaaaatgagacactccttacgtgacaagttactcgagttacagactccaggtaactgggatcacatcgtcaaccaatgtggtatgttctcttacaccggtttaacaaagccaatggtggaaagattagaaaaagaacatggtgtatacatggttgctagtggtagagcttccattgctgggttgaatgaaaagaacgttgaacatgtggctaaggctattaatgaagtcgttcgtcatttcaatgaatcatccaaattataa

SEQ ID NO: 4753 - protein, 421 aa, Kluyveromyces lactis NRRL Y-1140
MSRTILNNIQELPGDALFAIKQRLAEDPRSAKVDLGIGAYRDEDGKPWVLPAVRKAETLIHSDASFNHEYLGIAGLPALTSGAAKVILGDDSSALAEKRVVSAQSLSGTGALHIAAKFIQKFLPGKLLYVSDPTWANHVSIFESQGVKTATYPYWDAATKSLDLEGFIKAIESSPRGSVFLLHACAHNPTGLDPTEAQWEKILSACVKNDIIPLFDSAYQGFASGSLTNDAFAVRLGVKKFAESAPIFICQSFAKNVGMYGERCGCIHLIVPRQESNVNVSTITKAVASQISKITRSEVSNPPAYGAKIVAKILNNAELTEQWHKDMVTMSQRITKMRHSLRDKLLELQTPGNWDHIVNQCGMFSYTGLTKPMVERLEKEHGVYMVASGRASIAGLNEKNVEHVAKAINEVVRHFNESSKL

SEQ ID NO: 4754 - DNA, 1212 bp, Debaryomyces hansenii CBS767
  CDS (1)..(1212)
atggtacaatacgaatttttcggagatttaactctagctcccaaagatgaaatgaatgatcttaagataaaacttgaaaattgtcaatccagtaaggttgatgtttccgcaggagtatatagaggggagaatggtgagtcgtatacattatcatcagtaaaagcagctaaaggagtattacatgcaaatgatcccgggcatgactataattttaccctaggtatcaaaaacttcaacctgatggctgctgatatcatatttgggaaagatatttctactggtggatatattgctacatgtcaaacaatatctggaaccggtgcttgcagtatagctattaaatttctagtggactgctgcaaacttaccaatttctatattggaacaccaacttggcccaattacgctccaatgattaaagcagccaatgctgaagtcgtggaatatgttcattacaatccgttgacaagaagtcttgattttgaaagcgttttagaagccatttctaaagctaagatgcattcagtattcatcctacaattatgttgtcataatcccaccggtactgatttttcaatagatcagtggaaaattttggctgataaaatgcaagaaaaaaaaatcatgccagtgtttgattctgcctatcaagggtttggttcaggtgacattgcggtggacgcaaaacctattagattatactatgctaaaggattgcaatttttggtctgtcaatcattctccaaaaacttggggttatatagcgaaagggttggtgcacttcacgtcgtagtatgtgaaaaaaaattagctgaaattgtctctgatcaattaagaagtatattcagaagagagtgttcaagtgcgccagcttatggggctaggttggctgtcattatagcaaacgacccaaaattaactgaacaatggagaaacgatttaagaacaatctataagagactagttgataaaagaattgagcttcatgatttattgataaagtatcaaactccaggcagcttcgatcatttgttaaatcagaatggtttattttggttcagtggtttgtctaaggtccaatgtaaattattggttgaagaatatcatatctttattccttcgaatggtcgcgttaatatagccggtttaaataatagtaatattcattactttgcgaaatcattttccgaagtaatcaagatctcagtatag

SEQ ID NO: 4755 - protein, 403 aa, Debaryomyces hansenii CBS767
MVQYEFFGDLTLAPKDEMNDLKIKLENCQSSKVDVSAGVYRGENGESYTLSSVKAAKGVLHANDPGHDYNFTLGIKNFNLMAADIIFGKDISTGGYIATCQTISGTGACSIAIKFLVDCCKLTNFYIGTPTWPNYAPMIKAANAEVVEYVHYNPLTRSLDFESVLEAISKAKMHSVFILQLCCHNPTGTDFSIDQWKILADKMQEKKIMPVFDSAYQGFGSGDIAVDAKPIRLYYAKGLQFLVCQSFSKNLGLYSERVGALHVVVCEKKLAEIVSDQLRSIFRRECSSAPAYGARLAVIIANDPKLTEQWRNDLRTIYKRLVDKRIELHDLLIKYQTPGSFDHLLNQNGLFWFSGLSKVQCKLLVEEYHIFIPSNGRVNIAGLNNSNIHYFAKSFSEVIKISV

SEQ ID NO: 4756 - DNA, 1221 bp, Debaryomyces hansenii CBS767
  CDS (1)..(1221)
ttgaaaatgacaatcaaaagtaatttttctaatttaacgagagaagcaccagatccaatcgtggaaaccatgaccatgtatgcacaagatacttctccagataagattgatgtatcgataggtgtatacaaaggagagaagggagagtcatatgtttttcctgcggtgtctaaggctaagaagcacttatttgaaaatgatccgggacatagctataccaatatggcaggtattccagaatatacgagcggagcacgtaaggttgtgtttggagaaaaatatggtaccgaaggaaagattgcatcgttacagactatttcagggacaggggcttgccatatggcatttcttcttcttcgtgaagcggggctcactaacttctatgttggtacaccatgttggtcgaactatgggccaatgattacgcatgttggctcaaaatactccacatacactcactatgacgaaagtctccgtgggattgattttgatgctgttcttgaggcacttcagaatgcaccatcaaaatctgtattcttatttcaagcgtgttgtcataaccctacaggagcggatttttccaaagatcagtggaagcaaattgcttcaattgttaagtccagagatatcttccctgtttttgatattgcataccaaggattttcaagcggcgataaggatgttgatgcctggcctgtgaggtatttctacgagcaaaatttagaatttttagtttgccaatcattctccaagaacatgggattatacagtgaaagagcaggatgtcttcatgctgtggtacaagatacggattacgttccaaacgtgcaaagtcaacttgtggcactctttagatcggagtgctcttttgctccagcatatggtgcaagaattgccagtattatcatcaacgagcctggattagaaaatcagtggggccaagaagtttccgatgtgaccacaagattgaagaatattagaaagcagattttggataaatttctcgaattaggtactcctggtaagtgggatcatgtagtaaagcagcaagggttgttttggtattctggattatcacccgaacaaaacgataagcttatagaagaccatcatatttattcaacttcaattggcagagttaatattgccgggttaaatgaaagtagtgttgataaatttgttggcgccattgacaaggttgtcagagattctattggttaa

SEQ ID NO: 4757 - protein, 406 aa, Debaryomyces hansenii CBS767
LKMTIKSNFSNLTREAPDPIVETMTMYAQDTSPDKIDVSIGVYKGEKGESYVFPAVSKAKKHLFENDPGHSYTNMAGIPEYTSGARKVVFGEKYGTEGKIASLQTISGTGACHMAFLLLREAGLTNFYVGTPCWSNYGPMITHVGSKYSTYTHYDESLRGIDFDAVLEALQNAPSKSVFLFQACCHNPTGADFSKDQWKQIASIVKSRDIFPVFDIAYQGFSSGDKDVDAWPVRYFYEQNLEFLVCQSFSKNMGLYSERAGCLHAVVQDTDYVPNVQSQLVALFRSECSFAPAYGARIASIIINEPGLENQWGQEVSDVTTRLKNIRKQILDKFLELGTPGKWDHVVKQQGLFWYSGLSPEQNDKLIEDHHIYSTSIGRVNIAGLNESSVDKFVGAIDKVVRDSIG

SEQ ID NO: 4758 - DNA, 1296 bp, Debaryomyces hansenii CBS767
  CDS (1)..(1296)
atgttatcaagggtacaattaaagcgcataccaaattgcagacagttttctgtgatgaacagggcttgcaaatggaacgatattccattagcaccaccggataaaatcttgggtatcagcgaagcatttgttaaggattccaacaccaagaaaatcaatttgggagttggtgcatacagaaacaactctggtaagccaattgtgttcgaatcggtcaaaaatgctgaggccaagttattagaaacagaaaccgaaaaggaatacactggtattatcggtaacaagaacttccaaaaagtggtcagaaactttattttcaacaacagcggtaaggacgccaatggggccagattgattgacgaaaacagaatcgtcaccagtcaaaccatttctggtaccggttctttgagggttattgctgatttcttacacagattcaacacggccaagaaaatatacgtgccaaagccaacctgggccaaccacattgctgttttcactgatgctggtatgagtaccgaatactacgattactacaataaggaaatcaacaacttggactacgataagttgaagcaatcgttgtctaacgccgaagaaggttctgtggtcttgttgcacgcttgttgccacaaccctactggtatggacttgtcatccgaacaatgggacgaagtcttagccatcgtccaacaaaagcaattgttcccattagttgatatggcctaccagggtttcgcgtccggtaacccatacaaggacattggattgattcgtagattgaacgagttagtcgtcaacggtgacatttccacctacgctttatgtcaatctttcgctaagaacatgggtttgtacggtgaaagaactggttctatctccattgtcaccgaatctgctgaacattccactgcgattgagtcccaattgaagaagttaatcagaccaatctactcgtcgcctccaatccacggttccaagattgtggaaaccatcttcgccgacgaatccttgtacaactcttggttaagtgacttggaccaagttgtttccagattaaacaccgtcagaaccaagttatacgagaaattggacaagtccaactacaactgggaccacttattaaaacaaagaggtatgttcgtttacactggtttatcagctgaacaagttattgaattgagagaaaagtactctgtttacgctactgaagacggtagattctccatttctggtatcaacgacaacaacgttgattacttggccgatgccatgaaccaagttgttaacaaataa

SEQ ID NO: 4759 - protein, 431 aa, Debaryomyces hansenii CBS767
MLSRVQLKRIPNCRQFSVMNRACKWNDIPLAPPDKILGISEAFVKDSNTKKINLGVGAYRNNSGKPIVFESVKNAEAKLLETETEKEYTGIIGNKNFQKVVRNFIFNNSGKDANGARLIDENRIVTSQTISGTGSLRVIADFLHRFNTAKKIYVPKPTWANHIAVFTDAGMSTEYYDYYNKEINNLDYDKLKQSLSNAEEGSVVLLHACCHNPTGMDLSSEQWDEVLAIVQQKQLFPLVDMAYQGFASGNPYKDIGLIRRLNELVVNGDISTYALCQSFAKNMGLYGERTGSISIVTESAEHSTAIESQLKKLIRPIYSSPPIHGSKIVETIFADESLYNSWLSDLDQVVSRLNTVRTKLYEKLDKSNYNWDHLLKQRGMFVYTGLSAEQVIELREKYSVYATEDGRFSISGINDNNVDYLADAMNQVVNK

SEQ ID NO: 4760 - DNA, 1263 bp, Debaryomyces hansenii CBS767
  CDS (1)..(1263)
atgtcaaaatatttttcaagtattaaagaattacctccagatccattatttgggttgaaagctagatacacggccgatgaccgttcagataaagtagatttgggaatcggtgcttatagagataataacgggaagccatggatattaccagcggttagaaaggcagaagtgaagttggttaactcggaagaatacaaccacgagtatttatcgatttcggggtatcagccatttttgaccgagagtgctaaagttattttgggaaacaactcagctgccatcaaggaatcaagagtgaccagtcaacaatcgttgtctggtaccggggctttgcacttggctggagcctttttgaaggaatttttcaccactgaatcgaagaaagctccaacggtgtacttatcgaatcctacgtgggccaaccataaccaaattttcactagtttgggtttgcaggtagagaagtatccatactgggacaatgataccaaatcattgaacttgaaggggttcttgtcgactattcaagaagcacctaagaactcgatttttgtgttgcatgcgtgtgcccataatcctactggactcgatgccaccaaggagcaatgggaggaaattctcgaagcattggccaagaatgaacacttagcattatacgactctgcctaccaagggttcgctagtggtaacttggataacgatgggtttgctgtaagattggctgtcgactcgaagaagttgaaaaccccaattgttatctgtcaatcttttgcaaagaattgtggtatgtacggtgaaagagttggtgcaattcacgtcatcccagccgagaatgataagtcgttgaacaacgctataaagtcgcaattgaacaagctcaccaggtcggaaatttctaatcccccagcgtacggagccaaggttgttgcaaccattttgaccgactcagaattgagacagcaatgggaagacgacttggtcaccatgagttcgagaatcaacaaaatgagaaccaggttgagagatttgttgacaaaccaatacagcactcctggcaactgggatcacattgtctcccaatcaggtatgttctcgttcacaggattgaccccagatatggtgtccagattggaaaagaaccacggaatctacttggttagctccggtagagcctccgttgctggtttgaatgatggcaacgtcgaacaggtcgctaaggctatcgacgaagttgttcgtttctactccaagtccaagttataa

SEQ ID NO: 4761 - protein, 420 aa, Debaryomyces hansenii CBS767
MSKYFSSIKELPPDPLFGLKARYTADDRSDKVDLGIGAYRDNNGKPWILPAVRKAEVKLVNSEEYNHEYLSISGYQPFLTESAKVILGNNSAAIKESRVTSQQSLSGTGALHLAGAFLKEFFTTESKKAPTVYLSNPTWANHNQIFTSLGLQVEKYPYWDNDTKSLNLKGFLSTIQEAPKNSIFVLHACAHNPTGLDATKEQWEEILEALAKNEHLALYDSAYQGFASGNLDNDGFAVRLAVDSKKLKTPIVICQSFAKNCGMYGERVGAIHVIPAENDKSLNNAIKSQLNKLTRSEISNPPAYGAKVVATILTDSELRQQWEDDLVTMSSRINKMRTRLRDLLTNQYSTPGNWDHIVSQSGMFSFTGLTPDMVSRLEKNHGIYLVSSGRASVAGLNDGNVEQVAKAIDEVVRFYSKSKL

SEQ ID NO: 4762 - DNA, 1302 bp, Yarrowia lipolytica CLIB122
  CDS (1)..(1302)
atgctccgaaccatcgcccgaacccacgctgtggccgccaccaaggtcgtgcgagcctccactttttctgccacccccgccgcctcttttgtgcgattccagtccgtctgggccaaggtcccccagggtccccccgacgccattctcggaatcaccgaggcgttcaagaaggacgcctttgagcagaagatcaacctcggtgttggcgcctaccgagatgacggcggaaagcccttcgttcttccctccgtccgagaggccgagaaggaggtggtgaacaaggccctcgacaaggagtacgcccccatcaccggagtccccgccttcaccaaggctgctgccgagctcgcttacggcgccgactcccccgccgtcctcgaggaccgaattgccatcacccagaccatctccggtaccggtgctctgcgaatcggagccgagttcctcaacaagttctactcctccaagaagattctgctcccccagccttcttgggctaaccacaaggccgttttcaccgccgccggcctcgagcccgccacctaccggtactacgaccccaagaacattgccctcgactttgagggtctgctcgccgacctggaggctgcccccaacggaaccgccgtccttctgcacgcctgtgcccacaaccccaccggtgttgaccccactcccgagcagtggcgaaagattgaggaggtcgtcaaggccaagggccacttccccttcttcgacatggcctaccagggctttgccaccggtgacgtcaaccgagacgcctaccccatccgatactttgtcgagcagggccacgaggttgctctgtgccagtccttcgccaagaacatgggtctttacggtgagcgagtcggtgctttctctcttgtctgccaggacaccgccgagaagaaccgagttgactctcagctgaagattatcatccgacccttctactccaacccccccgtccacggtgcccgaatcgccgccaccatcctcaacaaccccgagctcaagaagcagtggctcggtgaggtcaagcagatggccgaccgaatgatcaagatgcgagctctgctcaaggagaacctcgagagacttggctcccagcagaactgggaccacgtcacctctcagattggtatgttctgctacaccggtctgtctcctgagcaggttgagcgacttgccaaggagttctccgtctacggaaccaaggacggccgaatctccattgccggaatcacctctcagaacgtcggccgactggcccaggctatctacgaggtgaccaaatag

SEQ ID NO: 4763 - protein, 433 aa, Yarrowia lipolytica CLIB122
MLRTIARTHAVAATKVVRASTFSATPAASFVRFQSVWAKVPQGPPDAILGITEAFKKDAFEQKINLGVGAYRDDGGKPFVLPSVREAEKEVVNKALDKEYAPITGVPAFTKAAAELAYGADSPAVLEDRIAITQTISGTGALRIGAEFLNKFYSSKKILLPQPSWANHKAVFTAAGLEPATYRYYDPKNIALDFEGLLADLEAAPNGTAVLLHACAHNPTGVDPTPEQWRKIEEVVKAKGHFPFFDMAYQGFATGDVNRDAYPIRYFVEQGHEVALCQSFAKNMGLYGERVGAFSLVCQDTAEKNRVDSQLKIIIRPFYSNPPVHGARIAATILNNPELKKQWLGEVKQMADRMIKMRALLKENLERLGSQQNWDHVTSQIGMFCYTGLSPEQVERLAKEFSVYGTKDGRISIAGITSQNVGRLAQAIYEVTK

SEQ ID NO: 4764 - DNA, 1296 bp, Yarrowia lipolytica CLIB122
  CDS (1)..(1296)
atgtcatactttgcatcagtccccgcagctcccgcagatgcccttttcggcctcatggccaagtacaaggccgataccttcgacaagaaggtcgacctcggagtcggagcctaccgagataacaccggaaaaccctgggtcctccctgtcgtctccaaggtcgattctctgattgtcgccgaccccactgccaaccacgagtacctccccatcactggtctgccagacttcaccaagtctgccgccaagctgattctggggcctgactctcctgccatcaaggagaaccgagttgcctcttgccagacaatctctggaactggagcaaaccatctgggatctctcttcctgtcgcggttcccctcctccgccgctccccccaagagcgtcttcctcagccgttctcccccttcccctggagcaaccggagatactcctccccgagctgctggcggccgaatctggatctccaaccccacctgggccaaccacaagcagatcttcgagaacgtcggtctgaccgttaagcagtacccctactgggaccccaagactctaggtctggacctcaagggcatgctcaacgctctggagaatgagacccgacccggagacattgttctgttgcacgcctgcgcacacaaccccaccggtgttgaccctgctcgagaggagtgggagaagattgccgctgtctgcaagtccaagaagctcttccccttcttcgactctgcctaccagggctttgcctccggtgatctcgagcgagacgcctgggcagtccagtactttgtttcccagggcctggagctgctcatctgccagtccttcgcaaagaactttggcctgtacggccagcgggccggatgcctgcacttcatcacccagaccgccaaggcgtcggagaacgtcaagtcacagcttgccttcctgcagcgatcagaaatctccaaccctcccatctacggtgcccgaattgtggcccgagttcttaacaaccccgagctcttcaatgagtggaaggaaaacctgctggagatggccaaccgaatcaagagcatgcgagatgcgctcaagagcgaactcatcaagcttgatactcccggtaactgggaccatatcactaaccagattggtatgttctctttcaccggtctgtcgccccagcaggtggaccgactggttaacgagttccacgtttacctgaccaagaacggccgaatttccatggctggtcttaacacacacaacgtcgcttacgtcgccaaggcctttgatgccgtcgttcgaggttaa

SEQ ID NO: 4765 - protein, 431 aa, Yarrowia lipolytica CLIB122
MSYFASVPAAPADALFGLMAKYKADTFDKKVDLGVGAYRDNTGKPWVLPVVSKVDSLIVADPTANHEYLPITGLPDFTKSAAKLILGPDSPAIKENRVASCQTISGTGANHLGSLFLSRFPSSAAPPKSVFLSRSPPSPGATGDTPPRAAGGRIWISNPTWANHKQIFENVGLTVKQYPYWDPKTLGLDLKGMLNALENETRPGDIVLLHACAHNPTGVDPAREEWEKIAAVCKSKKLFPFFDSAYQGFASGDLERDAWAVQYFVSQGLELLICQSFAKNFGLYGQRAGCLHFITQTAKASENVKSQLAFLQRSEISNPPIYGARIVARVLNNPELFNEWKENLLEMANRIKSMRDALKSELIKLDTPGNWDHITNQIGMFSFTGLSPQQVDRLVNEFHVYLTKNGRISMAGLNTHNVAYVAKAFDAVVRG

SEQ ID NO: 4766 - DNA, 1290 bp, Aspergillus nidulans FGSC A4
  CDS (1)..(1290)
atgctttctactctaaaagtcgccagccgccaggctgcctcgcgcaatgctagcgtgcgctccgtgtttgccggtgccagatgtgcttccacctggtccaatgttccccagggtcctcctgacgctatccttggtatcaccgaggcctacaaggccgacagtttcaaggaaaagatcaacctgggtgttggtgcctaccgtgacgaccagggtaagccctacgttctgccctccgtccgcgccgccgaggacaaggttgttgcatcgcgtttcgataaggaatatgctggaatcaccggtatcccctcgttcaccaaggctgccgcgcagctggcctacggagcggactctcccgttttgaaggaggaccgtctcgtgatcacccagtccatctctggtaccggtgctctgaggatcggcggcgctttccttcagcgtttctatcccggcgcaaagaagatctatctccctactcccagctgggccaaccacaacgctgtcttcaaggactcgggcttggaggttgagaagtaccgctactacaacaaggacaccatcggcctcgactttgagggtctcgtcgaggacctcaaggctgctcccaacaacagcatcatccttctccatgcttgcgctcacaaccccaccggtgtcgaccctacccaggaccagtggcgccagattagcaacgtaatgaaggagaagggccactttgccttcttcgacatggcttaccagggcttcgccagtggaaacgccgataccgacgcctttgcgcctcgacacttcgttgagcagggccacaacatcgctctgtgccaaagtttcgccaagaacatgggactctacggtgagcgtgtcggtgctttctctctcgtctgcgaatccgccgaggagaagaagcgtgtcgactctcagatcaagatcctcattcgtcccttctactccaaccctcccgtgcacggtgctcgtgtcgcctcgactatcatgaatgaccctgcgcttaacaagcaatggctcggcgaggttaagggcatggctgaccgcatcattgagatgcgtgctcttctcaagaagaacctggaagagcttggcagcaagcacgactggacgcacatcaccagccagatcggcatgtttgcttacactggtctcaagcccgagcagatggaggctcttgccaaggagcactccgtctacgccaccaaggacggccgtatctcagtggctggtatcactacgggcaacgtcaagcgccttgccgaatccatctacaaggtgactggttaa

SEQ ID NO: 4767 - protein, 429 aa, Aspergillus nidulans FGSC A4
MLSTLKVASRQAASRNASVRSVFAGARCASTWSNVPQGPPDAILGITEAYKADSFKEKINLGVGAYRDDQGKPYVLPSVRAAEDKVVASRFDKEYAGITGIPSFTKAAAQLAYGADSPVLKEDRLVITQSISGTGALRIGGAFLQRFYPGAKKIYLPTPSWANHNAVFKDSGLEVEKYRYYNKDTIGLDFEGLVEDLKAAPNNSIILLHACAHNPTGVDPTQDQWRQISNVMKEKGHFAFFDMAYQGFASGNADTDAFAPRHFVEQGHNIALCQSFAKNMGLYGERVGAFSLVCESAEEKKRVDSQIKILIRPFYSNPPVHGARVASTIMNDPALNKQWLGEVKGMADRIIEMRALLKKNLEELGSKHDWTHITSQIGMFAYTGLKPEQMEALAKEHSVYATKDGRISVAGITTGNVKRLAESIYKVTG

SEQ ID NO: 4768 - DNA, 1338 bp, Aspergillus nidulans FGSC A4
  CDS (1)..(1338)
atgtccactccttcatccgtatcttccagttcctactcggccgccaaatctcggcttgcttctctcgcctcacacatcatgggctcctcatcagcttccccggtcttctcgaccgctgttgtcccgtcggcgccagaggatccgctctttggtctcgcgcaggcttatcgccaggacccctcagacaagaaggtcgatctagtcattggtgcttatcgcgacgataatgcgaaaccctgggttttgcctgttgtcaagaaggcagatgagctcatccgcaacgaccccaaccttaaccacgaatacctcccaatcaaaggcctcgctgaatatacaaccgccgcccagaaactcatcatcggcgccgactcgcccgccatcgcggagaaccgtgtctgcacattccagaccatctccggcacaggcgccgtccatctaggcgcgctcttcctcgcccgcttccaccccgcaacccccaaaccgaccctctacctctccagcccgacctgggcaaaccaccaccagatcttcacaaatgtcggcttcacgcttgcgaactacccgtacttctcgccgcagacgaaaggcctcgatttcgacggcatgatcaacgcgttgcgctccgcgcccgccgggtcgatcatcctcctccatgcctgcgcccacaaccccacgggcgtggatctcacccaggagcagtggaaggaagttgccgtggtcatgcgcgaccgctcgcatttccccttttttgactgcgcataccagggtttcgcatcgggcgatctggcgcgtgacgcctgggcgatccggtatttcgtcgagcaagggttcgagctctgcatcgcgcagtccttcgccaagaactttggcttgtacggtgagcgcacgggcgcctttcatttcgtttccgcgccgggcccggaagccgctcagtcctcggcacatgtcgcctcgcagctggccattctgcaacgctctgagatctcgaacccgcctgcgtacggtgcgcggattgcgagtaaagtgctcaatgaccctgagctgtttgcgcaatgggaggacgatctgcgaacgatgagtgggcggatcgtcgagatgaggaaggggctcaggcagcgccttgaggagaagaagacacccggctcgtggaaccatattaccgaccagatcggcatgtttagctttacggggctcagtgaggcacaggttaaggtgctgcgtgagaagtggcatgtctatatgaccaagaacggtcgcatctccatggctggtctcaactcccataacctggattactttgccgaggcggttgatagcgttgtgagggagacatcgtga

SEQ ID NO: 4769 - protein, 445 aa, Aspergillus nidulans FGSC A4
MSTPSSVSSSSYSAAKSRLASLASHIMGSSSASPVFSTAVVPSAPEDPLFGLAQAYRQDPSDKKVDLVIGAYRDDNAKPWVLPVVKKADELIRNDPNLNHEYLPIKGLAEYTTAAQKLIIGADSPAIAENRVCTFQTISGTGAVHLGALFLARFHPATPKPTLYLSSPTWANHHQIFTNVGFTLANYPYFSPQTKGLDFDGMINALRSAPAGSIILLHACAHNPTGVDLTQEQWKEVAVVMRDRSHFPFFDCAYQGFASGDLARDAWAIRYFVEQGFELCIAQSFAKNFGLYGERTGAFHFVSAPGPEAAQSSAHVASQLAILQRSEISNPPAYGARIASKVLNDPELFAQWEDDLRTMSGRIVEMRKGLRQRLEEKKTPGSWNHITDQIGMFSFTGLSEAQVKVLREKWHVYMTKNGRISMAGLNSHNLDYFAEAVDSVVRETS

SEQ ID NO: 4770 - DNA, 1251 bp, Aspergillus nidulans FGSC A4
  CDS (1)..(1251)
atgaccgtgctcaatgtcagcccagttcctccggacgaaattttcgccctgaaccgtgcatacatcgacgatgacttcccgcagaaggtcaatctcggtgtaggcgtttaccgcaccaacgagggccagccatggcctctccccgtcgttgaggaagcagagaagcagctcgcagccgaaaacagcgtcttccgccatgaatacacagccattgaaggtgatagggcattcctccctctcgctcgggacctaatgtttgggttcgacggccaagctacttctgatgcgaagcaggaggcagccaaagcacgcattggcaccgtccagacagtcgccggcaccggcgcaaaccatctcggtgccctcttcctcgcaactcacatgaagccacgaaatgtctggctctccaacccctcttgggcaaaccacctcactatttgggaactcgccggagtgccccgcaaaacatacccctattactctgccgccacccgctcctttgatttcgacggcatgatctcaactctcgaatccgaagctcaggaaggagacgtgattcttctccacgcctgcgcccacaatcccacaggactcgaccccaacaaggagcaatggaaagctatcatcgacctctgcgagcgcaagcgcattttccctttcttcgactcagcataccaaggcttcgcctccggatccgtagacgaagacgcctgggctgtccggtacgtcctaaacgagaagccgcagatggaaatgtgcgttgcgcaatccttctctaagaactttggcctctacggccagcgagtcggcgccttccattacgtcctcaacgaaggcgcagaggatctccgcgatacagtcgtcaacaacctttgccacctcatccgcggagagtactccatgggtcccacggcaggctgcaacatcgtcaagaaagtcctcacaagtcctgagctcacggcaaaatggcaccaggatctgaaggtcatgagttcgcggataatttccatgcgcgaagctctttacaatgaactagtcagactcaaaacccccggaacttggaaacacatcgtcgaacagaacggaatgttctcctacacaggacttacaccttcacaagtctacgctcttaaagataaattccacatctacctgctcaagtccggcagagcctccatcagtggactgagcccgaagaatgtaaattacgtcgccagagctattgacgaggttgtacgaaatgtcaactga

SEQ ID NO: 4771 - protein, 416 aa, Aspergillus nidulans FGSC A4
MTVLNVSPVPPDEIFALNRAYIDDDFPQKVNLGVGVYRTNEGQPWPLPVVEEAEKQLAAENSVFRHEYTAIEGDRAFLPLARDLMFGFDGQATSDAKQEAAKARIGTVQTVAGTGANHLGALFLATHMKPRNVWLSNPSWANHLTIWELAGVPRKTYPYYSAATRSFDFDGMISTLESEAQEGDVILLHACAHNPTGLDPNKEQWKAIIDLCERKRIFPFFDSAYQGFASGSVDEDAWAVRYVLNEKPQMEMCVAQSFSKNFGLYGQRVGAFHYVLNEGAEDLRDTVVNNLCHLIRGEYSMGPTAGCNIVKKVLTSPELTAKWHQDLKVMSSRIISMREALYNELVRLKTPGTWKHIVEQNGMFSYTGLTPSQVYALKDKFHIYLLKSGRASISGLSPKNVNYVARAIDEVVRNVN

SEQ ID NO: 4772 - DNA, 1251 bp, Candida albicans SC5314
  CDS (1)..(1251): transl_table=12
atggctccatttgcaggtattaaagaattaccaccagatccattgttcggattaaaggcacgttacaatgctgattctcgtacaaataaagttgatttggggattggtgcctacagagacaacaacgggaaaccatggattttgccagctgttagacaagcagaacagaaattgatcaactcacctgattacaaccatgagtatctttctatcagtggatttgctccatttactgaaagtgcagccaaagttattttgggtgaaaactcattagccatcaaggataaaaaaattgtatcacaacaaagtttatcaggtaccggtgccttacatttagctggtgttttcattaaagagttttaccaaggtaaccacaccatttatttatcacaaccaacttgggccaaccacaagcaaattttcgaatacattggtttcaaagttgctagttatccatattggaacaatgacaccaagtcattggacttgagcgggttcttgaaagccatttccagtgctcctgatggttcagtgtttttgttgcatgcatgtgcccataatcctactgggttagatcctaatcaaagtcaatgggacgaaatcttggctgccttggaaaaaaagaagcatttcatcatttttgactctgcatatcaaggttttgccagtggagatttggaaaaagatgcttatccaattagaaaggcaattgactctaaagttatcacttctccaattattatctgtcaatcatttgccaagaatgttggtatgtatggagaaagagttggtgccatccatgtgataccatcaactgttgaatctaacgattccttgaaccgagctataaagtctcaattgaacagaatcatacgttctgaactttctaatcctcctgcctatggttctaaaattgttgctaccatcttgaatgatccagaattatattctcagtggcgtaaagatttagtgacaatgtcttctagaattggtgagatgagaaatacattgagaagcaaattggaaagtttaggaaccccaggtacttggaatcacataactgaacaaacaggtatgttttcatttactggtttaaccccacaaatggttgaacgtttggagaaacaccacggtatctatttggttagcagtggtagagcctctgttgccggattgaatgaacataatgtcgaccaagtagctaaagctattgatgaagtggttagacattttggtaaaagtaaactttag

SEQ ID NO: 4773 - protein, 416 aa, Candida albicans SC5314
MAPFAGIKELPPDPLFGLKARYNADSRTNKVDLGIGAYRDNNGKPWILPAVRQAEQKLINSPDYNHEYLSISGFAPFTESAAKVILGENSLAIKDKKIVSQQSLSGTGALHLAGVFIKEFYQGNHTIYLSQPTWANHKQIFEYIGFKVASYPYWNNDTKSLDLSGFLKAISSAPDGSVFLLHACAHNPTGLDPNQSQWDEILAALEKKKHFIIFDSAYQGFASGDLEKDAYPIRKAIDSKVITSPIIICQSFAKNVGMYGERVGAIHVIPSTVESNDSLNRAIKSQLNRIIRSELSNPPAYGSKIVATILNDPELYSQWRKDLVTMSSRIGEMRNTLRSKLESLGTPGTWNHITEQTGMFSFTGLTPQMVERLEKHHGIYLVSSGRASVAGLNEHNVDQVAKAIDEVVRHFGKSKL

SEQ ID NO: 4774 - DNA, 1314 bp, Candida albicans SC5314
  CDS (1)..(1314): transl_table=12
atgtacaagactcaattgattaaatcttcaactcaagctagatttttggctgttagacaattatcttccactagtcaattattgaaatggaatgatattccattggctccaccagacaagattttgggtatttctgaagcttataacaatgattctaaccctcaaaaagtcaatttgggggttggtgcttatagagataattctggtaaaccaattattttcccatcagttaaaaaagctgaagaaattttattgggtaaagaaactgaaaaggaatatactgccattgttggttccaaaaatttccaatcaattgtgaaaaatttcattttcaacaattctaataaagatgccaatggtaaacaattaattgatgatggtagaattgttactgctcaaaccatctctggtactggatcacttagagttatcgctgatttcttgaatcgtttctattctaacaagaaaattttggttccaaaaccaacttgggctaatcatgttgctgttttcaaagatgctggtttagaaccagaattttatagttattatgaaactagcaaaaatgatttggattatgccaatttgaaaaaatctttaactgctgctccagaaggttcaattgttttattacatgcttgttgtcataacccaaccggtatggatttgacttcagaacaatgggatgaagttttacaaattgttcaagataaaaaattcttcccattagtcgatatggcttatcaaggttttgctagtggtaaaccatttgaagatatcggtttaatcagaaaattgactaaattagctaatgaaaacaaaattccttcatttgccttgtgccaatcatttgctaagaatatgggtctttatggggaaagaactggttctatctctataatcaattcatcaggtgaagcttctaaagctgttgaatcacaattgaaaaaattaattagaccaatttattcatctccaccaattcatggttctaagattgttgaagttattttcgatgaaagttctggtttattacctcaatggttagatgaattagataaagttgttggtagattgaacactgttcgttccaaattatacgaaaaattagataaatccaattacaactgggaccatttgttaaaacaaagaggtatgtttgtttacactggtttatcaccagaacaagttattagattaagaaacgaatattcagtttatgccactgaagatggtagattcagtatttctggtattaatgataataacgttgattatttggctaatgctattaatgaagtcatcaaaaactaa

SEQ ID NO: 4775 - protein, 437 aa, Candida albicans SC5314
MYKTQLIKSSTQARFLAVRQLSSTSQLLKWNDIPLAPPDKILGISEAYNNDSNPQKVNLGVGAYRDNSGKPIIFPSVKKAEEILLGKETEKEYTAIVGSKNFQSIVKNFIFNNSNKDANGKQLIDDGRIVTAQTISGTGSLRVIADFLNRFYSNKKILVPKPTWANHVAVFKDAGLEPEFYSYYETSKNDLDYANLKKSLTAAPEGSIVLLHACCHNPTGMDLTSEQWDEVLQIVQDKKFFPLVDMAYQGFASGKPFEDIGLIRKLTKLANENKIPSFALCQSFAKNMGLYGERTGSISIINSSGEASKAVESQLKKLIRPIYSSPPIHGSKIVEVIFDESSGLLPQWLDELDKVVGRLNTVRSKLYEKLDKSNYNWDHLLKQRGMFVYTGLSPEQVIRLRNEYSVYATEDGRFSISGINDNNVDYLANAINEVIKN

SEQ ID NO: 4776 - DNA, 1314 bp, Candida albicans SC5314
  CDS (1)..(1314): transl_table=12
atgtacaagactcaattgattaaatcttcaactcaagctagatttttggctgttagacaattatcttccactagtcaattattgaagtggaatgatattccattggctccaccagacaaaattttgggtatttctgaagcttataacaatgattctaaccctcaaaaaatcaatttgggggttggtgcttatagagataattccggtaaaccaattattttcccatcagttaaaaaagctgaagaaattttattgggtaaagaaactgaaaaggaatatactgccattgttggttccaaaaatttccaatcaattgtgaaaaatttcattttcaacaattctaataaagatgccaatggtaaacaattaattgatgatggtagaattgttactgctcaaaccatctctggtactggatcacttagagttatcgctgatttcttgaatcgtttctattctaacaagaaaattttggttccaaaaccaacttgggctaatcatgttgctgttttcaaagatgctggtttagaaccagaattttatagttattatgaaactagcaaaaatgatttggattatgccaatttgaaaaaatctttaactgctgctccagaaggttcaattgttttattacatgcttgttgtcataacccaaccggtatggatttgacttcagaacaatgggatgaagttttacaaattgttcaagataaaaaattcttcccattagtcgatatggcttatcaaggttttgctagtggtaaaccatttgaagatatcggtttaatcagaaaattgactaaattagctaatgaaaacaaaattccttcatttgccttgtgccaatcatttgctaagaatatgggtctttatggggaaagaactggttctatctctataatcaattcatcaggtgaagcttctaaagctgttgaatcacaattgaaaaaattaattagaccaatttattcatctccaccaattcatggttctaagattgttgaagttattttcgatgaaagttctggtttattacctcaatggttagatgaattagataaagttgttggtagattgaacactgttcgttccaaattatacgaaaaattagataaatccaattacaactgggaccatttgttaaaacaaagaggtatgtttgtttacactggtttatcaccagaacaagttattagattaagaaacgaatattcagtttatgccactgaagatggtagattcagtatttctggtattaatgataataacgttgattatttggctaatgctattaatgaagtcatcaaaaactaa

SEQ ID NO: 4777 - protein, 437 aa, Candida albicans SC5314
MYKTQLIKSSTQARFLAVRQLSSTSQLLKWNDIPLAPPDKILGISEAYNNDSNPQKINLGVGAYRDNSGKPIIFPSVKKAEEILLGKETEKEYTAIVGSKNFQSIVKNFIFNNSNKDANGKQLIDDGRIVTAQTISGTGSLRVIADFLNRFYSNKKILVPKPTWANHVAVFKDAGLEPEFYSYYETSKNDLDYANLKKSLTAAPEGSIVLLHACCHNPTGMDLTSEQWDEVLQIVQDKKFFPLVDMAYQGFASGKPFEDIGLIRKLTKLANENKIPSFALCQSFAKNMGLYGERTGSISIINSSGEASKAVESQLKKLIRPIYSSPPIHGSKIVEVIFDESSGLLPQWLDELDKVVGRLNTVRSKLYEKLDKSNYNWDHLLKQRGMFVYTGLSPEQVIRLRNEYSVYATEDGRFSISGINDNNVDYLANAINEVIKN

SEQ ID NO: 4778 - DNA, 1302 bp, Ustilago maydis 521
  CDS (1)..(1302)
atgatgctcaccgctgccaccatccgaacggctgttcgagcctcgcaggcccctctcctgggcgctatgtcgctacctgccgtgcgtcagttcaagagtacttgggctcacgtcaaggctggacctcctgacccgattctcggtgttaccgaggcgttcaagcgcgaccaggaccctcgcaagatcaacctcggtgttggtgcctaccgtgacgagaacggaaagccttatgtgctcccctcggtgcgtcaggccgaggagctcgtcatcaccgctaagggtgacaaggagtacctgcccatcactggtctcgccgactttaccaagaacgccgccgttctcgcctacggcaaggacagcgcgcccatcaaggagaaccgcattgctatcacccagtcgatctcgggaaccggtgctcttcgcatcggtggtgctttcctgcagcgacactaccccgaggccaagaccatctacctgcccacaccttcgtggggtaaccacacacctatcttccgtgacagcggtcttgaggtgaaacagtaccgctactacgacaagaagacggtgggtctcgacttcaagggcatgattgaggacatcaaggcggcacctgccggttcgattgtcctgctgcatgcgtgcgcgcacaaccccaccggtgtcgaccccaccgtcgagcagtggaaagaaatcagcaacgtggtcaaggagaagggtcacttccccttcttcgacatggcctaccagggctttgccagtggtgacacggacaaggacgcctttgcggtgcgccactttgtcgccgagggccaccagatctgcctctcgcagtcgttcgccaagaacatgggtctgtatggtgagcgtgtcggcgcgttttcgatcgtctgcgctgaccctgacgagcgtgctcgtgtcgacagccagatcaagatcatcgttcggcccatgtactcgaacccacctatgcacggtgccaagatcgccggtaccatcctggccgaccaacagctgtaccagcaatggctcggtgaggtgaagggcatggccgaccgcatcaacggcatgcgatccacactcaaggacctgctcgtgcaggactttaactcgaagctcaactgggatcacatcaccaaccagatcggcatgtttgccttcctcggcatctcgcccgagcaggtggccaagctagtcaacgagcaccacgtctaccttactggagacggccgtatttcggtcgctggtatcaccgaccacaacgtcaagcacctcgccgagtcgctgcacaaggtcaccagctaa

SEQ ID NO: 4779 - protein, 433 aa, Ustilago maydis 521
MMLTAATIRTAVRASQAPLLGAMSLPAVRQFKSTWAHVKAGPPDPILGVTEAFKRDQDPRKINLGVGAYRDENGKPYVLPSVRQAEELVITAKGDKEYLPITGLADFTKNAAVLAYGKDSAPIKENRIAITQSISGTGALRIGGAFLQRHYPEAKTIYLPTPSWGNHTPIFRDSGLEVKQYRYYDKKTVGLDFKGMIEDIKAAPAGSIVLLHACAHNPTGVDPTVEQWKEISNVVKEKGHFPFFDMAYQGFASGDTDKDAFAVRHFVAEGHQICLSQSFAKNMGLYGERVGAFSIVCADPDERARVDSQIKIIVRPMYSNPPMHGAKIAGTILADQQLYQQWLGEVKGMADRINGMRSTLKDLLVQDFNSKLNWDHITNQIGMFAFLGISPEQVAKLVNEHHVYLTGDGRISVAGITDHNVKHLAESLHKVTS

SEQ ID NO: 4780 - DNA, 1269 bp, Ustilago maydis 521
  CDS (1)..(1269)
atgggttcaatttctgaacaatcctcagctctcgctgtttggagcgccgtcccacaggctccggaggatgccattttcaagctgacctcttcctacaaatccgatacctacgataagaaagtcaacctcggtgttggcgcataccgtgacaacaacggcaagccctacgttctgccctcggtaaaaaaggcgcaggcggatctcatcgcagacgagtcggtcgaccacgagtacctctccatcaccggtctggccgaattcaccagtgctgctgccaagctcatcctcggcgacgattcgcccgcgattgcagagaagcgtgttgcttcggtccagaccatctccggtaccggtgccaaccatctcggtgccgtctttctgcaacgcttctaccagtaccaggcctacggtgtcgaccgtcaaatctacatttcaaatccaacttgggccaatcacaaggccatcttcaatacggtcggcatcaagcccatcgactacccttattacgacgccaagacgattgcgctcgactttgacggtttcaccaacacgttgagacaggccaaaaaccagagcgtgttcttgctacatgcctgcgctcacaaccctaccggtgttgatcctacccaggagcagtggaagcagatcgccgatatctttgtcgagaagggtcactttgcctttttcgactgcgcttaccagggtttcgcctcgggtgacctggacagggatgcctgggcggtacgacactttgtttcgcgcaagagcattcctctgctcatttgccagagcttcgccaagaacgccggcttgtacggcgaacgtgtcggcgcgctccacgttgtgtccgccactccggcacagagcgctgccgtcttctcgcagctcgccgcgattcaacgatccgagatctctaaccctcccgctttcggcgcgcgtgtggtcaagatgatccttaccgatcctgcgctcttccaacagtggcaggccgatgtcaaggagatggcaggtcgcatcatcaccatgcgtcagagcttgtttgatttgctgaccaagaagttccaaacaccgggtaactgggaccacatcttgaaacaaatcggcatgtttacctttttgggtctcgacaccaaccagtgtaaccgtctgttggaggaaggtcacatctatttgaccgccaattcgcgtatttccatggctggattgacgacgaacaacgtcgaatacgttgcttcctggatcgacaaggtggtccgagagaagaagtga

SEQ ID NO: 4781 - protein, 422 aa, Ustilago maydis 521
MGSISEQSSALAVWSAVPQAPEDAIFKLTSSYKSDTYDKKVNLGVGAYRDNNGKPYVLPSVKKAQADLIADESVDHEYLSITGLAEFTSAAAKLILGDDSPAIAEKRVASVQTISGTGANHLGAVFLQRFYQYQAYGVDRQIYISNPTWANHKAIFNTVGIKPIDYPYYDAKTIALDFDGFTNTLRQAKNQSVFLLHACAHNPTGVDPTQEQWKQIADIFVEKGHFAFFDCAYQGFASGDLDRDAWAVRHFVSRKSIPLLICQSFAKNAGLYGERVGALHVVSATPAQSAAVFSQLAAIQRSEISNPPAFGARVVKMILTDPALFQQWQADVKEMAGRIITMRQSLFDLLTKKFQTPGNWDHILKQIGMFTFLGLDTNQCNRLLEEGHIYLTANSRISMAGLTTNNVEYVASWIDKVVREKK

SEQ ID NO: 4782 - DNA, 1362 bp, Cryptococcus neoformans var. neoformans B-3501A
  CDS (1)..(1362)
atgttaccccgactaggtgcgatacaatcaactactcatcccttcttcttcacaaccacaaaaatgcttgttcactcctcgaaatatctccttgcccggtccgctgccatctccaaggttctccccgccgtcgctgccagacgagccggctctacttggactaacgtccctgctggtcctcctgaccctatccttggtgttactgaaaagttcaaggccgacaagtctcccaagaagatcaatcttggtgtcggtgcttaccgagatggttcgggcaagccttacgtccttcctaccgtaaggaaagccgagaagatcctcgccgaagctatgcaggacaaggaataccttcccatcaccggtctctctgactttactaagctcgctgccgagctcgcgtatggcaaggactctaagccgctcgtcgagaatcgacttgcaatcacccagtctatctccggtactggtgctctccgaatcggtactgccttccttgccaggtggttccccggcgcaaagtccatatatcttcccactcctacttggggtaatcatattcccattgctaaggactctggtttggaggtcaagcagtacaaatactttgacaaaaaaaccgtcggccttgactttgaaggtatgaaggccgacattaaggccgctcctgagggctccatcgtccttctccacgcttgtgcacacaaccccactggtatcgaccctaccgaggctcagtggaaggagctttctgatattgtcaaggagaagaagcatttccccttctttgacatggcctaccaaggctttgcctctggtgacacactcaaggacgctttcgccgtccgatatttcgtcgagcagggtcaccagctcttgctttgtcaatcttttgccaagaacatgggtctatatggtgaaagagctggggccatctctttcgtctgtgaaagccccgaggagaaggccagggtcgattctcagttgaagattatcattcgacctatgtactccaaccctcccgttcacggcgcgcgtctcgtctctactattcttggctcccccgagctcaccaaggaatggctcgtcgaagtcaagggcatggccgaccgtatcatcgagatgcgtgagcgtctttacaacaagctcgtcgagcttgatacccctggagagtggggccacatcaagtctcagattggcatgttctcattcaccggtctcaagcccgagcaagtcgataagcttgcggagaaggcgtctatctacttgaccagggacggacgtatttccatggcaggattaaactctaacaacgttgattacttcgccgagagcgttagcaaggctgttaagggtacactttaa

SEQ ID NO: 4783 - protein, 453 aa, Cryptococcus neoformans var. neoformans B-3501A
MLPRLGAIQSTTHPFFFTTTKMLVHSSKYLLARSAAISKVLPAVAARRAGSTWTNVPAGPPDPILGVTEKFKADKSPKKINLGVGAYRDGSGKPYVLPTVRKAEKILAEAMQDKEYLPITGLSDFTKLAAELAYGKDSKPLVENRLAITQSISGTGALRIGTAFLARWFPGAKSIYLPTPTWGNHIPIAKDSGLEVKQYKYFDKKTVGLDFEGMKADIKAAPEGSIVLLHACAHNPTGIDPTEAQWKELSDIVKEKKHFPFFDMAYQGFASGDTLKDAFAVRYFVEQGHQLLLCQSFAKNMGLYGERAGAISFVCESPEEKARVDSQLKIIIRPMYSNPPVHGARLVSTILGSPELTKEWLVEVKGMADRIIEMRERLYNKLVELDTPGEWGHIKSQIGMFSFTGLKPEQVDKLAEKASIYLTRDGRISMAGLNSNNVDYFAESVSKAVKGTL

SEQ ID NO: 4784 - DNA, 1251 bp, Cryptococcus neoformans var. neoformans B-3501A
  CDS (1)..(1251)
atgagttttaccaacttctgggctggtgttcccgagggtcctcccgaccccatcctcggtgtgactgatgcattcaagaaggacacatctccaaaaaaggttaaccttggtgtcggcgcctatcgtgacgaggatggcaagccttacgttctcgactctgtcttgaaggccgaagacatcttgcacaagaagaagctcgataaggagtaccttcctatcaccggtgctgccgactttatcaagcttgcttctgaactcgcctatggcaaagactccaagcctctgcgggagggtagagtcgctgtctctcaatccatctctggtacaggcgccctccggatcgctactggtttcctctccagtttctactctggccccaaggtcatctacttgcccaaccccacttggggtaaccacgttcctttggccgaatctgtcggtatcaaggtcgaaagatataggtattttgacaagaagacagtcggtcttgactttgagggcatgaaggaggacatcaagaacgccgaatccggctctattattctcctccatgcctgtgcccaaaaccctactggtatcgaccctacgcaggagcaatggaaggagttgagcgatttgctcaaagccaagaagcatcttcccttgttcgacatggcttaccaaggtttcgcatctggcgacattatccgtgacgcttttgccgtacgatactttgttgagcagggtcaccagatcatcctctgccaatctttcgccaagaacttgggtctctacgctgagcgtgccggtaccttctccatggtctgcgcttcccccgaggagaaggaacgggtcatgtcccagatcaagcgtgtcgtccgacctctctactcttctccccccatccatggtgctcagctggttgctaccatcctcggtactcctgagctttacgacgagtggcttaccgaggtgaagaagatggctgaccgtatcatcgccatgcgagaaaagctttacaacctcctcattgagctcaaaactcctggagaatggggccacatcaagtctcaaatcgagtgtttaggcatgttctctttcaccggtatctccaaagaacaagtcgacgaccttgccgagtacgctcacgtgtacatgaccaaggacggccgtatctccatggctggtttgaacgaacataacattcagtactttgctgagagcttgtccaaggctgtcaaaggcgaattgaggaccaagtcggcactttag

SEQ ID NO: 4785 - protein, 416 aa, Cryptococcus neoformans var. neoformans B-3501A
MSFTNFWAGVPEGPPDPILGVTDAFKKDTSPKKVNLGVGAYRDEDGKPYVLDSVLKAEDILHKKKLDKEYLPITGAADFIKLASELAYGKDSKPLREGRVAVSQSISGTGALRIATGFLSSFYSGPKVIYLPNPTWGNHVPLAESVGIKVERYRYFDKKTVGLDFEGMKEDIKNAESGSIILLHACAQNPTGIDPTQEQWKELSDLLKAKKHLPLFDMAYQGFASGDIIRDAFAVRYFVEQGHQIILCQSFAKNLGLYAERAGTFSMVCASPEEKERVMSQIKRVVRPLYSSPPIHGAQLVATILGTPELYDEWLTEVKKMADRIIAMREKLYNLLIELKTPGEWGHIKSQIECLGMFSFTGISKEQVDDLAEYAHVYMTKDGRISMAGLNEHNIQYFAESLSKAVKGELRTKSAL

SEQ ID NO: 4786 - DNA, 1215 bp, Herminiimonas arsenicoxydans
  CDS (1)..(1215): transl_table=11
atgaacgcacctattcctgcttcgctcctcaacgccatcgaaatggcgccccgtgacccgattcttggcattaccgaggcgtttaacgccgacaagaatccaaataagatcaatctaggtgtcggcgtttacaacgacgacaacggtaaattgccgctgctggaatgcgtacgcaaagccgaagcgcaattgatggaaaaactgtcgccacgcggctacctgcctatcgacggtctggctgcttacgataaagcagtgcaggaactcgtatttggtgccgatagttcagtagtcaaggacaaacgtgcagtgaccgcgcaggcaatcggcggcacaggcgcattgaagctcggcgctgacttcctgaaacgctttgcacctaacgcgcaagtctggatcagcgatccaagttgggaaaaccaccgcgcgctgtttgaatcggccggtttcgtagtcaacaactacccgtactacgacgcagcaacccgcggcgtgaacttcgccggcatgctggacacactcaaatcgattcctagcggctcgatcgttctgttgcacgcttgctgccacaatccaaccggcgccgatctgaacgacgcacaatggctggaagtgttgaatgttgtcacgacacgcggcttgattccattcctcgacatggcttaccagggttttggcgacggcatcgaagccgacggcaaagtcgtacgccagttcgctgaagcaggcggcccggtattcgtatcgaactccttctccaaatcgttctcgctgtacggcgaacgcgttggcgcattgagcatcgtttccagcaacgcagaagaagcatcgcgcgtcctgtcgcaattgaaacgcgtcatccgcaccaactactccaacccgcctatgcacggcggtcaagtcgtcgcaaccgctctggcatcgccagaattgcgcgcactgtgggaagaagagctggccggcatgcgcgtacgcattcgcgaaatgcgtcaagcgtttgtacagaagcttaaagaacaggcccctgcgcacaacttcgatttcgtcaccaaacaacgcggcatgttctcgtactccggcctgaccaaaccgcaagtggatcgtctgcgcgatgagttctcgatttacgctgtcgacaccggccgcatctgcgttgcagcgctgaatacaaaaaacatcgattacgtcattgcggcaatcgcgaaagttctttaa

SEQ ID NO: 4787 - protein, 404 aa, Herminiimonas arsenicoxydans
MNAPIPASLLNAIEMAPRDPILGITEAFNADKNPNKINLGVGVYNDDNGKLPLLECVRKAEAQLMEKLSPRGYLPIDGLAAYDKAVQELVFGADSSVVKDKRAVTAQAIGGTGALKLGADFLKRFAPNAQVWISDPSWENHRALFESAGFVVNNYPYYDAATRGVNFAGMLDTLKSIPSGSIVLLHACCHNPTGADLNDAQWLEVLNVVTTRGLIPFLDMAYQGFGDGIEADGKVVRQFAEAGGPVFVSNSFSKSFSLYGERVGALSIVSSNAEEASRVLSQLKRVIRTNYSNPPMHGGQVVATALASPELRALWEEELAGMRVRIREMRQAFVQKLKEQAPAHNFDFVTKQRGMFSYSGLTKPQVDRLRDEFSIYAVDTGRICVAALNTKNIDYVIAAIAKVL

SEQ ID NO: 4788 - DNA, 1203 bp, Burkholderia vietnamiensis G4
  CDS (1)..(1203): transl_table=11
atgttcgaacacatcgacgcgtacccgggcgacccgatcctgacgctcaacgagaacttccagaaggatccgcgcgaccagaaggtcaacctgagcatcggcatctatttcgacgccgacggccggattccggtaatggccgccgtgcgcgaggccgaaaccgcgctgcagcgcgacgtcggcccgaagccgtatctgccgatggtcggcctcgccgcgtaccgcgacgcggtgcaggcgctggtgttcggcgccgatcacccggcgcgggcggccggccgcatcgcgaccgtgcagacgctcggcggctcgggcgcgctgaaagtcggcgccgatttcctgaagcgctacttcccggacgcgcaggtgtggctcagcgatccgagctgggaaaaccaccgtttcatcttcgagcgcgccggcttcacggtgaatacctacccgtactacgacgcggcgacgggcggcctgaagttcgacgcgatgctcgcggcgatcgacgcgctgccggcgcgcagcatcgtgctgctgcatgcgtgctgccacaacccgaccggcgtcgatctcgacgaaggccagtgggagaagctgatcgacgtgatcgaggcgcgcgagctgctgccgttcgtcgacatggcgtatcagggcttcggcgcgggcctcgacgccgatgcgttcgcggtgcgcgagttggcccgccgcggcgtgccggcgctcgtcgcgaattcgttctcgaagaacttttcgctgtacggcgagcgcgtcggcgcgctgagcgtcgtgtgcgaggatgcggacgcggccgagcgcgtgctcggccagctggccggcgcggtgcgctccaactacagcaacccgcagacgtatggcgcgaagctcgtcgcgaccgtgctgaacacgccggcgctgcgcaagcagtgggaggaagagcttgccgcgatgtgccgccggattgcgcggatgcgccaggcgatccacgacggcctgcgcgaccacgtgagcggcgaagcgctgacgcgctacgtgaagcagcgcgggatgttcacgtacaccgggctgaccgagacgcaggtcgacgcgctgcgcgacgtgcacggcgtctacattctgcgttcgggccgcatgtgcgtggccgggctgaacgattcgaacgtcggcatcgtcgccgatgcgattggcaaggtgctgaagagcggcgtctga

SEQ ID NO: 4789 - protein, 400 aa, Burkholderia vietnamiensis G4
MFEHIDAYPGDPILTLNENFQKDPRDQKVNLSIGIYFDADGRIPVMAAVREAETALQRDVGPKPYLPMVGLAAYRDAVQALVFGADHPARAAGRIATVQTLGGSGALKVGADFLKRYFPDAQVWLSDPSWENHRFIFERAGFTVNTYPYYDAATGGLKFDAMLAAIDALPARSIVLLHACCHNPTGVDLDEGQWEKLIDVIEARELLPFVDMAYQGFGAGLDADAFAVRELARRGVPALVANSFSKNFSLYGERVGALSVVCEDADAAERVLGQLAGAVRSNYSNPQTYGAKLVATVLNTPALRKQWEEELAAMCRRIARMRQAIHDGLRDHVSGEALTRYVKQRGMFTYTGLTETQVDALRDVHGVYILRSGRMCVAGLNDSNVGIVADAIGKVLKSGV

SEQ ID NO: 4790 - DNA, 1200 bp, Burkholderia vietnamiensis G4
  CDS (1)..(1200): transl_table=11
atgtcgctcttctccgctgtccagcttgctccccgcgacccgatcctgggcctgaacgaagccttcaacgccgatgcgcgtccgaccaaggtcaacctcggcgtcggcgtgtacacgaacgaagaaggcaagattccgctgctgcgcgcggttcgcgaagcggagaaggcgcgtgtcgacgcgggcctgccgcgcggttacctgccgatcgacgggatcgccgcgtacgacgccgccgtgcagaagctgctgctcggcaacgattcgccgctgatcgccgcaggccgcgtggtcaccgcgcaggcgctgggcggcacgggcgcgctgaagatcggcgccgatttcctgcgcaccgtgaacccgaacgtgaaggtcgcgatcagcgatccgagctgggaaaaccaccgcgcgctgttcgaggcggccggcttcgaagtcgtcgcatatccgtactacgacgcggcgacccacggcgtgaacttcgaagcgatgctggcggcgctcaacggctatgcggccggcacgatcgttgtgctgcatgcgtgctgccacaacccgaccggcgtggatctgaccgaagcgcaatggcagcaggtcgtcgacgtcgtcaaggcgcgcaacctcgtgccgttcctcgacatcgcgtatcaaggcttcggcgacggcatcgacgccgatgcggctgccgtgcgcctgttcgcagcggccgacctgaacgcgttcgtgtcgtcgtcgttctcgaagtcgttctcgctgtacggcgagcgcgtcggcgcgctgtcgatcatcacgtcgagcaaggaagaagcgacgcgcgtgctgtcgcagctcaagcgcgtgatccgcaccaactactcgaacccgccgacccatggcggcgccgtcgtcgcagcggtgctcgcatcgccggaactgcatgcatcgtgggtgcaggaactgggcgaaatgcgcgaccgcatccgcgcgatgcgcaacggcctcgtcgagcgcctgaaggcgagcggcgtcgagcgcgacttcagcttcatcaacgcgcaacgcgggatgttctcgtattcggggctgacgtcggcgcaagtcgatcgtctgcgcgaagaattcggcatctacgcggtcggcaccggccggatctgcgtggctgcgctgaatacgcgcaacctcgacgcggtcgcgaacgccatcgccgcggtgctgaagtaa

SEQ ID NO: 4791 - protein, 399 aa, Burkholderia vietnamiensis G4
MSLFSAVQLAPRDPILGLNEAFNADARPTKVNLGVGVYTNEEGKIPLLRAVREAEKARVDAGLPRGYLPIDGIAAYDAAVQKLLLGNDSPLIAAGRVVTAQALGGTGALKIGADFLRTVNPNVKVAISDPSWENHRALFEAAGFEVVAYPYYDAATHGVNFEAMLAALNGYAAGTIVVLHACCHNPTGVDLTEAQWQQVVDVVKARNLVPFLDIAYQGFGDGIDADAAAVRLFAAADLNAFVSSSFSKSFSLYGERVGALSIITSSKEEATRVLSQLKRVIRTNYSNPPTHGGAVVAAVLASPELHASWVQELGEMRDRIRAMRNGLVERLKASGVERDFSFINAQRGMFSYSGLTSAQVDRLREEFGIYAVGTGRICVAALNTRNLDAVANAIAAVLK

SEQ ID NO: 4792 - DNA, 1221 bp, Candidatus Protochlamydia amoebophila UWE25
  CDS (1)..(1221): transl_table=11
atgtcatttgagataagggatcccatgcctttttttaataatatttctcttttgccaccagacccaattttaaatctttctatagacttctctcttgatcaaaatcctcaaaaaattaatttgagtgcaggaacttataaaactgcagatgggcattcgctagttttcaccagtgtccgaaaagcagaaattgatctgcttcaaaaacatctcaataaagattatcaaccgatagagggaaatagtgttttcctaaaaaattctttagagctgttatttggttcagaccacgctttgtttaccaataaaaaattttttgctgttcaaaccgttggaggaacaagcgctttaagattaggaggagagtttttaaataagcttacttgccaaaaaatttttatttctcaaccatcgtggccaaaccacaaacaggtttttgaaaaaacaggtttaaaaattgattcctatccttacttcgattttaatgcatacaaattaaatttttcagggatgtgccaagccatccgccaaatgccaactggaagcgttatccttctgcatggttgctgtcacaatccatcaggggtcgatccaacttttgaacaatggaaagagctttctcagcttattaaaaaacatgaactcattcctttttttgatatcgcttatcaaggatttgggaaagatttagaactcgatgcacaacctattcggtactttgctagtgaaggccatgaaatgttgatcgcttactctttttctaaaaattttggtttatacggggaacgagtaggttttttgactgttgtgacatctcaacaaaaacaaataccatctatagctagtcaattaaaggttttaattcgtgctaattactccaatcctcctcttcaaggagctcgaattgtttctacaatcttgagttcaccagaattaaccgaagaatggaaaatagaattaaaaaatatgcgtgaccgagttgttgaaatgcggaaaacatttattgcttctttgttagtcaaaggagaagataaaaatttaaactacttgcaacaacaaattggtttatttggtttttgtggattaaattattcccaagtcaatcgtttgcggaaagaatttgctatttatattcctagcgacggacgaatcaatattgcaggattaaacactcaaaatattgaatatgtagtcaatgcaatttcatctgttatggagtag

SEQ ID NO: 4793 - protein, 406 aa, Candidatus Protochlamydia amoebophila UWE25
MSFEIRDPMPFFNNISLLPPDPILNLSIDFSLDQNPQKINLSAGTYKTADGHSLVFTSVRKAEIDLLQKHLNKDYQPIEGNSVFLKNSLELLFGSDHALFTNKKFFAVQTVGGTSALRLGGEFLNKLTCQKIFISQPSWPNHKQVFEKTGLKIDSYPYFDFNAYKLNFSGMCQAIRQMPTGSVILLHGCCHNPSGVDPTFEQWKELSQLIKKHELIPFFDIAYQGFGKDLELDAQPIRYFASEGHEMLIAYSFSKNFGLYGERVGFLTVVTSQQKQIPSIASQLKVLIRANYSNPPLQGARIVSTILSSPELTEEWKIELKNMRDRVVEMRKTFIASLLVKGEDKNLNYLQQQIGLFGFCGLNYSQVNRLRKEFAIYIPSDGRINIAGLNTQNIEYVVNAISSVME

SEQ ID NO: 4794 - DNA, 1215 bp, Acinetobacter sp. ADP1
  CDS (1)..(1215): transl_table=11
atgtttcaacatatcccaccgtatgcgggcgatccaatcttgtcgcttatggaacaattcaacgccgattcacgcgaagcgaaagttaatttgagcattggtctttattataatgaagacagtattgtgcctcagcttgacagcgtcattgaagcacaaaaacgcattgaaccacgtcaaaacaaggttaagccatacctgccaatggaaggttttaaaccttaccgtgatgcaattcaaaccttgctctttggtcacaatagcccagcagttaaagcagggcgtgccgtgaccattcagacgcttggtggctcaggtgcacttaaagtgggtgcagattttttaaaaaactatttcccagattcagaagtctgggtaagccagccaacctgggataatcatatcgccatttttaatggtgcaggatttaaaacgcatttttatccgtactttgatgcagaaacacgtggtctcgattttgaaggcatgttagcgacattaaaacagcttccaaagcacagcattgtgctactacatccatgctgtcataacccgactggtgttgatctggtaccggcacaatgggatcaggtcattgacgtattaaaagcaggccatctgattcctttcctcgacattgcctatcagggctttggtgatggcatggagcaagatgcttatgcaattcgtgcacttgatcagtctggtcttaattttattgtcagcaattcgttctccaaaatcttttcactgtatggcgaacgtgtaggcgggctcacctttgtttgtgatgatgccgaagcagctcaatgcacttttggccagttaaaagcgactgtacgtcgaatttattctagtccaccgactacaggtgcatggttggtcgatcaggtcttgaatgatgctgaactcagtcaacagtggcaaaatgaagttaaggagatgcgtgaacgtattctcaaaatgcgtatcattttacgtgatgaattgaccaaggctttaccagatcgtgactttaactatctggtcgatcaaaaaggcatgtttagctatacaggtttgactgcagatcaggtcgataccctgcgtgaagattatgccatctatctggttcgtagtggccgtatttgtgttgcgggtttaaacatgaataatgtctatattgtagccaaagcgatggctgaagtattagccaccgaagtgactcctgcttaa

SEQ ID NO: 4795 - protein, 404 aa, Acinetobacter sp. ADP1
MFQHIPPYAGDPILSLMEQFNADSREAKVNLSIGLYYNEDSIVPQLDSVIEAQKRIEPRQNKVKPYLPMEGFKPYRDAIQTLLFGHNSPAVKAGRAVTIQTLGGSGALKVGADFLKNYFPDSEVWVSQPTWDNHIAIFNGAGFKTHFYPYFDAETRGLDFEGMLATLKQLPKHSIVLLHPCCHNPTGVDLVPAQWDQVIDVLKAGHLIPFLDIAYQGFGDGMEQDAYAIRALDQSGLNFIVSNSFSKIFSLYGERVGGLTFVCDDAEAAQCTFGQLKATVRRIYSSPPTTGAWLVDQVLNDAELSQQWQNEVKEMRERILKMRIILRDELTKALPDRDFNYLVDQKGMFSYTGLTADQVDTLREDYAIYLVRSGRICVAGLNMNNVYIVAKAMAEVLATEVTPA

SEQ ID NO: 4796 - DNA, 1191 bp, Erwinia carotovora subsp. atroseptica SCRI1043
  CDS (1)..(1191): transl_table=11
atgtttgaaaatatctctgctgcaccggccgatcctattctcgggctgaccgatcttttccgcgccgatgaccgcgcggataaaatcaatctgggtattggtgtctataaagatgaaaccggcaaaactccggttctgaccagcgtaaaaaaagcagaacactatctgctggaaaatgaaaccaccaaaaactatctgggcattgacggtctgccagcattcggtcagtgcacgcaggaactgctgtttggcaagcagaatgccatcattgccgacaaacgtgctcgtacggcacaaaccccaggcggaaccggtgcgttgcgcgtagccgctgatttcattgcaaatcagacgtcagcaaaacgcatctggatcagtaacccaacctggccaaatcacaataacgtgttctctgctgccggtttggaagtttgccagtatgactattacgatgctgctaaccacgcactggattttgatggtttgctgaatagcctgaacgccgtagaagcgggtgacgtggtgctgtttcacggctgttgtcataacccaaccggtatcgatcctaccgctgagcagtgggctacgctggccgagctgtcggtagcaaaaggctggctgccgctgtttgacttcgcctatcagggctttgcccgtggtatcgaagaagatgcggaaggcctgcgactcttcgctgcgaagcacgctgaactgatcgtatgcagctcgtactctaaaaatttcggtctgtacaatgaacgtgtcggtgcctgtacgctggttgctgctgatgccgcaacagcagacaaggcattcagtcaggtgaaagccgccattcgcgcaaactactctaacccgccgtcacacggcgcgaccattgttgctaccatcttgggcaatgatgcgctgaaggccatttgggagcaggaattgacggcaatgcgggagcgtattcagcgtatgcgtcagctgttcgtgaataccttgcaggaaaaaggcgcacagcaggatttctccttcatcatcaaccagaatgggatgttctcattcagcggcttgaccaaggagcaggttctgcgtctgcgtgacgaattcggcgtttatgcggtgaattctggccgagtcaatgttgcaggaatgacgccagaaaacatggcgccactctgcgaagcgattgttgccgtgctctga

SEQ ID NO: 4797 - protein, 396 aa, Erwinia carotovora subsp. atroseptica SCRI1043
MFENISAAPADPILGLTDLFRADDRADKINLGIGVYKDETGKTPVLTSVKKAEHYLLENETTKNYLGIDGLPAFGQCTQELLFGKQNAIIADKRARTAQTPGGTGALRVAADFIANQTSAKRIWISNPTWPNHNNVFSAAGLEVCQYDYYDAANHALDFDGLLNSLNAVEAGDVVLFHGCCHNPTGIDPTAEQWATLAELSVAKGWLPLFDFAYQGFARGIEEDAEGLRLFAAKHAELIVCSSYSKNFGLYNERVGACTLVAADAATADKAFSQVKAAIRANYSNPPSHGATIVATILGNDALKAIWEQELTAMRERIQRMRQLFVNTLQEKGAQQDFSFIINQNGMFSFSGLTKEQVLRLRDEFGVYAVNSGRVNVAGMTPENMAPLCEAIVAVL

SEQ ID NO: 4798 - DNA, 1194 bp, Erwinia carotovora subsp. atroseptica SCRI1043
  CDS (1)..(1194): transl_table=11
gtgtttcaaaacgttgatacctatgccggagatcctatcctgtctctgatggaaaaattcaaacaggatccaagagcagataagatcaatttgagtatcgggctgtactacaacgagcagaatattatcccgcagttgcgatccgtcagcacagcggaaagcagcctacggcagcctgctcagagcgcgaattcctatctgccgatggaagggttacagccttaccgcacggctatccagcatttgttgttcggtgaaagccacgcggcgctggaagcaggtcgcatcgcgaccatccagacgttgggcggttccggtgcgctgaaagtcggtgcagatttcctgaaacgctacttcccagcgtcagaagtgtgggtcagcgatccaacatgggaaaaccatattgcgatcttcgagggcgcgggctttaacgttcacacctacccgtatttcgatagcgaaagtctgggcgtgaaatttgacgccatgctctccaccctgcaaacgctgccaacacgcagcattgtgctgctacatccgtgctgccataacccgactggttccgatctcaccaccgaacagtgggatcgcgtcattgaggttatcatccagcgtgagctgattccgtttatggacatcgcttatcagggctttggcctcggcatcgagcaggatgcgtatgcaattcgcgccgttgccagcgcaggcgttccggcactgatcgccaactcgttctccaagattttctcactgtatagcgagcgcgtcggtggcctttccgtggtgtgtgacgatgccgacagcgcgcagcgcgtattgggtcagttaaaagcgaccgtacgccgcaactactcttccccaccaaatttcggcgctcaggtggtttctaaagtcctgaacgacgtgcagttgaacgccgactggaaagcggaagtcgaagagatgcgcacgcgtattctaagcatgcgtcaggagttggtttccgcattgaaaaacgcactgccgaaccgcaacgtcgactacctgctcacccagcgcggtatgttcagttacacgggtttcagcccggaacaagttgaccgcctgcgtgaagaatttggcgtgtacctgatcgccagcggccgtatgtgtatggcgggactcaaccacagcaacgtccaacgcgtcgctgccgctttcgccgccattcagtaa

SEQ ID NO: 4799 - protein, 397 aa, Erwinia carotovora subsp. atroseptica SCRI1043
MFQNVDTYAGDPILSLMEKFKQDPRADKINLSIGLYYNEQNIIPQLRSVSTAESSLRQPAQSANSYLPMEGLQPYRTAIQHLLFGESHAALEAGRIATIQTLGGSGALKVGADFLKRYFPASEVWVSDPTWENHIAIFEGAGFNVHTYPYFDSESLGVKFDAMLSTLQTLPTRSIVLLHPCCHNPTGSDLTTEQWDRVIEVIIQRELIPFMDIAYQGFGLGIEQDAYAIRAVASAGVPALIANSFSKIFSLYSERVGGLSVVCDDADSAQRVLGQLKATVRRNYSSPPNFGAQVVSKVLNDVQLNADWKAEVEEMRTRILSMRQELVSALKNALPNRNVDYLLTQRGMFSYTGFSPEQVDRLREEFGVYLIASGRMCMAGLNHSNVQRVAAAFAAIQ

SEQ ID NO: 4800 - DNA, 1197 bp, Desulfotalea psychrophila LSv54
  CDS (1)..(1197): transl_table=11
atgtggcagaatattgaggcagcaccagcggattctattttaggtcttaccgaggcctttcgtaatgaccccaatcctgcaaaggtaaatcttggcgttggcatttataaggatgaacagggagcaacccctattttacagtgtgtgaagaatgctgaagctcggttgattgaaaccgaggaaagcaaggtctatctgcctatatccggtgcccccgcctatacagaaaacgtacagaagctgctctttggtgaagagagtgaagttatcagctcaaaacgggcgatcacagcccatgcccccggtggcacaggtgccctgaggatgggggcggggctgttgaagacatttttccctgaggccaaggtatgggtaagcactcccacctgggccaaccatacgggtatcttttccagcacaggttttgagattgctcactatccatactatgatgagactcaccgtagcgttgattttcaggccatgctgatgagtctgcgggcagtacctgagggtgatattgtccttcttcatgcctgctgtcataatcccaccggtgttgatttgacactggagcagtggcatcaggttgtagccattgctcaagagaggaactggattccctttcttgactttgcctatcagggctttggcgtcggcacctccgaggatcgctgtgccatagagctctgtgccgaggcggggattgatttttttgtcgccagctctttttccaagaactttggtatgtataatgagcgtaccggagcaattaccgtggttgctgcaaatcaagcaagtgcggctgtggccctcagtcatctgaagaagaccatccgggttgtctactctaatcctccagcccatggtggcctggtggcagctactattttgagtgaccctgaactctatgatctctggcagcaggagctgcaggatatgcgcgagcgcatcatcgccatgcgcgttgctctggtagagggcttgagttcacgcggggttgatcaggatttcagctttattaccgagcagtctggtatgttctcttttagtggtctctccgatgagattgttgcctggcttcgtaaggagaagagtatctatgtggtgggtggtggtcggattaatcttgctggtcttactgccagcaatatagactatgtctgtgatgccattgccgaggctcttaagtcgtag

SEQ ID NO: 4801 - protein, 398 aa, Desulfotalea psychrophila LSv54
MWQNIEAAPADSILGLTEAFRNDPNPAKVNLGVGIYKDEQGATPILQCVKNAEARLIETEESKVYLPISGAPAYTENVQKLLFGEESEVISSKRAITAHAPGGTGALRMGAGLLKTFFPEAKVWVSTPTWANHTGIFSSTGFEIAHYPYYDETHRSVDFQAMLMSLRAVPEGDIVLLHACCHNPTGVDLTLEQWHQVVAIAQERNWIPFLDFAYQGFGVGTSEDRCAIELCAEAGIDFFVASSFSKNFGMYNERTGAITVVAANQASAAVALSHLKKTIRVVYSNPPAHGGLVAATILSDPELYDLWQQELQDMRERIIAMRVALVEGLSSRGVDQDFSFITEQSGMFSFSGLSDEIVAWLRKEKSIYVVGGGRINLAGLTASNIDYVCDAIAEALKS

SEQ ID NO: 4802 - DNA, 1194 bp, Yersinia pseudotuberculosis IP 32953
  CDS (1)..(1194): transl_table=11
gtgttccagaatgttgacgcctacgcaggtgaccccatcctttcactgatggaaagttttaaagccgataaccgggcacataaggtgaatctgagtattgggctttattacaatgaacaaggtgaaatcccgcaaatgcaggctgtggatgctgccgaagcgcaattgagtgctcaacctcatgggacaccggtttatttaccgatggaaggtctgcaatcttaccgtactgctatccagcaattattatttggtcacgaccatccaatgctggttcagcaacgggtggcgacaatacagacggtgggcggttctggtgcgttgaaagtcggggctgatttccttaatcactatttccctgattcacaggtgtgggtcagcgatcctacctgggaaaaccacgtggctatttttagcggcgcaggttttaaagtgaacacctatccgtatttcgacaatgataagctggcggtgaagtttgacccgatgctggcaaccttgcagcaattgcccgccagaagcatcgtgttgttacatccttgctgccacaatccaaccggttctgatctgaccaatgcccaatgggatcgcctcattgatgtggtaaaagagcgtgaactgatcccgttcctggatatagcgtaccaaggctttggggcagggctgaatgaagatgcttatgctatccgcgctatggccgcagctggattgccatgcctcatcagcaactccttctcaaaaatcttctcgctctataacgagcgggtcggtggtttatctgtggtgtgtgaaagtgacgaggccgcagggcgtgtattgggccaattgaaagcgacagtgcgccgtaactattccagcccgccaaactttggtgcgcaggtcgtttcgaaagtcctaaatgatacggtattgcgcgcgcaatggcaggcagaggtggaacagatgcgcctacggatccttgatatgcgccacacgctggtggaagccttaaaagcctcgttaccagagcgcaattttgattatctgttgcaacaacgcggcatgttcagctacaccggctttagtgaggcacaggtagatcgcttacgtgaagagtttggtgtgtatctgattgcgagcggaagaatgtgtatggcgggagtcaatcaccagaatgttgagcaggttgcggttgcttttgcggcggtacagtaa

SEQ ID NO: 4803 - protein, 397 aa, Yersinia pseudotuberculosis IP 32953
MFQNVDAYAGDPILSLMESFKADNRAHKVNLSIGLYYNEQGEIPQMQAVDAAEAQLSAQPHGTPVYLPMEGLQSYRTAIQQLLFGHDHPMLVQQRVATIQTVGGSGALKVGADFLNHYFPDSQVWVSDPTWENHVAIFSGAGFKVNTYPYFDNDKLAVKFDPMLATLQQLPARSIVLLHPCCHNPTGSDLTNAQWDRLIDVVKERELIPFLDIAYQGFGAGLNEDAYAIRAMAAAGLPCLISNSFSKIFSLYNERVGGLSVVCESDEAAGRVLGQLKATVRRNYSSPPNFGAQVVSKVLNDTVLRAQWQAEVEQMRLRILDMRHTLVEALKASLPERNFDYLLQQRGMFSYTGFSEAQVDRLREEFGVYLIASGRMCMAGVNHQNVEQVAVAFAAVQ

SEQ ID NO: 4804 - DNA, 1263 bp, Mannheimia succiniciproducens MBEL55E
  CDS (1)..(1263): transl_table=11
ttgcaaattacaatccttgtgagtataaaagaaaaactcatatcaaagcacaacatttctaaggaaagccctatgtttaaaaatatcactccggcacctgccgacccgattttaggtttaggtgaagccttcaaagcggaaaccagagaaaataaaatcaatttaggtattggcgtttataaagatgcggacggtgtaacgcctattatgactgcagtaaaaaaagcggaaggccagttatttgaaaacgaaaaagataaaaactacctgcctatagagggtgttgcggaatataacgcttatgcaaaagaattgttattcggtaaagattcggaaattatcgcatcaaaccgagcctgcacggtgcaaaccttaggcggaaccggcgcattgcgtattgccgcagaatttgtgcgtcgccaaactaaagcacaaaacgtatggatcagcaaaccgacctggccgaatcataatgcgatttttaatgccgtcggcgtaactattcgcgaatatcgttggtacaaccctgaaactaaagccttagactgggataatttactggctgatttaaacaatgccaacccgggggatgtggtgttattgcacggctgctgtcacaacccgaccggtattgacccgacaccggaacaatggaaagcattagccgagatgtcagcgaaaaacggctggttgccgctattcgactttgcttaccaaggtctggcaaacggtttggaagaagatgccgtcggtttacgtactttcgcagaaacccatcgcgaattattagttgccagctcgttctctaaaaatttcggtttatacagcgaacgtgtcggtgcctttacattagttgcggataatgcggatgtggcggcggtagctttaacacagataaaatcaattatccgtacgctgtattctaacccgtccgctcatggcgcccgtaccgttgcaaccgtattggcaaatccggaactgcgcaaagaatgggaagacgaattaacgagtatgcgtgatcgcatcaaacaaatgcgtaagcaactggttgaattacttaaagaattcggtgcacaggaagatttcagctacatcattgatcaaaaaggaatgttctcattcagcggattaaccgccgaacaggttgaccgtttgaaagaagaattcgctatttacgccgttcgttccggcagaatcaatgtggcgggaatcactgaagccaatatccgttaccttgccgaaagcattgtaaaagtactttaa

SEQ ID NO: 4805 - protein, 420 aa, Mannheimia succiniciproducens MBEL55E
MQITILVSIKEKLISKHNISKESPMFKNITPAPADPILGLGEAFKAETRENKINLGIGVYKDADGVTPIMTAVKKAEGQLFENEKDKNYLPIEGVAEYNAYAKELLFGKDSEIIASNRACTVQTLGGTGALRIAAEFVRRQTKAQNVWISKPTWPNHNAIFNAVGVTIREYRWYNPETKALDWDNLLADLNNANPGDVVLLHGCCHNPTGIDPTPEQWKALAEMSAKNGWLPLFDFAYQGLANGLEEDAVGLRTFAETHRELLVASSFSKNFGLYSERVGAFTLVADNADVAAVALTQIKSIIRTLYSNPSAHGARTVATVLANPELRKEWEDELTSMRDRIKQMRKQLVELLKEFGAQEDFSYIIDQKGMFSFSGLTAEQVDRLKEEFAIYAVRSGRINVAGITEANIRYLAESIVKVL

SEQ ID NO: 4806 - DNA, 1218 bp, Burkholderia pseudomallei K96243
  CDS (1)..(1218): transl_table=11
atgttcgaacaccttcccgcccaccccggcgacccgatcctgtcgctgttccaggcgtttcagcgcgatcccgagccgcgcaaggtcaatctgagcatcggcctttactacgacgaaaacggcgccgtgccggtgctcgacagcgtgcgcgcggcggcggcgcggctggccgcgcgggacgacgcccacacgtatctgccgatggaaggcatggccgactaccggcgcgcgctgcaggcgctcgtgttcggcgcgaacagccccgcgctgcgcgagcagcggatcgcgaccgtgcagacggtaggcggctccggcgcgctgcgcctcggcgcggatctgctcaagcgctatttccccgacagcgcgatctggatcggcgatccgacgtgggacaaccaccgcgtgctgttcgccgcagcgggactcgacgtgcatacgtatccgtattacgacgcggcgacgaacggcgtgcgcttcgacgcgatgatggcgacgctcgacacgctgcccgcgcgcgcgatcgtgctgctgcagccgtgctgccacaacccgacgggcatcgatctgtcgcgcgagcagtggcgcgagctcgccgcgctgtgcgagcggcgcgcgctgattgcgtttctcgacatcgcgtatcagggcttcggcgacggcctcgacgacgacgcgtggccgatccgcgcgatggccgatgcggggctgcccgtgtttgtcagccattcgttctcgaagaacttctcgctgtacggcgaacgctgcggcgggctgtcgatcgcatgcgcgaacgaacgcgaggccgcacgggtgctgagccagatccaggcgggcgtgcgccgcgtctattcgagcccgccgctgcacggcgcgcgcctcgtctcgaccgtgctgaacgatccggcgctcgcgcggcaatgggaccgcgacgtcgccgcgatgcgcgcgcgaatcaagcggatgcgcaccgcgctcgccgcgcggctcgcggcgcgcgtgcccggcgcgtcgttcgactatctcgtcgagcagcgcgggatgttcagctacacggggctcgcgccccatgaggtcgacgcgctgcgcgagcacgacggcgtctatctgctgcgctccggccgcgcatgcatcgcggggctgagcgatgcgaacgtcgaccatgtcgcgaacgcgatcgccgcggtgttgaaggcgcggcgagcgcgcgccgcggcgtga

SEQ ID NO: 4807 - protein, 405 aa, Burkholderia pseudomallei K96243
MFEHLPAHPGDPILSLFQAFQRDPEPRKVNLSIGLYYDENGAVPVLDSVRAAAARLAARDDAHTYLPMEGMADYRRALQALVFGANSPALREQRIATVQTVGGSGALRLGADLLKRYFPDSAIWIGDPTWDNHRVLFAAAGLDVHTYPYYDAATNGVRFDAMMATLDTLPARAIVLLQPCCHNPTGIDLSREQWRELAALCERRALIAFLDIAYQGFGDGLDDDAWPIRAMADAGLPVFVSHSFSKNFSLYGERCGGLSIACANEREAARVLSQIQAGVRRVYSSPPLHGARLVSTVLNDPALARQWDRDVAAMRARIKRMRTALAARLAARVPGASFDYLVEQRGMFSYTGLAPHEVDALREHDGVYLLRSGRACIAGLSDANVDHVANAIAAVLKARRARAAA

SEQ ID NO: 4808 - DNA, 1215 bp, Azoarcus sp. EbN1
  CDS (1)..(1215): transl_table=11
atgttcgagcacgtcgacgcctatcccggcgaccccatcctctccctcgtcgaaactttccaccacgacccgcgcccgcggaaggtgaacctcggcatcgggctctactacgacgaagagggccgcatcccgctgctcggttcggtcgagaaggccgaggcagcgctggcggcaaatcccggtccgcggccctacctgccgatggaaggagcggccgactatcgcgccgctgtccagaaactcctgttcggtcccgacagcgcagcgttgcgcgcgggccgcatcgcgacgatccagaccatcggaggctcgggcgcattgaaggtcggcgccgacctgctcaagcggtattttccggcgagcgaagtgtgggtcagcgatccgacctgggacaaccatcgttcgatcttcgagggcgccggcatcgaagtgcacgactacccgtactacgacgcggcgagcggcggcgtgcgctttgacgagatgattgagaccctgcagtcgctgcccgcgcagagcatcgtgctgctgcacccgtgctgccataatccaacgggcgtcgacctgtcgacagcacaatggcaggaagtgatcgcagtggtggcgtcgcgcggactgatcccgttcctcgacatcgcgtaccagggcttcggcgacaacctcgacgacgatgcgtacgcggcccgggcgatggccgacgcaggggtgagtttcttcgtcagcaactcgttttccaagaacctgtcgttctacggcgagcgctgcggcggcctgtcggtcgtgtgccaggatgccgatgaagccgagcgcgtgctaggccagctgaaattcaccgtgcgccgcaactactcgagcccgcccgtgcatggcggccgggtcgctgccgcagtcatgaacgatgccggactgcacgaggaatgggtcggtgaagtgcgtggcatgcgcgagcgcatcaaggcgatgcgcgagaagctccacgaagtactgagcagcaccttgccggggcgggatttcagctatttcgtcaaacagcgcggcatgttcagctataccgggctgactcccgagcaggtcgatcgcctgcgcgaggagttcgccgtgtacgtcgtgcagtccggccgcatgtgcgtcgctggtctcaaccggggcaacgtcgattacgtcgcgaaagcgatggctgccgtgctgcaggaggccggcaccgccgctgcctga

SEQ ID NO: 4809 - protein, 404 aa, Azoarcus sp. EbN1
MFEHVDAYPGDPILSLVETFHHDPRPRKVNLGIGLYYDEEGRIPLLGSVEKAEAALAANPGPRPYLPMEGAADYRAAVQKLLFGPDSAALRAGRIATIQTIGGSGALKVGADLLKRYFPASEVWVSDPTWDNHRSIFEGAGIEVHDYPYYDAASGGVRFDEMIETLQSLPAQSIVLLHPCCHNPTGVDLSTAQWQEVIAVVASRGLIPFLDIAYQGFGDNLDDDAYAARAMADAGVSFFVSNSFSKNLSFYGERCGGLSVVCQDADEAERVLGQLKFTVRRNYSSPPVHGGRVAAAVMNDAGLHEEWVGEVRGMRERIKAMREKLHEVLSSTLPGRDFSYFVKQRGMFSYTGLTPEQVDRLREEFAVYVVQSGRMCVAGLNRGNVDYVAKAMAAVLQEAGTAAA

SEQ ID NO: 4810 - DNA, 1206 bp, Azoarcus sp. EbN1
  CDS (1)..(1206): transl_table=11
atgccttcgatcttcgccgccgtcgagatggcgcctcgtgacccgattctcggcctgaacgaggccttcaacaccgacacccgcaccgacaaggtcaaccttggtgtcggcgtctattacgacgacaacggcaagattccgctgctggccgcagtgaaggctgccgaaaaggcgcgcctcgaggccatgccgccgcgtggctaccagccgatcgaaggcgctccggcctacaacaacgcggtgcagaacctgctgttcggcaaggattccgcactgattgcaaacggtcaggtggtgacgatacaggcgctcggcggcaccggggcgctgaaagtcggcggcgactacctgaagcggctgaatccggctgcaaccgtctacatttccgatcccagctgggaaaaccaccgcgcgatcttcgagtccgccggtttcgcggtcgacacctacccgtactacgatccggcgacgcgcggcgtgaacttcgcgggcatgaaagcgaagctcggcgaactggctgccggcgccgtcgtcgtgctgcacgcgtgctgccataacccgaccggcgccgacctcaccgaagcgcagtggggcgaagtggtcgaggcctgccgcgcgcgcggcctcgtgcccttcctcgacatggcgtatcagggtttcgccgacggcatcgagccggatgcagtcgcggtgcgcctgttctccgccagcggcctgcagttcttcgtctccagttcgttctcgaagtcgttctcgctgtacggcgagcgcgtcggcgcgctgtcgatcgtcactgcggacaaggacgaagccggtcgcgtcctgtcgcaggtcaagcgcgtcatccgcacgaactactcgaacccgcctacccacggcggcgcagtcgtcgctgccgtgctcaacgcccccgaactgcgccagatgtgggaagacgagctcgccggcatgcgcgatcgcatccgcgcgatgcgcgttggcctggtcgagagcctcaaaggcgccggcgtcgcccaggatttctctttcgtcatcgagcagcgcggcatgttctcctacaccggcctgtccgccgctcaggtcgagcagctgaagaacgagttcggcatctacgcggtgtcgacgggacggatctgcctcgcggcgctgaactcgcgcaatatcggctacgtcgcgaaggcgatcgcgtcggtcgcgaaggcgtga

SEQ ID NO: 4811 - protein, 401 aa, Azoarcus sp. EbN1
MPSIFAAVEMAPRDPILGLNEAFNTDTRTDKVNLGVGVYYDDNGKIPLLAAVKAAEKARLEAMPPRGYQPIEGAPAYNNAVQNLLFGKDSALIANGQVVTIQALGGTGALKVGGDYLKRLNPAATVYISDPSWENHRAIFESAGFAVDTYPYYDPATRGVNFAGMKAKLGELAAGAVVVLHACCHNPTGADLTEAQWGEVVEACRARGLVPFLDMAYQGFADGIEPDAVAVRLFSASGLQFFVSSSFSKSFSLYGERVGALSIVTADKDEAGRVLSQVKRVIRTNYSNPPTHGGAVVAAVLNAPELRQMWEDELAGMRDRIRAMRVGLVESLKGAGVAQDFSFVIEQRGMFSYTGLSAAQVEQLKNEFGIYAVSTGRICLAALNSRNIGYVAKAIASVAKA

SEQ ID NO: 4812 - DNA, 1185 bp, Silicibacter pomeroyi DSS-3
  CDS (1)..(1185): transl_table=11
atgttcgaaaacctcaaggcgcagcctgcggacaagatccttgccctgatgcagatgtacaaggacgatccgcgcagcgacaagatcgacctgggcgttggcgtctacaagaacgccgagggcgtgaccccggtgatgcgcgccgtcaaggcggccgaaaagatcgtgtgggagcaacaggagagcaaatcctataccgggctgatcggcgatccggcctattcggatgcgatgatcaagctgatcctgggcgatgcggtgcagcgcgccaatgtcggcgctgcggccacgccgggtggcaccggcgcatgccggcaggcgttcgagctgatcaagatggccagtcccgaggcgcgggttttcgtctcggacccgacctggcccaaccatatctcgatcctgaactacctgggcatgaccatggtgccctatcgctatttcgatgccgacagccgtggcgtcgatttcgagggcatgctggtcgatctgggtcaggcgcgcgcgggcgacgtggtgctgctgcatggctgctgccacaacccgaccggcgccaacctgaacctgagccagtggagagaggtggtgaagctgatcaatgccaagggcctcgtggcgatgatcgacatcgcctatcagggctttggcgacgggctggaggaagatgcgcagggcacccgactggtggcctcgtcggtcaaggaatgcctgatcgcggcgtcctgctccaagaactttggcgtctatcgcgagcgcaccggcctgttgatggcggtcagtcaggacagcggccagaccgcgctgaaccaggcgactttggcgtttctgaaccgtcagaactattccttcccgcccgatcacggcgcgcgggtggtgaccaccatcctgaacgacgacgcgctgcgcgccgactggatggccgagctggaggaaatccgcctgtcgatgctgggtctgcgccagcagctggccgacgagttgcagcgtctgagcggctcggaccggttcagttttatcgcgcagcaccggggcatgttctcgcgtatcggcgcggcgcccgagttggtcgagaagctgcggaccgagttcggcatctacatggtgggcgacagccggatgaatatcgccgggctgaatgcccagacggtgccgatcctggccaaggcgatcatcgacgccgggatctga

SEQ ID NO: 4813 - protein, 394 aa, Silicibacter pomeroyi DSS-3
MFENLKAQPADKILALMQMYKDDPRSDKIDLGVGVYKNAEGVTPVMRAVKAAEKIVWEQQESKSYTGLIGDPAYSDAMIKLILGDAVQRANVGAAATPGGTGACRQAFELIKMASPEARVFVSDPTWPNHISILNYLGMTMVPYRYFDADSRGVDFEGMLVDLGQARAGDVVLLHGCCHNPTGANLNLSQWREVVKLINAKGLVAMIDIAYQGFGDGLEEDAQGTRLVASSVKECLIAASCSKNFGVYRERTGLLMAVSQDSGQTALNQATLAFLNRQNYSFPPDHGARVVTTILNDDALRADWMAELEEIRLSMLGLRQQLADELQRLSGSDRFSFIAQHRGMFSRIGAAPELVEKLRTEFGIYMVGDSRMNIAGLNAQTVPILAKAIIDAGI

SEQ ID NO: 4814 - DNA, 1194 bp, Neisseria gonorrhoeae FA 1090
  CDS (1)..(1194): transl_table=11
atgtaccgacacatcgaatactatcccggcgacccgattttgagtttggtcgaaaccttcaaaaacgacccgcgccccgaaaaagtcaatttgagcataggcatttatttcgacgacgaaggcagaatgcccgtattggaatccgtaagccgtgccgaaaccgcccgtgccgccgcgccagcgccgtcgccctacctgccgatggagggtttggacgtttaccgcagcgcggtgcagcatttgttgttcggcaaaggcaaccccgcgctcgcgcagggacgcatcgttaccgtacagactctgggcggctcgggcgcgctcaaagtcggggcggatttcctgcaccgctggtttcccgaagcgcgcgcctacgtcagcgatccgacttgggacaaccatcgcggcatttttgaaggcgcaggtttcgaggtcggcacttacccatattacgaccctgccactgtcggcgtgaaattcgacgaaatgaccgcgtttttcaacaccctgcccgaaaacagcgtcctcatcctccatccctgctgccacaacccgaccggcgtggatatgtcggaacggcaatgggacgaagtgttgcagatcatcaaaacgcgcaaactgattccgtttatggacatcgcctaccaaggcttcggcggcgatttggacagcgatgcctacgccgtccgcaaagcggtggaaatggatttgccgctgtttgtcagcaattcgttttcaaaaaacctgtcgctctacggcgaacgcgtcggcggcttaagcgtggtttgccccaataaagaagaagcggatttggtgttcggacaactcaaattcaccgtccgccgcatctactccagcccgcccgcgcacggcgcgtatatcgccgccgacgtgatgaacagctccgaactttacgccttgtggcaaaacgaagtttatatgatgcgcgaccgcatccgtgcgatgcggcagaaactttacggcgtattgaccgcccgaatccccgaccgcgatttcacttatttcatcaaacagcgcggaatgttcggctacacggggttgagcgtggggcaagtccgcaggttgcgcgacgaatttgccgtttacctgctggattccggcaggatgtgcgtcgccgggctgaatacatcaaatatcacttatgtcgccgatgcgcttgccgaagtgttgaaataa

SEQ ID NO: 4815 - protein, 397 aa, Neisseria gonorrhoeae FA 1090
MYRHIEYYPGDPILSLVETFKNDPRPEKVNLSIGIYFDDEGRMPVLESVSRAETARAAAPAPSPYLPMEGLDVYRSAVQHLLFGKGNPALAQGRIVTVQTLGGSGALKVGADFLHRWFPEARAYVSDPTWDNHRGIFEGAGFEVGTYPYYDPATVGVKFDEMTAFFNTLPENSVLILHPCCHNPTGVDMSERQWDEVLQIIKTRKLIPFMDIAYQGFGGDLDSDAYAVRKAVEMDLPLFVSNSFSKNLSLYGERVGGLSVVCPNKEEADLVFGQLKFTVRRIYSSPPAHGAYIAADVMNSSELYALWQNEVYMMRDRIRAMRQKLYGVLTARIPDRDFTYFIKQRGMFGYTGLSVGQVRRLRDEFAVYLLDSGRMCVAGLNTSNITYVADALAEVLK

SEQ ID NO: 4816 - DNA, 1191 bp, Neisseria gonorrhoeae FA 1090
  CDS (1)..(1191): transl_table=11
atgttcttcaagcacatcgaagccgcccccgccgatccgattctcggtttgggcgaagcgttcaaagccgaaacccgccccgaaaaagtcaacctcggcatcggcgtgtacaaagacgcatccggcgcgacacccattgtcaaagccgtcaaagaggctgaaaaacgcctgttggaaagcgaaaccaccaaaaattacctgaccatcgacggcgttgccgactacaacgagcaaacccaaatcctgctgttcggcaaagaccacgaaatcatcgccagccgccgcgccaaaacagcgcaaagccttggcggtacaggcgcattgcgtattgcggccgaatttgccaaacgtcagttgaacgcgcaaaccatctggatttccaatccgacctggccaaaccacaacgccattgccaaagcggtcggtatccaagacaaaccttatcgctactatgatgccgccaaacactgcttggattgggacggcatgattgaagatttgaaccaagcgcaaaaaggcgacatcgtcctgctgcacggctgctgccacaaccctaccggtatcgaccctacgcccgaacaatgggaaactttagcaaaactttctgccgaaaaaggctggttgccattgtttgactttgcctaccaaggcttcggcaatggtttggaagaagatgcctatggcttgcgcgtgttcttgaaacacaatacagaattgctgattgccagctcttattccaaaaacttcggcatgtacaacgagcgtgtcggtgcattcactttggtggccgaagatgaagaaacagcagcccgcgcccacagccaaatcaaaaccatcatccgtaccttgtattccaacccggcttcacatggtgcgaacaccattgcactggtgttgaaaaatgatgatttgaaagcacaatggattgccgaacttgacgaaatgcgcggccgcatcaaagccatgcgccaaaaatttgtcgagttgctcaaggccaaaggttcaacccaagactttgattttattattgaacaaaacggtatgttctctttcagcggcttgactcccgaacaagttgaccgtttgaaaaacgagtttgccatttatgccgtccgttccggccgcatcaacgtcgccggcattaccgacgacaacatcgattatctgtgtgaaagcatcgtgaaagtatag

SEQ ID NO: 4817 - protein, 396 aa, Neisseria gonorrhoeae FA 1090
MFFKHIEAAPADPILGLGEAFKAETRPEKVNLGIGVYKDASGATPIVKAVKEAEKRLLESETTKNYLTIDGVADYNEQTQILLFGKDHEIIASRRAKTAQSLGGTGALRIAAEFAKRQLNAQTIWISNPTWPNHNAIAKAVGIQDKPYRYYDAAKHCLDWDGMIEDLNQAQKGDIVLLHGCCHNPTGIDPTPEQWETLAKLSAEKGWLPLFDFAYQGFGNGLEEDAYGLRVFLKHNTELLIASSYSKNFGMYNERVGAFTLVAEDEETAARAHSQIKTIIRTLYSNPASHGANTIALVLKNDDLKAQWIAELDEMRGRIKAMRQKFVELLKAKGSTQDFDFIIEQNGMFSFSGLTPEQVDRLKNEFAIYAVRSGRINVAGITDDNIDYLCESIVKV

SEQ ID NO: 4818 - DNA, 1194 bp, Chlamydophila abortus S26/3
  CDS (1)..(1194): transl_table=11
atgagtttttttcatcaattacccacgtttgctcccgattctattttgggtttgcaaaaactatttttagaagacgagcgagaggagaaggtcaatcttgttataggttcttatgaagatcctaacaaggcttatggtggcttttcgagtgtccgcaaggcgcaattttcattgttagaaaacgagatgaataaagggtacttacctattagtgggttattgtcttttaatcagcaaatggaaagtcttgtttttggtgatgatgtaaatccgagttttgttgttggtgcccaagctctcgggggaacgggagcgttgcatttaggtgctaagattttcgccatggctcacccttctgctgcagtatacattcccgaacagacatggggaaaccatttgagaatatttgctcaacaaggtttagatgttctaaaatatccttattatagttcagaaagtaaaacactcgtttttgatgagatgatttctgtattgaaatctgctcccaagaactctttagtgcttttgcaatgttgttgtcataatcctacaggaatggaccttgacgagaacatgtggactcgtcttgcagaactgatgaaagaacgtcagcttcttcctttttttgatacggcgtatttaggctttgggttaggtatcgaagaagatagaaagcctataaagatttttatagattcagggcatactgtatttgtagccgcatgcgcaagtaagaatttttctctttatggggagcgtgtaggctattttgctgcatatagtcgggttgttgatgatttagataagatttctagctgtctcgaagaaaaaatacgaggagagtattcttcaccacctcgacatggagcgaaaattgtttctacaattttatcagatgcctctttaaaaacagaatggttggcagaattagacacgattcgttgttctttacaaaaaacacgcacgcgatttgttcaggctatgcgcaatcatattggtcattcttttgattttatcctatctcagaaaggattttttggttacccaggattttctttagaacaagtcttatttttaagattagaaaaaggtatttacacaaccagtggagccaggtttaatctcaacggaatcaccgataataacatcgatcatgtagttcagagctttgctgaggcataccaacaagcttag

SEQ ID NO: 4819 - protein, 397 aa, Chlamydophila abortus S26/3
MSFFHQLPTFAPDSILGLQKLFLEDEREEKVNLVIGSYEDPNKAYGGFSSVRKAQFSLLENEMNKGYLPISGLLSFNQQMESLVFGDDVNPSFVVGAQALGGTGALHLGAKIFAMAHPSAAVYIPEQTWGNHLRIFAQQGLDVLKYPYYSSESKTLVFDEMISVLKSAPKNSLVLLQCCCHNPTGMDLDENMWTRLAELMKERQLLPFFDTAYLGFGLGIEEDRKPIKIFIDSGHTVFVAACASKNFSLYGERVGYFAAYSRVVDDLDKISSCLEEKIRGEYSSPPRHGAKIVSTILSDASLKTEWLAELDTIRCSLQKTRTRFVQAMRNHIGHSFDFILSQKGFFGYPGFSLEQVLFLRLEKGIYTTSGARFNLNGITDNNIDHVVQSFAEAYQQA

SEQ ID NO: 4820 - DNA, 1197 bp, Pseudomonas syringae pv. syringae B728a
  CDS (1)..(1197): transl_table=11
atgagcctgttttccgctgtcgaaatggcaccccgcgatccgatcctgggtatcaacgaagccttcaacgccgacacccgcagcaccaaggtcaaccttggcgtaggcgtctactgtgatgaagacgggcgcatccccctgctgcgcgccgtggccgaagccgagaaggtccgcgtggcccagcatgctccgcgcggctacctgccgatcgacggtattgccgcctatgaccaggctgtgcaaaaactgttgctgggcgctgattcgccgctgatcgcctcgggccgcgtgctgaccacccaatcggtcggcggcaccggcgcactgaagatcggtgccgacttcctcaagcagctgctgcccgatgccgtcgtcgccatcagcgacccgagctgggaaaaccaccgtgcgctgttcgaaaccgcaggctttgcggtgcagaactatcgctactacgacgctgccactcacgacgtgaaccgtgccggcatgctcgaagacctgcacaacctgccgaacaactcggtggtggtgttgcatgcctgctgccacaacccgaccggcgtcgacctgagcctggatgactggaagaaagtgctggaagtggtcaaggccaagggccacgtaccgtttctggacatggcctaccaaggcttcggtcagggtattcaggaagatgcgctggcagtgcgcctgtttgccgagtcgggcctgaccttcttcgcctccagctcgttctccaaatcgctgtcgctgtatggcgaacgcgtcggcgcgctgtcgatcatcaccgaatcgaaggaagaaaccactcgcgtcctgtcccaggtcaaacgcgtgatccgtaccaactactccaacccgccgacccacggtgcgatcatctccgctgcggtgcttaacgacccgacgttgcgtgcaatgtgggaagaggaactaggcgaaatgcgtctgcgcatccagggcatgcgcaaggcgatggtcgagcgtctggctgataacccggccggtcaggacttcagcttcgtcgctcgccagtgcggcatgttttcctactccggcctgaccgccgaacaggcccagcgcctgcgcagcgagttcggcatctacgcgctggacaccgggcgtatctgcgtggccgcgctgaatcagaagaacatcgacgtagtgtgtgatgcgatcaagcaggttctttaa

SEQ ID NO: 4821 - protein, 398 aa, Pseudomonas syringae pv. syringae B728a
MSLFSAVEMAPRDPILGINEAFNADTRSTKVNLGVGVYCDEDGRIPLLRAVAEAEKVRVAQHAPRGYLPIDGIAAYDQAVQKLLLGADSPLIASGRVLTTQSVGGTGALKIGADFLKQLLPDAVVAISDPSWENHRALFETAGFAVQNYRYYDAATHDVNRAGMLEDLHNLPNNSVVVLHACCHNPTGVDLSLDDWKKVLEVVKAKGHVPFLDMAYQGFGQGIQEDALAVRLFAESGLTFFASSSFSKSLSLYGERVGALSIITESKEETTRVLSQVKRVIRTNYSNPPTHGAIISAAVLNDPTLRAMWEEELGEMRLRIQGMRKAMVERLADNPAGQDFSFVARQCGMFSYSGLTAEQAQRLRSEFGIYALDTGRICVAALNQKNIDVVCDAIKQVL

SEQ ID NO: 4822 - DNA, 1200 bp, Pseudomonas syringae pv. syringae B728a
  CDS (1)..(1200): transl_table=11
atgctagcccacgtggagtcatacgccggtgatccgatcctttcgctgatggagacctttggcaaggacccgcgtgcggacaaggtcaatctgagcatcggcctgtattacgacgcacagggccgcatcccgcagttggcatgcgtagcaacagcgcaacagcaactggccgaaggcgaacaggcggcgtccgtgtacctgccgatggaaggcctggcggcgtatcggcaggcggtgcaaaccctgttgttcggcgccgatcacccgctggttcaggcaggccgtgtcgccaccattcaaaccgtgggcggctcgggcgcgctgaagataggtgccgatttcctcaaatatgcgtttccggactcgcaggtctgggtgagtgacccgacctgggaaaaccataacgcgctgttcggcggggcgggcttcaaggtcaatgcgtatccgtactttgatgcccagaccggcggcgtcaggttcgagaccatgctcgacacggtgcaggggctgccggcgcagagcatcctcctgctgcacccgtgctgccataacccgaccggtgccgatctgacggtggcgcaatgggaccgcctgatcgaagtgatcaaggatcgtcagctcatcgccttcctggatatcgcctaccagggcttcggcaaaggcatcgacgaagacgtctatgccatccgggcgatggccaacgcaggtatcaccacgctggtcagtaactcgttctcgaaaatcttctcgctgtatggcgagcgggtaggcgggctgtcggtggtctgtgaggacacgacgtcggcggccaatgtgttcggccagctcaaggcaaccgtgcgccgcaactactccagcccgcctgcacatggcgcgtttctggtctcgaaagtgctcaacacgccgcacttgcgcgagcagtggctgggtgaagtcgaggccatgcgcctgcgtatcatcgacatgcgcacgcggctggtcgaggtgctggcgcagaaggtctccggccacgatttcagctttatcctcaggcagaacgggatgttcagctacaccggtctgaccccgcagcaggtcgacgaactgaaagatgttcacggcatttacatgctgcgcagtggccgggtgtgcatggcaggtttgaatgaagggaatatcgacaaggtatgtaacgcaatcgcgagcctcttcgcccgttaa

SEQ ID NO: 4823 - protein, 399 aa, Pseudomonas syringae pv. syringae B728a
MLAHVESYAGDPILSLMETFGKDPRADKVNLSIGLYYDAQGRIPQLACVATAQQQLAEGEQAASVYLPMEGLAAYRQAVQTLLFGADHPLVQAGRVATIQTVGGSGALKIGADFLKYAFPDSQVWVSDPTWENHNALFGGAGFKVNAYPYFDAQTGGVRFETMLDTVQGLPAQSILLLHPCCHNPTGADLTVAQWDRLIEVIKDRQLIAFLDIAYQGFGKGIDEDVYAIRAMANAGITTLVSNSFSKIFSLYGERVGGLSVVCEDTTSAANVFGQLKATVRRNYSSPPAHGAFLVSKVLNTPHLREQWLGEVEAMRLRIIDMRTRLVEVLAQKVSGHDFSFILRQNGMFSYTGLTPQQVDELKDVHGIYMLRSGRVCMAGLNEGNIDKVCNAIASLFAR

SEQ ID NO: 4824 - DNA, 1191 bp, Haemophilus influenzae 86-028NP
  CDS (1)..(1191): transl_table=11
atgtttgaacatattaaagcggcaccagccgatccaatcttaggcttaggcgaagcattcaaatccgaaactcgcgaaaataaaattaacttgggtattggcgtttataaagatgcgcaaggcacaaccccgattatgcgtgcagtgaaagaagcagaaaaacgcttatttgataaggaaaaaacgaaaaattatctgactatcgatggtattgctgattataacgaacaaacaaaagcgttacttttcggtaaagattctgaagtcatcaaatctaatcgtgcaagaacagtacaaagtttaggcggaacaggcgcattacgcattgcggcagaatttattaaacgtcaaactaaagcacaaaatgtttggatcagcaccccaacttggccaaaccacaatgccattttcaatgccgtcggtatgacaattcgtgaatatcgttattatgatgctgaacgcaaagcccttgattgggatcatttacttgaagatttaagccaagcaagcgaaggcgatgtggtgcttttacacggttgttgccataatccgactggtattgaccctactccagaacaatggcaagaattagccgcactttcggcgaaaaacggctggttgccactctttgactttgcttatcaaggtttagccaatggattagatgaagatgcttatggcttgcgtgcttttgcggcaaaccacaaagaattgttagtagcgagttcattctcgaaaaactttggtttatataatgaacgtgttggtgcctttactcttgtggcagaaaatgcagaaattgcatcaaccgcattaacccaagtgaaatcaattattcgtacactctactctaaccctgcatctcacggcggcgcaactgtagcaacagtattaaatgacactcaacttcgccaagagtgggaaaatgaattaactgaaatgcgcgaacgtatcaaaaaaatgcgtcatttattcgttcagttattaaaagaatacggtgcggaacaagatttcagctttatcattgaacaaaacggtatgttctctttcagtggattaactggggaacaagtggatcgcttaaaagaagaatttgccatttatgctgttcgttctggtcgtatcaatgtggctggtattactgaagataatattcgctatttatgtgaaagcattgtgaaagtgctttaa

SEQ ID NO: 4825 - protein, 396 aa, Haemophilus influenzae 86-028NP
MFEHIKAAPADPILGLGEAFKSETRENKINLGIGVYKDAQGTTPIMRAVKEAEKRLFDKEKTKNYLTIDGIADYNEQTKALLFGKDSEVIKSNRARTVQSLGGTGALRIAAEFIKRQTKAQNVWISTPTWPNHNAIFNAVGMTIREYRYYDAERKALDWDHLLEDLSQASEGDVVLLHGCCHNPTGIDPTPEQWQELAALSAKNGWLPLFDFAYQGLANGLDEDAYGLRAFAANHKELLVASSFSKNFGLYNERVGAFTLVAENAEIASTALTQVKSIIRTLYSNPASHGGATVATVLNDTQLRQEWENELTEMRERIKKMRHLFVQLLKEYGAEQDFSFIIEQNGMFSFSGLTGEQVDRLKEEFAIYAVRSGRINVAGITEDNIRYLCESIVKVL

SEQ ID NO: 4826 - DNA, 1191 bp, Pseudomonas fluorescens Pf-5
  CDS (1)..(1191): transl_table=11
atgcacttcgacgccatcggccgggttcccggcgacccgattctcggcctgatgggggcctacgccaacgatcccaacccgcgcaagttcgacctcggcgtgggggtctacaaggactcccagggcctgacgccgatcccgcgctcggtgaagctggccgaacagcgcctggtggacagccaggacaccaagatctacatcggcggccatggcgacacggccttcggcaaggtaatcaatgaactggtactgggcagcgattcgaaactgatcgccacccagcgtaccggcgccacgcagaccccgggcggcactggcgccctgcgcctgagtgccgacttcatcgcccactgcctgccgggccgtggcgtgtggctgagcaacccgacctggccgatccacgagaccatctttgccgcggccggggtcaaggtcagtcactacccctatgtgggcagcgacaaccgcctggacgtcgaggccatgctggcgaccctgaaccaggtgcccgagggcgacgtggtgctgctgcacgcctgctgccacaaccccaccggcttcgacctcggccacgccgactggcaacgcgtgctggacgtggtacgcagccgcaagctgctgccgctgatcgacttcgcctaccagggcttcggcgacggcctggagcaggatgcctgggcagtgcggctgttcgccgccgaactgccggaagtgctgatcaccagctcctgctcgaagaacttcggcctgtaccgcgaccggaccggcgctttgatcgtctgcacccaggacaccgagaaactgctcgatgtgcgcagccaactggcccatatcgcccgtaacctgtggtccacgccaccggatcacggcgcggcggtggtcgccaccatcctcggcgacccggagctgaaaagcctctgggccgacgaagtggaaaccatgcgcctacggatcgcgcaactgcgcgccggcctgctggaggccttgcagccttacggcctggccgaacgtttcgcgcatatcggcgtgcaacggggaatgttctcctacaccggcctgagccctgcccaggtccaggaactgcgtgaccaccacagcgtgtacatggtcagctccggccgcgccaacgtggccgggatcgacgccagccgcctggacttgctggctgaagccatcgcccgggtcgtatag

SEQ ID NO: 4827 - protein, 396 aa, Pseudomonas fluorescens Pf-5
MHFDAIGRVPGDPILGLMGAYANDPNPRKFDLGVGVYKDSQGLTPIPRSVKLAEQRLVDSQDTKIYIGGHGDTAFGKVINELVLGSDSKLIATQRTGATQTPGGTGALRLSADFIAHCLPGRGVWLSNPTWPIHETIFAAAGVKVSHYPYVGSDNRLDVEAMLATLNQVPEGDVVLLHACCHNPTGFDLGHADWQRVLDVVRSRKLLPLIDFAYQGFGDGLEQDAWAVRLFAAELPEVLITSSCSKNFGLYRDRTGALIVCTQDTEKLLDVRSQLAHIARNLWSTPPDHGAAVVATILGDPELKSLWADEVETMRLRIAQLRAGLLEALQPYGLAERFAHIGVQRGMFSYTGLSPAQVQELRDHHSVYMVSSGRANVAGIDASRLDLLAEAIARVV

SEQ ID NO: 4828 - DNA, 1197 bp, Pseudomonas fluorescens Pf-5
  CDS (1)..(1197): transl_table=11
atgagcctgttctccgctgtcgaaatggcaccacgcgatcctatcctgggcctcaacgaagcattcaacaccgatacccgcaccgataaggtcaaccttggggtgggcgtgtactgcaacgaggagggacgcattccgctcctgcgcgccgttgtcgaagccgagacgattcgcgccgcccaacatgcttcccgtggctacctgccgatcgacggcattgccgcctacgaccaggcggtacagaagctgctgttcggcaacgactcgccactgctggccgctggccgcgtggtcaccacccaggccgttggcggcactggcgccctgaagatcggtgccgacttcctcaagcagttgctgcccaacgccgtggtcgccatcagcgacccgagctgggaaaaccaccgcgccctgtttgagaccgccggcttcccggtgcagaactaccgctactacgacgctgccacccacgacgtgaaccgtgctggcctgctggaagacctgaacgccctgccggcccagtcgatcgtggtgctgcacgcctgctgccacaacccgaccggtgtcgacctgagcccacaggactggaaagacgtcctggaggtggtcaaggcgaaaaacctcgtgcccttcctcgacatggcctaccagggctttggcgacggcatcgacgaagacgccgcggcggtgcgcctgttcgccgagtcgggcctgaccttcttcgtttccagctcgttctccaagtcgttctcgctgtacggcgagcgcgttggcgccctgtccatcgtcagcagctccaaggaagaaagcgcccgcgtgctgtcccaggtcaagcgcgtgatccgcaccaactactccaacccgccgacccacggtgcaaccatcgtcgccgccgtgctgaacagcccggaactgcgcgcccagtgggagcaggaactggcgcaaatgcgcctgcggattcgcggcatgcgcacccagatggtcgacttgcttgccaaaggcgcccctgagcacgacttcagcttcgtcggtcgccagcgcggcatgttctcctactccggcctgaccgttgagcaagtgacccgcttgcgcaacgaattcggcatctacgccctggacaccggccgcatctgcgtcgccgcgctgaaccagaacaacatccatgtcgtgacccaggccatcctgcaagtgatctga

SEQ ID NO: 4829 - protein, 398 aa, Pseudomonas fluorescens Pf-5
MSLFSAVEMAPRDPILGLNEAFNTDTRTDKVNLGVGVYCNEEGRIPLLRAVVEAETIRAAQHASRGYLPIDGIAAYDQAVQKLLFGNDSPLLAAGRVVTTQAVGGTGALKIGADFLKQLLPNAVVAISDPSWENHRALFETAGFPVQNYRYYDAATHDVNRAGLLEDLNALPAQSIVVLHACCHNPTGVDLSPQDWKDVLEVVKAKNLVPFLDMAYQGFGDGIDEDAAAVRLFAESGLTFFVSSSFSKSFSLYGERVGALSIVSSSKEESARVLSQVKRVIRTNYSNPPTHGATIVAAVLNSPELRAQWEQELAQMRLRIRGMRTQMVDLLAKGAPEHDFSFVGRQRGMFSYSGLTVEQVTRLRNEFGIYALDTGRICVAALNQNNIHVVTQAILQVI

SEQ ID NO: 4830 - DNA, 1197 bp, Psychrobacter arcticus 273-4
  CDS (1)..(1197): transl_table=11
atgtttgaacgtatcgattactatgccggcgacccaatcttaggattgatggacaaatttgcagcagataacaacccagataaagtcaatttgggtgtcggtgtgtactatgacgaagatggcaaaatgccagtacttgagtgtgtaaaaacagctgaacagcgtattgcagacccaatctctcctcgtccgtatttgccaatggcaggtttaccaggacatcgcaaaggctgtcaagaattgctgtttggtaaagatgctcaggttttacaagatggcttggttgctactatcgcaaccatcggcggttctggtgcattaaaagtcggcgcagaatttatccacgaatggttcccgcagtctaagtgctatgtcagtgacccaacgtggggcaaccacattgctatttttgaaggctctgacgtcgaagtcggtaaatacccatactacgacaccgctactggtggcatcaaatttgatgagatgatcgcgttttttgagacgttgaataaagatgacgttcttttgcttcacccttgctgtcacaacccaacgggcgttgatttgactcgcgagcaatgggatcaagtactaaacgtcattcaagcgcgtgagctgattccgtttatggatatcgcttatcaaggctttggtgaagatatggacagcgatgcttacgcaattcgtaaagcggttgatatgggtctgccattgtttgttagcaactcattctctaaaaacttatcgctatatggcgagcgtgtcggtggtctatcagtcgtgtgcccaacagtcgatgaaactaaccgtgtttttggtcagctaaactctatggtacgtcgtatctactcaagcccgccatcacatggtggtcgcgtggtcgatatcgtgatgaacgacgaagccttgcatgagcaatgggttggcgaagtatatgcgatgcgtgaccgtatcaaatctatgcgcaccaagctcaaatcagtattagaagaaaaaatctcaggtcgtaactttgattacttgaccgcacaaaacggcatgtttagcttcacaggtctgacgcctgaacaagttgcacagctacaaagcaagtatggtatctatatggtatcgaactcacgtatgtgtgttgccggcttaaacagcagtaatatcgactatattgccaatgccatggttgacgtcttaaaagactaa

SEQ ID NO: 4831 - protein, 398 aa, Psychrobacter arcticus 273-4
MFERIDYYAGDPILGLMDKFAADNNPDKVNLGVGVYYDEDGKMPVLECVKTAEQRIADPISPRPYLPMAGLPGHRKGCQELLFGKDAQVLQDGLVATIATIGGSGALKVGAEFIHEWFPQSKCYVSDPTWGNHIAIFEGSDVEVGKYPYYDTATGGIKFDEMIAFFETLNKDDVLLLHPCCHNPTGVDLTREQWDQVLNVIQARELIPFMDIAYQGFGEDMDSDAYAIRKAVDMGLPLFVSNSFSKNLSLYGERVGGLSVVCPTVDETNRVFGQLNSMVRRIYSSPPSHGGRVVDIVMNDEALHEQWVGEVYAMRDRIKSMRTKLKSVLEEKISGRNFDYLTAQNGMFSFTGLTPEQVAQLQSKYGIYMVSNSRMCVAGLNSSNIDYIANAMVDVLKD

SEQ ID NO: 4832 - DNA, 1191 bp, Colwellia psychrerythraea 34H
  CDS (1)..(1191): transl_table=11
atgtttggtagtttaaaggctttgcctgccgatccaattcttggattattagctaaatataaaaaagataacaacccaaataaaattgatttgggtgttggcgtattcaaaaacgaagcaggtcatactgccgttttagattgtgtaaaaaaagctgaacaacatcgtaccaatactgaagacagtaaagtttacattggccctacaggctctcctgtctttaatgacgaaatggccaaacttatttttggtagtgagcataaagtattaaatgaaaaccgtgcccgcactatatcaacacctggcggtactggcgcattacgcgttgcggcggaatttattaagtcttgtaaagcaggtgcaactatttgggtaagcaacccaacatgggcaaatcatactggcttatttgcggctgctggtttaaacgttaaaacatatccttattacgattatgaaaacaaaagcttagactttgacggtatgttaaatgcccttaaagaagtgagcagcgatgacgtggtgttattacacgcttgttgtcataacccaagtggtatggatttaaataatgagcaatggcaacaagttgctgatgtagcgaaagatgttggtttcacaccattaatcgatatggcttatcaaggttttggctcaggtttagacgaagatgcttacggtctgcgtcttatggctgaaacagttaaagaaatgattgtttgtagttcatgttctaaaaactttggcttataccgagaacgtattggcgcttgtaccattattggtgaatcaagtatttctgttgatattgctaactctgttttactttacgttgtgcgcgttatctactcaatgccgccagcacatggtgccgctattgtcgaaaccatcttaagttcagatgaacttcgcaacgaatggtatgttgaattaaaagcaatgcgtgaccgcattaacggtaatcgtcaattaatcgttgataagttaatagaaaatggtgttacacgtgactttagctttattagtcgtcaaagtggtatgttctctttcttaggtcttacgcctgagcaagttcaacagctacaagatgaatacagcatttatttagtaggctctagccgaatgagtattgctggtattgccaatagcaatgttgattacttagcaaaatctattgctaaggtgctttag

SEQ ID NO: 4833 - protein, 396 aa, Colwellia psychrerythraea 34H
MFGSLKALPADPILGLLAKYKKDNNPNKIDLGVGVFKNEAGHTAVLDCVKKAEQHRTNTEDSKVYIGPTGSPVFNDEMAKLIFGSEHKVLNENRARTISTPGGTGALRVAAEFIKSCKAGATIWVSNPTWANHTGLFAAAGLNVKTYPYYDYENKSLDFDGMLNALKEVSSDDVVLLHACCHNPSGMDLNNEQWQQVADVAKDVGFTPLIDMAYQGFGSGLDEDAYGLRLMAETVKEMIVCSSCSKNFGLYRERIGACTIIGESSISVDIANSVLLYVVRVIYSMPPAHGAAIVETILSSDELRNEWYVELKAMRDRINGNRQLIVDKLIENGVTRDFSFISRQSGMFSFLGLTPEQVQQLQDEYSIYLVGSSRMSIAGIANSNVDYLAKSIAKVL

SEQ ID NO: 4834 - DNA, 1197 bp, Pseudomonas syringae pv. phaseolicola 1448A
  CDS (1)..(1197): transl_table=11
atgagcctgttctccgctgtcgaaatggcaccccgcgatccgatcctgggtatcaacgaagccttcaacgctgacacctgcaccaccaaggtcaaccttggcgtaggcgtctactgtgatgaagaggggcgcattcctctgctgcgtgccgtggctgaagctgaaaagatccgtgtcgcccagcacgcgccgcgcggttacctgccgatcgacggcattgccgcttatgaccaggccgtgcaaaaactgctgctgggagctgattcaccgctgatcgcttcaggccgtttgctgaccactcaatcggtcggcggcacaggtgccttgaagatcggtgccgacttcctcaagcaactgctgcccaacgcagtggtagcgatcagcgacccaagctgggaaaaccaccgcgcactgttcgaaaccgcaggtttcccggtgcagaactaccgttattacgacgcagccacccacgacgtgaaccgcgccggcatgcttgaagacctgcagaacctgccgaacaactcgatcgtcgtgctgcacgcctgctgccacaacccgactggcgtcgatctgagcctggatggctggaaaaaagtgctggaagtggtaaaggccaagggccatgtaccttttctggacatggcgtaccagggcttcggtcaaggcattcaggaagatgcactggctgtgcgcctgttcgccgagtcgggcctgaccttcttcgcctccagctcgttttccaagtcgctgtcgctgtatggcgaacgtgtgggcgcgctgtcgattattaccgaatcgaaagaagaaactgcccgcgttctgtcgcaggtcaagcgcgtgatccgcaccaactactccaacccgccgacccacggcgcaatcatttccgctgcggtgctaaacgacccggcactgcgcgccctgtgggaagaagaacttggcgagatgcgcgtgcgcattcaaggcatgcgcaaagccatggtcgagcggctggcggataacccgaccggtcaggacttcagctttgtcggccgtcagtgcggcatgttctcctattccggcctgaccgccgcacaggcacaacgcctgcgcagcgaattcggcatctacgcgctggataccgggcgtatctgcgtggcggcgctgaaccagaagaatattgatgccgtgtgcgacgcaatcaagaaagtgctgtaa

SEQ ID NO: 4835 - protein, 398 aa, Pseudomonas syringae pv. phaseolicola 1448A
MSLFSAVEMAPRDPILGINEAFNADTCTTKVNLGVGVYCDEEGRIPLLRAVAEAEKIRVAQHAPRGYLPIDGIAAYDQAVQKLLLGADSPLIASGRLLTTQSVGGTGALKIGADFLKQLLPNAVVAISDPSWENHRALFETAGFPVQNYRYYDAATHDVNRAGMLEDLQNLPNNSIVVLHACCHNPTGVDLSLDGWKKVLEVVKAKGHVPFLDMAYQGFGQGIQEDALAVRLFAESGLTFFASSSFSKSLSLYGERVGALSIITESKEETARVLSQVKRVIRTNYSNPPTHGAIISAAVLNDPALRALWEEELGEMRVRIQGMRKAMVERLADNPTGQDFSFVGRQCGMFSYSGLTAAQAQRLRSEFGIYALDTGRICVAALNQKNIDAVCDAIKKVL

SEQ ID NO: 4836 - DNA, 1200 bp, Pseudomonas syringae pv. phaseolicola 1448A
  CDS (1)..(1200): transl_table=11
atgctagcccacgtggagtcatacgctggtgatccgatcctttccctgatggaaacctttggcaaggattcccgtgcggacaaggtcaatctgagcatcggcttgtattacgacgcgcagggccgtatccctcagctggcatgcgtagcaacggcacaacagcaactggcccagggcgagcaggaggcttctgtctatctgccgatggaaggcctggcggcttatcggcatgcagtgcagaccctgttgttcggggcggatcacccgcttgtgcaggcaggacgcgtggcgaccatccagaccgtgggcggctccggcgcgctgaaagtaggtgccgacttcctcaagtatgccttcccggactcgcaggtctgggtcagcgatccgacctgggaaaaccacaacgcgctgttcggtggtgcgggcttcaaggtcaacagctacccgtatttcgacgcgcagactggcggggtcaggttcgaggccatgctcgatacggtgcagcgcctgcctgcgcagagcatccttttgctgcacccttgctgccacaacccgacaggtgccgatctgacagtcgagcaatgggaccggttgatcgaggttatcaaggatcgtcagctcatcgcgtttctggatattgcctatcagggctttggcaaaggcattgatgaggatgcctatgccatccgcgcaatggccaacgcaggtgttacaacgctggtcagtaactcgttctcgaaaatcttctcgctgtacggcgagcgggtcggcgggctgtcggtcgtctgcgaagacaccgcgtcggctgccaacgtattcggccagctgaaggccactgtacgtcgcaactactccagcccgcctgcgcatggcgcctttctggtttcaaaagtgctcaacacgccgcacctgcgcgagcagtggctgagcgaagtcgaggccatgcgcgtgcgcatcatcgacatgcgcacgcggctggttgaggtgctggcgcagaaggtttccggacgtgatttcagctttatcctcaggcagagcgggatgttcagctataccggtctgacgccacagcaggtcgatgaactgaaagacgttcacggcatttacatgctgcgcagtggccgggtgtgcatggcgggcctgaatgaaggcaatatcgacaaggtatgtaacgcaatcgcgagcctcttcacccactaa

SEQ ID NO: 4837 - protein, 399 aa, Pseudomonas syringae pv. phaseolicola 1448A
MLAHVESYAGDPILSLMETFGKDSRADKVNLSIGLYYDAQGRIPQLACVATAQQQLAQGEQEASVYLPMEGLAAYRHAVQTLLFGADHPLVQAGRVATIQTVGGSGALKVGADFLKYAFPDSQVWVSDPTWENHNALFGGAGFKVNSYPYFDAQTGGVRFEAMLDTVQRLPAQSILLLHPCCHNPTGADLTVEQWDRLIEVIKDRQLIAFLDIAYQGFGKGIDEDAYAIRAMANAGVTTLVSNSFSKIFSLYGERVGGLSVVCEDTASAANVFGQLKATVRRNYSSPPAHGAFLVSKVLNTPHLREQWLSEVEAMRVRIIDMRTRLVEVLAQKVSGRDFSFILRQSGMFSYTGLTPQQVDELKDVHGIYMLRSGRVCMAGLNEGNIDKVCNAIASLFTH

SEQ ID NO: 4838 - DNA, 1209 bp, Dechloromonas aromatica RCB
  CDS (1)..(1209): transl_table=11
atgtcctcttcgatcttcgctgcggtggaaatggccccgcgcgatcctatcctgggtctgaatgaagctttcaatgctgatgcgcgcactaccaaggttaaccttggcgtcggcgtgtatttcgacgacaacggcaagattccgctgctggccgccgtcaaggccgctgaggacgtccgcgtcaaggccgcactgccgcgcggctatcagccgatcgaaggcaatccggcctacaacacggctgtccagaacctgttgctcggcaaggactccgcactgatcgccaacggccaggtcatcaccgctcaggccctcggtggcacaggcgccctgaaaattggcgccgactacctgaagcgcctgaatccaaacgccaaggtatacatcagcgacccatcctgggaaaaccatcgcgccctgttcgaatccgccggcttcgtcgtagaaaactatccgtattacgacgccgccacgcgtggcgttaacttcgagggaatgaaggcctgcctgaagggtctggatgcaggctcggtcatcatccttcacgcttgctgccacaacccgaccggcgccgatttgtcggatgcccaatggagcgaagttgtcgcaatctgccaggagcgcggtttggtacccttcctcgacatggcctaccagggctttgccgatggtatcgatgccgacgccgtcgctgttcgtgctttctccgcttccggcctgcaattcttcgcttccagctcgttctccaagaacttctcgctttatggcgagcgcgtcggcgccctgtccatcgtcacggccggcaaggaagaatctgctcgcgtcatgtcgcaggtcaagcgcgtcatccgcaccaattactccaacccgccgacccatggcggtgcgctagtggctggtgttctggcgtccgcggaactacgccagatgtgggaaaccgagctggccggcatgcgtgaccgcatccgcgccatgcgcaccggtctggtcgatgccatcaaggcacaaggcgtggcgcaggatttctccttcgttgcccagcagcgcggtatgttctcctataccggcctgacggctgcccaggtcgaacgcatgcgtgaagaattcggcatctacgccgtgtcgaccggccgtatctgcctggctgcgctgaataccaagaatctggattacgtggccaaggcgattgccgcagttaccaagccctga

SEQ ID NO: 4839 - protein, 402 aa, Dechloromonas aromatica RCB
MSSSIFAAVEMAPRDPILGLNEAFNADARTTKVNLGVGVYFDDNGKIPLLAAVKAAEDVRVKAALPRGYQPIEGNPAYNTAVQNLLLGKDSALIANGQVITAQALGGTGALKIGADYLKRLNPNAKVYISDPSWENHRALFESAGFVVENYPYYDAATRGVNFEGMKACLKGLDAGSVIILHACCHNPTGADLSDAQWSEVVAICQERGLVPFLDMAYQGFADGIDADAVAVRAFSASGLQFFASSSFSKNFSLYGERVGALSIVTAGKEESARVMSQVKRVIRTNYSNPPTHGGALVAGVLASAELRQMWETELAGMRDRIRAMRTGLVDAIKAQGVAQDFSFVAQQRGMFSYTGLTAAQVERMREEFGIYAVSTGRICLAALNTKNLDYVAKAIAAVTKP

SEQ ID NO: 4840 - DNA, 1197 bp, Ralstonia eutropha JMP134
  CDS (1)..(1197): transl_table=11
atgagtttgttttctgccgtcgaaatggccccgcgcgacccgatcctgggcctgaatgaagctttcaatgccgacacccgcgccaccaaggtgaacctgggcgttggcgtttacttcaccgacgaagggaaaattccgctgctgcgcgccgtgcaggaagcggaaaaggcgcgcctgaccaccgccacgccgcgcggctacctgccgatcgaaggcattgccgcctatgaccaggccgtgcagtcgctgctgttcggcaaggaatcgccgctgatcacggaaggccgtgttgtgacggctcaggcactgggcggtaccggcgcgctgaagatcggcgccgacttcctgaagcgcctctacccgacttcgaaggtcgcgatcagcgacccgagctgggaaaaccaccgcgcgctgttcgaagccgccggctttgaggtcgtgaactacgcctactacgacgccccgacccacggcctgaacttcgccggcatggtggaatcgctgaagtcgtatccggccaacaccatcgtcgtgctgcacgcttgctgccacaacccgaccggcgtcgacctgtcggccgaccagtggaaggaagtggtcgcgctgatcaaggaacgcaacctgatcccgttcctcgacatggcctaccagggctttgccgacggcatcgacccggacggcgcagccgtgcgcctgttcgcggattcggggctgccgttcttcgtgtcgagctcgttctcgaagagcttctcgctgtacggcgaacgcgtgggcgccctgtcgatcgtcacgaccggcaaggaagaagcgcagcgcgtgctgtcgcaggtcaagcgcgtcattcgcaccaactactcgaacccgccgacgcacggcggcaccgtggtagctaccgtgctgaacagcccggaactgcgcgccatgtgggaagaggaactggccgaaatgcgcgaccgcatcaagctgatgcgccacgcgctggtcgacaagctggccgccaagggcgtgaagacggacttttcgttcgtgaaggcgcagcgcggcatgttctcgtactcgggcctgacctcggcgcaagtcgaccgcctgcgtaacgagcatggcatctacgccgtcggcaccggccgcatctgcgtggccgcgctgaacagccgcaatatcgacgccgtcgtcgacgctatcgcggcagtgctgtaa

SEQ ID NO: 4841 - protein, 398 aa, Ralstonia eutropha JMP134
MSLFSAVEMAPRDPILGLNEAFNADTRATKVNLGVGVYFTDEGKIPLLRAVQEAEKARLTTATPRGYLPIEGIAAYDQAVQSLLFGKESPLITEGRVVTAQALGGTGALKIGADFLKRLYPTSKVAISDPSWENHRALFEAAGFEVVNYAYYDAPTHGLNFAGMVESLKSYPANTIVVLHACCHNPTGVDLSADQWKEVVALIKERNLIPFLDMAYQGFADGIDPDGAAVRLFADSGLPFFVSSSFSKSFSLYGERVGALSIVTTGKEEAQRVLSQVKRVIRTNYSNPPTHGGTVVATVLNSPELRAMWEEELAEMRDRIKLMRHALVDKLAAKGVKTDFSFVKAQRGMFSYSGLTSAQVDRLRNEHGIYAVGTGRICVAALNSRNIDAVVDAIAAVL

SEQ ID NO: 4842 - DNA, 1200 bp, Ralstonia eutropha JMP134
  CDS (1)..(1200): transl_table=11
atgtttgcacatatcgaggcctttcctggcgacccgatcctttcgctcaacgaagacttccagaaggacccgcgcaccgacaaggtcaacctgagcatcggcatctatttcgacgacgaaggccggctgccggtcatggaagctgtcgaaaaggccgaggccgcgctgctggccgacatgggcccgcgcccctacctgccgatgtcgggcctggtggcctaccgcaatgccgtgcaggcgctggtgttcggcgaggacagcgcggcccgcgcgaccggccgcgtcgccacgctgcagacgctgggcggctcgggcgcgctgcgcgtgggtgccgattttctgaagcgctacttcccgcagtcgcaggtgtggatcagcgacccgagctgggaaaaccaccgcgtggtgttcgagcgcgcgggcttcaccgtcaacacgtatccgtactacgacgatgccaccggcggcctgaagttcgacgccatggtcgatgcgatcagcaagctgcccaagcagagcatcgtgctgctgcacgtgtgttgccacaacccgaccggcgtggacctgaaccaggaccagtggcgccagctgatcggcgtgctgaaggccaaggaactgctgccgttcgtcgatatggcctaccagggctttggcgaaggcctggacgaagacgcgttcgccatccgcgagctggaccgccagggcgtgccgtgcctggtcgcgaactcgttctcgaagaacttctcgctgtatggcgagcgttgcggcggcctgagcgtggtgtgcaacagcgcggccgaagcggccaatgtgctgggccagctgaccggtgccgtgcgcgccaactatagcaacccgccgacgcacggcgcgcgcgtggtggccaaggtgctgaccacgcccgaactgcgcacgctgtggcagcaggagctggccgcgatgtgcaaccgcatcacccgcatgcgcgaggccatccaccaccacctgcgcgaccacgtcagcggcgaagcgctgtcgcgctacctgacccagcgcggtatgttcacgtacacgggccttaccgcggagcaggccgaccgcctgcgcgaagaccacggtgtgtacctgttgcgctcgggccgcatgtgcgtcgccggtctcaatgaacgcaatgtgaccgtggtggccaaggccatcgccgcggtgctcggcggcaagtaa

SEQ ID NO: 4843 - protein, 399 aa, Ralstonia eutropha JMP134
MFAHIEAFPGDPILSLNEDFQKDPRTDKVNLSIGIYFDDEGRLPVMEAVEKAEAALLADMGPRPYLPMSGLVAYRNAVQALVFGEDSAARATGRVATLQTLGGSGALRVGADFLKRYFPQSQVWISDPSWENHRVVFERAGFTVNTYPYYDDATGGLKFDAMVDAISKLPKQSIVLLHVCCHNPTGVDLNQDQWRQLIGVLKAKELLPFVDMAYQGFGEGLDEDAFAIRELDRQGVPCLVANSFSKNFSLYGERCGGLSVVCNSAAEAANVLGQLTGAVRANYSNPPTHGARVVAKVLTTPELRTLWQQELAAMCNRITRMREAIHHHLRDHVSGEALSRYLTQRGMFTYTGLTAEQADRLREDHGVYLLRSGRMCVAGLNERNVTVVAKAIAAVLGGK

SEQ ID NO: 4844 - DNA, 1194 bp, Pseudomonas fluorescens PfO-1
  CDS (1)..(1194): transl_table=11
atgcacttcgacgccatcggccgagtgcccggcgacccgatcctcggtctgatggaggcctacgcgcaggattccaacccgcgcaagttcgaccttggcgtgggcgtctacaaggatgcccagggcctgacgccgatccccgaggcggtgaaaatcgccgaggcgcgtctggtcgagagccaggacaccaagacctacatcggtggccacggcaatccgctgttcggcaaggtcatcaatgagctggtgcttggcgtcgattcgaagctgatcgccgagcaacgcgccggcgccacccaaacgccgggcggtactggcgccctgcgtctggcggcggacttcatcgcccaatgcctgccgggcaagggtgtatggctgagcaacccgacctggccgatccacgaaacgattttcgcggccgccggggtcaagatcagccattacccgtacgtcggcagcgacaaccgcctcgacgtcgatgcgatgctcgccgtgctcaacgaagtgccgaaaggtgatgtggtgctgctgcacgcgtgctgccacaacccgaccggtttcgacctgagccacgacgactggcagcgagtgctggaggtagtacgccgccgtgacctgctgccgctgatcgactttgcctaccagggctttggcgacggtctggagcaggatgcatggtcgacccggctgttcgccgccgagttgcccgagctgctgatcaccagctcctgctcgaagaacttcggtttatatcgcgaccgcaccggtgcgttgatcgtcagcgcgaaaaccgctgacaagctgatcgacatccgcagccagttggcgcacatcgcccgcaacctgtggtcaacgccaccggatcacggcgcggctgtggtcgccacgatcctcgccgacccggagctgaaacgccgctgggccgacgaagtggaagccatgcgtctgcgcatcgcccagttgcgcagcggactggtggaagcgctggaaccgcacggcctgcgcgagcgttttgcgcacatcggcgtgcaacgcgggatgttctcctacaccggactgtcgccggaacaggtgaagaacctgcgtgagcatcacagcgtgtacatggtcagctcgggccgggccaacgttgccgggattgatgcgacgcgtctcgacctgctggccgaagcgatcgccaacgtctgcaaatag

SEQ ID NO: 4845 - protein, 397 aa, Pseudomonas fluorescens PfO-1
MHFDAIGRVPGDPILGLMEAYAQDSNPRKFDLGVGVYKDAQGLTPIPEAVKIAEARLVESQDTKTYIGGHGNPLFGKVINELVLGVDSKLIAEQRAGATQTPGGTGALRLAADFIAQCLPGKGVWLSNPTWPIHETIFAAAGVKISHYPYVGSDNRLDVDAMLAVLNEVPKGDVVLLHACCHNPTGFDLSHDDWQRVLEVVRRRDLLPLIDFAYQGFGDGLEQDAWSTRLFAAELPELLITSSCSKNFGLYRDRTGALIVSAKTADKLIDIRSQLAHIARNLWSTPPDHGAAVVATILADPELKRRWADEVEAMRLRIAQLRSGLVEALEPHGLRERFAHIGVQRGMFSYTGLSPEQVKNLREHHSVYMVSSGRANVAGIDATRLDLLAEAIANVCK

SEQ ID NO: 4846 - DNA, 1197 bp, Pseudomonas fluorescens PfO-1
  CDS (1)..(1197): transl_table=11
atgagcctgttctccgctgtcgaaatggcaccccgcgatccaatcctgggcctcaacgaagcattcaacgccgatacccggaccaacaaggtcaacctcggggtgggtgtgtactgcaacgaagaggggcgaattccactcctgcgcgccgtcatcgaagccgaaaccattcgcgccgctcagcatgcctcccgtggctacctgccgatcgacggcatcgcggcctacgaccaggctgtgcaaaagctgctgttcggcaatgattcgccactgctggcggctggccgcgttatcaccactcaggccgtcggcggtaccggcgcactgaaaatcggtgccgacttcctcaagcaactgctgcccaatgccgtcgtggcgatcagcgacccgagctgggaaaaccaccgcgcgctgttcgaaaccgccggtttcccggtgcagaactaccgctactacgacgccgccacccacgacgtgaaccgtgccggcctgctggaagacctcaatgccctgccgaacggctcgatcgtcgtgctgcacgcctgctgccacaatccgaccggcgtcgacctgagcccggcggactggaacaacgtgctggaggcggtcaaggccaaaggtcacgtgccgttcctcgacatggcttaccagggtttcggtgacggcatcgccgaagacgccgctgccgtgcgtctgttcgcggaatccggtctgaccttcttcgtatcgagctcgttctccaagtcgttctcgttgtacggcgagcgcgtcggtgcactgtcgatcatcagcgaatcgaaagaagaaagcgcccgcgtcctgtcgcaagtcaaacgcgtgatccgcaccaactactccaacccgccgacccacggcgcaagcatcgttgccgctgtgctgaacagcccggaactgcgcgctcagtgggaagccgaactggctgaaatgcgcctgcgcattcgcggcatgcgcgagcagatggttgctctgctggccaagaaagccccgcagcgtgacttcagcttcgtcggtcgccagcgcggcatgttctcctactccggcctgaccaccgaacaggttcaccgcctgcgcaacgagttcggcatctacgccctggacaccggccgcatctgcgtcgccgcgctgaaccagagcaacatcgaagccgtgacggacgccatcgttcaggtcatctga

SEQ ID NO: 4847 - protein, 398 aa, Pseudomonas fluorescens PfO-1
MSLFSAVEMAPRDPILGLNEAFNADTRTNKVNLGVGVYCNEEGRIPLLRAVIEAETIRAAQHASRGYLPIDGIAAYDQAVQKLLFGNDSPLLAAGRVITTQAVGGTGALKIGADFLKQLLPNAVVAISDPSWENHRALFETAGFPVQNYRYYDAATHDVNRAGLLEDLNALPNGSIVVLHACCHNPTGVDLSPADWNNVLEAVKAKGHVPFLDMAYQGFGDGIAEDAAAVRLFAESGLTFFVSSSFSKSFSLYGERVGALSIISESKEESARVLSQVKRVIRTNYSNPPTHGASIVAAVLNSPELRAQWEAELAEMRLRIRGMREQMVALLAKKAPQRDFSFVGRQRGMFSYSGLTTEQVHRLRNEFGIYALDTGRICVAALNQSNIEAVTDAIVQVI

SEQ ID NO: 4848 - DNA, 1185 bp, Rhodobacter sphaeroides 2.4.1
  CDS (1)..(1185): transl_table=11
atgctgaccgccctgaagccgcagcccgcggacaagatcctgcaactgatccagatgttccgcgaggatgcgcgcgcggacaagatcgatctgggcgtgggcgtctacaaggacccgaccgggctcaccccggtcatgcgggccgtgaaggcggccgagaagcggctctgggaggtcgagaccaccaagacctacaccggccttgccgacgagccggcctacaatgccgcgatggcgaagctgatcctcgcgggcgcggtcccggccgaccgggtggcctcggtcgccacccccggcggcacgggcgcggtgcgtcaggcgctcgagctgatccgcatggcctcgcccgaggccaccgtctggatctcgaacccgacctggccgaaccatctgtcgatcgtgaaatatctcggcatcccgatgcgggaataccgctatttcgacgccgagaccggcgccgtcgatgccgagggcatgatggaggatctggcccaggtgaaggcgggcgacgtggtgctgctgcacggctgctgccacaacccgaccggcgccaacccgaacccggtgcagtggctggccatctgcgagagcctggcccggacaggcgcggtgccgctgatcgacctcgcctatcagggcttcggcgacgggctcgagatggatgcggcggcgacgcggcttctggccaccagactgcccgaggtgctgatcgcggcctcctgctcgaagaacttcggcatctaccgcgagcgcacgggcatcctgatcgccatcggcgaggcggcgggccggggcacggtgcaggccaacctcaacttcctgaaccggcagaactactccttcccgccggaccatggcgcgcggctcgtgaccatgatcctcgaggacgagacgctgagcgccgactggaaggcggaactcgaggaggtgcggctcaacatgctgacactgcgccgccagcttgccgatgcgctgcaggccgagaccggctcgaaccgcttcggcttcgtggccgagcatcgcggcatgttctcgcgcctcgggatcacgcccgccgaggtggagcggctgcggaccgagcacggggtctacatggtgggcgattcgcggctgaacatcgcggggctgaaccggacgaccgtgccggtgctggcgcgcgcggtggccaaggtgctgcgcggctga

SEQ ID NO: 4849 - protein, 394 aa, Rhodobacter sphaeroides 2.4.1
MLTALKPQPADKILQLIQMFREDARADKIDLGVGVYKDPTGLTPVMRAVKAAEKRLWEVETTKTYTGLADEPAYNAAMAKLILAGAVPADRVASVATPGGTGAVRQALELIRMASPEATVWISNPTWPNHLSIVKYLGIPMREYRYFDAETGAVDAEGMMEDLAQVKAGDVVLLHGCCHNPTGANPNPVQWLAICESLARTGAVPLIDLAYQGFGDGLEMDAAATRLLATRLPEVLIAASCSKNFGIYRERTGILIAIGEAAGRGTVQANLNFLNRQNYSFPPDHGARLVTMILEDETLSADWKAELEEVRLNMLTLRRQLADALQAETGSNRFGFVAEHRGMFSRLGITPAEVERLRTEHGVYMVGDSRLNIAGLNRTTVPVLARAVAKVLRG

SEQ ID NO: 4850 - DNA, 1200 bp, Burkholderia sp. 383
  CDS (1)..(1200): transl_table=11
atgtcgctcttctccgctgtccagcttgctccccgcgacccgatcctgggcctgaacgaagccttcaacgccgatgcgcgtccgaccaaggtcaacctcggcgtcggtgtgtacacgaacgaagaaggcaagattccgctgctgcgcgcggttcgcgaagcagagaaggtgcgtgtcgacgccggcctgccccgcggctacctgccgatcgacggcatcgctgcctacgacgcggccgtgcagaagctgctgctcggcaacgactcgccgctgatcgcagctggtcgcgtggtcacggcccaggcgctgggcggcacgggcgcactgaagatcggcgccgatttcctgcgcaccgtgaacccgaacgtgaaggtcgcgattagcgatccgagctgggaaaaccaccgcgcgctgttcgaagcagccggtttcgaagtcgttgcgtacccgtattacgacgctgccaccaatggcgtgaacttcgaaggcatgctgtcggcactgaatagctacgcggcaggtacggtcgtcgtgctgcacgcgtgctgccacaacccgaccggcgtggacctgaccgaagcgcaatggcaacaggtcgtcgacgtcgtgaaggcgcgcaacctcgtgccgttcctcgacatggcctaccagggcttcggcgagaacatcgaggccgatgctgctgccgtgcgcctgtttgccgcggctgacctgaacgcattcgtgtcgtcgtcgttctcgaagtcgttctcgctgtatggcgagcgcgtcggcgcactgtcgatcatcacgtcgagcaaggaagaggcgacgcgcgtgctgtcgcaactgaagcgcgtgatccgcacgaactactcgaacccgccgacccatggcggcgccgtggtcgcagcggtgctcgcatcgccggaactgcacgcttcgtgggtgcaggaactcggtgaaatgcgcgatcgtatccgctcgatgcgcaatggtctcgtcgagcgcctgaaggcaagcggcgtcgatcgcgacttcagcttcatcaacgagcagcgcgggatgttctcgtattcgggcctgacctcggcgcaagtcgatcgcctgcgcgacgagttcggcatctacgcagtcggcacgggccggatctgcgtcgcagcactgaacacgcgcaacctcgacgcggtcgccaatgcggtcgcagccgtcctgaagtaa

SEQ ID NO: 4851 - protein, 399 aa, Burkholderia sp. 383
MSLFSAVQLAPRDPILGLNEAFNADARPTKVNLGVGVYTNEEGKIPLLRAVREAEKVRVDAGLPRGYLPIDGIAAYDAAVQKLLLGNDSPLIAAGRVVTAQALGGTGALKIGADFLRTVNPNVKVAISDPSWENHRALFEAAGFEVVAYPYYDAATNGVNFEGMLSALNSYAAGTVVVLHACCHNPTGVDLTEAQWQQVVDVVKARNLVPFLDMAYQGFGENIEADAAAVRLFAAADLNAFVSSSFSKSFSLYGERVGALSIITSSKEEATRVLSQLKRVIRTNYSNPPTHGGAVVAAVLASPELHASWVQELGEMRDRIRSMRNGLVERLKASGVDRDFSFINEQRGMFSYSGLTSAQVDRLRDEFGIYAVGTGRICVAALNTRNLDAVANAVAAVLK

SEQ ID NO: 4852 - DNA, 1203 bp, Burkholderia sp. 383
  CDS (1)..(1203): transl_table=11
atgttcgaacacatcgacgcgtacccgggcgacccgatcctgacgctcaacgagaacttccagaaagatccgcgcgaccagaaggtcaacctgagcatcggcatctacttcgacgccgaaggccggattccggtgatgggcgccgtgcgcgaagccgaaaccgcgctgcagcgcgacagcggcgcgaagccgtacctgccgatggttggcctgcccgcgtatcgcgacgccgtgcaggcgctcgtgttcggcgccgatcacccggcccgcgcggccggccgcatcgcgacgctgcagacgctcggcggctccggcgcgctgaaggtgggcgccgatttcctgaagcgctacttcccggactcgcaggtgtggctcagcgatccgagctgggaaaaccaccgcttcatcttcgagcgcgccggcttcacggtgaacacgtatccgtactacgacgaagcgacgggcggcctgaagttcgacgcgatgctcgcggcgatcgacgcgctgccggcgcgcagcatcgtgctgctgcacgcgtgctgccataacccgaccggtgtcgacctcgacgaaggccagtgggagaagctgatcgacgtgatcgaggcgcgcgggctgctgccgttcgtcgacatggcgtaccagggcttcggcgcgggcctcgacgcagatgctttcgcggtgcgcgaactggctcgccgcggcgtgccggcgctggtcgcgaactcgttctcgaagaacttctcgctgtacggcgagcgcgtgggcggcctgagcgtcgtctgcgaggatgcggccgcagccgaccgcgtgctcggccagctggccggcgccgtgcgctcgaactacagcaacccgcaaacctacggcgcgaaggtcgtggcggccgtgctcggcacgcccgcgctgcgcaagcagtgggaagaggaactggcggcgatgtgccgccgcatcgcgcggatgcgccagtcgatccatgacggcctgcgcgaccacgtcagcggcgaggcactcacgcgctatgtgaagcagcgcgggatgtttacgtacacgggcctgaccgaatcgcaggtcgacgcgctgcgcgaagtgcacggcgtgtacgtgctgcgttcgggccggatgtgcgtcgcgggcctgaacgactcgaacgtcgccatcgtcgcggatgccatcggcaaggtgctgaagagcggcgtctga

SEQ ID NO: 4853 - protein, 400 aa, Burkholderia sp. 383
MFEHIDAYPGDPILTLNENFQKDPRDQKVNLSIGIYFDAEGRIPVMGAVREAETALQRDSGAKPYLPMVGLPAYRDAVQALVFGADHPARAAGRIATLQTLGGSGALKVGADFLKRYFPDSQVWLSDPSWENHRFIFERAGFTVNTYPYYDEATGGLKFDAMLAAIDALPARSIVLLHACCHNPTGVDLDEGQWEKLIDVIEARGLLPFVDMAYQGFGAGLDADAFAVRELARRGVPALVANSFSKNFSLYGERVGGLSVVCEDAAAADRVLGQLAGAVRSNYSNPQTYGAKVVAAVLGTPALRKQWEEELAAMCRRIARMRQSIHDGLRDHVSGEALTRYVKQRGMFTYTGLTESQVDALREVHGVYVLRSGRMCVAGLNDSNVAIVADAIGKVLKSGV

SEQ ID NO: 4854 - DNA, 1203 bp, Burkholderia thailandensis E264
  CDS (1)..(1203): transl_table=11
atgtttgaacatatcgatgcataccccggcgatccgattctcacgctgaacgagaacttccagcaggacccgcgcacacgcaaggtcaacctgagcatcggcatctatttcgacgacgacggcaggattccggtgatgggcgccgtgcgcgaggccgaggccgtcgtgcagcgcgaatccggcccgaagccgtatttgccgatgacggggctcgcggcgtatcgcgacgcggtgcaggcggtcgtgttcggcgagaacagcgacgcgcgcgcggccggacgcatcgcgacggttcagacgctcggcggttcgggcgcgctgaaggtcggcgcggatttcatcaagcgctatttcccgcacgcgcaggtgtggatcagcgatccgagctgggagaaccaccggttcatcttcgagcgcgcgggcttcacggtcaacacgtacccgtactacgacgaggcgacgggcggcctgaagttcgacgcgatgctggccgcgatcgacgcgctgccgaaaaggagcgtcgtgctgctgcatgcgtgctgccacaacccgacgggcgtcgatctcgacgacgcgcagtggctcaagctgatcgacgtgctgcaggcgcgcgagttgctgccgttcgtcgacatggcgtatcagggcttcggcgcggggctcgcggccgacgcgttcgcgatccgcgagctggcgcgccgcgggatgccggcgttcgtcgcgaactcgttctcgaagaatttctcgctgtacggcgagcgcgtcggcgcgctgtcggtgatctgcgaggacgcggcggccgccgcgcgcgtgctcggccagctcgcgggcgcggtgcgctcgaactacagcaacccgccgacgtacggcgcgaagatcgtcgcgcaagtgctgacgacgcccgcgctgcgcgcgcaatgggaagaagagctcgcggcgatgtgccggcgcatcgcgaagatgcgcggcgcgatccacgatggcctgcgcgcgcacgtgcagggcgaggcgctgtcgcgctacgtgaagcagcgcgggatgttcacgtacacggggctcaccgaggcgcaggtcgagtgcctgcgcgagcagcacggcgtttatgtgctgcgctcgggccgcatgtgcgtggccggcctgaacgaggcgaacgtcgggatcgtcgcggaagcgatcggcgctgtgatcgcgagcggcgtctga

SEQ ID NO: 4855 - protein, 400 aa, Burkholderia thailandensis E264
MFEHIDAYPGDPILTLNENFQQDPRTRKVNLSIGIYFDDDGRIPVMGAVREAEAVVQRESGPKPYLPMTGLAAYRDAVQAVVFGENSDARAAGRIATVQTLGGSGALKVGADFIKRYFPHAQVWISDPSWENHRFIFERAGFTVNTYPYYDEATGGLKFDAMLAAIDALPKRSVVLLHACCHNPTGVDLDDAQWLKLIDVLQARELLPFVDMAYQGFGAGLAADAFAIRELARRGMPAFVANSFSKNFSLYGERVGALSVICEDAAAAARVLGQLAGAVRSNYSNPPTYGAKIVAQVLTTPALRAQWEEELAAMCRRIAKMRGAIHDGLRAHVQGEALSRYVKQRGMFTYTGLTEAQVECLREQHGVYVLRSGRMCVAGLNEANVGIVAEAIGAVIASGV

SEQ ID NO: 4856 - DNA, 1200 bp, Burkholderia thailandensis E264
  CDS (1)..(1200): transl_table=11
atgtcgctcttctccgctgtcgaacttgccccccgcgaccctatcctgggcctgaacgaagccttcaacgccgacacgcgcccgaccaaggtgaatctgggcgtcggcgtctacaccaacgaggacggcaagattccgctgctgcgcgcggtgcgcgacgcggagaaggcgcgggtcgaagccggcctgccgcgcggctatctgccgatcgacgggatcgccgcctatgacgcatcggtgcagaagctgctgctcggcgacgactcgccgctgatcgcggccggccgcgtcgtgacggcacaggcgctcggcggcacgggcgcgctgaagatcggcgctgacttcctgcgcacgctgaatccgaaggcgaaggtcgcgatcagcgatccgagctgggaaaaccaccgtgcgctgttcgacatggcgggcttcgaagtcgtcgcgtacccgtactacgacgcgaagacgaacggcgtgaacttcgacggcatgctggccgcgctcaacggctacgagccgggcacgatcgtcgtgctgcacgcgtgctgccacaacccgacgggcgtggatctgaacgacgcgcaatgggcgcaggtggtcgaagtcgtgaaggcgcgtcagctcgtgccgtttctcgacatcgcctatcaaggcttcggcgagagcatcgaggccgacgcggccgcggtacgcctgttcgcggcggcaaatctgaacgtgttcgtatcgtcgtcgttctcgaagtcgttctcgctgtatggcgagcgcgtcggcgcgctgtcgatcatcaccgacagcaaggacgaagccgcacgcgtgctgtcgcagctgaagcgcgtgatccgcacgaactactcgaacccgccgacgcacggcggcgcgatcgttgctgccgtgctcgcctcgccggaactgcgcgcttcgtgggtgcaggaactgggcgaaatgcgcgatcgcatccgcgcgatgcgcaacggcctcgtcgagcgcctgaaggcggccggcatcgagcgcgacttcggcttcatcaacgcgcaacgcgggatgttctcgtactcgggtctgacgtccgcgcaagtcgaccgtctgcgagaagagttcggcatctatgcggtcagcaccggccggatctgcgtcgcggcgctcaacacgcgcaacctcgacgtcgtcgcgaacgcgatcgccgcggtgttgaagtaa

SEQ ID NO: 4857 - protein, 399 aa, Burkholderia thailandensis E264
MSLFSAVELAPRDPILGLNEAFNADTRPTKVNLGVGVYTNEDGKIPLLRAVRDAEKARVEAGLPRGYLPIDGIAAYDASVQKLLLGDDSPLIAAGRVVTAQALGGTGALKIGADFLRTLNPKAKVAISDPSWENHRALFDMAGFEVVAYPYYDAKTNGVNFDGMLAALNGYEPGTIVVLHACCHNPTGVDLNDAQWAQVVEVVKARQLVPFLDIAYQGFGESIEADAAAVRLFAAANLNVFVSSSFSKSFSLYGERVGALSIITDSKDEAARVLSQLKRVIRTNYSNPPTHGGAIVAAVLASPELRASWVQELGEMRDRIRAMRNGLVERLKAAGIERDFGFINAQRGMFSYSGLTSAQVDRLREEFGIYAVSTGRICVAALNTRNLDVVANAIAAVLK

SEQ ID NO: 4858 - DNA, 1278 bp, Burkholderia thailandensis E264
  CDS (1)..(1278): transl_table=11
atgcggctcggccgccgcggccaagccgttgttcccgtcatccgtcaacccgtgtccaacatgttcgaacacattcccgcgtatcccggcgacccgatcctgtcgctgttccaggcgttccagcgcgatcccgagccgcgcaaggtcaatctgagcatcggcctttactacgacgaaaacgacgccgtgccggtgctcgacagcgtgcgcgcggcggcggcgcaatgggccgggcggcacgacgcgcacacgtatctgccgatggaaggcatggccgactaccggcgcgcgctgcaatcgctcgtgttcggcgcaagcagcgccgcgttgcgcgacaagcggatcgcgaccgtgcagacggtgggcggctccggcgcgctgcgcctcggcgcggatctgctcaagcgctatttccccgacagcgcggtctggatcggcgatccgacgtgggacaaccaccgcgtgctgttcgccgcggcgggcctcgacgtgcacacgtatccgtactacgacgcggcgacgaacggcgtgcgcttcgacgcgatgatggcgacgctcgacacgctgcccgcgcgcgcgatcgtgctattgcagccgtgctgccacaacccgaccggcatcgacctgtcgcgcgagcagtggcgcgagatcgccgcgctgtgcgaccggcgcgggctgatcccgtttctcgacatcgcgtatcaaggcttcggcgacggcctcgacgacgatgcatggccgatccgcgcgatgaccgacgcgggcctgcccgtgttcgtgagcaactcgttctcgaagaatttctcgctgtacggcgaacgctgcggcgggctgtcgatcgcgtgcgcgaacgagcgcgaggcggcgcaggtgctcacccagatccaggcgggcgtgcgccgcgtctattcgagcccgccgctgcacggcgcgcgcctcgtgtcgaccgtgctgaacgacccggcgctcgcgcggcagtgggagcgcgacgtcgccgcgatgcgcgagcggatcaggcggatgcgcacggcgctcgcctcgcggctcgcggcgctcgtgcccggcgcgtcgttcgactatctcgccgagcagcgcggaatgttcagctacacgggcctcgcgcccgacgaggtcgatgcgctgcgcgagcacgacggcgtctacctgctgcgctccggccgcgcgtgcatcgcggggctgagcgacgcgaacgtcgactatgtcgcgaacgcgatcgccgcggtgctgaaggctcggcgcctgcgcgtcgcggcgtga

SEQ ID NO: 4859 - protein, 425 aa, Burkholderia thailandensis E264
MRLGRRGQAVVPVIRQPVSNMFEHIPAYPGDPILSLFQAFQRDPEPRKVNLSIGLYYDENDAVPVLDSVRAAAAQWAGRHDAHTYLPMEGMADYRRALQSLVFGASSAALRDKRIATVQTVGGSGALRLGADLLKRYFPDSAVWIGDPTWDNHRVLFAAAGLDVHTYPYYDAATNGVRFDAMMATLDTLPARAIVLLQPCCHNPTGIDLSREQWREIAALCDRRGLIPFLDIAYQGFGDGLDDDAWPIRAMTDAGLPVFVSNSFSKNFSLYGERCGGLSIACANEREAAQVLTQIQAGVRRVYSSPPLHGARLVSTVLNDPALARQWERDVAAMRERIRRMRTALASRLAALVPGASFDYLAEQRGMFSYTGLAPDEVDALREHDGVYLLRSGRACIAGLSDANVDYVANAIAAVLKARRLRVAA

SEQ ID NO: 4860 - DNA, 1248 bp, Novosphingobium aromaticivorans DSM 12444
  CDS (1)..(1248): transl_table=11
atgcgggggttgcccccgccgcgttccggcggcatggagccgccgcattttgctccccgcaatggaaggccgcgaccaatgctcgaaaatcttgccgcccagcccgccgacgcgctgctggcgctgatcaagcttcacaacgccgatccgcgcgaagacaagattgaccttggcgtcggtgtctatcgcacgtccgagggcgctacccctgttttcaaggcgatcaaggcggccgaggccaagctgctcgaaagccaggattccaaggcctacctcggccccgaaggcgacatgggcttcgtccacgcgctgatcccctatgtcttcggcaaggacttcgatcgttcgaaggttgagggcatgcaggcccccggcggcaccggcgcggtgcgcctcgccatcgaggtggccaagcgttcgggcgtcaagcgggtctggatgggcacgccttcgtggcccaaccacgcgcagatcatcgctgctgccggcatggagctgaagaccttcagccacatgaccgccgacggccttgccgatctcgaagcattgaagaccgccctggccggtgccgaagcgggcgatgccgtcctgctccacggttgctgccacaaccccacaggcgtcgactataccgaagcccagtgggacgagatcgccccgcttctggtcgagcgccaggtcctgccaatcctcgaccttgcctaccaggggcttggcgcgggcatggaagccgacgcctatggcctgcgcaaggtgctcagcctcgctccggaagcgctggtcgcctattcgtgcgacaagaacttcggcctctatcgtgaccgcgtcggcgctttctatgccgtcacgtccgacgccaccgccctggcaaacgccatgggcaacggcgcgacgatcgcgcgcgcctcgtggtcgatgccgcccgatcatggcgccgccgccgtccgcctgatcctcgacgatgccgagctgaccgcaatgtggctggccgagctcgacgagatgcgtgatcgcatgcgctgggttcgcgatcgccttgccgccgcgcagcacgtcggcccgatcaacatggcgccgctcggcgtgcagaacggcctgttctcgatgcttccgctcagggccgaccagattctcgccatccgcgagaagcacggcgtctacatggccggttcgggacgcatcaacattgccggcctcaccaccggtaacatcgacaagttcgtcgaagccctgcgcgacgtcgcgtaa

SEQ ID NO: 4861 - protein, 415 aa, Novosphingobium aromaticivorans DSM 12444
MRGLPPPRSGGMEPPHFAPRNGRPRPMLENLAAQPADALLALIKLHNADPREDKIDLGVGVYRTSEGATPVFKAIKAAEAKLLESQDSKAYLGPEGDMGFVHALIPYVFGKDFDRSKVEGMQAPGGTGAVRLAIEVAKRSGVKRVWMGTPSWPNHAQIIAAAGMELKTFSHMTADGLADLEALKTALAGAEAGDAVLLHGCCHNPTGVDYTEAQWDEIAPLLVERQVLPILDLAYQGLGAGMEADAYGLRKVLSLAPEALVAYSCDKNFGLYRDRVGAFYAVTSDATALANAMGNGATIARASWSMPPDHGAAAVRLILDDAELTAMWLAELDEMRDRMRWVRDRLAAAQHVGPINMAPLGVQNGLFSMLPLRADQILAIREKHGVYMAGSGRINIAGLTTGNIDKFVEALRDVA

SEQ ID NO: 4862 - DNA, 1194 bp, Saccharophagus degradans 2-40
  CDS (1)..(1194): transl_table=11
atgtttgatcgtttatcgctgttgtctgcagaccccattcttgggttaattggccaatttacggccgattcaaatcccaacaaaatcgatttgggggtgggggtatatcgagatgcccaaggtcatacgcctatattggcaacggtaaaaaaagccgaatctattttgtgggaagccgaacaaactaaatcttacattggccctgccggcaaccaacaatttaaccgcttggtgcttgagcttattctaggggatgagcacacagcattggcagacaaccgcgctatagctatgcaaacccctgggggctgtggagccttacgtgtcgctgccgagctaatagtggccgccaacccgaaagcaaaaatttgggtaagtgaccccacgtggggtaaccacgttccactgcttggtgattctggtatggagatagccacatacccatactacgactatgagagccacggtattcgctttgccgatatgctaaccacgctgcgtgagtctgcggtggccggcgaccttgtattagtgcatgcatgttgccataacccaagtggggcggacctcagtttggcccagtggttacagcttactaatttatgtgcagaaaaagggcttatcccgtttgtagatatggcctatcaaggttttggggatggtttagatcaagatgcagcgggtttgcgcatgatggccgatcagttacccgaagtgatatttgcctatagctgctctaaaaactttggtttgtatcgcgaacgaattggtgcagtaggcgttgttgccgcaaacaccgagcgcgccactgccgttgccagtcaaattatgcgcatagtgcgaggtatttattccatgcccccatcgcacggcgcggcaattgtagaaactattctcgccgaccctgtgctttgccaagcttgggtggatgagctggcgttgatgcgcaatcgcattcaaaccatgcgccaagcattattagatgcgatgaccgcgcaaggatacggcgataggtttcattttattaccggcgaaaaaggcatgttctcgtttttaggcttaacgcccgagcaggtgcagcggcttattaaagagcacagtgtttacatggtggacagcagccgcattaacgttgctgggcttacgccaacgaatatagatccgctggtgaaagccctaactgccgtgctgtag

SEQ ID NO: 4863 - protein, 397 aa, Saccharophagus degradans 2-40
MFDRLSLLSADPILGLIGQFTADSNPNKIDLGVGVYRDAQGHTPILATVKKAESILWEAEQTKSYIGPAGNQQFNRLVLELILGDEHTALADNRAIAMQTPGGCGALRVAAELIVAANPKAKIWVSDPTWGNHVPLLGDSGMEIATYPYYDYESHGIRFADMLTTLRESAVAGDLVLVHACCHNPSGADLSLAQWLQLTNLCAEKGLIPFVDMAYQGFGDGLDQDAAGLRMMADQLPEVIFAYSCSKNFGLYRERIGAVGVVAANTERATAVASQIMRIVRGIYSMPPSHGAAIVETILADPVLCQAWVDELALMRNRIQTMRQALLDAMTAQGYGDRFHFITGEKGMFSFLGLTPEQVQRLIKEHSVYMVDSSRINVAGLTPTNIDPLVKALTAVL

SEQ ID NO: 4864 - DNA, 1200 bp, Burkholderia xenovorans LB400
  CDS (1)..(1200): transl_table=11
atgttcgaccacattcccgcttatccaggcgacccgattctgggcctgaacgaagactttcaactcgacccgcgcaccaacaaggtcaatctgagcatcggcatctatttcgacgacgccggcaagctgccggtcatgaacgcggtgcgccgggccgaaaccgcgctgctcgattcgatcggcccgcgctcctatctgccgatggccggcctgccgctctatcgcgatgcggcgcaggcgctcgtattcggcgcggacagcgaggcgcgcaaggcgggccggatcgcgacgttgcaaaccatcggcggatcgggcgcactcaaggtcggcgccgatttcctgaagcgctatttcccgggctcgcaggtctggatcagcgacccgagctgggaaaaccaccgcgtcgtattcgaaggcgcggggctcacggtcaacacctatccatattacgacgcccagaccggcggcctgcgtttcgccgagatgctcgacgccattggccgcctgccggaacagagcgtggtgctgctgcacgcgtgctgccacaacccgaccggcgtcgatctgagccctgcgcaatgggccggactggtgccggtattgcagcgccgcaagctgatcgcgttcgtcgatatggcttaccagggttttggcgcgggtctggaagaggacgccgcctgcgtgcgcctgctggccgacgcgggcattccattgatcgccgcgaattcgttctcgaagaatttttcgctgtacggcgagcgtgtcggcgcattgagcgtcgtttgcaaaagcgcggaagaggccgggcgcgtgctcggtcaattgatgtcgacggtgcgcgcgaactacagcaatccgcccacgcacggcgcgcggctcgtcgccaacgtgctggcggatgcgtcgctgcgcgcttcatgggaagcggaactcgccaccatgcgcgaacgcattctcgccatgcgcggcacgatccacgccggactcgccggccgtgtggacgaagtgatgcgcgcacgctacgtcgcgcagcgcggcatgttcacctacaccggcctgagcgaaagccaggtggagcggctgcgcagcgaacacgcggtgtacgtgctgcgctccgggcgcatgtgcgtggccgggctgaacgcgcgcaacgcggagtatgtggcggcctcgatcgcggcggtggtgtcgggcgcctga

SEQ ID NO: 4865 - protein, 399 aa, Burkholderia xenovorans LB400
MFDHIPAYPGDPILGLNEDFQLDPRTNKVNLSIGIYFDDAGKLPVMNAVRRAETALLDSIGPRSYLPMAGLPLYRDAAQALVFGADSEARKAGRIATLQTIGGSGALKVGADFLKRYFPGSQVWISDPSWENHRVVFEGAGLTVNTYPYYDAQTGGLRFAEMLDAIGRLPEQSVVLLHACCHNPTGVDLSPAQWAGLVPVLQRRKLIAFVDMAYQGFGAGLEEDAACVRLLADAGIPLIAANSFSKNFSLYGERVGALSVVCKSAEEAGRVLGQLMSTVRANYSNPPTHGARLVANVLADASLRASWEAELATMRERILAMRGTIHAGLAGRVDEVMRARYVAQRGMFTYTGLSESQVERLRSEHAVYVLRSGRMCVAGLNARNAEYVAASIAAVVSGA

SEQ ID NO: 4866 - DNA, 1200 bp, Burkholderia xenovorans LB400
  CDS (1)..(1200): transl_table=11
atgtctctgttctccgccgtcgaacttgctccccgcgacccgattctgggcctgaacgaagccttcaatgccgatacgcgcaccaccaaggtcaaccttggcgtcggcgtgtacttcaatgaagaaggcaagattccgttgctgcgcgccgtgcgcgacgcagaaaaggcccgcgtcgatgccgcgctgccgcgcggctacctgccgatcgaaggcatcgccgcttacgatgccgctgtgcagaagctgctgctcggcaacgactcgccgctgatcgcggcgggccgcgtcgtgacggcgcaggcgctgggcggcacgggcgcgctgaaaattggcgcggacttcctgaagcgcctgaacccgaacgccaaggtcgcgatcagcgatccgagctgggaaaaccaccgcgcattgttcgaaggcgcaggtttcgaagtcgtgtcgtacccgtactacgacgcgcacacccacggcgtgaatttcgacgccatgctgagcgcgctgaacagctatgccgccggcacgatcgtcgtgctgcacgcgtgctgccacaacccgaccggcgtggacctcaacatcgagcaatggaagcaggttgtcgaagtggtcaaggcgcgcaatctggtgccgttcctcgacatcgcctaccagggtttcggcgacaacatcgaagcagacgcagcggccgtccgtctgttcgccgcggcggaactgaacgtgttcgtgtcgtcgtcgttctcgaagtcgttctcgctgtacggcgagcgcgtcggcgcgctgtcgatcatcacggcaagcaaggaagaagccgctcgcgtgctgtcgcaactcaagcgcgtgatccgcacgaactattcgaacccgccgacgcacggcggctcggtggtcgcggccgtgctcgcgtcgccggagctgcgcgccacgtgggaaacggaactggccgaaatgcgcgatcgcatccgcgccatgcgcaatggtctggtcgaacgcctgaaggcgagcggcgtggatcgcgacttcagcttcgtgaacgcgcagcgcggcatgttctcgtactcgggtctgacggcgccgcaggtggaccgtctgcgcgaagaattcggcatctacgccgtgagcacgggtcgcatctgcgtggccgcgctgaatacgcgcaacctcgacgcggtggccaacgcgatcgctcacgtattgaagtaa

SEQ ID NO: 4867 - protein, 399 aa, Burkholderia xenovorans LB400
MSLFSAVELAPRDPILGLNEAFNADTRTTKVNLGVGVYFNEEGKIPLLRAVRDAEKARVDAALPRGYLPIEGIAAYDAAVQKLLLGNDSPLIAAGRVVTAQALGGTGALKIGADFLKRLNPNAKVAISDPSWENHRALFEGAGFEVVSYPYYDAHTHGVNFDAMLSALNSYAAGTIVVLHACCHNPTGVDLNIEQWKQVVEVVKARNLVPFLDIAYQGFGDNIEADAAAVRLFAAAELNVFVSSSFSKSFSLYGERVGALSIITASKEEAARVLSQLKRVIRTNYSNPPTHGGSVVAAVLASPELRATWETELAEMRDRIRAMRNGLVERLKASGVDRDFSFVNAQRGMFSYSGLTAPQVDRLREEFGIYAVSTGRICVAALNTRNLDAVANAIAHVLK

SEQ ID NO: 4868 - DNA, 1197 bp, Ralstonia metallidurans CH34
  CDS (1)..(1197): transl_table=11
atgagtttgttttctgccgtcgagatggccccgcgcgacccgatcctgggcctgaatgaagcgttcaatgccgatacccgcgccaccaaggtgaacctgggcgttggcgtgtacttcaccgacgaagggaaaattccgctgctgcgcgccgtgcaggaggccgaaaaggcccgcctgacgaccgccacgccgcgcggctacctgccgatcgaaggcatcgccgcctatgaccaggccgtgcaaaccttgctgttcggcaaggaatcgcccctgatcaccgaaggccgcgtggtgacggctcaggcactcggcggcactggcgccctgaagatcggcgccgacttcctgaagcgcctgtacccgaacgcgtcggtcgcgatcagcgatccgagctgggaaaaccaccgcgcgctgttcgaagctgccggcttccctgtggtcaactacgcctactacgacgctgccagccacggcctgaacttcgccggcatggtggaatcgctgaagtcgtacccggccaacacgatcgtcgtgctgcacgcctgctgccacaacccgaccggcgtggacctggacgaagcccagtggaagcaggtcgtggaactggtcaaggaacgtaacctgatcccgttcctggacatggcctaccaaggctttgccgagggtatcgagccggacggcgccgctgtgcgcctgttcgcggagtcgggcctgccgttcttcgtttccagctcgttctcgaagagcttctcgctgtacggcgagcgcgttggcgccctgtcgatcgtgaccacgggcaaggaagaagcccagcgcgtgatgtcgcagatcaagcgcgtcatccgcacgaactactcgaacccgccgacccacggcggcactgtggtggccaccgtgctgaacagcccggaactgcgcgccatgtgggagcaggaactggccgaaatgcgcgaccgcatcaagctgatgcgccatgcgctggtcgacaagctggccgccaagggcgtgccgggcgacttctcgttcgtgaaggcccagcgcggcatgttctcgtactcgggcctgacctcggcccaggttgaccgcctgcgcaccgaacacggcatctacgccgtgggcacgggccgcatctgcgtggcagcgttgaacagccgcaacatcgacgccgtggtgaacgcgatcgccgccgtctactaa

SEQ ID NO: 4869 - protein, 398 aa, Ralstonia metallidurans CH34
MSLFSAVEMAPRDPILGLNEAFNADTRATKVNLGVGVYFTDEGKIPLLRAVQEAEKARLTTATPRGYLPIEGIAAYDQAVQTLLFGKESPLITEGRVVTAQALGGTGALKIGADFLKRLYPNASVAISDPSWENHRALFEAAGFPVVNYAYYDAASHGLNFAGMVESLKSYPANTIVVLHACCHNPTGVDLDEAQWKQVVELVKERNLIPFLDMAYQGFAEGIEPDGAAVRLFAESGLPFFVSSSFSKSFSLYGERVGALSIVTTGKEEAQRVMSQIKRVIRTNYSNPPTHGGTVVATVLNSPELRAMWEQELAEMRDRIKLMRHALVDKLAAKGVPGDFSFVKAQRGMFSYSGLTSAQVDRLRTEHGIYAVGTGRICVAALNSRNIDAVVNAIAAVY

SEQ ID NO: 4870 - DNA, 1197 bp, Ralstonia metallidurans CH34
  CDS (1)..(1197): transl_table=11
atgttcgaacatatagaagcctttccgggtgacccgatcctctcgctcaacgaggacttccagcaggacccgcgtaccaacaaggtcaatctgagcatcggcatctacttcgacgacgaaggccgcctgccggtgatgaaggccgtggcggaagccgaggccgcgctgctgtcggacatgggtccgcgcccgtacctgccgatgtccggcatggccgcgtatcgtcaggccgtgcaggcgctggtgttcggcgaggattgcgccgcccgcgccgaaggccgcgtcgccacgctgcagacgctgggcggctcgggcgcgctgcgcgtcggcgccgatttcctgaagcgctacttcccgaaggcggagatgtggatcagcgatccgagctgggagaatcaccgcgtggtcttcgagcgtgccggcttcaaggtcaacacttacccgtactacgatccggccaccggcggcctgaaattcgacgcgatgcttgccgcgatcgaagcgatcccgcaaggcgacatcgtgctgctgcacgcgtgctgccacaacccgaccggcgtcgacctgaaccaggaccagtggcgccaggtgatcggcgtgctcaaggcgcgcaagctgctgccgttcgtcgacatggcctaccagggtttcggctcgggcctggacgatgacgccttcgccgtgcgcgaactggcccgccagaatgtgccctgcctggtggccaattcgttctcgaagaacttctcgctgtacggcgagcgttgcggcggcctttcggtggtctgccaaagcgccgacgaagccagccgtgtgctgggccagcttaccggcgccgtgcgcgccaactacagcaacccgccgacccacggcgcgcgcgtggtggcccgtgtgctgaccacgccggcgctgcgcgcgaactgggagcaggaactggccgcgatgtgccagcgcatcacccgtatgcgccaggccatccacgaccacctgcgcgagcatgtgagcggcgaaaagctctcgcgctacatcacccagcgcggcatgttcacgtacaccggtctgtcggccgatcaggtcgaccgcctgaagaacgagcacggcgtgtacgtgctgcgctcgggccgcatgtgcgtggccggtctgaacgagcgcaacgtgggcgtcgtcgccaacgccatcgggcaggtgctgaaggcctga

SEQ ID NO: 4871 - protein, 398 aa, Ralstonia metallidurans CH34
MFEHIEAFPGDPILSLNEDFQQDPRTNKVNLSIGIYFDDEGRLPVMKAVAEAEAALLSDMGPRPYLPMSGMAAYRQAVQALVFGEDCAARAEGRVATLQTLGGSGALRVGADFLKRYFPKAEMWISDPSWENHRVVFERAGFKVNTYPYYDPATGGLKFDAMLAAIEAIPQGDIVLLHACCHNPTGVDLNQDQWRQVIGVLKARKLLPFVDMAYQGFGSGLDDDAFAVRELARQNVPCLVANSFSKNFSLYGERCGGLSVVCQSADEASRVLGQLTGAVRANYSNPPTHGARVVARVLTTPALRANWEQELAAMCQRITRMRQAIHDHLREHVSGEKLSRYITQRGMFTYTGLSADQVDRLKNEHGVYVLRSGRMCVAGLNERNVGVVANAIGQVLKA

SEQ ID NO: 4872 - DNA, 1185 bp, Silicibacter sp. TM1040
  CDS (1)..(1185): transl_table=11
atgttcgagaacctcaaaccccagcctgccgacaagattctggcgctgatgcagatgtaccgcgaagatccgcgggaccagaaggtcgatctgggtgtaggtgtctacaagaacgccgagggtgtgaccccggtgatgcgcgccgtgaaggccgcagaacagcgcatcatcgacgagcagaccaccaaggcctacaccggcctcgcgggtgatcccgcctacgccgacgcgatgatcgacctcatcctcggtacctcggtcgagcgcagcaagatcgccgccgtcgcgacccccggtggcaccggtgccgtgcgtcaggcctttgaactgatcaagatggccaaccccgaggcacgcgtttttgtgtccgaccccacctggcccaaccacgtgtcgatcctgaaatacgtcggcatcgaaaccgtggtttaccgctactttgacaccgagacccgtgccgtgaacttcgacggtatgatcgaagacctcaaaggcgccaagacaggcgacgtggttctgctgcacggctgctgccacaacccgaccggtgccaacctcaacatcagccagtggcaagccgtggtcgagctgctcaacgaacgcggcctgatcccgatgatcgacatcgcctatcagggctttggcgacggtctcgaagaagacgccgccggcgtgcgccttgtggcctcctcggtgccagaatgcctgatcgcggcgagctgctccaagaactttggcatctaccgcgagcgcaccggccttctgatggcgatcagccagaagggcgacgaagccggtctcaaccaaaagaccctcgcctatctgaaccgccagaactactccttccctcctgatcacggcgcacgcgttgtgaccacgatcctgaacgatcccgagctgcgcgcggattggcagaaagagctggaagaaacccgcctgggcatgctcgccctgcgccagcagctcgcggatgagctgcagcgcctctccgggtcggatcgctttggctttattgcagagcaccgcggcatgttctccctgctcggcaccacgcccgaactcgtcgagaaaatgcgtgtagacgcagggatttacatggtcggggacagccgtctcaatattgcggggctcaacgcccagaccgtgccgatccttgccaaggcgatcatcgacgccggcgtctga

SEQ ID NO: 4873 - protein, 394 aa, Silicibacter sp. TM1040
MFENLKPQPADKILALMQMYREDPRDQKVDLGVGVYKNAEGVTPVMRAVKAAEQRIIDEQTTKAYTGLAGDPAYADAMIDLILGTSVERSKIAAVATPGGTGAVRQAFELIKMANPEARVFVSDPTWPNHVSILKYVGIETVVYRYFDTETRAVNFDGMIEDLKGAKTGDVVLLHGCCHNPTGANLNISQWQAVVELLNERGLIPMIDIAYQGFGDGLEEDAAGVRLVASSVPECLIAASCSKNFGIYRERTGLLMAISQKGDEAGLNQKTLAYLNRQNYSFPPDHGARVVTTILNDPELRADWQKELEETRLGMLALRQQLADELQRLSGSDRFGFIAEHRGMFSLLGTTPELVEKMRVDAGIYMVGDSRLNIAGLNAQTVPILAKAIIDAGV

SEQ ID NO: 4874 - DNA, 1191 bp, Haemophilus somnus 129PT
  CDS (1)..(1191): transl_table=11
atgttcgagaacattaatgctgcacccgctgatccaattttaggtttaggtgaggcttttaaatctgaaacacgtgccaataaaattaacttgggtattggggtctataaagatgctaatggtaacacccccattatgaaagctgttaaagaagctgaaaatcgtctatttgaattagaaaccactaaaaactatttaactattgatggtattgcagaatttaattcatacactaaagaattattatttggtacaaattctaaaattattaaacaaggacgtgctaaaacagtacaaagtttaggaggaactggtgcgttacgtattgctgccgaatttatcaaacgtcaaaccacatctcaaaacgtttggattagttcaccaacttggccaaaccataatgctattttcaacgctgtaggtatgacaatccgtgaatatcgttactacgatgcagagaaaaaagctttagattgggataatttaattgctgacttaagcaatgccagtgaaggtgatgtggtgttattacatggttgttgtcataacccaacgggtattgatccaacccctgagcaatggaaaatactagcagaaatgtcagaaaaaaatggttggttaccgctctttgattttgcctatcaaggtcttgctaacgggttagaagaagatgctattggtttgcgaacttttgcagaaaatcataaagaattattagtcgcaagttcttattccaaaaactttggtttatacaatgaacgtgttggtgcctttactttagtagcagaaacagaagaaatttcagcaatagcattaacacaagtgaaatcaattattcgtactctctactctaacccagcttctcatggtgctacagctgtttctatcattttaggtgatgacctattacgtcaacaatgggaatccgaattaaccgaaatgcgtaatcgcattaaacgtatgcgttatcaatttgttgaattgctaaaagaatatggtgccaagcaagactttaacttcattattgaacaaaatggtatgttctcttttagtggtctaaatgcagaacaggtggatcgcttaaaagaagaatttgccatttatgctgtgcgttcaggacgtattaatttagccggtgtaactgaagataatattcgttatttatgtgaaagtattgtcaaggtgctttaa

SEQ ID NO: 4875 - protein, 396 aa, Haemophilus somnus 129PT
MFENINAAPADPILGLGEAFKSETRANKINLGIGVYKDANGNTPIMKAVKEAENRLFELETTKNYLTIDGIAEFNSYTKELLFGTNSKIIKQGRAKTVQSLGGTGALRIAAEFIKRQTTSQNVWISSPTWPNHNAIFNAVGMTIREYRYYDAEKKALDWDNLIADLSNASEGDVVLLHGCCHNPTGIDPTPEQWKILAEMSEKNGWLPLFDFAYQGLANGLEEDAIGLRTFAENHKELLVASSYSKNFGLYNERVGAFTLVAETEEISAIALTQVKSIIRTLYSNPASHGATAVSIILGDDLLRQQWESELTEMRNRIKRMRYQFVELLKEYGAKQDFNFIIEQNGMFSFSGLNAEQVDRLKEEFAIYAVRSGRINLAGVTEDNIRYLCESIVKVL

SEQ ID NO: 4876 - DNA, 1191 bp, Shewanella sp. MR-4
  CDS (1)..(1191): transl_table=11
atgtttaactcactcgtcgcaatgcctgcggatcctatcctcggcctattaacccagtaccgtgaagactcacatcctcaaaaagtcgacttaggtgtgggcgtttataaggatcccgctggaaacactcccatccttaattgcgtgaaaaaagccgaaaaattccgtttagacactgaaaccaccaaagtgtatatcggcccaaccggttcgcctcagtttaataccctgataacagaattagcctttggcagtgatcacagcgcgattatcgccaaccgaattcgtactgtatccacgcctggtggtacaggcgccctgcgcgttgccggtgattttattaaacgctgcaatcctaatgctgtgctatgggtgagcgatcccacatgggctaaccatataggcttgtttgaagcggcgggtctgactgttaaaacctacccttactatgattacgacactaaatcgttaaagtttgatgagatgctcagcgcgcttgcgcagattggcccgaacgatgttgtgctattccacgcctgttgccataacccgagcgggatggatttaacggcagaacaatgggataaagtggttgccctcaccaaggagcaaggttttaccccgcttatcgacatggcttaccaaggttttggtgatggggtcgatatcgatgcctacggcgtgcgtaaaatggccgccgcggtcgataatatgatcctgtgtagctcttgctcgaaaaactttggtctgtaccgtgagcgtatcggttcatgctctgtggttgcaaaagatgcaaacacggcaagcatcgcgcaatcagtactgctttacgtagttcgttgcctctactccatgccgccagcccacggcgcggcgattgtcgaaaccattctaggttcggcagaattaaagcaagagtggttagatgagctcaaagtaatgcgcgaccgtatcaacggtaaccgcgccattttagtggaaaacctcaaaaccaatggcgtggaccgcgactttagctttatcgcacgtcaaaaaggcatgttctctttcctaggggttaatcctgagcaagtggcgcgtctgcagaaagaattcagcatttatatggtgggttcgagccgcattagcattgcaggcattagcgaagacaatgtggattacttagctaagtcgattgccgaagtactgtaa

SEQ ID NO: 4877 - protein, 396 aa, Shewanella sp. MR-4
MFNSLVAMPADPILGLLTQYREDSHPQKVDLGVGVYKDPAGNTPILNCVKKAEKFRLDTETTKVYIGPTGSPQFNTLITELAFGSDHSAIIANRIRTVSTPGGTGALRVAGDFIKRCNPNAVLWVSDPTWANHIGLFEAAGLTVKTYPYYDYDTKSLKFDEMLSALAQIGPNDVVLFHACCHNPSGMDLTAEQWDKVVALTKEQGFTPLIDMAYQGFGDGVDIDAYGVRKMAAAVDNMILCSSCSKNFGLYRERIGSCSVVAKDANTASIAQSVLLYVVRCLYSMPPAHGAAIVETILGSAELKQEWLDELKVMRDRINGNRAILVENLKTNGVDRDFSFIARQKGMFSFLGVNPEQVARLQKEFSIYMVGSSRISIAGISEDNVDYLAKSIAEVL

SEQ ID NO: 4878 - DNA, 1194 bp, Shewanella sp. MR-4
  CDS (1)..(1194): transl_table=11
atgattttctctcaggtagtactcgcacccgctgatcccatccttggtttaaccgataccttcaaggccgatccacgccaagataaagtgaacctcggtgttggcatttataaggatgaagcagggcagactccagtattacagtcagtgaagaaagcagaagccctattgcttgagcaagagaagaccaagaactatttaggtattgaaggggttcaaacctataaccgcgtggtacaagagctattatttggcgagggcagtacgcttgtgacgtcaggccgtgccgcgaccgctcaggcgccaggtggtactggtgcactgcgtattgccgccgagtttctactgcgcaacacgccatcgcgcactgtgtgggtcagtaacccaacttgggcgaaccatcagaatatttttgaaactgcaggtttaacggttaaagaatacggttactacaatgcaagtgctcacgatatcgatttcgatggcatgatgactgatctcgccaatgcacaggcgggtgacattgttctactgcacggctgctgccataacccaacgggtattgatttgaccttagcccaatgggaattggttgctaacctgtgtgcagacaaacagttagtgccattgtttgactttgcttaccaaggttttggtgctgggattgaagaagatgccgcaggtttacgtttagtggctgcaaaagtacctgagttgttagtggctaactcattctctaaaaactttggtctttataacgagcgtatcggtgctgtgactgtggttgcacaaaatgccgatgaagcagtacgtgcctttagccaagtgaaacgtactatccgcgctaattactcaaacccaccagcacacggtgcgttaatcgttagcaccattttaagtgatgcggcattgaaagcactttgggtacaagagttgaccgaaatgcgtgagcgtatcgccgagatgcgtaccctgttcgtccaaagcttaaaggatgaaggcgtcacccaggactttagctttatttcccgtcaaaacggtatgtttagcttctctggtttaaacaaagcgcaggttgcacgcttgaaagacgagtttggtatttatatcgtaggctcaggccgtattagtgttgccggtatgaccaaaaccaatatgcctgtgatctgtaaagcgattgcccaggttctttaa

SEQ ID NO: 4879 - protein, 397 aa, Shewanella sp. MR-4
MIFSQVVLAPADPILGLTDTFKADPRQDKVNLGVGIYKDEAGQTPVLQSVKKAEALLLEQEKTKNYLGIEGVQTYNRVVQELLFGEGSTLVTSGRAATAQAPGGTGALRIAAEFLLRNTPSRTVWVSNPTWANHQNIFETAGLTVKEYGYYNASAHDIDFDGMMTDLANAQAGDIVLLHGCCHNPTGIDLTLAQWELVANLCADKQLVPLFDFAYQGFGAGIEEDAAGLRLVAAKVPELLVANSFSKNFGLYNERIGAVTVVAQNADEAVRAFSQVKRTIRANYSNPPAHGALIVSTILSDAALKALWVQELTEMRERIAEMRTLFVQSLKDEGVTQDFSFISRQNGMFSFSGLNKAQVARLKDEFGIYIVGSGRISVAGMTKTNMPVICKAIAQVL

SEQ ID NO: 4880 - DNA, 1194 bp, Shewanella sp. MR-7
  CDS (1)..(1194): transl_table=11
atgattttctctcaggtagtactcgcacccgctgatcccatccttggtttaaccgatacctttaaggccgatccacgccaagataaagtcaacctcggtgttggcatttataaggatgaagcagggcagactccggtattacagtcagtaaagaaagcagaagccctattgcttgagcaagagaaaaccaaaaactatttaggtattgaaggggttcaaacctataaccacgtagtacaagagctgttatttggtgagggcagtacgcttgtgacgtcaggccgtgccgcgaccgctcaggcgcctggtggtactggcgcactgcgtattgccgccgagtttttactgcgcaacaccccatcgcgcactgtatgggtaagtaacccaacttgggctaaccatcaaaatatttttgagaccgcaggtttaacggttaaagaatacggttactacaacgctgctgcacacgatattgatttcgatgccatgatgacagatctcgccaatgcactggcgggtgacattgttctgcttcacggctgctgccataacccaacgggtattgatttgaccttagcccaatgggaattggttgccaacctgtgtgcagacaagcagttagtgccattgtttgactttgcttaccaaggctttggtgctgggattgaagaagatgccgctggtctgcgtttagtggcagcaaaagtacctgagttgttagtggctaactcattctctaaaaactttggtctttataacgagcgtatcggcgctgtgactgtggttgcacaaaatgccgatgaagcggtgcgtgccttcagccaagtgaagcgtactatccgcgctaattactcaaacccaccagcacacggtgcgttaatcgttagcaccattttaagcgatgcggcattgaaagcactttgggtacaagagttgaccgaaatgcgtgagcgtatcgccgagatgcgtaccctgttcgtccaaagcttaaaggatgaaggtgtgactcaggactttagctttatttcccgccaaaacggtatgtttagcttctctggtttaaataaagcgcaggttgcacgcttgaaagacgagtttggtatttatatcgtcggctctggccgcattagtgttgccggtatgactaaaaccaatatgcctgtgatctgtaaagcgattgcccaagttctttaa

SEQ ID NO: 4881 - protein, 397 aa, Shewanella sp. MR-7
MIFSQVVLAPADPILGLTDTFKADPRQDKVNLGVGIYKDEAGQTPVLQSVKKAEALLLEQEKTKNYLGIEGVQTYNHVVQELLFGEGSTLVTSGRAATAQAPGGTGALRIAAEFLLRNTPSRTVWVSNPTWANHQNIFETAGLTVKEYGYYNAAAHDIDFDAMMTDLANALAGDIVLLHGCCHNPTGIDLTLAQWELVANLCADKQLVPLFDFAYQGFGAGIEEDAAGLRLVAAKVPELLVANSFSKNFGLYNERIGAVTVVAQNADEAVRAFSQVKRTIRANYSNPPAHGALIVSTILSDAALKALWVQELTEMRERIAEMRTLFVQSLKDEGVTQDFSFISRQNGMFSFSGLNKAQVARLKDEFGIYIVGSGRISVAGMTKTNMPVICKAIAQVL

SEQ ID NO: 4882 - DNA, 1191 bp, Shewanella sp. MR-7
  CDS (1)..(1191): transl_table=11
atgtttaactcactcgtcgcaatgcctgcggatcctatcctcggcctattaacccagtaccgtgaagactcacatcctcaaaaagtcgacttaggtgtgggcgtttataaggatcccgctggaaacactcccatccttaattgcgtgaaaaaagccgaaaaattccgtttagacactgaaaccaccaaagtgtatatcggcccaaccggttcgcctcagtttaataccctgataacagaattagcctttggcagtgatcacagcgcgattatcgccaaccgaattcgtactgtatcaacgcctggtggtacaggcgccctgcgcgttgccggtgattttattaaacgctgcaatcctaatgctgtgctatgggtgagcgatcccacatgggctaaccatataggcttgtttgaagcggcgggtctggccgttaaaacctacccttactatgattacgacactaagtcgttaaagttcgatgagatgctcagcgcgcttacgcagattggcccgaacgatgtggtgctgttccacgcctgttgccataacccgagcgggatggatttaacgacagaacaatgggataaagtggttgccctcaccaaggagcaaggttttaccccgcttatcgacatggcttaccaaggttttggtgatggtgtcgatatcgatgcctacggcgtacgtaaaatggccgcagcggtcgataatatgatcctgtgtagctcttgctcgaaaaactttggtctgtaccgtgagcgtatcggctcatgctctgtggttgcaaaagatgcaaacacggcaaacatcgcgcaatctgtactgctttacgtagttcgctgcctctactccatgccgccagcccacggcgcagcgattgtcgaaaccattctaggttcggcggaattaaagcaagagtggttagatgagctcaaagtgatgcgcgaccgtatcaacggtaaccgcgccattttagtggaaaaacttaaaatcaatggcgtggaccgcgactttagctttatcgcacgccaaaaaggcatgttctctttcctaggggttaatcctgagcaagtcgcgcgtctgcagaaagaattcagcatttatatggtgggttcgagccgcattagcattgcaggcattagcgaagacaatgtggattacttagctaagtcgattgccgaagtactgtaa

SEQ ID NO: 4883 - protein, 396 aa, Shewanella sp. MR-7
MFNSLVAMPADPILGLLTQYREDSHPQKVDLGVGVYKDPAGNTPILNCVKKAEKFRLDTETTKVYIGPTGSPQFNTLITELAFGSDHSAIIANRIRTVSTPGGTGALRVAGDFIKRCNPNAVLWVSDPTWANHIGLFEAAGLAVKTYPYYDYDTKSLKFDEMLSALTQIGPNDVVLFHACCHNPSGMDLTTEQWDKVVALTKEQGFTPLIDMAYQGFGDGVDIDAYGVRKMAAAVDNMILCSSCSKNFGLYRERIGSCSVVAKDANTANIAQSVLLYVVRCLYSMPPAHGAAIVETILGSAELKQEWLDELKVMRDRINGNRAILVEKLKINGVDRDFSFIARQKGMFSFLGVNPEQVARLQKEFSIYMVGSSRISIAGISEDNVDYLAKSIAEVL

SEQ ID NO: 4884 - DNA, 1191 bp, Hyphomonas neptunium ATCC 15444
  CDS (1)..(1191): transl_table=11
atgtctcatttctcgcccctctccacgctcccgccggatgcgctcctcgggctcatgacggcataccgcgccgatgagcgcagtgaaaaattcgatctcggcgtcggtgtctacaaggacgagaatggcgaaaccccgatcctctcggcggtgcgcaaggccgaggccaagatgctcgcggcgcagaccacgaaggtctacgaaggcccgcgcggcaataccgatttctgcgcccatatcgaaaagttcgtgttcggcaaggaccatccggcgctggccgaaaaccgcgtcctctccttcacgtctccgggtggctgcggcgcgctctttctcggcgtcggcctgatgcgccgcatgggcacgcgccgcgtctgggtctcgcggcccacttggccaaaccaccccaacgtcgtcaaatccctgggcctggacgtgaaggaatacacctattcgcgtgacggcgccttctaccgtctcggcgcgctggctgacctctcgaccgcagagcgtggcgatggcatcatcatccagggcccctgccacaaccccaccggaatcgatccgtcaacggaagactggcgcgagcttggaaagctctgcaaggataagggcatcatcgcgctgctcgatgtcgcctatcacggcttcgcctcgggccttgaccgggacatggacggcgtgcgcgccttcattgatgaggcgggcgaggcactgatctcctattcctgctcgaagaactttggtctctaccgggaacgcacgggctgcttcctcgccgttggcgcagaagcagaaggcatcgcggcggccaccacgcatgtggccgatatgggccgcgcgacctggtctatgccgccgtcgcatggcgcaggcatcgtcgccaccattctggacgatccggacctgcgcgccgaatgggagacggagctttccgccatgcgcacacggatgatcggtctgcgcgaagcgctctctgacgccctcgtcagccattcgggatcaaacctgctggcggccctcaagacgcagaacggcatgttctcccaactgccgatctcggccgaagacaccgccaaggcccgcgaagcagacggcatctacatgccgtcttccggccgcatcaatatcgccgggcttcacccaagtgacattccgcgcctcgcggaaatcctggcgggctatctggtctag

SEQ ID NO: 4885 - protein, 396 aa, Hyphomonas neptunium ATCC 15444
MSHFSPLSTLPPDALLGLMTAYRADERSEKFDLGVGVYKDENGETPILSAVRKAEAKMLAAQTTKVYEGPRGNTDFCAHIEKFVFGKDHPALAENRVLSFTSPGGCGALFLGVGLMRRMGTRRVWVSRPTWPNHPNVVKSLGLDVKEYTYSRDGAFYRLGALADLSTAERGDGIIIQGPCHNPTGIDPSTEDWRELGKLCKDKGIIALLDVAYHGFASGLDRDMDGVRAFIDEAGEALISYSCSKNFGLYRERTGCFLAVGAEAEGIAAATTHVADMGRATWSMPPSHGAGIVATILDDPDLRAEWETELSAMRTRMIGLREALSDALVSHSGSNLLAALKTQNGMFSQLPISAEDTAKAREADGIYMPSSGRINIAGLHPSDIPRLAEILAGYLV

SEQ ID NO: 4886 - DNA, 1191 bp, Rhizobium leguminosarum bv. viciae 3841
  CDS (1)..(1191): transl_table=11
atgttcgatgatctgataatgccgccagccgacaagatcctgtcgttgatgccgattttccggcaggacagtcgttcgaacaagatcgatctcggcgtcggagtctaccgcgacgcctccggtacgacgccgatcccgcgggcggtgagggaggcagaaaagcgaatccataccgcgcagacgaccaaggcctatgtcggcccggccggggatcctgttttttgcgatctcatcggcaggcttgtcttcggcgaggcagcgccgtgggagcgaattcgcggcatccagacgccgggcggagcaggcgccttgacggtgctcgccggcctgatctccctggcgcgcccgggtgcagcggtccatgtgcccgatccgacctgggtgaaccatgtgtcgatcctcgaagacaacgggcttcgggtcgtcacttacccgtacctcgatcgccggacaggcgaagtggatttcgacaccctgcttgatcatttctcacggtcggaacggggcgacatcgtgttgctgcacggctgctgccacaatccgaccggcgccgacccgagccgttcgcaatggcaggcgctggcggagatcatcgccgagcgcgggctcgttccgctggtcgatatcgcttatcaagggtttggcgagggtctcgaggacgatgccttcgtggtacggctgctcgccggcatggttccggaaatgctcgtctcctcgtcatgctcgaagaatttcggaatctatcgcgagcgtacaggtgccgcattcattctcgccaggaacgcggatcgggcggatgcagccaaggcgcaactcacggtgcgagcccgtgtcgtctattcgatgccgccggatcatggctcggctatagttcgcaccgtcctggaggaccctgcactcgcggccgactggcgcgccgaactggacgatatgcgctccagcattctgtcgctgcgccaggggcttgctgcctcgttccggcgtttcaccaatggcagcgactacgatttcctcgccaagaacaaaggcatgttttcgctgatcggtctgacacccggagaagccgtgatgctgcgcgagcagcacgccatctacatcgtcgaggacggacgcatcaatgtcgccgggctgcaggccagccagatcgacacctttgcggaagccgttctggcagttcgcgggaaacgctga

SEQ ID NO: 4887 - protein, 396 aa, Rhizobium leguminosarum bv. viciae 3841
MFDDLIMPPADKILSLMPIFRQDSRSNKIDLGVGVYRDASGTTPIPRAVREAEKRIHTAQTTKAYVGPAGDPVFCDLIGRLVFGEAAPWERIRGIQTPGGAGALTVLAGLISLARPGAAVHVPDPTWVNHVSILEDNGLRVVTYPYLDRRTGEVDFDTLLDHFSRSERGDIVLLHGCCHNPTGADPSRSQWQALAEIIAERGLVPLVDIAYQGFGEGLEDDAFVVRLLAGMVPEMLVSSSCSKNFGIYRERTGAAFILARNADRADAAKAQLTVRARVVYSMPPDHGSAIVRTVLEDPALAADWRAELDDMRSSILSLRQGLAASFRRFTNGSDYDFLAKNKGMFSLIGLTPGEAVMLREQHAIYIVEDGRINVAGLQASQIDTFAEAVLAVRGKR

SEQ ID NO: 4888 - DNA, 1188 bp, Rhizobium leguminosarum bv. viciae 3841
  CDS (1)..(1188): transl_table=11
atgtttgagaaactcaccgcgcaaccagccgacagcctacttgcgctcatcaaagcgtttcaggccgatccaagaggctacaaagtcgacctcggcgtcggcgtctacagagacgaacaggggcgaacaccagtcatgcgggccgtcaagctcgctgaaaagcagctcctcgagacccaggacagcaagcggtatctcgggcctgaaggggacctgaatttcgtcaacctcctgaagccgatcattttcggcgcaactcataatgccggcaacgttgtgggcatccagacgccaggtggaagcggcgctctgcgactgggcgctgaactcatcgcctctgccacgcccggtgcgaaagtctggcttggcacaccaagctggcccaaccatgctccgattttcgagtcggcgcgcttgaccgtgaaagactatcgtttcgtcgaccttgccaagcagcaaatcgacttcgatcgtgttttggaggcactcgacgcggcgcaggctggtgatgtgatcctgctacacggctgctgccacaacccaactggcattgattttgatatccagcaatggaagcagatcgctgcaaagctggtggagcgcaaactccttcccttcatcgatcttgcctaccaaggcctgggcgacggcctcgaagcggacgcagagccaacccgccttatcctcgaggcagtagacgaagcgcttgtcgcctattcgtgtgacaaaaatttcggtctttatcgcgaacgtgttggtgccctttaccttgttagccgcaatgcggaccagcttaagattgccgatggcaacatggcttcgttggctcgcgtcaactggtcgatgcccccggaccacggcgcggccatcgtacgtgtgattctggagagcgcggagctaacccaaatctggaagcaggagctggttgaaatgtgcgctcgggtcaatggtaaccgcgccgctcttgcagcttctcatccggaactgggcttcatcgcgaaccagcgagggcttttctccaacctggcgatgtcgaaagaaacggcagtcgcgttgtgccacaaacacggcatctacatggccgattccggtcgcatgaatttggcggggatgcagccttctgacgcggccgcgatcgtcaaggctttgtcggcagaaggcacgctaagcacccgctcggcggcctga

SEQ ID NO: 4889 - protein, 395 aa, Rhizobium leguminosarum bv. viciae 3841
MFEKLTAQPADSLLALIKAFQADPRGYKVDLGVGVYRDEQGRTPVMRAVKLAEKQLLETQDSKRYLGPEGDLNFVNLLKPIIFGATHNAGNVVGIQTPGGSGALRLGAELIASATPGAKVWLGTPSWPNHAPIFESARLTVKDYRFVDLAKQQIDFDRVLEALDAAQAGDVILLHGCCHNPTGIDFDIQQWKQIAAKLVERKLLPFIDLAYQGLGDGLEADAEPTRLILEAVDEALVAYSCDKNFGLYRERVGALYLVSRNADQLKIADGNMASLARVNWSMPPDHGAAIVRVILESAELTQIWKQELVEMCARVNGNRAALAASHPELGFIANQRGLFSNLAMSKETAVALCHKHGIYMADSGRMNLAGMQPSDAAAIVKALSAEGTLSTRSAA

SEQ ID NO: 4890 - DNA, 1197 bp, Pseudomonas aeruginosa UCBPP-PA14
  CDS (1)..(1197): transl_table=11
atgagtctgttttctgccgtcgaaatggcaccgcgtgatcccatccttggcctgaacgaagccttcaacgccgatacccgtccgggcaagatcaacctgggcgtgggcgtgtactacaacgaggaggggcgcattccgctgttgcgtgccgtgcaggctgccgagaaggcccgcatcgaggcccacgcgccgcgcggctacctgccgatcgaagggatcgccgcctacgaccagggcgtacagaaactgctgttcggtaacgaatccgagctgctggccgccggccgcgtggtcacgacccaggccgtcggcggcaccggcgccctcaagctcggcgccgacttcctcaagcgcctgctgcccgacgccaccgtggccatcagcgacccgagctgggaaaaccaccgcgcactgttcgaagccgccggcttcccggtgcagaactaccgctattacgacgccgccagcaatggcgtgaaccgcgccggcctgctggaagacctgaatgccctgccggcccgctcgatcgtggtcctgcacgcctgctgccataatccgaccggcgtcgatctcgagctggacgactggaaacaggtgctggacgtgctcaaggccaagggccacgtgccgttcctcgacatcgcctaccagggcttcggcaacggcatcgaggaagacgccgccgcggtgcgcctgttcgcccagtcgggcctgagcttcttcgtttccagctcgttctccaaatccttctcgctctatggcgaacgcgtcggcgccctctcgatcgtgaccgaaagccgcgatgaatcggcccgcgtgctgtcccaggtgaagcgggtgatccgcaccaactattcgaacccaccgacccacggcgccagcgtcgtctcctccgtgctcaacagctcggaactgcgggccctctgggagcaggaactgggcgagatgcgcgaccgcatccgcgacatgcgcctggcgatggtcgagcaactggcagcccacggcgccaagcgcgacttcagcttcgtcggtcgccagcgtggcatgttctcctattccggcctgaccgccgaccaggtcgagcgcctgaagaccgagttcggtatctatgccgtcagcaccggccgtatctgcgtcgccgcgctgaacaaatcgaacctggagaccatcaccaaggccatcgtccaggtcctgtag

SEQ ID NO: 4891 - protein, 398 aa, Pseudomonas aeruginosa UCBPP-PA14
MSLFSAVEMAPRDPILGLNEAFNADTRPGKINLGVGVYYNEEGRIPLLRAVQAAEKARIEAHAPRGYLPIEGIAAYDQGVQKLLFGNESELLAAGRVVTTQAVGGTGALKLGADFLKRLLPDATVAISDPSWENHRALFEAAGFPVQNYRYYDAASNGVNRAGLLEDLNALPARSIVVLHACCHNPTGVDLELDDWKQVLDVLKAKGHVPFLDIAYQGFGNGIEEDAAAVRLFAQSGLSFFVSSSFSKSFSLYGERVGALSIVTESRDESARVLSQVKRVIRTNYSNPPTHGASVVSSVLNSSELRALWEQELGEMRDRIRDMRLAMVEQLAAHGAKRDFSFVGRQRGMFSYSGLTADQVERLKTEFGIYAVSTGRICVAALNKSNLETITKAIVQVL

SEQ ID NO: 4892 - DNA, 1200 bp, Pseudomonas aeruginosa UCBPP-PA14
  CDS (1)..(1200): transl_table=11
atgagtcatttcgccaaggtcgcccgcgtaccgggcgacccgatcctgggcctgctcgacgcctaccgcaacgatccgcgcgcggacaagctggacctcggcgtcggtgtctacaaggatgcccagggcctgaccccgatcctgcgctcggtgaaactcgccgagcagcgcctggtcgagcaggaaaccaccaagagctacgtcggcggccacggcgatgcgctgttcgccgcgcgcctggcggaactggcgctcggcgccgcctcgccgctgttgctggagcaacgcgccgacgccacccagacgcccggcggcaccggcgccttgcgcctggccggcgacttcatcgcccattgcctgcccggccgcggcatctggctgagcgacccgacctggccgatccacgagacgctgttcgccgccgccggcctgaaggtttcccactacccctacgtcagcgccgacaaccgcctggatgtcgaggcgatgcttgctggcctggagcgcattccccagggagacgtggtgctgctgcatgcctgctgccacaacccgaccggtttcgacctgagccacgacgactggcgcagggtgctcgacgtggtgcgtcgtcgcgagctgctgccgctgatcgacttcgcctaccagggcttcggcgacggtctcgaggaagacgcctgggcggtacgcctgttcgccggcgaactgccggaggtgctggtcaccagttcctgctcgaagaacttcggcctgtaccgcgaccgcgtcggcgcgctgatcgtctgcgcgcagaacgccgagaagctcaccgacgtgcgtagccaactggccttcctcgcccgcaacctctggtcgaccccgccggcgcatggcgccgaggtggtcgcggcgatcctcggcgacagcgagttgaagggactctggcaggaagaggtcgaaggcatgcgctcgcgcatcgccagcctgcgcatcggcctggtcgaagccctggcgccgcacggcctggccgagcgcttcgcccatgtcggcgcgcaacgcgggatgttttcctataccggactgagcccgcagcaggtcgctcggctgcgcgacgagcacgccgtttacctggtctccagcggccgggccaacgtcgccggtctcgacgcgcgccgcctcgaccgcctggcgcaagccatcgcccaggtctgcgcggactga

SEQ ID NO: 4893 - protein, 399 aa, Pseudomonas aeruginosa UCBPP-PA14
MSHFAKVARVPGDPILGLLDAYRNDPRADKLDLGVGVYKDAQGLTPILRSVKLAEQRLVEQETTKSYVGGHGDALFAARLAELALGAASPLLLEQRADATQTPGGTGALRLAGDFIAHCLPGRGIWLSDPTWPIHETLFAAAGLKVSHYPYVSADNRLDVEAMLAGLERIPQGDVVLLHACCHNPTGFDLSHDDWRRVLDVVRRRELLPLIDFAYQGFGDGLEEDAWAVRLFAGELPEVLVTSSCSKNFGLYRDRVGALIVCAQNAEKLTDVRSQLAFLARNLWSTPPAHGAEVVAAILGDSELKGLWQEEVEGMRSRIASLRIGLVEALAPHGLAERFAHVGAQRGMFSYTGLSPQQVARLRDEHAVYLVSSGRANVAGLDARRLDRLAQAIAQVCAD

SEQ ID NO: 4894 - DNA, 1191 bp, Shewanella sp. ANA-3
  CDS (1)..(1191): transl_table=11
atgtttaactcactcgtcgcaatgcctgcggatcctatcctcggcctattaacccagtaccgtgaagactcacatcctcaaaaagtcgacttaggtgtgggcgtatataaggatcccgctggaaacactcccatccttaattgcgtgaaaaaagccgaaaaattccgtttagacactgaaaccaccaaagtgtatatcggcccaaccggttcacctcagtttaataccctgataacagaattagcctttggcagtgatcacagcgcgattatcaccaaccgcattcgtactgtttctactcctggtggcacgggcgccctgcgcgttgccggtgattttattaaacgctgcaatcctaatgctgtgctatgggtgagcgatcccacatgggctaaccatataggcttgtttgaagcggcgggtctgaccgttaaaacctacccttactatgattacgacactaaatcgttaaagttcgatgagatgctcagcgcgcttgcgcagattggcccgaacgatgtggtgctattccacgcctgttgccataacccaagcgggatggatttaacgacagaacaatgggataaagtggttgccctcaccaaggagcaaggttttaccccgcttatcgacatggcttaccaaggttttggtgatggggtcgatatcgatgcctacggcgtgcgtaaaatggccgctgcggtcgataatatgatcctgtgtagctcttgctcgaaaaacttcggtctgtaccgtgagcgtatcggttcatgctctgtggttgcaaaagatgcaaacacggcaaacatcgcgcaatctgtgctgctttacgtggttcgctgcctctactccatgccgccagcccacggcgcggcgattgtcgaaaccattctaggttcggcagaattaaagcaagaatggttagatgagctgaaagtgatgcgcgaccgtatcaacggtaaccgcgccattttagtggaaaaactcaaaaccaatggcgtggaccgcgactttagctttatcgcacgccaaaaaggcatgttctctttcctaggggttaatcctgagcaagtcgcgcgtctgcagaaagaattcagcatttatatggtgggttcgagtcgcattagcattgcaggcattagcgaagacaatgtggattacttagctaagtcgattgcaaaagtactgtaa

SEQ ID NO: 4895 - protein, 396 aa, Shewanella sp. ANA-3
MFNSLVAMPADPILGLLTQYREDSHPQKVDLGVGVYKDPAGNTPILNCVKKAEKFRLDTETTKVYIGPTGSPQFNTLITELAFGSDHSAIITNRIRTVSTPGGTGALRVAGDFIKRCNPNAVLWVSDPTWANHIGLFEAAGLTVKTYPYYDYDTKSLKFDEMLSALAQIGPNDVVLFHACCHNPSGMDLTTEQWDKVVALTKEQGFTPLIDMAYQGFGDGVDIDAYGVRKMAAAVDNMILCSSCSKNFGLYRERIGSCSVVAKDANTANIAQSVLLYVVRCLYSMPPAHGAAIVETILGSAELKQEWLDELKVMRDRINGNRAILVEKLKTNGVDRDFSFIARQKGMFSFLGVNPEQVARLQKEFSIYMVGSSRISIAGISEDNVDYLAKSIAKVL

SEQ ID NO: 4896 - DNA, 1194 bp, Shewanella sp. ANA-3
  CDS (1)..(1194): transl_table=11
atgattttctctcaggtagtactcgcacccgctgatcccatccttggtttaaccgataccttcaaggccgatccacgccaagataaagtgaacctcggtgttggcatttataaggatgaagcagggcagactccagtattacagtcagtgaagaaagcagaagccctattgcttgagcaagagaagaccaagaactatttaggtattgaaggggttcaaacctataaccgcgtggtacaagagctattatttggcgagggcagtacgcttgtgacgtcaggccgtgccgcgaccgctcaggcgccaggtggtactggtgcactgcgtattgccgccgagtttctactgcgcaacacgccatcgcgcactgtgtgggtcagtaacccaacttgggcgaaccatcagaatatttttgaaactgcaggtttaacggttaaagaatacggttactacaatgccagtgcccacgatatcgatttcgatggcatgatgacagatctcgccaatgcacaggcgggtgacattgttctactgcacggttgctgccataacccaacgggtattgatttgaccttagcccaatgggaattggttgctaacctgtgtgcagacaaacagttagtgccattgtttgactttgcttaccaaggttttggtgctgggattgaagaagatgccgcaggcctacgtttagtggctgcaaaagtacctgagttgttagtggctaactctttctctaaaaactttggtctttataacgagcgtatcggcgctgtgactgtagtggcacaaaatgccgatgaagcggtgcgtgccttcagccaagtgaaacgtactattcgcgccaattactcaaacccaccagcacacggtgcgttaattgttagcaccattttaagcgatgcggcattaaaagcactttgggtacaagagttgactgaaatgcgtgaacgtatcgcccagatgcgtactctgttcgtccaaagcttaaaggatgaaggcgtcacccaggactttagctttatttcccgccaaaacggtatgtttagcttctctggcttaaacaaagagcaggttgcacgcttaaaagacgagtttggtatttatatcgtcggctcaggccgcattagtgttgccggtatgaccaaaaccaatatgcctgtgatctgtaaagcgattgcccaagttctttaa

SEQ ID NO: 4897 - protein, 397 aa, Shewanella sp. ANA-3
MIFSQVVLAPADPILGLTDTFKADPRQDKVNLGVGIYKDEAGQTPVLQSVKKAEALLLEQEKTKNYLGIEGVQTYNRVVQELLFGEGSTLVTSGRAATAQAPGGTGALRIAAEFLLRNTPSRTVWVSNPTWANHQNIFETAGLTVKEYGYYNASAHDIDFDGMMTDLANAQAGDIVLLHGCCHNPTGIDLTLAQWELVANLCADKQLVPLFDFAYQGFGAGIEEDAAGLRLVAAKVPELLVANSFSKNFGLYNERIGAVTVVAQNADEAVRAFSQVKRTIRANYSNPPAHGALIVSTILSDAALKALWVQELTEMRERIAQMRTLFVQSLKDEGVTQDFSFISRQNGMFSFSGLNKEQVARLKDEFGIYIVGSGRISVAGMTKTNMPVICKAIAQVL

SEQ ID NO: 4898 - DNA, 1209 bp, Azoarcus sp. BH72
  CDS (1)..(1209): transl_table=11
atgtccgcatcgatcttcgccgccgtcgagttggcgccccgtgacccgatcctcggcctcaacgaggccttcgccgccgacacccgcgcccagaaggtgaacctcggcgtcggcgtctactacgacgacaacggcaagattccgctgctggccgccgtccgcgccgccgaaaaggcccgcctcgaagccatgccgccgcgcggctaccagccgatcgaaggccccgccgcctacaacaacgcggtgcagaacctgctgctcggcaaggattccgcgctgatcgccaacggccaggtcgtcaccgtcgaagcactcggcggcaccggcgcgctgaaggtcggcgccgactacctcaagcgcctgctgccgggcgccacggtctacatctccgacccgagctgggaaaaccaccgcgcgctgttcgaatcggccggcttcccggtcgacacctacccttactacgacgccgccacccgcggcgtgaacttcgccggcatgaaggccaagctggaaagcctgccggccggctcgatcatcgtgctgcacgcctgctgccacaacccgaccggcgcggatctttccgacgcccagtgggatgaggtcgtcgccgcctgccgcgcccgcggcctggtgcccttcctcgacatggcctaccagggcttcgccgacggcatcgacgccgacgccgtcgcggtgcgcgccttctcggccagcggcctgcagttcttcgtttccagctcgttctccaagagcttctcgctgtacggcgagcgcgtcggcgcgctgtccatcatcaccgccagcaaggaagagtccggccgcgtgctgtcgcaagtcaagcgcgtgatccgtaccaactattccaacccgccgatccacggcggcgccatcgtcgccgcggtgctcaactccgccgaactgcgccagcagtgggaagacgaactcgccggcatgcgcgaccgcatccgcgcgatgcggacggggctggtcgagcagctgaaggccgaaggcgtggcgcaggacttctccttcgtgatcaagcagcgcggcatgttctcctacaccggcctcaccgccgcccaggtcgagaagctgaagaccgacttcggcatctacgcggtgtcgacgggccgtatctgcctggcggcgctgaactccaagaacatcggctacgtcgccaaggcgatcgcggcggtggtcaagggctga

SEQ ID NO: 4899 - protein, 402 aa, Azoarcus sp. BH72
MSASIFAAVELAPRDPILGLNEAFAADTRAQKVNLGVGVYYDDNGKIPLLAAVRAAEKARLEAMPPRGYQPIEGPAAYNNAVQNLLLGKDSALIANGQVVTVEALGGTGALKVGADYLKRLLPGATVYISDPSWENHRALFESAGFPVDTYPYYDAATRGVNFAGMKAKLESLPAGSIIVLHACCHNPTGADLSDAQWDEVVAACRARGLVPFLDMAYQGFADGIDADAVAVRAFSASGLQFFVSSSFSKSFSLYGERVGALSIITASKEESGRVLSQVKRVIRTNYSNPPIHGGAIVAAVLNSAELRQQWEDELAGMRDRIRAMRTGLVEQLKAEGVAQDFSFVIKQRGMFSYTGLTAAQVEKLKTDFGIYAVSTGRICLAALNSKNIGYVAKAIAAVVKG

SEQ ID NO: 4900 - DNA, 1194 bp, Neisseria meningitidis FAM18
  CDS (1)..(1194): transl_table=11
atgttcttcaagcacatcgaagccgcccccgccgatccgattctcggtttgggcgaagcattcaaagccgaaacccgccccgaaaaagtcaacctcggcatcggcgtttataaagacgcatccggcgcgacacccctcgtcaaagccgtcaaagaagccgaaaaacgcctgttggaaagcgaaaccaccaaaaactacctcaccatcgacggcgttgccgactacaacgcgcaaacccaaatcctgctgttcggcaaagaccacgaaatcatcgccagccgtcgcgccaaaacagcgcaaagcctcggcggtacgggcgcattgcgtattgcggccgagtttgccaaacgccagttgaacgcgcaaaccatctggatttccaatccgacttggcccaaccacaacgccatcgccaaagcggtcggtatccaagacaaaccttatcgttactatgatgccgccaaacacggtttggattgggacggcatgattgaggacttgagccaagcgcaaaaaggcgacatcgtcctgctgcacggctgctgccacaatcctaccggcatcgaccctacgcccgaacaatgggaaactttggcaaaactttctgccgaaaaaggctggttgccgctgtttgactttgcctaccaaggcttcggcaacggtctggaagaagatgcctacggcttgcgcgtgttcttgaaacacaatacagaattgctgattgccagctcttattccaaaaacttcggtatgtacaacgagcgcgtgggcgcgttcactttggtggccgaagatgaagcaaccgccgcccgcgcccacagccaagtcaaaaccatcatccgtaccttgtattccaatccggcttcacacggcgcgaacactattgcgctggtgttgaaaaatgatgatttgaaagcacaatggattgccgaactcgatgaaatgcgcggccgcatcaaagccatgcgccaaaaatttgtcgagttgctcaaagccaaaggtgcaagccaagactttgatttcattatcgaacaaaacggtatgttctctttcagcggtctgactcccgaacaagttgaccgtttgaaaaacgagtttgccatttatgccgtccgctccggccgcatcaacgttgccggcattaccgacgacaacatcgattatctgtgcgaaagcatcgtgaaagtactgtaa

SEQ ID NO: 4901 - protein, 397 aa, Neisseria meningitidis FAM18
MFFKHIEAAPADPILGLGEAFKAETRPEKVNLGIGVYKDASGATPLVKAVKEAEKRLLESETTKNYLTIDGVADYNAQTQILLFGKDHEIIASRRAKTAQSLGGTGALRIAAEFAKRQLNAQTIWISNPTWPNHNAIAKAVGIQDKPYRYYDAAKHGLDWDGMIEDLSQAQKGDIVLLHGCCHNPTGIDPTPEQWETLAKLSAEKGWLPLFDFAYQGFGNGLEEDAYGLRVFLKHNTELLIASSYSKNFGMYNERVGAFTLVAEDEATAARAHSQVKTIIRTLYSNPASHGANTIALVLKNDDLKAQWIAELDEMRGRIKAMRQKFVELLKAKGASQDFDFIIEQNGMFSFSGLTPEQVDRLKNEFAIYAVRSGRINVAGITDDNIDYLCESIVKVL

SEQ ID NO: 4902 - DNA, 1194 bp, Neisseria meningitidis FAM18
  CDS (1)..(1194): transl_table=11
atgtaccgacacatcgaatactatcccggcgatccgattttgagtttggtcgaaaccttcaaaaacgacccgcgccccgaaaaagtcaatttgagcataggcatttatttcgacgacgaaggcaaaatgcccgtgttggaatccgtgagccgcgccgaaaccgcccgcgccgccactcctgtgccgtcgccctacctgccgatggaaggcttagacacttaccgcagcgcggtgcagcatttgttgttcggcaaagacaaccccgcgctcgcgcaaggacgtattgttaccgtacaaaccttgggcggctcaggcgcgctcaaagtcggggcggactttctgcaccgctggtttcccgaagcgcgcgcctacgtcagcgacccgacttgggacaaccatcgcggcatttttgaaagcgcaggtttcgaggtcggcacttacccatattacgaccctgctgccgtcggcgtgaaattcgacgaaatgaccgcgtttttcaacaccctgcccgaaaacagcgtcctgatcctccatccctgctgccacaacccgaccggcgtggatatgtcggaacaacaatgggacgaagtgttgcacatcatcaaaacgcgcaaactgattccgtttatggacatcgcctaccaaggcttcggcggcgatttggacagcgatgcctacgccgtccgcaaagcggtggaaatggaattgcccttgttcgtcagcaattccttctcaaaaaacctgtcgctctacggcgagcgcgtcggcggcctgagcgtggtttgcccgaataaggaagaagcggatttggtgttcggacagctcaaattcaccgtccgccgcatctactccagcccgcccgcgcacggcgcgtatatcgccgccgacgtgatgaacagccccgaactttacgccttgtggcaaaacgaggtttatatgatgcgcgaccgcatccgtgcgatgcggcagaaactttatgatgtcttaactgcgcaaatccccgatcgcgatttcacttatttcatcaaacagcgcggcatgttcggctacacaggattgagcgtggaacaagtccgcaggctgcgcgacgaatttgccgtttacctgctggattccggcaggatgtgcgtcgccggactgaatacgtcgaataccgactatgttgcccgcgcatttgcggaagtcttgaaataa

SEQ ID NO: 4903 - protein, 397 aa, Neisseria meningitidis FAM18
MYRHIEYYPGDPILSLVETFKNDPRPEKVNLSIGIYFDDEGKMPVLESVSRAETARAATPVPSPYLPMEGLDTYRSAVQHLLFGKDNPALAQGRIVTVQTLGGSGALKVGADFLHRWFPEARAYVSDPTWDNHRGIFESAGFEVGTYPYYDPAAVGVKFDEMTAFFNTLPENSVLILHPCCHNPTGVDMSEQQWDEVLHIIKTRKLIPFMDIAYQGFGGDLDSDAYAVRKAVEMELPLFVSNSFSKNLSLYGERVGGLSVVCPNKEEADLVFGQLKFTVRRIYSSPPAHGAYIAADVMNSPELYALWQNEVYMMRDRIRAMRQKLYDVLTAQIPDRDFTYFIKQRGMFGYTGLSVEQVRRLRDEFAVYLLDSGRMCVAGLNTSNTDYVARAFAEVLK

SEQ ID NO: 4904 - DNA, 1197 bp, Acidovorax sp. JS42
  CDS (1)..(1197): transl_table=11
atgtctctgttcaccgccgtcgaaatggctccccgcgacccgatcctgggtctcaacgaacaatacgccgccgaccccaatccagccaaggtcaacctgggcgtgggcgtgtacttcgacgacaacggcaagctgcccctgctgcagtgcgtgcaggcagccgaaaaggccatgatggacaagcccgctgcgcgcggctacctgcccatcgacggcatcgctgcctatgacaacgcggtcaaggccctggtgttcggcgcggagtccgacgtcgtcaaggccggccgcgtggccacggtgcaggccattggcggcacgggcggcctgaagatcggcgcagacttcctcaagaagatcagcccgaacgcgaaggtgctgatctccgacccgagctgggaaaaccaccgcgccatcttcaccaacgccggcttcgaggtgggcagctaccgctactacgacgccgccaaccgcaaggtggacttcgacggcatgctggccgacctgaacgccgccgcgcccggcaccatcgtggtgctgcatgcctgctgccacaaccccacgggctacgacatcaccgccgcgcagtgggagcaggtgatcgccgccgtgaaggccaagggcctggtggctttcctcgacatggcctaccagggcttcggccacggtattgccgaggacggcgccgtgatcggcaagttcgtcgcggccggcctgaacatcttcgtgtccacctcgttctccaagagcttcagcctgtacggcgagcgcgtgggcgcgctgtccgtggtggccaacgacaaggacgaggccgcgcgcgtgctctcgcagctcaagatcgtgatccgcaccaactacagcaacccgcccacgcacggcggcgccgtggtggcggcggtactgaacaaccccgagctgcgcgccctgtgggaaaaggagctgggcgaaatgcgcgtgcgcatcaaggaaatgcgccagaagctggtggacggcctgaaggccgccggtgtgaagcaggacatgggcttcatcaccacgcagatcggcatgttcagctactccggcctgtccaaagaccagatggtgcgcctgcgcaacgagttcggcgtgtacggcaccgacaccggccgcatgtgcgtggccgcgctcaacagcaagaacatcgactacgtctgccaggccattgccaaggtgatgtaa

SEQ ID NO: 4905 - protein, 398 aa, Acidovorax sp. JS42
MSLFTAVEMAPRDPILGLNEQYAADPNPAKVNLGVGVYFDDNGKLPLLQCVQAAEKAMMDKPAARGYLPIDGIAAYDNAVKALVFGAESDVVKAGRVATVQAIGGTGGLKIGADFLKKISPNAKVLISDPSWENHRAIFTNAGFEVGSYRYYDAANRKVDFDGMLADLNAAAPGTIVVLHACCHNPTGYDITAAQWEQVIAAVKAKGLVAFLDMAYQGFGHGIAEDGAVIGKFVAAGLNIFVSTSFSKSFSLYGERVGALSVVANDKDEAARVLSQLKIVIRTNYSNPPTHGGAVVAAVLNNPELRALWEKELGEMRVRIKEMRQKLVDGLKAAGVKQDMGFITTQIGMFSYSGLSKDQMVRLRNEFGVYGTDTGRMCVAALNSKNIDYVCQAIAKVM

SEQ ID NO: 4906 - DNA, 1191 bp, Haemophilus somnus 2336
  CDS (1)..(1191): transl_table=11
atgttcgagaatattaatgcggcacccgctgatccaattttaggtttaggtgaggcttttaaatctgaaatgcgtgccaataaaattaacttgggtattggggtctataaagatgctaatggtaacacccccattatgaaagctgttaaagaagctgaaaatcgtctatttgaattagaaaccactaaaaactatttaactattgatggtattgcagagtttaattcatacactaaagaattattatttggtacaaattctaaaattattaaacaaggacgtgctaaaacagtacaaagtttaggaggaaccggtgcgttacgcattgctgccgaatttatcaaacgtcaaaccacatctcaaaacgtttggattagttcaccaacttggccaaaccataatgctattttcaacgctgtaggtatgacaatccgtgaatatcgttactacgatgcagagaaaaaagctttagattgggataatttaattgctgacttaagcaatgccagtgaaggtgatgtggtgttattacatggttgttgtcataacccaacgggtattgatccaacccctgagcaatggaaaatactagcagaaatgtcagaaaaaaatggttggttaccgctctttgattttgcttatcaaggtcttgctaacgggttagaagaagatgctattggtttgcgaacttttgcagaaaatcataaagaattattagtcgcaagttcttattccaaaaactttggtttatacaatgaacgtgttggtgcctttactttagtagcagaaacagaagaaatttcagcaatagcattaacacaagtgaaatcaattattcgtactctctactctaacccagcttctcatggtgctacagctgtttctatcattttaggtgatgacctattacgtcaacaatgggaatccgaattaaccgaaatgcgtaatcgcattaaacgtatgcgttatcaatttgttgaattgttaaaagaatatggtgcaaagcaagactttagcttcattattgaacaaaatggcatgttctcttttagtggtctaaatgcagaacaggtggatcgcttaaaagaagaatttgccatttatgctgtgcgttcaggacgtattaatttagccggtgtaactgaagataatattcgttatttatgtgaaagtattgtcaaggtgctttaa

SEQ ID NO: 4907 - protein, 396 aa, Haemophilus somnus 2336
MFENINAAPADPILGLGEAFKSEMRANKINLGIGVYKDANGNTPIMKAVKEAENRLFELETTKNYLTIDGIAEFNSYTKELLFGTNSKIIKQGRAKTVQSLGGTGALRIAAEFIKRQTTSQNVWISSPTWPNHNAIFNAVGMTIREYRYYDAEKKALDWDNLIADLSNASEGDVVLLHGCCHNPTGIDPTPEQWKILAEMSEKNGWLPLFDFAYQGLANGLEEDAIGLRTFAENHKELLVASSYSKNFGLYNERVGAFTLVAETEEISAIALTQVKSIIRTLYSNPASHGATAVSIILGDDLLRQQWESELTEMRNRIKRMRYQFVELLKEYGAKQDFSFIIEQNGMFSFSGLNAEQVDRLKEEFAIYAVRSGRINLAGVTEDNIRYLCESIVKVL

SEQ ID NO: 4908 - DNA, 1191 bp, Haemophilus influenzae R2846
  CDS (1)..(1191): transl_table=11
atgtttgaacatatcaaagcggcaccagccgatccaatcttaggcttaggcgaagcattcaaatccgaaactcgcgaaaataaaattaacttgggcattggcgtttataaagatgcgcaaggcacaaccccgattatgcgtgcagtgaaagaagcagaaaaacgcttatttgataaggaaaaaacgaaaaattatctgactatcgatggtattgctgattataacgaacaaacaaaagcgttacttttcggtaaagattctgaagtcatcaaatctaatcgtgcaagaacagtacaaagtttaggcggaacaggcgcattacgcattgcggcagaatttattaaacgtcaaactaaagcacaaaatgtgtggatcagcaccccaacttggccaaaccacaatgccattttcaatgccgtcggtatgacaattcgtgaatatcgttattatgatgctgaacgcaaagcccttgattgggatcatttacttgaagatttaagccaagcaaacgaaggcgatgtggtgcttttacacggttgttgccataatccgactggtattgacccaactccagaacaatggcaagaattagccgcactttcagcaaaaaatggctggttgccactctttgactttgcttatcaaggtttagcaaatggcttagatgaagatgcttatggcttgcgtgcttttgcggcaaaccacaaagaattgttagtagcaagttcattctcgaaaaactttggtttatacaatgagcgtgtaggcgcctttactcttgtggctgaaaatgcagaaattgcatcaaccgcattaacacaagtgaaatcaattattcgtacactctactctaacccagcatctcacggcggcgcaactgtagcaacagtattaaatgacactcaacttcgccaagagtgggaaaatgaattaactgaaatgcgcgaacgtatcaaaaaaatgcgtcatttattcgttcagttattaaaagaatacggtgcggaacaagatttcagctttatcattgaacaaaacggtatgttctctttcagtggattaactggggaacaagtggatcgcttaaaagaagaatttgccatttatgctgttcgttctggtcgtatcaatgtggctggtattactgaagataatattcgctatttatgtgaaagcattgtgaaagtgctttaa

SEQ ID NO: 4909 - protein, 396 aa, Haemophilus influenzae R2846
MFEHIKAAPADPILGLGEAFKSETRENKINLGIGVYKDAQGTTPIMRAVKEAEKRLFDKEKTKNYLTIDGIADYNEQTKALLFGKDSEVIKSNRARTVQSLGGTGALRIAAEFIKRQTKAQNVWISTPTWPNHNAIFNAVGMTIREYRYYDAERKALDWDHLLEDLSQANEGDVVLLHGCCHNPTGIDPTPEQWQELAALSAKNGWLPLFDFAYQGLANGLDEDAYGLRAFAANHKELLVASSFSKNFGLYNERVGAFTLVAENAEIASTALTQVKSIIRTLYSNPASHGGATVATVLNDTQLRQEWENELTEMRERIKKMRHLFVQLLKEYGAEQDFSFIIEQNGMFSFSGLTGEQVDRLKEEFAIYAVRSGRINVAGITEDNIRYLCESIVKVL

SEQ ID NO: 4910 - DNA, 1191 bp, Haemophilus influenzae R2866
  CDS (1)..(1191): transl_table=11
atgtttgaacatattaaagcggcaccagccgatcccatcttaggcttaggcgaagcattcaaatctgaaactcgcgaaaataaaattaacttgggcattggcgtttataaagatgcgcaaggcacaaccccgattatgcgtgcagtgaaagaagcagaaaaacgcttatttgataaggaaaaaacgaaaaattatctgactatcgatggtattgctgattataacgaacaaacaaaagcgttacttttcggtaaagattctgaagtcatcaaatctaatcgtgcaagaacagtacaaagtttaggcggaacaggcgcattacgcattgcggcagaatttattaaacgtcaaactaaagcacaaaatgtttggatcagcaccccaacttggccaaaccacaatgcgattttcaatgccgtcggtatgacaattcgtgaatatcgttattatgatgctgaacgcaaagcccttgattgggatcatttacttgaagatttaagccaagcaagcgaaggcgatgtggtgcttttacacggttgttgccataatccgactggtattgaccctactccagaacaatggcaagaattagccgcactttcggcgaaaaacggctggttgccactctttgactttgcttatcaaggtttagcaaatggcttagatgaagatgcttatggcttgcgtgcttttgcggcaaaccacaaagaattgttagtagcgagttcattctcgaaaaactttggtttatataatgaacgtgttggtgcctttactcttgtggcagaaaatgcagaaattgcatcaaccacattaacccaagtgaaatcaattattcgtacactctactctaaccctgcatctcacggtggcgcaactgtagcaacagtattaaatgacactcaacttcgccaagagtgggaaaatgaattaactgaaatgcgtgaacgtatcaaaaaaatgcgtcatttattcgttcagttattaaaagaatatggtgcagaacaagatttcagctttatcattgaacaaaacggtatgttctctttcagtggattaacaggggaacaagtggatcgcttaaaagaagaatttgcaatttacgctgttcgttctggtcgtatcaatgtggctggtattactgaagataatattcgctatttatgtgaaagcattgtgaaagtgctttaa

SEQ ID NO: 4911 - protein, 396 aa, Haemophilus influenzae R2866
MFEHIKAAPADPILGLGEAFKSETRENKINLGIGVYKDAQGTTPIMRAVKEAEKRLFDKEKTKNYLTIDGIADYNEQTKALLFGKDSEVIKSNRARTVQSLGGTGALRIAAEFIKRQTKAQNVWISTPTWPNHNAIFNAVGMTIREYRYYDAERKALDWDHLLEDLSQASEGDVVLLHGCCHNPTGIDPTPEQWQELAALSAKNGWLPLFDFAYQGLANGLDEDAYGLRAFAANHKELLVASSFSKNFGLYNERVGAFTLVAENAEIASTTLTQVKSIIRTLYSNPASHGGATVATVLNDTQLRQEWENELTEMRERIKKMRHLFVQLLKEYGAEQDFSFIIEQNGMFSFSGLTGEQVDRLKEEFAIYAVRSGRINVAGITEDNIRYLCESIVKVL

SEQ ID NO: 4912 - DNA, 1290 bp, Burkholderia vietnamiensis G4
  CDS (1)..(1290): transl_table=11
atgcccgctatgcgctcggcgacggcgcatcggcccgctgacgcaggcccgcacccgatcactcctacgaaccagaccgacatagccatgttcgaacacatcgacgcgtacccgggcgacccgatcctgacgctcaacgagaacttccagaaggatccgcgcgaccagaaggtcaacctgagcatcggcatctatttcgacgccgacggccggattccggtaatggccgccgtgcgcgaggccgaaaccgcgctgcagcgcgacgtcggcccgaagccgtatctgccgatggtcggcctcgccgcgtaccgcgacgcggtgcaggcgctggtgttcggcgccgatcacccggcgcgggcggccggccgcatcgcgaccgtgcagacgctcggcggctcgggcgcgctgaaagtcggcgccgatttcctgaagcgctacttcccggacgcgcaggtgtggctcagcgatccgagctgggaaaaccaccgtttcatcttcgagcgcgccggcttcacggtgaatacctacccgtactacgacgcggcgacgggcggcctgaagttcgacgcgatgctcgcggcgatcgacgcgctgccggcgcgcagcatcgtgctgctgcatgcgtgctgccacaacccgaccggcgtcgatctcgacgaaggccagtgggagaagctgatcgacgtgatcgaggcgcgcgagctgctgccgttcgtcgacatggcgtatcagggcttcggcgcgggcctcgacgccgatgcgttcgcggtgcgcgagttggcccgccgcggcgtgccggcgctcgtcgcgaattcgttctcgaagaacttttcgctgtacggcgagcgcgtcggcgcgctgagcgtcgtgtgcgaggatgcggacgcggccgagcgcgtgctcggccagctggccggcgcggtgcgctccaactacagcaacccgcagacgtatggcgcgaagctcgtcgcgaccgtgctgaacacgccggcgctgcgcaagcagtgggaggaagagcttgccgcgatgtgccgccggattgcgcggatgcgccaggcgatccacgacggcctgcgcgaccacgtgagcggcgaagcgctgacgcgctacgtgaagcagcgcgggatgttcacgtacaccgggctgaccgagacgcaggtcgacgcgctgcgcgacgtgcacggcgtctacattctgcgttcgggccgcatgtgcgtggccgggctgaacgattcgaacgtcggcatcgtcgccgatgcgattggcaaggtgctgaagagcggcgtctga

SEQ ID NO: 4913 - protein, 429 aa, Burkholderia vietnamiensis G4
MPAMRSATAHRPADAGPHPITPTNQTDIAMFEHIDAYPGDPILTLNENFQKDPRDQKVNLSIGIYFDADGRIPVMAAVREAETALQRDVGPKPYLPMVGLAAYRDAVQALVFGADHPARAAGRIATVQTLGGSGALKVGADFLKRYFPDAQVWLSDPSWENHRFIFERAGFTVNTYPYYDAATGGLKFDAMLAAIDALPARSIVLLHACCHNPTGVDLDEGQWEKLIDVIEARELLPFVDMAYQGFGAGLDADAFAVRELARRGVPALVANSFSKNFSLYGERVGALSVVCEDADAAERVLGQLAGAVRSNYSNPQTYGAKLVATVLNTPALRKQWEEELAAMCRRIARMRQAIHDGLRDHVSGEALTRYVKQRGMFTYTGLTETQVDALRDVHGVYILRSGRMCVAGLNDSNVGIVADAIGKVLKSGV

SEQ ID NO: 4914 - DNA, 1203 bp, Xylella fastidiosa Ann-1
  CDS (1)..(1203): transl_table=11
gtgcccttatttacagatgtggaattggttccgggtgatcccattttgagcctcaacgatgcttataacgccgatacgcgtaccaacaaggtcaatttgggtattggtatttattgtgacgagagcggttgtatcccgctgttgcgggctgtccagcaggttgaagagcaacttgcgaagcatccgaaaccgcgcggttatctgccgattgatggtttgccagcctatatcaaagccacacaacaattgttgtttggagttgactccctcttgttgacggctggccgtgtggcgacttcacagactgttggaggttctggtgcattgcgggtggctgctgaggtactgaagcaggtgctaccgcatgccactgtggccattagccgtccaagctgggagaaccaccgtgctttgttcaccgctgctggcttcaagattgaggactatacctatttcgatacgctcggccacgcggtggactttactggaatggtggcggacttggcgaagctgcaaccaaagaccgtggtattacttcatggttgctgtcataacccaacgggtgccgatctcagcagggatcagtggaagcagcttgttgccttgttccaggaacgtcaattgctgccatgtattgatctggcttaccaaggattcaatcagggcattgatgcggatgcttatgccatacgtttgcttgccgaagaaggtattagtaactatgtagttgccaactcctactccaaatcgttctcgttgtatggcgagcgtgttggggggctgtcgatcgttgcttccaatactgagcaagctcaagcaatccagtcacaagtaaagcgtatcatccgtacgatttattccagtccgccggcacacggtgcctacttggtcgcgagcgtgctgaacagtcatgaattgcgcacgctgtgggagcaggagttagctcagatgcgtgaacgtatccacgggttgcgtgcgggtttggttactcgattgaaggcgctgggtgtgccggagtttgatttcatacaacgtcaagcaggcatgttttcgtattcggggttgagcaagatccaggtggatcgtttacgcgacgagttcgggatttatgcggtcagtagtggacgtatctgtctggctgcgttgagtcagcacaaattggaatacgtggcccaggctgtggtgaaggtgcatcaaggctga

SEQ ID NO: 4915 - protein, 400 aa, Xylella fastidiosa Ann-1
MPLFTDVELVPGDPILSLNDAYNADTRTNKVNLGIGIYCDESGCIPLLRAVQQVEEQLAKHPKPRGYLPIDGLPAYIKATQQLLFGVDSLLLTAGRVATSQTVGGSGALRVAAEVLKQVLPHATVAISRPSWENHRALFTAAGFKIEDYTYFDTLGHAVDFTGMVADLAKLQPKTVVLLHGCCHNPTGADLSRDQWKQLVALFQERQLLPCIDLAYQGFNQGIDADAYAIRLLAEEGISNYVVANSYSKSFSLYGERVGGLSIVASNTEQAQAIQSQVKRIIRTIYSSPPAHGAYLVASVLNSHELRTLWEQELAQMRERIHGLRAGLVTRLKALGVPEFDFIQRQAGMFSYSGLSKIQVDRLRDEFGIYAVSSGRICLAALSQHKLEYVAQAVVKVHQG

SEQ ID NO: 4916 - DNA, 1185 bp, Sulfitobacter sp. EE-36
  CDS (1)..(1185): transl_table=11
atgttcgaaaccctacaggcgcagcccgccgataaaatccttgccttgatgcagatgtacaaggatgacccccgcgagaccaagatcgaccttggcgtgggcgtgtacaaggatgccacggggctgacgcccgtcatgcgcgcggtcaaggcggctgaacaccaactgtgggaagcccagaccagcaaggcctatactggtttggcgggcgaccctgcctttggcgatgcgatggtgcagatggtgcttggcgatgcggtcccccgcgcacaggtcgccgccgccgcgactccgggcgggaccggcgcgatccgtcaggcgttcgagctgatccagatggcccgtcctcaggcgcgggtgtttgtgtcgaacccgacatggccgaaccatctgtcgatcctgaaatatctggggatggaggtggccccctaccgctatttcgacgatgaaacccgtggcgttgatttcgatggcatgatcgccgacctcaagaccgcgcaaaaaggcgatgtggtcctgctgcacggctgctgccacaacccgacaggggccaacctgaacgccgccgaatgggacgcggtgatcaaagtgttgcaagacaccggcgccaccccgatgatcgatatcgcctaccagggctttggcgacgggcttgacgcggatgcggcggccacgcgcaaggtcgcggcggcggtgccggaatgtctgatcgcggcaagctgctccaagaacttcgggatttaccgcgaacgcactggcatcctgatggcgctgtcggcagacacctcggcgcaaaagctgaaccagggcacgctggcctttctcaaccgccagaacttcagcttcccgcccgatcacggggcgcgcatcgtcaccaccatcctgaacgacgacgccttgcgcagcgactggatggccgagctcgaagacatccgcaacaccatgctgggtctgcgcagccagctcgcgggcgaacttcagcgtctctccggctctgaccgttttggattccttgccgaacaccgcggcatgttctcgcgcctcggaacctcgtctgacatggtcgacaagctgcgcgaagaccacggtatttatatggtgggtgacagccgcatgaacatcgcggggctgaacgccgaaaccgtgccgatcctcgccaaggcgatcattgaggtcggcatctaa

SEQ ID NO: 4917 - protein, 394 aa, Sulfitobacter sp. EE-36
MFETLQAQPADKILALMQMYKDDPRETKIDLGVGVYKDATGLTPVMRAVKAAEHQLWEAQTSKAYTGLAGDPAFGDAMVQMVLGDAVPRAQVAAAATPGGTGAIRQAFELIQMARPQARVFVSNPTWPNHLSILKYLGMEVAPYRYFDDETRGVDFDGMIADLKTAQKGDVVLLHGCCHNPTGANLNAAEWDAVIKVLQDTGATPMIDIAYQGFGDGLDADAAATRKVAAAVPECLIAASCSKNFGIYRERTGILMALSADTSAQKLNQGTLAFLNRQNFSFPPDHGARIVTTILNDDALRSDWMAELEDIRNTMLGLRSQLAGELQRLSGSDRFGFLAEHRGMFSRLGTSSDMVDKLREDHGIYMVGDSRMNIAGLNAETVPILAKAIIEVGI

SEQ ID NO: 4918 - DNA, 1179 bp, Sulfitobacter sp. EE-36
  CDS (1)..(1179): transl_table=11
atgctcgacgcgcttgccgcccttcccgaagacccgatctggggtctgacctctgcctttcgcgccgatccgcgcagccacaagatcgacatggtcatcggcgtctaccgcgatgacaacggggccacgccgaatatgaaggcggtgcgcatggccgagcgcgccttggcgcaggacagtgcgccgaaaacctaccgcgctttggcgggcaatgcggtgttcaacgcgggcatggcgcggctggtcttgggcgatgcgcccgcgcggatcgcgcgcagccatgtgatccagacggtcggcgggacaggcgccttgcgcgtcctgggggatatgctggccagcctgcgccccgacaccacggtctggagcacggaccccggctatgtgaaccaccgtccgatattcgagggagccgggctgacgctgcagttgtatcgctggcaggccaagggcgacgcactggatcttgaccgcgtgctcgcggatctggcggcggcgaagccgggggatgtggtgctgctgcacggctgctgccacaaccccacgggcatcgatcccgatgcgaatatgtggcatgcgctggcccgattttgcgcggcgcgggggctgatcccgttgatcgacattgcctatcagggctttggccgcgggctcgacgaagatgcggcggggctgcgggtgatggtcgatgcggtgcccgtggcgatggttgcggcaagcgggtccaagaacatggggctatattgcgaacgtatcggggcggcgatggtgctggggccggatgcggcgtccatcgcccatgtgggtcgccacctagagacattgacccgcgcgaattattcgatgccccccgaacatggtgccgctgtcgcctgccatgtctttgacacccgcaccatctgggaggaagagctcaacagtatgcgcgcccgtgtccaatcgctgcggcagcaactggccgatgcgctggccgcgattgatgcggcccccgcatttcaggcgctgcggcaccatcgggggatgttttcgctgctgcccctcgcgcccgaccagatggagagcttgcgccgcgaccacgcgatctatggcacggccaccggacggatcaatatcgccggtctgcgcagcacgcagatcgaacaggtcgcggctgcgcttcgggaggtgtcacaggcgtga

SEQ ID NO: 4919 - protein, 392 aa, Sulfitobacter sp. EE-36
MLDALAALPEDPIWGLTSAFRADPRSHKIDMVIGVYRDDNGATPNMKAVRMAERALAQDSAPKTYRALAGNAVFNAGMARLVLGDAPARIARSHVIQTVGGTGALRVLGDMLASLRPDTTVWSTDPGYVNHRPIFEGAGLTLQLYRWQAKGDALDLDRVLADLAAAKPGDVVLLHGCCHNPTGIDPDANMWHALARFCAARGLIPLIDIAYQGFGRGLDEDAAGLRVMVDAVPVAMVAASGSKNMGLYCERIGAAMVLGPDAASIAHVGRHLETLTRANYSMPPEHGAAVACHVFDTRTIWEEELNSMRARVQSLRQQLADALAAIDAAPAFQALRHHRGMFSLLPLAPDQMESLRRDHAIYGTATGRINIAGLRSTQIEQVAAALREVSQA

SEQ ID NO: 4920 - DNA, 1179 bp, Roseovarius nubinhibens ISM
  CDS (1)..(1179): transl_table=11
atgctcagcaacctatcgcagcagcccgaggacaagatcctcgccctcatggcccagtatcgcgccgatccgcgcgacaccaaggtcgatctcggcgtcggggtctacaaggacgcaagcgggcacaccccgatcatgcgcgccgtcaaggcggccgagaaacggctctgggaagaggaacagaccaaatcctatgtggcgctcgcgggcgatcccggcttttccgacgcgatggtctcgctggtgctcggcgatgccgtggcccgcgatgccgtggcggcggcggcgaccccgggcggcaccggtgccgtgcgtcaggcgttcgagctgatccgcatggccaaccccaaggcgcggattttcgtgcccaacccgacctggcccaaccacctgagcatcctcaaatatctcggcatggaaacggtcacctaccgctatttcgacagcgccaccggtgccgtcgatttcgccgggatgcaggaagatctcgccgggctcaccgcaggcgatgtggtgctgctgcatggctgctgccacaacccaaccggcgccaacctgaccctgccggaatggcaggcggtgattgccgtgctcaatgacaagggcgcgatgccgatgatcgacatcgcctatcagggctttggcgacgggctcgacgccgatgccgccgccacccgtctggtggccaaatcctgccctgagacgctgatcgcggcgtcctgctcgaagaatttcggcatctaccgcgaacgcaccggcatcctgatggcggtgagccaaggccagaccgccgtggcgcaggacaatctcaacttcctgaaccggcagaacttttccttcccgcccgaccatggcgcgcggctggtgacgatgatcctcaatgatgacgcgctccgcgccgattggcaggccgagctcgaagaggtccgcaacggcatgctgggcctgcgcgaaagcctcgcggatgagctgcgcaaactctccggctcggaccggttcggctttgtcgcacagcatcgcggcatgttctcgcgcctcggcgcaacgcccgaacaggtcgcccatatgcgcgagcatcacggcatctacatggtgggcgacagccgcatcaacatcgccgggctcaacgtcaaatcggtgccgatcctcgccaaggcgatgatcgacgcaggcgtctga

SEQ ID NO: 4921 - protein, 392 aa, Roseovarius nubinhibens ISM
MLSNLSQQPEDKILALMAQYRADPRDTKVDLGVGVYKDASGHTPIMRAVKAAEKRLWEEEQTKSYVALAGDPGFSDAMVSLVLGDAVARDAVAAAATPGGTGAVRQAFELIRMANPKARIFVPNPTWPNHLSILKYLGMETVTYRYFDSATGAVDFAGMQEDLAGLTAGDVVLLHGCCHNPTGANLTLPEWQAVIAVLNDKGAMPMIDIAYQGFGDGLDADAAATRLVAKSCPETLIAASCSKNFGIYRERTGILMAVSQGQTAVAQDNLNFLNRQNFSFPPDHGARLVTMILNDDALRADWQAELEEVRNGMLGLRESLADELRKLSGSDRFGFVAQHRGMFSRLGATPEQVAHMREHHGIYMVGDSRINIAGLNVKSVPILAKAMIDAGV

SEQ ID NO: 4922 - DNA, 1185 bp, Oceanicola batsensis HTCC2597
  CDS (1)..(1185): transl_table=11
ttgttcgcagagctgcgcccccagcccgatgatccgatcctcgccctgatggaccggttccgggccgacccgcgcgcggacaagatcgacctcggcgttggggtctacaggaacagccggggcgtgacgcccgtgatgcaggccgtgaaatctgccgagcagcaactgctcgaacggcaggaaagcaagagctatacgggcctcgccggggatcccgctttcgtcgcggcgatgacgcggctcgtgctgggcggagaaatcgacgccgagcgcatcgccggcgccgcgaccgtgggcgggaccggtgcgctccggcaggccctcgatctggcgcgcttggcaagcccgggcgcgacggttcacattcccgatcccagctggcccaaccaccgggcgatcatcgaggcggtcgggctgtcctgccgcagctaccggtattacgacccggcagccggcggcatcgacatcgaggggatgattgccgacctcgccgcggcagagcccggggatgtcgttgtccttcatggctgctgtcacaatccgacaggcgccgatccgacggccgcgcaatggcacgatatcgtcgaggcgctccgcacatcccgtgcaaccgttctgatcgaccttgcgtatctggggttcggcgaggggctggatgcggatgccgccgcgacccgtctcgttgcgcggcaactgcccgaggtgatcgtggcggtgagttgctccaagaacttcggtctctatcgcgaccgggccggggtcgtgcttgtcctgtcagagaccggtgcgcatcgcgatgtggttcagggcaacctcgccacgctgaaccggctggcctattcctttcccgccgatcacggggcgaaggtggccgaaacgatcctgaacgatcctgcgctccatgcgtcctggaccgaggagctgggccagatgcgggggcggatcaacgagttgcgccggagcttggccgatgccctgcggtccgagaccggctcggaccgcttcgcctttctggcgtctcagaacggcatgttctcgcgtctggcggtgccaccggaggacatccgtcggctgcgcgaggagaaggcgatctatctgatcggagacgggcgcctgaatgtcgccgggctgaacgccgaggacatcccgcgcctcgcccgggcaatcgccgagatcagcccctag

SEQ ID NO: 4923 - protein, 394 aa, Oceanicola batsensis HTCC2597
MFAELRPQPDDPILALMDRFRADPRADKIDLGVGVYRNSRGVTPVMQAVKSAEQQLLERQESKSYTGLAGDPAFVAAMTRLVLGGEIDAERIAGAATVGGTGALRQALDLARLASPGATVHIPDPSWPNHRAIIEAVGLSCRSYRYYDPAAGGIDIEGMIADLAAAEPGDVVVLHGCCHNPTGADPTAAQWHDIVEALRTSRATVLIDLAYLGFGEGLDADAAATRLVARQLPEVIVAVSCSKNFGLYRDRAGVVLVLSETGAHRDVVQGNLATLNRLAYSFPADHGAKVAETILNDPALHASWTEELGQMRGRINELRRSLADALRSETGSDRFAFLASQNGMFSRLAVPPEDIRRLREEKAIYLIGDGRLNVAGLNAEDIPRLARAIAEISP

SEQ ID NO: 4924 - DNA, 1188 bp, Erythrobacter sp. NAP1
  CDS (1)..(1188): transl_table=11
atgctcgacaatctcgaaccccaatcgcccgatgcgctgcttgcgctgatcaagctccacgctgccgacgaacggcccgacaagatcgaccttggcgtcggtgtctaccgcacggggcagggcgcgacccctgtcttcggagcgatcaaggcggctgagaaatggctggtcgagaaccaggattccaagtcctatctcggtccggaaggcgatatgggcttcgtcaacgctctcaaaccgtacattttcggcgaagacccgacgatgggcgggcgcattcagggcatgcagacaccgggcggcaccggcgcggttcgccttgcggcggccttggcgcaggcagccggcatgaccaggcttcacatgggaacgccaagttggcccaaccatgctcagatcttcggcgatatcgaccttgaatgggtcgctttcgatcatgcgaaccctgacggcacggctaacatcgacgcggtgcttgctgcgatcaagagcgcaggccccggcgaaggcgtgctcctgcatggctgctgccacaatccgacggggatcgactacaccgccgatcagtgggacgcgattggcgatgcgctggttgagagcggcacgttcccgattatcgacaccgcctatcacgggctgggtcacgggcttgatgaggacgtcgcgggtcttcgcagcgtgcttgccaaggtgcccgaggcgttcatcgcttacagctgcgacaagaacttcggcatgtaccgcgaccgcgtgggtgcattctacatcatgtccaagtccggtcctgaaggcaccgacacgctcgacaaggcgttctcgaatgccaacgcgctggcccgcgcgagctggtcgatgccgcccgaccatggagcggctgccgtgcgcgtgatcctgcgcgatccagagatgacgcagcaatggctcgacgagctcgaccagatgcgcgcgcggatgcggcaggtgcgcgattacctcgccaaagctggcgttgccggcagcgtcgaccttgcgccgcttggcattcagaatggcctgttctcggtgcttccgatcagcaaggagcaggtgcaggcgcttcgcgaggatcacggcatctacatggccgggtctggccgcatcaacgttgcgggcctgacgatggacaacatcgacaagttcatcggcgccatcgctgacgtgacgggctga

SEQ ID NO: 4925 - protein, 395 aa, Erythrobacter sp. NAP1
MLDNLEPQSPDALLALIKLHAADERPDKIDLGVGVYRTGQGATPVFGAIKAAEKWLVENQDSKSYLGPEGDMGFVNALKPYIFGEDPTMGGRIQGMQTPGGTGAVRLAAALAQAAGMTRLHMGTPSWPNHAQIFGDIDLEWVAFDHANPDGTANIDAVLAAIKSAGPGEGVLLHGCCHNPTGIDYTADQWDAIGDALVESGTFPIIDTAYHGLGHGLDEDVAGLRSVLAKVPEAFIAYSCDKNFGMYRDRVGAFYIMSKSGPEGTDTLDKAFSNANALARASWSMPPDHGAAAVRVILRDPEMTQQWLDELDQMRARMRQVRDYLAKAGVAGSVDLAPLGIQNGLFSVLPISKEQVQALREDHGIYMAGSGRINVAGLTMDNIDKFIGAIADVTG

SEQ ID NO: 4926 - DNA, 1191 bp, Pseudoalteromonas tunicata D2
  CDS (1)..(1191): transl_table=11
atgttttctattttgaaaccgttaccaacagacccgatattaggcttaatggcagcctaccgccaagatacaaatccaaataaaattgatttaggtgtcggtgtttttaaagatgaatcaggccacacaccagtacttaaatctgtaaagaaagccgaagcttttcgtttagagaatgaaacatctaaatcttatattggtttagcgggtgatttaggtttctgtaacaaaatggaaattcaattattaggagagcataaagcactgcttgcgaatcgtgttcgaacagcacaaacacctggtggtacaggtgctttacgagttgcggctgaatttattgtgcgctgcaatccaaatgcaacggtatgggtaacaacaccaacttgggcaaaccatatcagcttattcgaagcagctggtctaacagttaaagaatacccatattatgattatgaaaataaagggttattatttgatgaaatgatcacagcattaaaacaagtaccaaaaggtgatgttgttttattacatgcatgttgtcataacccaagtggtatggatttaaacattgagcaatggaaaatagttgcagaactggcagttgaagttggttttacgccattagtagatattgcatatcaagggtttggcactgggcttgatgatgatgccgctggtttacgcttactagctgagtatgtagatgagttaattatttgttcttcatgttcaaaaaactttggtttatatcgtgagcgtattggtgcatgttctattgtatcttctgatgcaaaggttgctgatgtggctaactcagttttattaagtgttgtccgtagtatttattcgatgccgccagcacacggtgccgcaattgttgataccatcctaggcagtacagagttgactgcgctttggcatcaagagctagctgaaatgcgtgaccgtattaatggccttcgtactttaatcgttgattctttgaatgctcaagggattgatcaagatttctcttttattaaacaccaatttggcatgttctcatttttgggcattaacaaagagcaaattgatcgtttacaaaaagaatatggtatttatatggttggttctagccgtgtaaatgttgcaggtgttagccatgctaatattgattatttttcaaaagcggttgcttcggtattaaaataa

SEQ ID NO: 4927 - protein, 396 aa, Pseudoalteromonas tunicata D2
MFSILKPLPTDPILGLMAAYRQDTNPNKIDLGVGVFKDESGHTPVLKSVKKAEAFRLENETSKSYIGLAGDLGFCNKMEIQLLGEHKALLANRVRTAQTPGGTGALRVAAEFIVRCNPNATVWVTTPTWANHISLFEAAGLTVKEYPYYDYENKGLLFDEMITALKQVPKGDVVLLHACCHNPSGMDLNIEQWKIVAELAVEVGFTPLVDIAYQGFGTGLDDDAAGLRLLAEYVDELIICSSCSKNFGLYRERIGACSIVSSDAKVADVANSVLLSVVRSIYSMPPAHGAAIVDTILGSTELTALWHQELAEMRDRINGLRTLIVDSLNAQGIDQDFSFIKHQFGMFSFLGINKEQIDRLQKEYGIYMVGSSRVNVAGVSHANIDYFSKAVASVLK

SEQ ID NO: 4928 - DNA, 1191 bp, Photobacterium sp. SKA34
  CDS (1)..(1191): transl_table=11
atgtttgagaaaattacggcagctcctgctgatccaattttaggtttaacagaagaattcaaagcagatacacgcgcaacaaagattaatctaggcgttggtatttataaagatgaaacaggtaatacgcctgttcttgctactgtaaaaaaagcagaagctattttgcttgaaaaagaaaaaacaaaatcatacttaagcattccaggtacgccagaatacggcctagccgttcaagagctgctttttggtaacgatgcaacaatcatcactgaaaaacgcgcacaaacagctcaagcaccaggtggtactggtgcgttacgtgttgctgcagaatttattaagcgacaattaggcgatgtaaaagtatggatcagtaatcctacttgggctaaccaccacggcgtctttggtgcagctggtcttgaaacacagccatactcttactataacgctgaaacaagtgatattgactttgacgcagcaattactgatttaagccaagctagccaaggtgatattgttcttctgcatggttgctgccataacccaacaggtattgacccaacaacagagcaatggcaaacactagcaaaactttgcattgaaaaaaagctactaccaatgtttgattttgcttatcaaggttttgcacgcggcgtagaagatgatgcgcaaggtttacgcatctttgcagatcaactgccagaattactggtagcgagctctttctctaagaactttggtttatacaatgagcgtgtaggcgcatttacacttgtaggtaaaacagcagagcaagcagcaacggcatttagccaagtgaaatctatcgcacgtgttatttattctaacccacccgctcacggtgctgcgattgttacaacaatcctaaataacgctgagcttcgtgcagaatgggaacaagaagttgctgatatgcgtgatcgtatccaagaaatgcgtacgctatttgtaaacacattaaaagagctgggtgtaactaacgactttagctttattgaacgtcaaaacggtatgttctcgttctctggtttatctaaagagcaagtaacacaacttaaaaatgattttgcgatttatattgttggttcaggccgtattagtgttgcgggtatgacaaaagataatatgatgcctttatgtaaaggtattgctgccgtcttataa

SEQ ID NO: 4929 - protein, 396 aa, Photobacterium sp. SKA34
MFEKITAAPADPILGLTEEFKADTRATKINLGVGIYKDETGNTPVLATVKKAEAILLEKEKTKSYLSIPGTPEYGLAVQELLFGNDATIITEKRAQTAQAPGGTGALRVAAEFIKRQLGDVKVWISNPTWANHHGVFGAAGLETQPYSYYNAETSDIDFDAAITDLSQASQGDIVLLHGCCHNPTGIDPTTEQWQTLAKLCIEKKLLPMFDFAYQGFARGVEDDAQGLRIFADQLPELLVASSFSKNFGLYNERVGAFTLVGKTAEQAATAFSQVKSIARVIYSNPPAHGAAIVTTILNNAELRAEWEQEVADMRDRIQEMRTLFVNTLKELGVTNDFSFIERQNGMFSFSGLSKEQVTQLKNDFAIYIVGSGRISVAGMTKDNMMPLCKGIAAVL

SEQ ID NO: 4930 - DNA, 1182 bp, Photobacterium sp. SKA34
  CDS (1)..(1182): transl_table=11
atgtttaaatctctctctccagcccaattagatcctattctttccctatcgatcgcatatcgagaagatccgcgtgacaacaaaatagatttaggtgtcggtgtttaccgcaatagtcttggtgaaacaccgatcatgcaagcagttcaacttgctgagcaacgtttaattaaaacacaaacaacaaaatcatacgtgagtttagcgggtagcgaagtatttaatcagtctatgatggatcttttactctcagatacatcggcacattctcgcgctgcagcagtgcaaactccgggtgcgagtggtgcgttacgtatgcttgctgatcttattcaagttgctcaacctgatactactgtttggttaaccaatccgagttatgttaaccataaacctgtgatggaagcggcaggtttaaaggtgaagtattacccatattttgagcctgaaactaagcaagttaatagcgatgcaatgctcaaagagattgccaaagcaggtccaaaagatgttgtgctattacatggttgctgccataacccgacaggtgctgatattacatttgctgattggcaagcgattacggcattggcaaacaaaaatggctttatgccgtttgtcgatatggcatatcttggttttggagatggcttagaacaagatggcgctggccttaagtacatggctgacaatatagaagagatggttgtagcgacttcttgttcaaagaactttggtttgtaccgtgaacgaacgggtgctgcgattattattagtaatagtcagcaagaagcacaaaaagcgaaaggacgtgttcttactttagcgcgttcaagttataccatgccaccagatcatggcgcggcattagttgctgatattttaaatgatcaacaactgacaactatctggaaagatgaattatataccatgcatagccgcattttgacgttacgccaagggttaacacaagcaatacgtcaacgtggtagtgagcaatttgattttattgaacagcataaaggtatgttctctgtaactggcttaacgcctgagcagattttaacggtacgtaagaagtatggtatttatgcggtaggtgatgggcgaattaatattgccggtttacaagagcagcatatcgaccacttggcagatgccttagttagcgtatcacgataa

SEQ ID NO: 4931 - protein, 393 aa, Photobacterium sp. SKA34
MFKSLSPAQLDPILSLSIAYREDPRDNKIDLGVGVYRNSLGETPIMQAVQLAEQRLIKTQTTKSYVSLAGSEVFNQSMMDLLLSDTSAHSRAAAVQTPGASGALRMLADLIQVAQPDTTVWLTNPSYVNHKPVMEAAGLKVKYYPYFEPETKQVNSDAMLKEIAKAGPKDVVLLHGCCHNPTGADITFADWQAITALANKNGFMPFVDMAYLGFGDGLEQDGAGLKYMADNIEEMVVATSCSKNFGLYRERTGAAIIISNSQQEAQKAKGRVLTLARSSYTMPPDHGAALVADILNDQQLTTIWKDELYTMHSRILTLRQGLTQAIRQRGSEQFDFIEQHKGMFSVTGLTPEQILTVRKKYGIYAVGDGRINIAGLQEQHIDHLADALVSVSR

SEQ ID NO: 4932 - DNA, 1200 bp, Oceanospirillum sp. MED92
  CDS (1)..(1200): transl_table=11
atgttcgaaggtttacacgcagttccccaagatccgattctagcgatgctggcgagctatcgagaagatacacacccgcagaaaatcgatctgggtatcggggtttataaaaatgatcagggtgataccccgattatgcgagcggtacaggtagcagaggccagactgctggcgactgaaaccacaaagagttatacagctcccgctggctcgcctgtttataacgaacgtgtcgctaagttggtttttggttcagaccatcctgtacttaacgataagcgagttgtttcagctcagaccccgggtggctgtggagccctacgcatggcggctgagtttctaagaggctgtaacgaggatagtaaggtatgggttagcacacccacgtgggcaaatcatatgcctttgttgggtggtgcgggtctagagatctgcatgtacccatactacgaccatgacaacaaaaacatcgattttcaggcgatgcttgatgcgctggaaagcgctgtggcaggggatatcgtgttgcttcatggttgctgccataacccaagtggcgctgaccttaataaagaacagtggcatgccatagcagatctgatggagcgcaagggcctgattccatttgtcgatatggcctatcagggcctaggtgcaggaatcgatgaagatgcctacggcttgcgtatgttggctgcacgtttcccggaaatggttgcagcgacttcctgctcaaagaactttggcctctatcgggagcgcacaggcacgctgtttattgttgcagcaacaccagagcaggcagcaaatgccggcagtcagctgttcagtaagatccgtagtcattactccatgccaccttctcatggtgcagccattgtagaaaccattctgggtgataccgagctttctcagacctggttggatgagctggctgtgatgcgtaaccgcattcaagggttacgtcagagtctggttgcaaaaattagagattcagcgatcgatcgtgacttctcttttatagagcagcaatttggcatgttctcctttctggggattaccagtgctcaggtcgaggcactgcgttcacagcacagtatttacatgattgattccagccgcatgaacgtagcgggtttgaatgatgaatgtatggactatttcgtatctgcgttaggcgaggtattgcgagccagctaa

SEQ ID NO: 4933 - protein, 399 aa, Oceanospirillum sp. MED92
MFEGLHAVPQDPILAMLASYREDTHPQKIDLGIGVYKNDQGDTPIMRAVQVAEARLLATETTKSYTAPAGSPVYNERVAKLVFGSDHPVLNDKRVVSAQTPGGCGALRMAAEFLRGCNEDSKVWVSTPTWANHMPLLGGAGLEICMYPYYDHDNKNIDFQAMLDALESAVAGDIVLLHGCCHNPSGADLNKEQWHAIADLMERKGLIPFVDMAYQGLGAGIDEDAYGLRMLAARFPEMVAATSCSKNFGLYRERTGTLFIVAATPEQAANAGSQLFSKIRSHYSMPPSHGAAIVETILGDTELSQTWLDELAVMRNRIQGLRQSLVAKIRDSAIDRDFSFIEQQFGMFSFLGITSAQVEALRSQHSIYMIDSSRMNVAGLNDECMDYFVSALGEVLRAS

SEQ ID NO: 4934 - DNA, 1188 bp, Oceanospirillum sp. MED92
  CDS (1)..(1188): transl_table=11
atgttttctgagttaatggcaccaccagcggatccaatccttggcttgtctattaaattcaaagccgacgaaaatccgaacaaaatcgatcttggtcctggtatctataaagacgaagccggcaatacaccggttctggcttgcgttaaaactgctgaaaaactccgcgtagacaacgaaacaacgaaaacctacctgggttcagcaggctcctccctgtttaatgacaagatcgctgatctgttactgggcgagcatgacattattaaacaaaatcgtatccgtacagtatccacccctggcggcacaggcgcactgcgtcttgcgggtgagttcctgaaaacctgtaaagcgggtgcgactatctgggttagcaacccgacatgggctaaccatcaaggtgttttcacagcagccggcctgactgttaaaacctacccgtactacgattatgaaaacaaatgcctggactttgcagcgatgactgaagcgctgaaacaagttccggcaggcgatgctgttctattacacgcatgctgccataacccaagcggcatggacctgaacaatgagcagtggcaacaagttgcagaattagccaaagaaaaaggctttatgccagtgatcgacattgcgtaccagggcttcggcaatggtctcgatgaagatgcctacggtctgcgcctgatggctaacaccgttgacgagctgattgtgtgcagctcatgctctaagaacttcggcctataccgtgagcgtatcggcggttgctccatcatcggtaaagacgcagcttctgcagacattatcggcgcagtgctaaaccgcgttgtacgtgttctgtattctatgccacctgcacatggcgcagcgattgttgaaacaatcctaagctcggaagagctgtccgctcagtggcacgcagaactgaaagagatgcgcgatcgcatcaacggaacacgccagctcttggttgagaaactagctgaaaaaggcgttactcaggactttagctttatcacgcgccaaaacggaatgttctcattcctgggcatcgatcaggcacaggtaacccgcctacaggacgagttcagcatctacgttgtggattccagccgcatcaacgtggcaggcatctctcagtcaaacgttgattacctgactgagtccctggctaagattctataa

SEQ ID NO: 4935 - protein, 395 aa, Oceanospirillum sp. MED92
MFSELMAPPADPILGLSIKFKADENPNKIDLGPGIYKDEAGNTPVLACVKTAEKLRVDNETTKTYLGSAGSSLFNDKIADLLLGEHDIIKQNRIRTVSTPGGTGALRLAGEFLKTCKAGATIWVSNPTWANHQGVFTAAGLTVKTYPYYDYENKCLDFAAMTEALKQVPAGDAVLLHACCHNPSGMDLNNEQWQQVAELAKEKGFMPVIDIAYQGFGNGLDEDAYGLRLMANTVDELIVCSSCSKNFGLYRERIGGCSIIGKDAASADIIGAVLNRVVRVLYSMPPAHGAAIVETILSSEELSAQWHAELKEMRDRINGTRQLLVEKLAEKGVTQDFSFITRQNGMFSFLGIDQAQVTRLQDEFSIYVVDSSRINVAGISQSNVDYLTESLAKIL

SEQ ID NO: 4936 - DNA, 1197 bp, Oceanospirillum sp. MED92
  CDS (1)..(1197): transl_table=11
atgctggagcatattgatgcagagcttgaggacccaattctaaaagtaatggccagtttcaaagcctctactgtttctcataaactggatctcggtattggcgtctatcgcgatagcaagggtaaaacaccgatttttaaagcggtcaaagaagctgagctcatcattcaaatgcaggagaccagtaaagcctatctggggcctgttggtgatacccaatataccggactgatccatcagcttttgtttggccagcttgattgcccccccgattttttccaaatcattcaaaccccaggtggtacgggtgcgctcagggttgctggggagtttttacacagcgcgctacccttcgcaactttgtggctttcagaccccgcctggtctacgcacaagcctatcttttccggggcacaactgcctactaaggagtatcgttactttgatcatgaaactcgtgtgctggattttgccgccatgtgcgaagatattgcagccatcccaacaggcgatatcgtcctgctgcagagctgtggtcacaaccccagcggctgcaatcttagttatgagcaatggctaagcgtttcgcaattaatggccgatagagggcttttacctttactcgatctggcctatcacgggctagatcagggtcagattttggatcttcaatcaattaaagcgattgaagcacaccatgatgagtggttgctttgctattcagcttcgaaaaccttcagtctatacaacgacagaaccggcgcgttggcagttagaaacagaaccattcaaaacgcccatcacgcgcttagcctgatcctgaatctggtgtgcgcaaactactatatgccacctgctcatggcgcatcggtggttcggaccattcttacaagctctgacctcacagagctctggaaacatgaacttgaagccgcccgaactagaattattgactgcagaaaagcgcttatcgatgctttatcaagttcggggaccgatgactatcagttcctcgaacgccaagagggtatgtttgcctatctgggcctgacagaaaaagagctagcttggctaagggaaaagcatgctctctattttggtccgggtggtcgtctgaacattgccggtttaaacccgcagagtcttccgcaaatcagccaagcgttgactgaacttgcgaaaaaaaaacggggctaa

SEQ ID NO: 4937 - protein, 398 aa, Oceanospirillum sp. MED92
MLEHIDAELEDPILKVMASFKASTVSHKLDLGIGVYRDSKGKTPIFKAVKEAELIIQMQETSKAYLGPVGDTQYTGLIHQLLFGQLDCPPDFFQIIQTPGGTGALRVAGEFLHSALPFATLWLSDPAWSTHKPIFSGAQLPTKEYRYFDHETRVLDFAAMCEDIAAIPTGDIVLLQSCGHNPSGCNLSYEQWLSVSQLMADRGLLPLLDLAYHGLDQGQILDLQSIKAIEAHHDEWLLCYSASKTFSLYNDRTGALAVRNRTIQNAHHALSLILNLVCANYYMPPAHGASVVRTILTSSDLTELWKHELEAARTRIIDCRKALIDALSSSGTDDYQFLERQEGMFAYLGLTEKELAWLREKHALYFGPGGRLNIAGLNPQSLPQISQALTELAKKKRG

SEQ ID NO: 4938 - DNA, 1194 bp, marine gamma proteobacterium HTCC2207
  CDS (1)..(1194): transl_table=11
atgtttgaaagtttaaagcccgtagttgctgatcctattcttggattgatggcggcttttcgagaagacccgcgcgagactaaaatcgatttaggcgttggcgtctatatgaatgaccgcggtcaaacgccggttatggattcggtaaaacgcgccgaagccaaattggccgagcttgagaaaaccaaatcctatcaaggcattgctggcgatgctgagtacaacagcagaatgttgcagttgatgtttggtcaggatcacgctgttctggcatctggacgagctaagagcctgcaggccccaggtggttctggcgctttgagagtcggtgctgaggtgattcgtcgcgctcgccccgaggcaaaattatgggttggcacacccacctggccgaaccatatcccactgcttggcagtgcgggttttgagattgcagaatatccctattacgacacagcgactcgcgaggtcaatattgacctaatgcttgagactctgcgccgggttcccgctggtgatgtggtgctgttgcatggttgctgtcataacccgactggcgcggatctgagcaacgaacagtgggaccagattactgagattgcgctggagcgcggttttgtaccctttattgacaccgcctatcaggggcttggtgatggcttggacgaagatgcctacggcatgcgtctgatggctgagaagttaccggagttggtagtggcctcgagctgctctaagaactttggtctctaccgcgagcgcactggatcgattacctttattacacaaactcctgagcaagctgcaattgtcggcggtcaggccatggcggtcgcccgtcagatgtactccatgccacctgctcacggcgctctgttagtctcgttaattctgggcgatgaagcgctttgtaaggactggaaagcggagctggaagaggttcgcctgcgaatcaaagctatgcgtacattgctggccgacagtattcaggacaatgcagcaggactggattttagtcatatcaagcgccagaacggcatgttctcgttcttgggtattgcgccagagcacctgacgcgcctgagagaagagtttggtatctatattgtctcttcaactcgtattaacttggcgggcattaactcaagcaatattgcctatcttgctgagtcgattcgcactgtactcaagtag

SEQ ID NO: 4939 - protein, 397 aa, marine gamma proteobacterium HTCC2207
MFESLKPVVADPILGLMAAFREDPRETKIDLGVGVYMNDRGQTPVMDSVKRAEAKLAELEKTKSYQGIAGDAEYNSRMLQLMFGQDHAVLASGRAKSLQAPGGSGALRVGAEVIRRARPEAKLWVGTPTWPNHIPLLGSAGFEIAEYPYYDTATREVNIDLMLETLRRVPAGDVVLLHGCCHNPTGADLSNEQWDQITEIALERGFVPFIDTAYQGLGDGLDEDAYGMRLMAEKLPELVVASSCSKNFGLYRERTGSITFITQTPEQAAIVGGQAMAVARQMYSMPPAHGALLVSLILGDEALCKDWKAELEEVRLRIKAMRTLLADSIQDNAAGLDFSHIKRQNGMFSFLGIAPEHLTRLREEFGIYIVSSTRINLAGINSSNIAYLAESIRTVLK

SEQ ID NO: 4940 - DNA, 1200 bp, Vibrio sp. Ex25
  CDS (1)..(1200): transl_table=11
atgaagattatgtttgaaaaagtagttgccgctccggctgaccctattcttggccttactgaagagtttaaaaaagatactcgcgcagacaaaattaaccttggcgtaggtatttacaaaaacgagcaaggcgaaactcccgttcttgcaacagtaaagaaagctgaagcagcgcttgttgaaactgaaaaaaccaagtcttacctaactatcgaaggcacagcagagtacggcattgcagtacaaaaactgcttttcggctctgatgcggaaattgtaaacgaaaaacgcgctaaaacagctcaagctccaggtggtaccggtgcattacgtgttgctggtgagttcattaaacgccaacttggcgatgtaaaaatctggatcagcaaccctacttgggcaaaccacaacggcgtatttactgctgctggtatcgaaacggcacaatacagctactacaacgctgaaacaaaagacaaagacttcgatgcaatgctaaacgatctgcaatctgcatctgaaggtgacatcgtgcttctacacggctgctgccacaaccctacaggtatcgacccaactgctgaagaatgggaaacattggcgaaactagtcgcagagaagaaattgcttcctctatttgacttcgcataccaaggctttgctaaaggtgtggaagaggatgcggcgggtcttcgtacttttgctaagtacaacaaagaaatcctagtcgcgagctctttctcgaaaaactttggcctatacaacgaacgcgttggtgccttcacgttagtagcggaatcagaagaagtcgcaacaaccgcattctcgcaagttaaagccattattcgctctatctactctaacccaccagcgcacggcagcgcggtcgtgactcacattcttggcaatgccgaaatgcgtgcggaatgggaagctgaagtagcagaaatgcgtgaccgtatccaagagatgcgtgaactatttgtagcgacactaaaatcagaaggtgtggacgcagactttagcttcatcgaacgtcaaaatggtatgttctctttctctggcctatctaaagagcaagtaaaccgtctgaaagaagagttcggtatttacatcgtcggttcaggccgaatcagtgttgctggtatgacgaagtcaaatatgggtcctctatgtaaaggcattgcagcggttttataa

SEQ ID NO: 4941 - protein, 399 aa, Vibrio sp. Ex25
MKIMFEKVVAAPADPILGLTEEFKKDTRADKINLGVGIYKNEQGETPVLATVKKAEAALVETEKTKSYLTIEGTAEYGIAVQKLLFGSDAEIVNEKRAKTAQAPGGTGALRVAGEFIKRQLGDVKIWISNPTWANHNGVFTAAGIETAQYSYYNAETKDKDFDAMLNDLQSASEGDIVLLHGCCHNPTGIDPTAEEWETLAKLVAEKKLLPLFDFAYQGFAKGVEEDAAGLRTFAKYNKEILVASSFSKNFGLYNERVGAFTLVAESEEVATTAFSQVKAIIRSIYSNPPAHGSAVVTHILGNAEMRAEWEAEVAEMRDRIQEMRELFVATLKSEGVDADFSFIERQNGMFSFSGLSKEQVNRLKEEFGIYIVGSGRISVAGMTKSNMGPLCKGIAAVL

SEQ ID NO: 4942 - DNA, 1191 bp, Alteromonadales bacterium TW-7
  CDS (1)..(1191): transl_table=11
atgttctcagtattaaaaccattaccaaccgatcctattcttggccttatggcggcctataaaaaagatacaaaccctaataaaattgatttaggtgtgggtgtttataaagatgagcacggtaatacacctgtattaaacgcagtgaagaaagcagaagcatttcgcttagaaaatgaaacaagcaaatcttatattggcttagcaggtaacttagactactgtcaaaaaatggaacagctattacttggtgagcaccaagcattattagcaaatcgcgtgcgtacagcacaagcaccaggtggtacaggtgcgcttcgtgttgctgctgagtttattaagcgttgtaatacagatgcaactgtatgggttactacacctacttgggcaaaccatattagtttatttgaagctgcgggtttaaccgtaaaagaatacccgtactacgactacgaaaataaagacctgctgtttgatgagatgatcaatacccttaagcaagtaccaaagggtgatgtagtgctattacacgcatgctgtcataacccaagtggaatggatttaaacgaagctcagtggaacacagtagcagagcttgctaaagaagttggctttacaccattagtggatatagcttaccaaggctttggctcttcactagaagaagatgcgcgcggacttcgtattttagctgatgccgttgaagagttaattatttgctcatcgtgctctaaaaactttggtttatatcgtgagcgtatcggtgcatgttcattaattgcaaaagacagtgcgacagctgatgtgtcaaactcagtaatgttaagtgtggtacgtagcatttattcaatgcctccggcacatggtgctgatattgttaacactattttaagcagtacagagcttacgcaaatgtggcatgctgaacttgatgaaatgcgtacgcgtattaatggccttcgtagtttaattaaagaaagcttagcatcaaaagacatagcacaagacttttcatttattgaacgtcaacacggtatgttttcgttcttgggtattaataaagagcaaattgagcgattacaaaaagagtacggcatatacattgttggctcaagtcgtgtcaacgtagccggtgttagcaaagcaaaccttgattactttgcaaatgcagttgctgacgtttgtaaataa

SEQ ID NO: 4943 - protein, 396 aa, Alteromonadales bacterium TW-7
MFSVLKPLPTDPILGLMAAYKKDTNPNKIDLGVGVYKDEHGNTPVLNAVKKAEAFRLENETSKSYIGLAGNLDYCQKMEQLLLGEHQALLANRVRTAQAPGGTGALRVAAEFIKRCNTDATVWVTTPTWANHISLFEAAGLTVKEYPYYDYENKDLLFDEMINTLKQVPKGDVVLLHACCHNPSGMDLNEAQWNTVAELAKEVGFTPLVDIAYQGFGSSLEEDARGLRILADAVEELIICSSCSKNFGLYRERIGACSLIAKDSATADVSNSVMLSVVRSIYSMPPAHGADIVNTILSSTELTQMWHAELDEMRTRINGLRSLIKESLASKDIAQDFSFIERQHGMFSFLGINKEQIERLQKEYGIYIVGSSRVNVAGVSKANLDYFANAVADVCK

SEQ ID NO: 4944 - DNA, 1188 bp, marine gamma proteobacterium HTCC2143
  CDS (1)..(1188): transl_table=11
gtgttttcacagttaaagcaacagcctgcggaccccattttgggcttatcagttaaatttaaagccgataacaactccaataaaattgaccttggcgcgggtatttacaaagatgaggccggtcgcacgcctgttttagccagtgtgaaggcggctgagcagtttcgtactgacaatgaaacaagtaaagcctatttaggctcagcgggctcaatgttatttaatgaaaaaattcaggcgctgaatttgggtgagcataaagttattggtgacaatcgcattcgcaccatatctacccctggtggcactggagctttgcgtatagcggctgagtttattaaccgctgcacgccgggcgcgactatttgggtgagtaatccgacgtgggcaaaccatcagggtgtatttacagctgccgggttgaatgtgaaaacctacccgtattacgactatgacaataaatgtatagattttgctggaatggttgaagcgctaaaagaagtgtccaaagacgatgcggtgctgttacatgcctgttgccacaatccaagtggtatggatttaagcaacagtcaatggcgtgaaattgccgagctatcgaaaaaaattggcttcatgccagttgttgatatggcgtaccagggcttcggtcagggcttagatgaggatgcctacggtctgaggttaatggccgacaccgttgatgagatgattatttgcagttcatgttcgaaaaacttcggtttgtatcgggagcgtatcggtgcatgttcaattatcgggaaaagtgcggctgctgccgatatcattaattcagcgttgcttcccattgtccgagttaactactctatgccgccggcgcacggtgctgctatcgtcgaaacaatcttaagctccgaagaactgactagccagtggcatggtgagctgaatgaaatgcgcagtcgcatcggtgggatgcgccgtctgttggttgataaattagtggctaagggtgttactcgtgacttcagcttcatcacccaacaaaacggcatgttctcatttctgggtatcgataaagaccaagtacagcgtttacaggacgagtttagtatctatattgttggctccagccgcataagcgttgccgctgtgtcctatgacaatgttgattatttaacggagtctattgccaaagtactttag

SEQ ID NO: 4945 - protein, 395 aa, marine gamma proteobacterium HTCC2143
MFSQLKQQPADPILGLSVKFKADNNSNKIDLGAGIYKDEAGRTPVLASVKAAEQFRTDNETSKAYLGSAGSMLFNEKIQALNLGEHKVIGDNRIRTISTPGGTGALRIAAEFINRCTPGATIWVSNPTWANHQGVFTAAGLNVKTYPYYDYDNKCIDFAGMVEALKEVSKDDAVLLHACCHNPSGMDLSNSQWREIAELSKKIGFMPVVDMAYQGFGQGLDEDAYGLRLMADTVDEMIICSSCSKNFGLYRERIGACSIIGKSAAAADIINSALLPIVRVNYSMPPAHGAAIVETILSSEELTSQWHGELNEMRSRIGGMRRLLVDKLVAKGVTRDFSFITQQNGMFSFLGIDKDQVQRLQDEFSIYIVGSSRISVAAVSYDNVDYLTESIAKVL

SEQ ID NO: 4946 - DNA, 1188 bp, marine gamma proteobacterium HTCC2080
  CDS (1)..(1188): transl_table=11
atgtttgaagaattacctatattgcctccagattccattcttggcctggcggctgaatgccgagctgacccgaatcccgataaggtcgatctgacgattggcatctatatggacgagtcaggcaattgccccgtctttaatgctgttcgattggctcaacatcaactcgtagatgaggagcagaccaagtcctacatacccccccagggcgacccaaattttataaagggcctggtcgagcttgttgtcggggccgatgctctggccgcccgagctggatgcgtcggcgcggttcaggctcctggtggttgtggcgccgttcgcctgggagcggaagtgctcaaggcctcgggcactcagggtaaagtttgggtgagcgatccaacgtggccggtgcacattccgttgattacgagtgctgggctggagctgagccaatatcgatactacgatccagagactcatggcgtggatttttctgccatggcagaagatttggctgctgcaggatcgaacgacattgttttgcttcatggttgttgtcacaacccaagtggcgctgatttgacgccggagcaatggcgcgaaattgccagcatggcagcgaagcagggtttcacgccgatggtcgatctagcctatcaaggatttggggaaggtcttgagacggatgtttatgggctgagaacccttattgagcaggttcctgaggtggttattgcagcttcactgtctaaaaacatgggtctttatcgtgagcgcacggggttggcgatttttgtgggccccgattcccgaaccgcagaggcaacggtgagtcaagccaaagccgccgccaggcgcatttactcaatgcccccagcccatggggcgctcctggcgggacgcgttttgggcgaccctatcttgcgcgctgattgggaggctgagttgaccgcaatgtgtgctcgcatcaacggcctgcgttctgagtttcaacgtcggcttgaggaggcgacgggccgagattttggtttcatcgcaaaagaaaaagggatgttttctttcttgggcttaactgaggatcaagctcgtagcgttagatccgagcggggcctttacatgttgaactcatcacgaattaacatcgccagtttgaacgctcaaaacatggatcgtgtggtcgcggcggtggcttcggtgctttaa

SEQ ID NO: 4947 - protein, 395 aa, marine gamma proteobacterium HTCC2080
MFEELPILPPDSILGLAAECRADPNPDKVDLTIGIYMDESGNCPVFNAVRLAQHQLVDEEQTKSYIPPQGDPNFIKGLVELVVGADALAARAGCVGAVQAPGGCGAVRLGAEVLKASGTQGKVWVSDPTWPVHIPLITSAGLELSQYRYYDPETHGVDFSAMAEDLAAAGSNDIVLLHGCCHNPSGADLTPEQWREIASMAAKQGFTPMVDLAYQGFGEGLETDVYGLRTLIEQVPEVVIAASLSKNMGLYRERTGLAIFVGPDSRTAEATVSQAKAAARRIYSMPPAHGALLAGRVLGDPILRADWEAELTAMCARINGLRSEFQRRLEEATGRDFGFIAKEKGMFSFLGLTEDQARSVRSERGLYMLNSSRINIASLNAQNMDRVVAAVASVL

SEQ ID NO: 4948 - DNA, 1197 bp, Pseudomonas putida GB-1
  CDS (1)..(1197): transl_table=11
gtgttcaaacatgtcgatgcctatgccggcgacccgatcctctcgttgatggaaaccttcaaggccgacccgcgcgccgacaaggtcaacctgagtattggcctgtactacgatgaggccggcgtggtgccgcaactggcggctgtggatgcggtggaaaaacgcatggccggccaggaccacgaagcctccctgtacctgccgatggaaggcctggccagctaccgccaggcgatccaggcgctgctgttcggtgctgatcaccccgccgtgacgggcggtcgcgtggctaccgtgcagaccgtgggcggctccggtgcccttaaagttggtgccgacttcctcaagcgctacttcccgcagtccgaagtctgggtcagcaacccgacctgggacaaccaccgcgccatcttcgaaggcgcaggcttcaaggtgcactcctacccgtacttcgaccaggccacccgtggcgtggacttcgacggcatgctggccaccctgcagaccctgccggccaacagcgtggtcctgctgcacccgtgctgccacaaccctaccggcgccgacctggaacagcaccagtggcagcaagtggtcgaagtggtcaaggcgcgccagctgatcccgttcctcgacatcgcctaccaaggcttcgccgaaggcctggtggaagacgcctacgccatccgcgaaatggcccgtgccggcgtgccgtgcctggtcagcaactcgttctcgaaaatcttctcgctgtacggcgagcgggtaggcggcctgtcggtggtgtgcgatgacgacgccactgcccagagcgtacttggccagttgaaggccaccgtgcgccgcaactactccagcccgcccaacttcggcgcccagctggtggctggcgtgctcagcgatgcaggcctgaatgcccagtgggccgaagaagtcgaagtgatgcgcaagcggatcctcgacatgcgccaggcgctggtcgatgccctggccgtgctgctgccaggccaggacttccagttcttcctgcgccagcgcggcatgttcagctacaccggcttcagcgtcgagcaggtgcgtcgcctgcgtgacgagttcggtgtgtacctgatcgacagcggccgcgtgtgcatgtccggcctgcgcccggccaacctgcagcgggttgccgaagcgttcgccgccgttcagaagtaa

SEQ ID NO: 4949 - protein, 398 aa, Pseudomonas putida GB-1
MFKHVDAYAGDPILSLMETFKADPRADKVNLSIGLYYDEAGVVPQLAAVDAVEKRMAGQDHEASLYLPMEGLASYRQAIQALLFGADHPAVTGGRVATVQTVGGSGALKVGADFLKRYFPQSEVWVSNPTWDNHRAIFEGAGFKVHSYPYFDQATRGVDFDGMLATLQTLPANSVVLLHPCCHNPTGADLEQHQWQQVVEVVKARQLIPFLDIAYQGFAEGLVEDAYAIREMARAGVPCLVSNSFSKIFSLYGERVGGLSVVCDDDATAQSVLGQLKATVRRNYSSPPNFGAQLVAGVLSDAGLNAQWAEEVEVMRKRILDMRQALVDALAVLLPGQDFQFFLRQRGMFSYTGFSVEQVRRLRDEFGVYLIDSGRVCMSGLRPANLQRVAEAFAAVQK

SEQ ID NO: 4950 - DNA, 1197 bp, Pseudomonas putida GB-1
  CDS (1)..(1197): transl_table=11
atgagcctgttttccgctgtcgagctggcaccccgcgaccctatcctgggcctcaacgaagcattcaacgccgacccacgtaccgacaaggtcaacctgggcgtgggcgtgtactgcaatgaggaaggccgcatcccgctgctgcgcgccgtgatcgaagccgagacccagcgtgccgcacagcacgcctcgcgcggctacctgccgatcgacggcatcgccacttatgaccaggccgtgcaaaagctgatcttcggcgccgagtcgccactgctggccgctggccgtgtggtcaccgtacaggccgtcggtggtaccggcgcactgaaaatcggtgccgacttcctcaagcgcatctcgcctgacgccgtggtcgccatcagcgacccaagctgggaaaaccatcgcgcgctgttcgagtcggccggtttcccggtgcagacctatcgctactacgatgcgccgaccaacgatgtgaaccgcggcggcatgctggaagacctcaacgccctgccatcgggctcgatcgtcgtgctgcacgcctgctgccacaacccgaccggcgtcgacctgaacctggacgactggaaaaatgtcctggaggtggtcaaggccaagggccacgtgccgttcctcgacatggcctaccagggctttggtgatggcatcgccgaagacgccttcgccgttcgcctgttcgccgagtcgggcctggagttctttgtttccagctcgttctccaaatcgttctcgctgtacggcgagcgcgtcggcgcactgtcggtcgtcaccgcctccaaggacgagagcactcgcgtgctgtcgcaggtcaagcgcgtgatccgcaccacttactccaacccaccaacccacggtgcaaccatcgtagccaccgtgctgaacagcgccgaactgcgccagatgtgggaaaccgaactgggcgaaatgcgccagcgcatccacggcatgcgcaagcagatggtttcgctgctggccgaatatggcgccaatcgcgacttcagcttcgttggccgccaggtcggcatgttctcctactcgggcctgaccgttgatcaggtggcccgcctgaagaacgatttcggcatctacgccctggacaccggccgtatcgccgtggccgcgctgaaccagagcaacatccatgtggtcaccaaggctatcgtggaagtgctgtaa

SEQ ID NO: 4951 - protein, 398 aa, Pseudomonas putida GB-1
MSLFSAVELAPRDPILGLNEAFNADPRTDKVNLGVGVYCNEEGRIPLLRAVIEAETQRAAQHASRGYLPIDGIATYDQAVQKLIFGAESPLLAAGRVVTVQAVGGTGALKIGADFLKRISPDAVVAISDPSWENHRALFESAGFPVQTYRYYDAPTNDVNRGGMLEDLNALPSGSIVVLHACCHNPTGVDLNLDDWKNVLEVVKAKGHVPFLDMAYQGFGDGIAEDAFAVRLFAESGLEFFVSSSFSKSFSLYGERVGALSVVTASKDESTRVLSQVKRVIRTTYSNPPTHGATIVATVLNSAELRQMWETELGEMRQRIHGMRKQMVSLLAEYGANRDFSFVGRQVGMFSYSGLTVDQVARLKNDFGIYALDTGRIAVAALNQSNIHVVTKAIVEVL

SEQ ID NO: 4952 - DNA, 1690 bp, Glycine max
  CDS (152)..(1522)
tcattcttcttacataataggggaaggagaagaaaaaaaatgaaataagaaaaactcaactttgtaattcgtggagggaatacttttccattacgcacgcactttaattacagacgagaaaattataattaatagtaatacagacagcagcatgcgcccaccggttattctcaaaactaccacctctcttttggattcttcttcttcttcaccaccctgtgatcgcagactcaacactctcgctagacacttccttccgcaaatggcttctcacgacagcatctccgcttctccaacctccgcttctgattccgtcttcaatcacctcgttcgtgctcccgaagatcctatcctcggggtaactgtcgcttataacaaagatccaagtccagttaagctcaacttgggagttggtgcttaccgaactgaggaaggaaaacctcttgttttgaatgtagtgaggcgagttgaacagcaactcataaatgacgtgtcacgcaacaaggaatatattccgatcgttgggcttgctgattttaataaattgagtgctaagcttatttttggggctgacagccctgctattcaagacaacagggttaccactgttcaatgcttgtctggaactggttctttaagagttgggggtgaatttttggctaaacactatcaccaacggactatatacttgccaacaccaacttggggcaatcacccgaaggttttcaacttagcaggcttgtctgtcaaaacataccgctactatgctccagcaacacgaggacttgactttcaaggacttctggaagaccttggttctgctccatctggatctattgttttgctacatgcatgcgcacataaccccactggtgtggatccaacccttgagcaatgggagcagattaggcagctaataagatcaaaagctttgttacctttctttgacagtgcttatcagggttttgctagtggaagtctagatgcagatgcccaacctgttcgtttgtttgttgctgatggaggcgaattgctggtagcacaaagctatgcaaagaatctgggtctttatggggaacgtgttggcgccttaagcattgtctgcaagtcagctgatgttgcaagcagggttgagagccagctgaagctagtgattaggcccatgtactcaagtcctcccattcatggtgcatccattgtggctgccattctcaaggaccggaatttgttcaatgactggactattgagttgaaggcaatggctgatcgcatcatcagtatgcgccaagaacttttcgatgctttatgttccagaggcacacctggcgattggagtcacattatcaaacagattggaatgtttactttcactggattgaatgcggaacaagtttccttcatgactaaagagttccatatatacatgacatctgatgggaggattagcatggctggtctgagttccaaaactgtcccacttctggcggatgcgatacatgcagctgtaacccgagttgtctaaaacatgttgacaacagttttcaacatgctccctagtccctataggagaacttccattatttttgtttaataattgtcaacatcaacaatgaaaccttttatttgatgtgagatttttaaaggaaacttttctgcctaccgggctccaaaaaaaaaaaaaaaaaaaaaa

SEQ ID NO: 4953 - protein, 456 aa, Glycine max
MRPPVILKTTTSLLDSSSSSPPCDRRLNTLARHFLPQMASHDSISASPTSASDSVFNHLVRAPEDPILGVTVAYNKDPSPVKLNLGVGAYRTEEGKPLVLNVVRRVEQQLINDVSRNKEYIPIVGLADFNKLSAKLIFGADSPAIQDNRVTTVQCLSGTGSLRVGGEFLAKHYHQRTIYLPTPTWGNHPKVFNLAGLSVKTYRYYAPATRGLDFQGLLEDLGSAPSGSIVLLHACAHNPTGVDPTLEQWEQIRQLIRSKALLPFFDSAYQGFASGSLDADAQPVRLFVADGGELLVAQSYAKNLGLYGERVGALSIVCKSADVASRVESQLKLVIRPMYSSPPIHGASIVAAILKDRNLFNDWTIELKAMADRIISMRQELFDALCSRGTPGDWSHIIKQIGMFTFTGLNAEQVSFMTKEFHIYMTSDGRISMAGLSSKTVPLLADAIHAAVTRVV

SEQ ID NO: 4954 - DNA, 1194 bp, Klebsiella pneumoniae
  CDS (1)..(1194): transl_table=11
atgtttcaaaaagttgacgcctacgccggcgaccctattctttctctgatggaacgcttcaaagaagacccgcgaagcgacaaagtcaacctgagtatcgggctgtactacaacgatgacggcattatcccgcagctgcaggcggtggcggaagcggaagcacgcctgaacgccgagccgcatggcgcctccctgtatctgccaatggaagggtttagcggctaccgtcaggcgattgcgccgctgctgtttggcgcagaacataccgcgcttaagcaaaatcgcattgcctccattcagacggtcggcggttccggcgcgttgaaggtcggggccgacttcctcaaacgttactttcctgagtctcatgtctgggtcagcgatccgacctgggaaaaccacatcgccatttttgaaggggctggcttcgaagtaagtacttacccctggtttgataaagccaccaacggcgtgcgctttgagaacctgctggcgatgctgcaaacgctgccggcccgcgatattgtgctgctgcacccttgctgccacaacccgaccggcgccgacctgacgccagcccagtgggaccgcgtggttgaggtattgaaagcgcgtcagctgatccccttcctcgacatcgcctaccagggctttggcggggggctggaagaggatgcctacgccattcgcgccatcgccagcgccgggatgccgatgttggtcagcaattcgttctccaaaattttctcgctgtacggggagcgcgtcggcggtctgtccgtggtctgtgaagacagcgaaaccgcgggccgcgtgctgggtcagctgaaggccaccgtgcgccgcaactactccagcccgccaagctttggcgcgcaggtggtggcgacggtgctgaacgatgcagctctgaaagccacctggcaggcggaggtggacgccatgcgcgcgcacatcctgaccatgcgccaggcgctggtcgacgcgctgcagcaggttgccccgggcagcaaagtggattacctgctcaagcagcgcgggatgttcagctataccggatttagcgcggcgcaggtggatcgtctgcgcgatgagtttggcgtctacctgattgccagcggacgcatgcgcgtggcggggttaaactcacgtaatgttcagcaggtagcgaaggcgtttgttgcggtgatgtaa

SEQ ID NO: 4955 - protein, 397 aa, Klebsiella pneumoniae
MFQKVDAYAGDPILSLMERFKEDPRSDKVNLSIGLYYNDDGIIPQLQAVAEAEARLNAEPHGASLYLPMEGFSGYRQAIAPLLFGAEHTALKQNRIASIQTVGGSGALKVGADFLKRYFPESHVWVSDPTWENHIAIFEGAGFEVSTYPWFDKATNGVRFENLLAMLQTLPARDIVLLHPCCHNPTGADLTPAQWDRVVEVLKARQLIPFLDIAYQGFGGGLEEDAYAIRAIASAGMPMLVSNSFSKIFSLYGERVGGLSVVCEDSETAGRVLGQLKATVRRNYSSPPSFGAQVVATVLNDAALKATWQAEVDAMRAHILTMRQALVDALQQVAPGSKVDYLLKQRGMFSYTGFSAAQVDRLRDEFGVYLIASGRMRVAGLNSRNVQQVAKAFVAVM

SEQ ID NO: 4956 - DNA, 2112 bp, Ajellomyces capsulata
  CDS (331)..(1614)
ctggcaaaatttggttaaaggagcaacacatccgcccccgggaaaggaaaaagggtacaaagtttattattattattattttttaaaggcaagataatatcctaaatgcttctcccagttcttggacttcttgattcagatttccaggggagaagattgagacaactgctggcaaacttgcttgaactccccatcctcggaatcaatctttctaaatctgtaagggcaacagtgtggaattttctggttgttatttaaacagaattaaagaaagaaaatatattaagattacaattataatcgaatcacataccaaatcaacatctgaacatggctcctgcaccgcaagaaagcctgttcagcaccttggaaatccctcaatatgatgaggttttcggactcatggctcaatttgtggctgacacttcgccgcagaaggtcagtcttggagccggagtgtacagagacaatgaggccaagagctggaggttaaacatcgtcgaaaaacaactgtgtgaagatccgacgtttgaccatgaatatcttcctattgaagggtaccagccattcgtggatgcagcgagggatctggtctttgggaacagctgccccattgccaaaggccgcattgccagcttgcaaacggtttcgggaacaggcgcaaaccatctcggtgctcgtttcctcaaagaacacctccctcgtctgatctcaccatcctcatcgtccgctactccaacccgaaaaatctggctctcagacccaacctgggccaaccaccatttgatctgggacctggtcgcctcaagttccaccggaagccccatcaagaccgttctctacccatactaccacgcccagacccgctccttcgatttcgacggcatgatccgcacactggaagctaacgcgcagcgcggggatgtcatccttctgcatgcctgcgcgcacaaccccacgggtcttgaccccaccagggcccagtgggaggccatcgcctctctgtgtcagaggaagggaatattcccattcttcgactctgcgtatcagggtttcgcgtcgggggatttggataatgacgcctgggccatgcgagagtttgtcgcgcgtgggatggagatgtgtgtggcacagagctttagcaagaacctgggcctctatgggcagcgggttggggcttttcatctcgtgtgccacaccgaggattcggccagaagggctaggttccagctcattgagttgcaaaggggggagatttcgatgccgcctgcttatggttcaaaaatcgcagctgcagtcctcagagaccccgccaacgttatcgaatggaaacaagacctgtctatcatgagcagcaggataaaatccatgcgacgcgcgctgtacgatgagctacgccgtctaggcacgcccggcaattgggaccatatcatcaatcagatcggcatgttttcatacaccggcctgaccaagaagcagatcaagaccctgagggaagactatcatatctatatgcttgagtcggggagagcgtcgatttctggactgaccaccaataacgtgaagtacgtcgccggcgcctttgacgcggtggtgagagacatgccgtactaaatcgccgcgcatgcgtcaccaaactccagaacattactggcccaattccagcctgccttttgtttcggcagagacgcagcttccaaggctgcaacgcttgtctccaaacagggaataacatccgtaatccctaccttatctcaacgattggcgttttatcggttaagtgcggcaccggcctcatcggcatcatcgatatcaaacaaacccgcccgtttgggttagggggtgtggggggggttggctgacttctcgatcatttcgatttattcattcattacgtacttggataactaactgtatgtagaatagttagatagagagtagccttcctactggctccgcggtttggggatgcggtttgtttttctttcctattcaaccctcttcctctctcttttatttttttactttattttatatttttgatacaatggcggattaatgtctcctctgatataggtatatacatatacatattaaacagcgtgtatacag

SEQ ID NO: 4957 - protein, 427 aa, Ajellomyces capsulata
MAPAPQESLFSTLEIPQYDEVFGLMAQFVADTSPQKVSLGAGVYRDNEAKSWRLNIVEKQLCEDPTFDHEYLPIEGYQPFVDAARDLVFGNSCPIAKGRIASLQTVSGTGANHLGARFLKEHLPRLISPSSSSATPTRKIWLSDPTWANHHLIWDLVASSSTGSPIKTVLYPYYHAQTRSFDFDGMIRTLEANAQRGDVILLHACAHNPTGLDPTRAQWEAIASLCQRKGIFPFFDSAYQGFASGDLDNDAWAMREFVARGMEMCVAQSFSKNLGLYGQRVGAFHLVCHTEDSARRARFQLIELQRGEISMPPAYGSKIAAAVLRDPANVIEWKQDLSIMSSRIKSMRRALYDELRRLGTPGNWDHIINQIGMFSYTGLTKKQIKTLREDYHIYMLESGRASISGLTTNNVKYVAGAFDAVVRDMPY

SEQ ID NO: 4958 - DNA, 1191 bp, Escherichia coli
  CDS (1)..(1191): transl_table=11
atgtttgagaacattaccgccgctcctgccgacccgattctgggcctggccgatctgtttcgtgccgatgaacgtcccggcaaaattaacctcgggattggtgtctataaagatgagacgggcaaaaccccggtactgaccagcgtgaaaaaggctgaacagtatctgctcgaaaatgaaaccaccaaaaattacctcggcattgacggcatccctgaatttggtcgctgcactcaggaactgctgtttggtaaaggtagcgccctgatcaatgacaaacgtgctcgcacggcacagactccggggggcactggcgcactacgcgtggctgccgatttcctggcaaaaaataccagcgttaagcgtgtgtgggtgagcaacccaagctggccgacccataagagcgtctttaactctgcaggtctggaagttcgtgaatacgcttattatgatgcggaaaatcacactcttgacttcgatgcactgattaacagcctgaatgaagctcaggctggcgacgtagtgctgttccatggctgctgccataacccaaccggtatcgaccctacgctggaacaatggcaaacactggcacaactctccgttgagaaaggctggttaccgctgtttgacttcgcttaccagggttttgcccgtggtctggaagaagatgctgaaggactgcgcgctttcgcggctatgcataaagagctgattgttgccagttcctactctaaaaactttggcctgtacaacgagcgtgttggcgcttgtactctggttgctgccgacagtgaaaccgttgattgcgcattcggccaaatgaaagcggcgattcgcgctaactactctaacccaccagcacacggcgcttctgttgttgccaccatcctgagcaacgatgcgttacgtgcgatttgggaacaagagctgactgatatgcgccagcgtattcagcgtatgcgtcagttgttcgtcaatacgctgcaggaaaaaggcgcaaaccgcgacttcagctttatcatcaaacagaacggcatgttctccttcagtggcctgacaaaagaacaagtgctgcgtctgcgcgaagagtttggcgtatatgcggttgcttctggtcgcgtaaatgtggccgggatgacaccagataacatggctccgctgtgcgaagcgattgtggcagtgctgtaa

SEQ ID NO: 4959 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDCAFGQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 4960 - DNA, 1191 bp, Escherichia coli
  CDS (1)..(1191): transl_table=11
atgtttgagaacattaccgccgctcctgccgacccgattctgggcctggccgatctgtttcgtgccgatgaacgtcccggcaaaattaacctcgggattggtgtctataaagatgagacgggcaaaaccccggtactgaccagcgtgaaaaaggctgaacagtatctgctcgaaaatgaaaccaccaaaaattacctcggcattgacggcatccctgaatttggtcgctgcactcaggaactgctgtttggtaaaggtagcgccctgatcaatgacaaacgtgctcgcacggcacagactccggggggcactggcgcactacgcgtggctgccgatttcctggcaaaaaataccagcgttaagcgtgtgtgggtgagcaacccaagctggccgacccataagagcgtctttaactctgcaggtctggaagttcgtgaatacgcttattatgatgcggaaaatcacactcttgacttcgatgcactgattaacagcctgaatgaagctcaggctggcgacgtagtgctgttccatggctgctgccataacccaaccggtatcgaccctacgctggaacaatggcaaacactggcacaactctccgttgagaaaggctggttaccgctgtttgacttcgcttaccagggttttgcccgtggtctggaagaagatgctgaaggactgcgcgctttcgcggctatgcataaagagctgattgttgccagttcctactctaaaaactttggcctgtacaacgagcgtgttggcgcttgtactctggttgctgccgacagtgaaaccgttgatcgagcattcagccaaatgaaagcggcgattcgcgctaactactctaacccaccagcacacggcgcttctgttgttgccaccatcctgagcaacgatgcgttacgtgcgatttgggaacaagagctgactgatatgcgccagcgtattcagcgtatgcgtcagttgttcgtcaatacgctgcaggaaaaaggcgcaaaccgcgacttcagctttatcatcaaacagaacggcatgttctccttcagtggcctgacaaaagaacaagtgctgcgtctgcgcgaagagtttggcgtatatgcggttgcttctggtcgcgtaaatgtggccgggatgacaccagataacatggctccgctgtgcgaagcgattgtggcagtgctgtaa

SEQ ID NO: 4961 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 4962 - DNA, 1191 bp, Escherichia coli
  CDS (1)..(1191): transl_table=11
atgtttgagaacattaccgccgctcctgccgacccgattctgggcctggccgatctgtttcgtgccgatgaacgtcccggcaaaattaacctcgggattggtgtctataaagatgagacgggcaaaaccccggtactgaccagcgtgaaaaaggctgaacagtatctgctcgaaaatgaaaccaccaaaaattacctcggcattgacggcatccctgaatttggtcgctgcactcaggaactgctgtttggtaaaggtagcgccctgatcaatgacaaacgtgctcgcacggcacagactccggggggcactggcgcactacgcgtggctgccgatttcctggcaaaaaataccagcgttaagcgtgtgtgggtgagcaacccaagctggccgacccataagagcgtctttaactctgcaggtctggaagttcgtgaatacgcttattatgatgcggaaaatcacactcttgacttcgatgcactgattaacagcctgaatgaagctcaggctggcgacgtagtgctgttccatggctgctgccataacccaaccggtatcgaccctacgctggaacaatggcaaacactggcacaactctccgttgagaaaggctggttaccgctgtttgacttcgcttaccagggttttgcccgtggtctggaagaagatgctgaaggactgcgcgctttcgcggctatgcataaagagctgattgttgccagttcctactctaaaaactttggcctgtacaacgagcgtgttggcgcttgtactctggttgctgccgacagtgaaaccgttgatcgagcattcaaacgaatgaaagcggcgattcgcgctaactactctaacccaccagcacacggcgcttctgttgttgccaccatcctgagcaacgatgcgttacgtgcgatttgggaacaagagctgactgatatgcgccagcgtattcagcgtatgcgtcagttgttcgtcaatacgctgcaggaaaaaggcgcaaaccgcgacttcagctttatcatcaaacagaacggcatgttctccttcagtggcctgacaaaagaacaagtgctgcgtctgcgcgaagagtttggcgtatatgcggttgcttctggtcgcgtaaatgtggccgggatgacaccagataacatggctccgctgtgcgaagcgattgtggcagtgctgtaa

SEQ ID NO: 4963 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFKRMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 4964 - DNA, 1191 bp, Escherichia coli
  CDS (1)..(1191): transl_table=11
atgtttgagaacatgaccgccgctcctgccgacccgattctgggcctggccgatctgtttcgtgccgatgaacgtcccggcaaaattaacctcgggattggtgtctataaagatgagacgggcaaaaccccggtactgaccagcgtgaaaaaggctgaacagtatctgctcgaaaatgaaaccaccaaaaattacctcggcattgacggcatccctgaatttggtcgctgcactcaggaactgctgtttggtaaaggtagcgccctgatcaatgacaaacgtgctcgcacggcacagactccggggggcactggcgcactacgcgtggctgccgatttcctggcaaaaaataccagcgttaagcgtgtgtgggtgagcaacccaagctggccgacccataagagcgtctttaactctgcaggtctggaagttcgtgaatacgcttattatgatgcggaaaatcacactcttgacttcgatgcactgattaacagcctgaatgaagctcaggctggcgacgtagtgctgttccatggctgctgccataacccaaccggtatcgaccctacgctggaacaatggcaaacactggcacaactctccgttgagaaaggctggttaccgctgtttgacttcgcttaccagggttttgcccgtggtctggaagaagatgctgaaggactgcgcgctttcgcggctatgcataaagagctgattgttgccagttcctactctaaaaactttggcctgtacaacgagcgtgttggcgcttgtactctggttgctgccgacagtgaaaccgttgatcgcgcattcagccaaatgaaagcggcgattcgcgctaactactctaacccaccagcacacggcgcttctgttgttgccaccatcctgagcaacgatgcgttacgtgcgatttgggaacaagagctgactgatatgcgccagcgtattcagcgtatgcgtcagttgttcgtcaatacgctgcaggaaaaaggcgcaaaccgcgacttcagctttatcatcaaacagaacggcatgttctccttcagtggcctgacaaaagaacaagtgctgcgtctgcgcgaagagtttggcgtatatgcggttgcttctggtcgcgtaaatgtggccgggatgacaccagataacatggctccgctgtgcgaagcgattgtggcagtgctgtaa

SEQ ID NO: 4965 - protein, 396 aa, Escherichia coli
MFENMTAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 4966 - DNA, 1191 bp, Escherichia coli
  CDS (1)..(1191): transl_table=11
atgtttgagaacattaccgccgctcctgccgacccgattctgggcctggccgatctgtttcgtgccgatgaacgtcccggcaaaattaacctcgggattggtgtctataaagatgagacgggcaaaaccccggtactgaccagcgtgaaaaaggctgaacagtatctgctcgaaaatgaaaccaccaaaaattacctcggcattgacggcatccctgaatttggtcgctgcactcaggaactgctgtttggtaaaggtagcgccctgatcaatgacaaacgtgctcgcacggcacagactccggggggcactggcgcactacgcgtggctgccgatttcctggcaaaaaataccagcgttaagcgtgtgtgggtgagcaacccaagctggccgacccataagagcgtctttaactctgcaggtctggaagttcgtgaatacgcttattatgatgcggaaaatcacactcttgacttcgatgcactgattaacagcctgaatgaagctcaggctggcgacgtagtgctgttccatggctgctgccataacccaaccggtatcgaccctacgctggaacaatggcaaacactggcacaactctccgttgagaaaggctggttaccgctgtttgacttcgcttaccagggttttgcccgtggtctggaagaagatgctgaaggactgcgcgctttcgcggctatgcataaagagctgattgttgccagttcctactctaaaaactttggcctgtacaacgagcgtgttggcgcttgtactctggttgctgccgacagtgaaaccgttgattgcgcattcaatctgatgaaagcggcgattcgcgctaactactctaacccaccagcacacggcgcttctgttgttgccaccatcctgagcaacgatgcgttacgtgcgatttgggaacaagagctgactgatatgcgccagcgtattcagcgtatgcgtcagttgttcgtcaatacgctgcaggaaaaaggcgcaaaccgcgacttcagctttatcatcaaacagaacggcatgttctccttcagtggcctgacaaaagaacaagtgctgcgtctgcgcgaagagtttggcgtatatgcggttgcttctggtcgcgtaaatgtggccgggatgacaccagataacatggctccgctgtgcgaagcgattgtggcagtgctgtaa

SEQ ID NO: 4967 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDCAFNLMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 4968 - DNA, 1191 bp, Escherichia coli
  CDS (1)..(1191): transl_table=11
atgtttgagaacattaccgccgctcctgccgacccgattctgggcctggccgatctgtttcgtgccgatgaacgtcccggcaaaattaacctcgggattggtgtctataaagatgagacgggcaaaaccccggtactgaccagcgtgaaaaaggctgaacagtatctgctcgaaaatgaaaccaccaaaaattacctcggcattgacggcatccctgaatttggtcgctgcactcaggaactgctgtttggtaaaggtagcgccctgatcaatgacaaacgtgctcgcacggcacagactccggggggcactggcgcactacgcgtggctgccgatttcctggcaaaaaataccagcgttaagcgtgtgtgggtgagcaacccaagctggccgacccataagagcgtctttaactctgcaggtctggaagttcgtgaatacgcttattatgatgcggaaaatcacactcttgacttcgatgcactgattaacagcctgaatgaagctcaggctggcgacgtagtgctgttccatggctgctgccataacccaaccggtatcgaccctacgctggaacaatggcaaacactggcacaactctccgttgagaaaggctggttaccgctgtttgacttcgcttaccagggttttgcccgtggtctggaagaagatgctgaaggactgcgcgctttcgcggctatgcataaagagctgattgttgccagttcctactctaaaaactttggcctgtacaacgagcgtgttggcgcttgtactctggttgctgccgacagtgaaaccgttgatcgtgcattcgggataatgaaagcggcgattcgcgctaactactctaacccaccagcacacggcgcttctgttgttgccaccatcctgagcaacgatgcgttacgtgcgatttgggaacaagagctgactgatatgcgccagcgtattcagcgtatgcgtcagttgttcgtcaatacgctgcaggaaaaaggcgcaaaccgcgacttcagctttatcatcaaacagaacggcatgttctccttcagtggcctgacaaaagaacaagtgctgcgtctgcgcgaagagtttggcgtatatgcggttgcttctggtcgcgtaaatgtggccgggatgacaccagataacatggctccgctgtgcgaagcgattgtggcagtgctgtaa

SEQ ID NO: 4969 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFGIMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 4970 - DNA, 1191 bp, Escherichia coli
  CDS (1)..(1191): transl_table=11
atgtttgagaacattaccgccgctcctgccgacccgattctgggcctggccgatctgtttcgtgccgatgaacgtcccggcaaaattaacctcgggattggtgtctataaagatgagacgggcaaaaccccggtactgaccagcgtgaaaaaggctgaacagtatctgctcgaaaatgaaaccaccaaaaattacctcggcattgacggcatccctgaatttggtcgctgcactcaggaactgctgtttggtaaaggtagcgccctgatcaatgacaaacgtgctcgcacggcacagactccggggggcactggcgcactacgcgtggctgccgatttcctggcaaaaaataccagcgttaagcgtgtgtgggtgagcaacccaagctggccgacccataagagcgtctttaactctgcaggtctggaagttcgtgaatacgcttattatgatgcggaaaatcacactcttgacttcgatgcactgattaacagcctgaatgaagctcaggctggcgacgtagtgctgttccatggctgctgccataacccaaccggtatcgaccctacgctggaacaatggcaaacactggcacaactctccgttgagaaaggctggttaccgctgtttgacttcgcttaccagggttttgcccgtggtctggaagaagatgctgaaggactgcgcgctttcgcggctatgcataaagagctgattgttgccagttcctactctaaaaactttggcctgtacaacgagcgtgttggcgcttgtactctggttgctgccgacagtgaaaccgttgatgcagcattctgctggatgaaagcggcgattcgcgctaactactctaacccaccagcacacggcgcttctgttgttgccaccatcctgagcaacgatgcgttacgtgcgatttgggaacaagagctgactgatatgcgccagcgtattcagcgtatgcgtcagttgttcgtcaatacgctgcaggaaaaaggcgcaaaccgcgacttcagctttatcatcaaacagaacggcatgttctccttcagtggcctgacaaaagaacaagtgctgcgtctgcgcgaagagtttggcgtatatgcggttgcttctggtcgcgtaaatgtggccgggatgacaccagataacatggctccgctgtgcgaagcgattgtggcagtgctgtaa

SEQ ID NO: 4971 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDAAFCWMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 4972 - DNA, 1755 bp, Glycine max
  CDS (73)..(1464)
gtttccttcatcttcttcttcttcttctatctctctacaacacacttttttaagtgattcgttcgcagaaacatggcttcttcgtttctatccgcagcttcgcacgctgtctcaccctcttgttctctgtccaccacgcacaagggaaagcccatgcttggaggcaacactttgagatttcacaaaggacccaattccttctctagttcaaggtctagaggtcggatctctatggctgttgcagttaatgtatctcggtttgaaggcatacctatggctcctcctgatccaattctcggagtttccgaggcgtttaaggcagacaatagtgatgtcaagctcaatcttggagttggggcatacagaacagaagaactacagccatatgtgcttaatgttgttaagaaggcagagaatcttatgctggagagaggggataacaaagagtatctcccaattgagggtttggcagcatttaataaggcaactgcagagttgttactcggagcagacaacccagcaatcaaacagcaaagagttgccactgtccaaggtctttctggaactggttctctgcgactaggtgcagctctgatagagcgatattttcctggggcaaaagttttgatatcagctcctacctggggtaatcacaagaatattttcaatgatgctagtgtcccatggtctgagtaccgatattatgatcccaagacagttgggttggattttgagggcatgattgaagatataaagtcagctccggaaggatcttttatcttacttcatggatgtgctcataatcctactggtattgatccaacacctgaacagtgggaaaaaatagctgatttaattgaagaaaagaaccacattcccttttttgatgttgcttaccaggggtttgctagtggaagccttgatgaagatgcagcttctgtgagactgtttgtggcacgtggcatcgaggttcttgtagctcaatcttacagtaaaaatctcggtctctatgctcaaaggattggagcaatcaatgtgatttcatcgtcaccagaatctgcagcaagggaaacgagccaactgaaaaggattgcccgaccaatgtactctaatccaccggtacacggggctaggatagttgccgatgttgttggaaacccagttctctttaatgaatggaaagcagagatggaaatgatggctggaaggataaagaatgttagacagcagctatatgatagtattacttcaaaagacaaaagtggaaaggattggtcattcatacttaagcagataggcatgttctcattcactggcttgaacaagaaccagagtgacaacatgacaaacaagtggcacgtatacatgacaaaggatggaaggatttcctcggcaggattgtcgttggctaaatgcgaataccttgcggatgctattattgattcatatcataatgtcagctgaaactcaattagatatttttggtgagtgttatacccaatcggagcgattggcatacatgaaaataatttagaataatttatgtatgcattatgtgtgtacatatgtaccctcaaagtaccctaggaaattttttttaactttgaaacaagttgactcaaagtattgatgcgtaatgagtcaggttctcagacttaaagctagttgaatcgaagtactgatgcatagtgaggatgtttatcatttcatatgggtgagattggataaatcatggtaacaatagtttcgttaaaa

SEQ ID NO: 4973 - protein, 463 aa, Glycine max
MASSFLSAASHAVSPSCSLSTTHKGKPMLGGNTLRFHKGPNSFSSSRSRGRISMAVAVNVSRFEGIPMAPPDPILGVSEAFKADNSDVKLNLGVGAYRTEELQPYVLNVVKKAENLMLERGDNKEYLPIEGLAAFNKATAELLLGADNPAIKQQRVATVQGLSGTGSLRLGAALIERYFPGAKVLISAPTWGNHKNIFNDASVPWSEYRYYDPKTVGLDFEGMIEDIKSAPEGSFILLHGCAHNPTGIDPTPEQWEKIADLIEEKNHIPFFDVAYQGFASGSLDEDAASVRLFVARGIEVLVAQSYSKNLGLYAQRIGAINVISSSPESAARETSQLKRIARPMYSNPPVHGARIVADVVGNPVLFNEWKAEMEMMAGRIKNVRQQLYDSITSKDKSGKDWSFILKQIGMFSFTGLNKNQSDNMTNKWHVYMTKDGRISSAGLSLAKCEYLADAIIDSYHNVS

SEQ ID NO: 4974 - DNA, 1755 bp, Glycine max
  CDS (73)..(1464)
gtttccttcatcttcttcttcttcttctatctctctacaacacacttttttaagtgattcgttcgcagaaacatggcttcttcgtttctatccgcagcttcgcacgctgtctcaccctcttgttctctgtccaccacgcacaagggaaagcccatgcttggaggcaacactttgagatttcacaaaggacccaattccttctctagttcaaggtctagaggtcggatctctatggctgttgcagttaatgtatctcggtttgaaggcatacctatggctcctcctgatccaattctcggagtttccgaggcgtttaaggcagacaatagtgatgtcaagctcaatcttggagttggggcatacagaacagaagaactacagccatatgtgcttaatgttgttaagaaggcagagaatcttatgctggagagaggggataacaaagagtatctcccaattgagggtttggcagcatttaataaggcaactgcagagttgttactcggagcagacaacccagcaatcaaacagcaaagagttgccactgtccaaggtctttctggaactggttctctgcgactaggtgcagctctgatagagcgatattttcctggggcaaaagttttgatatcagctcctacctggggtaatcacaagaatattttcaatgatgctagtgtcccatggtctgagtaccgatattatgatcccaagacagttgggttggattttgagggcatgattgaagatataaagtcagctccggaaggatcttttatcttacttcatggatgtgctcataatcctactggtattgatccaacacctgaacagtgggaaaaaatagctgatttaattgaagaaaagaaccacattcccttttttgatgttgcttaccaggggtttgctagtggaagccttgatgaagatgcagcttctgtgagactgtttgtggcacgtggcatcgaggttcttgtagctcaatcttacagtaaaaatctcggtctctatgctgaaaggattggagcaatcaatgtgatttcatcgtcaccagaatctgcagcaagggaaacgagccaactgaaaaggattgcccgaccaatgtactctaatccaccggtacacggggctaggatagttgccgatgttgttggaaacccagttctctttaatgaatggaaagcagagatggaaatgatggctggaaggataaagaatgttagacagcagctatatgatagtattacttcaaaagacaaaagtggaaaggattggtcattcatacttaagcagataggcatgttctcattcactggcttgaacaagaaccagagtgacaacatgacaaacaagtggcacgtatacatgacaaaggatggaaggatttccctggcaggattgtcgttggctaaatgcgaataccttgcggatgctattattgattcatatcataatgtcagctgaaactcaattagatatttttggtgagtgttatacccaatcggagcgattggcatacatgaaaataatttagaataatttatgtatgcattatgtgtgtacatatgtaccctcaaagtaccctaggaaattttttttaactttgaaacaagttgactcaaagtattgatgcgtaatgagtcaggttctcagacttaaagctagttgaatcgaagtactgatgcatagtgaggatgtttatcatttcatatgggtgagattggataaatcatggtaacaatagtttcgttaaaa

SEQ ID NO: 4975 - protein, 463 aa, Glycine max
MASSFLSAASHAVSPSCSLSTTHKGKPMLGGNTLRFHKGPNSFSSSRSRGRISMAVAVNVSRFEGIPMAPPDPILGVSEAFKADNSDVKLNLGVGAYRTEELQPYVLNVVKKAENLMLERGDNKEYLPIEGLAAFNKATAELLLGADNPAIKQQRVATVQGLSGTGSLRLGAALIERYFPGAKVLISAPTWGNHKNIFNDASVPWSEYRYYDPKTVGLDFEGMIEDIKSAPEGSFILLHGCAHNPTGIDPTPEQWEKIADLIEEKNHIPFFDVAYQGFASGSLDEDAASVRLFVARGIEVLVAQSYSKNLGLYAERIGAINVISSSPESAARETSQLKRIARPMYSNPPVHGARIVADVVGNPVLFNEWKAEMEMMAGRIKNVRQQLYDSITSKDKSGKDWSFILKQIGMFSFTGLNKNQSDNMTNKWHVYMTKDGRISLAGLSLAKCEYLADAIIDSYHNVS

SEQ ID NO: 4976 - DNA, 1717 bp, Glycine max
  CDS (54)..(1337)
ctctccctctctgttcgcactctgtctttcccctgtttccgcgtcactgagtcatggcgattcgcaactcgctcaccggccaattcctccgccgcagctccgtcgccggagcaaggctcatgtcttcttcgtcctcatggttccggagcatcgagcccgctcccaaggatcctatcctcggagtcactgaagctttcctcgccgatcagagtccaaacaaagtcaacgtcggagtgggtgcgtatcgcgatgaccaacggaaacctgtggttttggaatgtgttagagaagcagagaggagggttgccggaagtcaattcatggagtatcttcccatgggtggaagcataaaaatgatagaagaatcgctgaagctggcatttggagacaactctgagttcatcaaggataaaagaatagctgcagtgcaggctttatctgggactggtgcatgtcgactttttgctgcatttcaacagagatttcatcctaatacccaaatctatataccagtgcctacctgggccaaccaccataacatttggagagatgctggagtgcctatgaagacattccgttactatcaccctgagtctagaggattggatttttcaggactgatggatgacataaagaatgctccagatggttccttctttctgcttgtgcttactgctcataatcctactggagtagatccttcagaagaacaatggagagagatctcttcccagataaaggctaagggtcatttccctttctttgacatggcatatcaaggttttgctagtggtgatccagagagagatgcaaaagccataaagatttttcttgaggatggtcatttaataggacttgctcagtcatatgcaaaaaatatgggactgtatggccagcgagcaggaagcctgagtgtgctttgtgaagatgagaaacaagctgtggctgtaaaaagtcagttgcagctgattgctagacccatgtacagtaacccacctctccatggagcacttatagtttctactgtccttggtgatccagatttgaagaagttatggcttaaagaagtcaaggttatggcagaccgcatcatcggaatgaggactacactacgagaaaacttagaaaagaaggggtctactttgccatggcagcatataactaatcagattggtatgttctgctacagtggattgacacctgaacaggttgatcgtatgacaaacgagtttcatatttacatgacccgtaacggtcgtatcagtatggctggtcttaatacgggcaacgttggatatgtcttggacgctatccatgaggttacaaaatcattctagattattcaatcacccaacaggtgaccaaatttttgtctttggagacaaacatctcagaagtagtacccttatccaggggagcaaaataaatttaataaagtctgacaaattttcaacttgtttcggggtaagatagtgatactcttcagggtttaccttgcatattgaagacccttattgcaatacgtatccgatttatcatatccatgcaccatagattatatccatttttacagacatcttgtttagcactttaatgagcataaccctgtatcatcattttttttataaaataatttgagtagtagattgaataagggctttatttatggtgaacaggaagtacgtagcttcattccttactacactattattctgtt

SEQ ID NO: 4977 - protein, 427 aa, Glycine max
MAIRNSLTGQFLRRSSVAGARLMSSSSSWFRSIEPAPKDPILGVTEAFLADQSPNKVNVGVGAYRDDQRKPVVLECVREAERRVAGSQFMEYLPMGGSIKMIEESLKLAFGDNSEFIKDKRIAAVQALSGTGACRLFAAFQQRFHPNTQIYIPVPTWANHHNIWRDAGVPMKTFRYYHPESRGLDFSGLMDDIKNAPDGSFFLLVLTAHNPTGVDPSEEQWREISSQIKAKGHFPFFDMAYQGFASGDPERDAKAIKIFLEDGHLIGLAQSYAKNMGLYGQRAGSLSVLCEDEKQAVAVKSQLQLIARPMYSNPPLHGALIVSTVLGDPDLKKLWLKEVKVMADRIIGMRTTLRENLEKKGSTLPWQHITNQIGMFCYSGLTPEQVDRMTNEFHIYMTRNGRISMAGLNTGNVGYVLDAIHEVTKSF

SEQ ID NO: 4978 - DNA, 1191 bp, Actinobacillus porcitonsillarum
  CDS (1)..(1191): transl_table=11
atgtttagtcatattcaagcagcaccagccgatcctattttaggtttaggagaagcatttaaagcagaaacacgtgccggaaaaattaatcttggtattggtgtttatatgaacgatgaagggaaaacgacaatcgttaaagccgttaaagaatcggaacgccaattattagaaacggaaatgaccaaaaattatttaaccattgatggtgtggcagcttataacgcccaaacccaagtattgcttttcggtgaaaatgctgaagtgattacttctggtcgagcgaaaacagcacaaagtttgggtggcaccggtgctttacgtattgcagcagaatttattaaacgtaacacctctgcaaaaaatgtttggatttcggctccaacttggccaaaccataatgcgattatggcagcggttggcttaaatgtgaaagattatcgctactacgatccaaaaacaaaccgcttagattgggataatcttattgcggatttaagccaagcggaagctggtgatgtggtgttattccacggttgttgtcataacccaaccggtatcgatccaacaccggaacaatgggaaacattagcagctttatctgcagaaaaaggctggttaccattatttgactttgcttatcaaggtcttggtaacggtttagaagaagatgcttacggtttacgtgcctttgctaaaagccacaaagaattattagttgcaagctcgtattcaaaaaacttcggtttatataatgagcgtgttggtgcatttaccctagtggctgaaaatgcagaagttgcaaatcgtgcctttacgcaagtgaaatctattattcgtgtactctactctaacccatcagcacacggtgcaagtaccgttgcaacagtgttagcaaatcctacgctgaaagcttcgtggattgaagaattgacggaaatgcgtaaccgtattaaagagatgcgcaatcaattagttcagttattaaaagagaaaggggcaactcaagacttctcttttatcaatgaacaaaatggaatgttctctttcagtggcttaacacctgaacaagtcgatcgtttacgtgaagaatttgctatttatgcggttcgctccggacgtatcaacgttgcaggcattaccagcagcaatattgaagcgttagcagaagctattgtgaaagtactttaa

SEQ ID NO: 4979 - protein, 396 aa, Actinobacillus porcitonsillarum
MFSHIQAAPADPILGLGEAFKAETRAGKINLGIGVYMNDEGKTTIVKAVKESERQLLETEMTKNYLTIDGVAAYNAQTQVLLFGENAEVITSGRAKTAQSLGGTGALRIAAEFIKRNTSAKNVWISAPTWPNHNAIMAAVGLNVKDYRYYDPKTNRLDWDNLIADLSQAEAGDVVLFHGCCHNPTGIDPTPEQWETLAALSAEKGWLPLFDFAYQGLGNGLEEDAYGLRAFAKSHKELLVASSYSKNFGLYNERVGAFTLVAENAEVANRAFTQVKSIIRVLYSNPSAHGASTVATVLANPTLKASWIEELTEMRNRIKEMRNQLVQLLKEKGATQDFSFINEQNGMFSFSGLTPEQVDRLREEFAIYAVRSGRINVAGITSSNIEALAEAIVKVL

SEQ ID NO: 4980 - DNA, 1232 bp, Pseudomonas putida
  CDS (10)..(1206): transl_table=11
aaggtaacaatgagcctgttttccgctgtcgagctggcaccccgcgaccctatcctgggcctcaacgaagcattcaacgccgacccacgtaccgacaaggtcaacttgggcgttggcgtgtactgcaatgaggaaggccgcattccgctgctgcgcgccgtgatcgaagccgaaacccagcgtgccgcccagcacgcctcgcgcggctacctgccgatcgacggcatcgccacttacgaccaggccgtgcaaaaactgatcttcggcgccgagtcgccactgctggccgctggccgcgtggtcaccgtgcaggccgttggcggcaccggcgcgctgaagatcggcgccgacttcctcaagcgcctgtcgcccaatgccgtggttgccatcagtgacccgagctgggaaaaccaccgcgcactgttcgaaaccgccggtttcccggtacagaactaccgctactacgacgcgcctagcaacgacgtcaaccgtgccggcatgctcgaagacctgaacaacctgccgtccggctcgatcgtcgtgctgcatgcctgctgccacaacccgactggcgtcgacctgggcctggacgactggaaaaacgtcctggaagtggtcaaggccaagggccatgtgccgttcctcgacatggcctaccagggctttggtgacggtatcgccgaagacgccttcgccgtgcgcctgttcgccgagtcgggcctggagttcttcgtttccagctcgttctccaagtcgttctcgctgtacggcgagcgcgttggcgcactgtcgatcgtcaccggcaacaaagacgaaagcactcgcgtgctgtcgcaggtcaagcgcgtaatccgcaccacctactccaacccgccgacccacggcgcgaccatcgtcgctaccgtgctgaacagcgacgaactgcgccagatgtgggaagccgagctgggcgagatgcgccagcgcatccacggcatgcgccagcaaatggtcagcctgctggctgaatatggcgccaagcgcgacttcagcttcgttggccgccaggcgggcatgttctcctactcgggcctgaccgttgaacaagtggcgcgcctgaagaacgattttggcatctacgcgctggacaccggccgcatcgcggttgccgcgctgaaccagagcaacatccacgtggtgaccaaggccatcgtcgaagtgctgtaacctattgatttgcctgggagaggctt

SEQ ID NO: 4981 - protein, 398 aa, Pseudomonas putida
MSLFSAVELAPRDPILGLNEAFNADPRTDKVNLGVGVYCNEEGRIPLLRAVIEAETQRAAQHASRGYLPIDGIATYDQAVQKLIFGAESPLLAAGRVVTVQAVGGTGALKIGADFLKRLSPNAVVAISDPSWENHRALFETAGFPVQNYRYYDAPSNDVNRAGMLEDLNNLPSGSIVVLHACCHNPTGVDLGLDDWKNVLEVVKAKGHVPFLDMAYQGFGDGIAEDAFAVRLFAESGLEFFVSSSFSKSFSLYGERVGALSIVTGNKDESTRVLSQVKRVIRTTYSNPPTHGATIVATVLNSDELRQMWEAELGEMRQRIHGMRQQMVSLLAEYGAKRDFSFVGRQAGMFSYSGLTVEQVARLKNDFGIYALDTGRIAVAALNQSNIHVVTKAIVEVL

SEQ ID NO: 4982 - DNA, 1194 bp, Neisseria subflava
  CDS (1)..(1194): transl_table=11
atgtaccaacacgtcgaatactatcccggcgacccgattttgagcctagtcgaaaccttcaaaaacgaccagcgccccgaaaaagtcaatttgagcataggcatttatttcgacgacgaaggcaaaatgcccgtattggaatccgtgagccgcgccgaaaccgcccgcgccgccacgcctgcgccgtcgccctatctgccgatggaaggtttgaacacttaccgcagcgcggtgcagcatttattgttcggcaaagacaaccctgcgcttgcgcaaggacgcatcgttaccgtacaaaccttgggcggttcgggcgcgctcaaagtcggggcggatttcctgcaccgctggttccccgaagcgcgcgcctacgtcagcgacccaacttgggacaaccaccgcggcatttttgaaggcgcaggtttcgaggtcggcacttatccttattacgaccccgccaccgtcggcgtgaaattcgacgaaatgaccgcgtttttcaatactctgcccgaacacagcgccttaatcctacacccctgctgccacaacccgaccggcgtggatatgtcggaacagcaatgggacgaagtgttgcaaatcatcaaaacgcgcaagcttattccgtttatggacattgcctaccaaggcttcggcggcgatttggacagcgatgcctacgccatccgcaaagcggtggaaatggatttgcctctgttcgtcagcaattcattctcaaaaaacctgtcgctctacggcgagcgcgtcggcggtttgagcgtggtttgcccgaataaagaagaagcagaattggtgttcggacaactcaaattcaccgtccgccgcatctactccagcccgcccgcacacggcgcctacatcgccgccgatgtgatgaacaaccccgaactttacgccttgtggcaaaatgaagtctatgtcatgcgcgaccgcatccgcgccatgcggcagaaactttacgacgtcttgaccgcgcaaatccctgaccgcgatttcacttatttcatcaaacagcgcggcatgttcagttacacaggattgagcgtggaacaagtccgcaggctgcgcgacgaatttgccgtttacctgctggattccggcaggatgtgcgtcgccgggctgaatgcttcgaatatcgcctatgttgccgatgcgtttgccgaagtgctgaaataa

SEQ ID NO: 4983 - protein, 397 aa, Neisseria subflava
MYQHVEYYPGDPILSLVETFKNDQRPEKVNLSIGIYFDDEGKMPVLESVSRAETARAATPAPSPYLPMEGLNTYRSAVQHLLFGKDNPALAQGRIVTVQTLGGSGALKVGADFLHRWFPEARAYVSDPTWDNHRGIFEGAGFEVGTYPYYDPATVGVKFDEMTAFFNTLPEHSALILHPCCHNPTGVDMSEQQWDEVLQIIKTRKLIPFMDIAYQGFGGDLDSDAYAIRKAVEMDLPLFVSNSFSKNLSLYGERVGGLSVVCPNKEEAELVFGQLKFTVRRIYSSPPAHGAYIAADVMNNPELYALWQNEVYVMRDRIRAMRQKLYDVLTAQIPDRDFTYFIKQRGMFSYTGLSVEQVRRLRDEFAVYLLDSGRMCVAGLNASNIAYVADAFAEVLK

SEQ ID NO: 4984 - DNA, 1690 bp, Glycine max; identical to SEQ ID NO: 4952
  CDS (263)..(1522)

SEQ ID NO: 4985 - protein, 419 aa, Glycine max
MASHDSISASPTSASDSVFNHLVRAPEDPILGVTVAYNKDPSPVKLNLGVGAYRTEEGKPLVLNVVRRVEQQLINDVSRNKEYIPIVGLADFNKLSAKLIFGADSPAIQDNRVTTVQCLSGTGSLRVGGEFLAKHYHQRTIYLPTPTWGNHPKVFNLAGLSVKTYRYYAPATRGLDFQGLLEDLGSAPSGSIVLLHACAHNPTGVDPTLEQWEQIRQLIRSKALLPFFDSAYQGFASGSLDADAQPVRLFVADGGELLVAQSYAKNLGLYGERVGALSIVCKSADVASRVESQLKLVIRPMYSSPPIHGASIVAAILKDRNLFNDWTIELKAMADRIISMRQELFDALCSRGTPGDWSHIIKQIGMFTFTGLNAEQVSFMTKEFHIYMTSDGRISMAGLSSKTVPLLADAIHAAVTRVV

SEQ ID NO: 4986 - DNA, 1191 bp, Aeromonas hydrophila
  CDS (1)..(1191): transl_table=11
atgtttgaaaaggttgttgccgccccaccggatccgatcctgggcctgaccgaagccttccgcgctgactctcgcagccacaagatcaatctgggggtcgggatctacaaggatgaaaccggtgccacccctatccttcactgcgtcaagaaagccgagcagaagctgctcaccgacgagaagaccaagaattatctcggtattgaaggcaatatcgaatacggccgcatagtgcagcaactgctgttcggacaggactccgccttgatcgccagtggccgcgccaagaccgcccaggcgccgggcggcaccggtgccctgcgcattgccgccgagttcgtggtgcgcaacgggctggccaagaccatctggatctccgatcccacctgggccaaccacgtcagcgtattccaggccgccggtttgaccgtcaagtggtacaagtactacgacgccgccaccaaggggctcgactttgccgccatgcaggcgtcgctcaatgacgtacaggctggtgagctggtgctgctgcacggctgctgccacaacccgaccggtatcgaccccaccgctgagcagtggcgcgccctggccaaacagagtgccgccgccggctggctgccgctgtttgacttcgcctatcagggctttgcccgtggcatcgaagaagatgccgagggtcttcgcatcttcgccgagtgtcacgacgagctgctggtggcgagctctttctccaaaaacttcggcctctacaacgagcgggtcggcgccttcaccctggtcagcgcgaccaaggcgatcgccgatgtggccttcacccaggtcaagaccgtcatccgtgccaactactccaacccgccgtcacacggcgctgccgtggtgacaaccatcgtcagtgacccggctctctatgtcgagtgggttgaagaagtggcggccatgcgggtgcgcattcgcgagatgcgcgagctgctggtggagaagctggcagccttgggtgtgagccaggatttcagctttatccgcgagcagaacggcatgttctccttctccggtctctccaaggatcaggttgagcagctcaagagcgagtttgccatctacatcgtcggttcaggccggatcagcgtggccgggatcacccgtgccaacatagatcccctgtgtgacgccatcgccaaggtactgtga

SEQ ID NO: 4987 - protein, 396 aa, Aeromonas hydrophila
MFEKVVAAPPDPILGLTEAFRADSRSHKINLGVGIYKDETGATPILHCVKKAEQKLLTDEKTKNYLGIEGNIEYGRIVQQLLFGQDSALIASGRAKTAQAPGGTGALRIAAEFVVRNGLAKTIWISDPTWANHVSVFQAAGLTVKWYKYYDAATKGLDFAAMQASLNDVQAGELVLLHGCCHNPTGIDPTAEQWRALAKQSAAAGWLPLFDFAYQGFARGIEEDAEGLRIFAECHDELLVASSFSKNFGLYNERVGAFTLVSATKAIADVAFTQVKTVIRANYSNPPSHGAAVVTTIVSDPALYVEWVEEVAAMRVRIREMRELLVEKLAALGVSQDFSFIREQNGMFSFSGLSKDQVEQLKSEFAIYIVGSGRISVAGITRANIDPLCDAIAKVL

SEQ ID NO: 4988 - DNA, 1197 bp, Pseudomonas aeruginosa
  CDS (1)..(1197): transl_table=11
atgagtctgttttctgccgtcgaaatggcaccgcgtgatcccatccttggcctgaacgaagccttcaacgccgatacccgtccgggcaagatcaacctgggcgtgggcgtgtactacaacgaggaggggcgcattccgctgttgcgtgccgtgcaggctgccgagaaggcccgcatcgaggtccacgcgccgcgcggctacctgccgatcgaagggatcgccgcctacgaccagggcgtacggaaactgctgttcggtaacgaatccgagctgctggccgccggccgcgtggtcacgacccaggccgtcggcggcaccggcgccctcaagctcggcgccgacttcctcaagcgcctgctgcccgacgccaccgtggccatcagcgacccgagctgggaaaaccaccgcgcactgttcgaagccgccggcttcccggtgcagaactaccgctattacgacgccgccagcaatggcgtgaaccgcgccggcctgctggaagacctgaatgccctgccggcccgctcgatcgtggtcctgcacgcctgctgccataatccgaccggcgtcgatctcgagctggacgactggaaacaggtgctggacgtgctcaaggccaagggccacgtgccgttcctcgacatcgcctaccagggcttcggcaacggcatcgaggaagacgccgccgcggtgcgcctgttcgcccagtcaggcctgagcttcttcgtttccagctcgttctccaaatccttctcgctctatggcgaacgcgtcggcgccctctcgatcgtgaccgaaagccgcgatgaatcggcccgcgtgctgtcccaggtgaagcgggtgatccgcaccaactattcgaacccaccgacccacggcgccagcgtcgtctcctccgtgctcaacagcccggaactgcgggccctctgggagcaggaactgggcgagatgcgcgaccgcatccgcgacatgcgcctggcgatggtcgagcaactggcagcccacggcgccaagcgcgacttcagcttcgtcggtcgccagcgtggcatgttctcctattccggcctgaccgccgaccaggtcgagcgcctgaagaccgagttcggtatctacgccgtcagcaccggccgtatctgcgtcgccgcgctgaacaaatcgaacctggagaccatcaccaaggccatcgtccaggtcctgtag

SEQ ID NO: 4989 - protein, 398 aa, Pseudomonas aeruginosa
MSLFSAVEMAPRDPILGLNEAFNADTRPGKINLGVGVYYNEEGRIPLLRAVQAAEKARIEVHAPRGYLPIEGIAAYDQGVRKLLFGNESELLAAGRVVTTQAVGGTGALKLGADFLKRLLPDATVAISDPSWENHRALFEAAGFPVQNYRYYDAASNGVNRAGLLEDLNALPARSIVVLHACCHNPTGVDLELDDWKQVLDVLKAKGHVPFLDIAYQGFGNGIEEDAAAVRLFAQSGLSFFVSSSFSKSFSLYGERVGALSIVTESRDESARVLSQVKRVIRTNYSNPPTHGASVVSSVLNSPELRALWEQELGEMRDRIRDMRLAMVEQLAAHGAKRDFSFVGRQRGMFSYSGLTADQVERLKTEFGIYAVSTGRICVAALNKSNLETITKAIVQVL

SEQ ID NO: 4990 - DNA, 1293 bp, Arabidopsis thaliana
  CDS (1)..(1293)
atggctttggcgatgatgatccgaaacgcagcttcgaagcgaggaatgactccgatctccggtcatttcggtggtttgagatctatgtcttcatggtggaagagcgttgagcctgctcctaaagatccgatcctcggagttaccgaagcttttctcgctgatcctagtcctgaaaaagttaatgttggtgtgggagcatatcgtgatgataatgggaagcctgttgtcttggaatgtgtcagagaagctgagaaaaggcttgctgggagcactttcatggagtaccttcctatgggaggaagtgccaaaatggtggacctaacattgaagcttgcctatggggacaatagtgaatttatcaaagataaaagaattgctgcagttcagactctgtctggcactggagcctgccggctctttgcagacttccagaaacgtttttctcctggttcacagatctacattcctgttccaacctggtccaaccaccacaacatctggaaagatgcacaagtccctcaaaagacatatcattactatcatccagaaaccaagggcttggatttctcagcattgatggatgatgtgaagaatgctccggaagggtcattcttccttcttcatgcttgtgctcataatcctactggagtagaccctacagaggaacaatggagagagatatcacagctattcaaggctaaaaagcatttcgcattcttcgatatggcttaccaaggttttgctagtggagatccagcgagagatgccaagtccatcaggatctttcttgaagatggtcatcatattggaatttctcagtcctatgcaaaaaacatgggactctacggccagagggtgggatgtctcagtgtgctttgtgaagatccgaagcaagccgtggctgtgaaaagtcaattgcagcagctagctagaccaatgtacagcaacccacctttgcatggtgctcagctggtctcaaccattcttgaagacccagagttaaagagtctgtggctaaaagaagttaaggtcatggctgataggatcatcggcatgagaactactttgcgagaaagccttgagaagttaggatcgcctttgtcatgggagcacgttaccaaacagattggaatgttctgctacagtgggttaacaccagaacaggttgaccgcttaacaagcgaatatcacatctatatgacccgtaacggccgtatcagtatggctggtgttacaacaggaaacgtgggataccttgcgaatgctatacatgaagtcaccaagtcatcttaa

SEQ ID NO: 4991 - protein, 430 aa, Arabidopsis thaliana
MALAMMIRNAASKRGMTPISGHFGGLRSMSSWWKSVEPAPKDPILGVTEAFLADPSPEKVNVGVGAYRDDNGKPVVLECVREAEKRLAGSTFMEYLPMGGSAKMVDLTLKLAYGDNSEFIKDKRIAAVQTLSGTGACRLFADFQKRFSPGSQIYIPVPTWSNHHNIWKDAQVPQKTYHYYHPETKGLDFSALMDDVKNAPEGSFFLLHACAHNPTGVDPTEEQWREISQLFKAKKHFAFFDMAYQGFASGDPARDAKSIRIFLEDGHHIGISQSYAKNMGLYGQRVGCLSVLCEDPKQAVAVKSQLQQLARPMYSNPPLHGAQLVSTILEDPELKSLWLKEVKVMADRIIGMRTTLRESLEKLGSPLSWEHVTKQIGMFCYSGLTPEQVDRLTSEYHIYMTRNGRISMAGVTTGNVGYLANAIHEVTKSS

SEQ ID NO: 4992 - DNA, 1218 bp, Arabidopsis thaliana
  CDS (1)..(1218)
atggattccgtcttctctaacgttgctcgtgctcccgaagatcctattctcggtgtaactgttgcttacaacaatgatcctagtcctgttaagatcaatttgggtgtcggtgcctaccgaactgaggaagggaagcctcttgttcttgatgtggtgcgtaaggcagaacaacagctagtgaacgatccgtctcgggtcaaggaatacattcccattgttggtatttccgattttaacaagttaagcgccaagctcatcttaggtgctgacagtcctgcgattacagaaagtagagttactacagtccagtgcttgtctggtactggttcgttgagagttggggctgagtttctcaaaacacactaccaccaaagtgtcatttacattccaaaaccaacttgggggaaccatcccaaagttttcaacttggcaggcttgtctgtggagtatttccgctactatgatcctgcaacccgtggtcttgacttcaaaggcttgctcgaggatcttggcgctgcaccatctggagctattgtcttacttcatgcatgtgcacacaatcccactggagttgacccaacctctgaacagtgggaacagattcgacagctgatgagatctaaaagcttattacccttttttgatagtgcatatcagggttttgctagtggtagccttgacacagatgcacaatctgtccgtacatttgttgctgatggcggtgaatgcttgatagctcaaagttacgccaaaaatatgggactttatggggagcgtgttggtgcccttagcattgtctgcaagtcagcagatgtggctagtaaggttgagagccaggtgaagcttgttgtgcggcccatgtattcgagcccccctattcatggagcatcaattgttgccaccattctaaaaagcagtgatatgtacaacaactggaccatcgagctgaaagaaatggctgaccgtataaagagcatgcgccaacagttatttgaagctatacaagctagaggtacacctggtgactggagtcatattatcaaacagattgggatgtttacatttactggattgaacaaggagcaagttgaattcatgaccaaagagttccacatttacatgacctctgatgggagaataagcatggcaggtctaagttcgaagacagtgcctcaccttgccgatgctatgcatgctgcagtgacccgcctcggctaa

SEQ ID NO: 4993 - protein, 405 aa, Arabidopsis thaliana
MDSVFSNVARAPEDPILGVTVAYNNDPSPVKINLGVGAYRTEEGKPLVLDVVRKAEQQLVNDPSRVKEYIPIVGISDFNKLSAKLILGADSPAITESRVTTVQCLSGTGSLRVGAEFLKTHYHQSVIYIPKPTWGNHPKVFNLAGLSVEYFRYYDPATRGLDFKGLLEDLGAAPSGAIVLLHACAHNPTGVDPTSEQWEQIRQLMRSKSLLPFFDSAYQGFASGSLDTDAQSVRTFVADGGECLIAQSYAKNMGLYGERVGALSIVCKSADVASKVESQVKLVVRPMYSSPPIHGASIVATILKSSDMYNNWTIELKEMADRIKSMRQQLFEAIQARGTPGDWSHIIKQIGMFTFTGLNKEQVEFMTKEFHIYMTSDGRISMAGLSSKTVPHLADAMHAAVTRLG

SEQ ID NO: 4994 - DNA, 1381 bp, Arabidopsis thaliana
  CDS (1)..(1350)
atgaaaactactcatttctcttcctcttcttcttccgatcgcaggatcggtgctctgctccgtcatctcaattccggctcagattcggacaacctgagctctctttatgcatctccgacatcgggaggcaccggtggttctgttttctctcatcttgttcaagctccagaggatcctattcttggggtgacagttgcatacaacaaagatcctagcccagttaagctgaatttaggagttggtgcttaccgaactgaggagggaaaacctttggttcttaatgttgtgaggaaagctgagcagcagcttatcaatgacagaacaagaatcaaggagtatcttcccattgttggattggttgagttcaacaagttaagcgctaagctcatactaggcgctgacagtcctgctattcgggagaatcggattaccaccgtggagtgtttgtctggtactggttctctgagagttggaggagagtttttggctaaacattatcatcagaaaacaatttacatcactcagccaacatggggaaatcatccaaagattttcacgctcgctggtttgacagtgaaaacttaccgatactacgatccagcgacgcgtgggttgaactttcaaggtttattagaagaccttggtgctgccgcacctggttctatagtgcttctccatgcctgtgcccataaccctactggtgttgatccaaccattcaacaatgggagcaaatcaggaagttgatgcgatcaaagggattgatgcccttcttcgatagtgcttatcagggctttgcaagtggaagtcttgatacagatgcgaaacctattaggatgtttgttgctgatggcggagaatgcctcgttgctcaaagttatgcgaagaacatgggactctatggagaacgagttggagctctcagcattgtatgcaaatcagcagatgttgcggggagagttgaaagccaactgaaactagtgataaggccaatgtactcgagtcctccaatccatggtgcatcaatcgtggctgtaatcctccgtgacaagaatttgttcaacgaatggactctggaactgaaggccatggctgatcgtatcatcagcatgaggaaacagcttttcgaggcattacgtactcgaggcactcctggagactggagtcacatcataaagcagattggtatgtttaccttcacagggttaaacccagctcaagtctccttcatgactaaagagtaccacatctacatgacatctgacgggaggataagcatggctggtctgagttcgaagactgtacctcaccttgcagacgctatccatgctgttgtcaccaaagccgtctgagaaactgaacaccaccatgacaccaaagctt

SEQ ID NO: 4995 - protein, 449 aa, Arabidopsis thaliana
MKTTHFSSSSSSDRRIGALLRHLNSGSDSDNLSSLYASPTSGGTGGSVFSHLVQAPEDPILGVTVAYNKDPSPVKLNLGVGAYRTEEGKPLVLNVVRKAEQQLINDRTRIKEYLPIVGLVEFNKLSAKLILGADSPAIRENRITTVECLSGTGSLRVGGEFLAKHYHQKTIYITQPTWGNHPKIFTLAGLTVKTYRYYDPATRGLNFQGLLEDLGAAAPGSIVLLHACAHNPTGVDPTIQQWEQIRKLMRSKGLMPFFDSAYQGFASGSLDTDAKPIRMFVADGGECLVAQSYAKNMGLYGERVGALSIVCKSADVAGRVESQLKLVIRPMYSSPPIHGASIVAVILRDKNLFNEWTLELKAMADRIISMRKQLFEALRTRGTPGDWSHIIKQIGMFTFTGLNPAQVSFMTKEYHIYMTSDGRISMAGLSSKTVPHLADAIHAVVTKAV

SEQ ID NO: 4996 - DNA, 1447 bp, Arabidopsis thaliana
  CDS (1)..(1362)
atggcttctttaatgttatctctcggttccacttctctgttaccgcgcgagattaacaaggataagctaaagcttggaacttctgcttcgaacccgttcctaaaagcaaagtcttttagcagagtgactatgacggttgcagtgaagccttctcgtttcgagggtataactatggctccaccagaccctattcttggagtcagtgaagcattcaaagctgacactaacgggatgaaactcaatcttggtgttggtgcttatcgtactgaggaactccagccttatgtgcttaatgttgttaaaaaggcggagaatttgatgttggagagaggagataacaaagagtatcttccaattgaggggttggcagcattcaacaaggctactgctgagttgctatttggagctggtcatcctgttattaaggaacaaagagtagcaacaattcagggtctttcgggaacaggttcactgcgattagcagcggctcttatagagcgttatttccctggagcaaaagttgtgatctcatcaccaacctggggtaatcacaagaatatcttcaatgatgccaaagttccgtggtccgaataccgctactatgatccaaaaacaattggtttggattttgagggaatgatagcagatataaaggaagctccagaaggatccttcatcttgcttcacggatgtgctcacaacccaactggaattgacccaacaccagaacagtgggtaaaaattgctgatgtcattcaggaaaagaaccatatcccatttttcgatgttgcataccagggctttgctagtggaagccttgatgaagatgcagcatctgtgagattatttgctgagcggggaatggagttttttgttgctcagtcatatagtaaaaatttaggtttgtatgcagaaagaattggggcaatcaatgtcgtgtgctcctcagctgatgctgctacaagggtcaagagccagttgaaaaggattgctcggcctatgtactcgaatccaccagttcatggggcgagaatcgtggccaatgtagtgggtgatgtaactatgttcagtgaatggaaagcagagatggaaatgatggcaggaagaataaagacggttagacaagagctgtatgatagcctcgtttcaaaagacaagagcgggaaggactggtccttcattctgaagcaaattggcatgttctctttcaccggcctaaacaaagctcagagcgataacatgacggacaaatggcacgtgtatatgactaaagacgggaggatatcattggccggattatctctggccaaatgcgagtatcttgctgatgcgatcatcgactcataccataacgtaagctgagcttccatctcagtagatgacaataagaaacagttttatataccctttttagcttcttcttgatctttgattgaaaccagatggc

SEQ ID NO: 4997 - protein, 453 aa, Arabidopsis thaliana
MASLMLSLGSTSLLPREINKDKLKLGTSASNPFLKAKSFSRVTMTVAVKPSRFEGITMAPPDPILGVSEAFKADTNGMKLNLGVGAYRTEELQPYVLNVVKKAENLMLERGDNKEYLPIEGLAAFNKATAELLFGAGHPVIKEQRVATIQGLSGTGSLRLAAALIERYFPGAKVVISSPTWGNHKNIFNDAKVPWSEYRYYDPKTIGLDFEGMIADIKEAPEGSFILLHGCAHNPTGIDPTPEQWVKIADVIQEKNHIPFFDVAYQGFASGSLDEDAASVRLFAERGMEFFVAQSYSKNLGLYAERIGAINVVCSSADAATRVKSQLKRIARPMYSNPPVHGARIVANVVGDVTMFSEWKAEMEMMAGRIKTVRQELYDSLVSKDKSGKDWSFILKQIGMFSFTGLNKAQSDNMTDKWHVYMTKDGRISLAGLSLAKCEYLADAIIDSYHNVS

SEQ ID NO: 4998 - DNA, 1523 bp, Daucus carota
  CDS (24)..(1241)
caaaaccctagcttatacttccgatgtcttccgtcttcgctaacgtcgttcgcgctcctgaggatcctatcttaggggtcactgttgcttatcacaaagatcaaagtcctaataagttgaatttgggtgttggtgcttatcgaactgaggaaggaaaacctcttgttcttaatgttgtgaagaaagcagagcagatgcttgtaaatgatcagtctcgagtaaaagagtatcttcctattgttggactggcagactttaacaaattgagtgccaagctgattttcggcgctgatagtcctgccattcaagagaatagagtcgcaactgtccagtgcttatctggtactggctcactgagggttgggggtgaattcctggccagacattatcatgaacatacagtgtatatcccccagccaacttggggaaaccatccaaaaattttcactttagcaggcttatcggtgaagacataccgctattataatccagaaacgcgtggattggattttgaaggcatgctagaggatcttggttctgctccattgggagcaatagtgcttcttcatgcatgtgctcacaatccaaccggtgttgatccaaccattgagcagtgggagcagatcagacagctgatgagatcgaaaagcttgttacctttctttgacagtgcatatcagggttttgctagcggcagccttgacgccgatgcacagtctgttcgcatctttgttgcagatggtggtgaatgccttgcagctcagagttatgcaaagaatatgggactctatggggaacgcgttggtgccctgagcattgtttgcaagactgcagatgtggcaagcaaggttgagagccaattgaaactagttatcaggcctatgtattccagtccacctcttcatggtgcatctattgtggctgcgattctcaaagatggtgacctctataatgaatggacactggagctgaaagcaatggctgaccgaatcatcagcatgcgacaggagctctttaatgctttacaagcaaaaggaacaccaggtgactggagtcacattgtcaagcaaattggaatgtttacattcactgggttaaactctgagcaagtcaccttcatgaccaatgagtatcatatatatttgacatctgatgggcggatcagcatggcaggtcttagttcccgaacagttcctcatcttgcagatgctattcatgctgcagttactggcaaggcctagatactgttgtgttatatatacatgtttcatgagatttttgggtagatgtctgaaaaccttgtttggagctcactgatcttcagttagctttaataaagatgtacatgtcgcctggagccaaatggttaggttttatctgtgagctagcatgtctggtaagagcatgacatgacattaagcacaatataaatgcctagacagctattacaggaacatgattgacgctgagaaatgacttcgtttttgcaaaaacttttttatatatctaaatgcatcatattt

SEQ ID NO: 4999 - protein, 405 aa, Daucus carota
MSSVFANVVRAPEDPILGVTVAYHKDQSPNKLNLGVGAYRTEEGKPLVLNVVKKAEQMLVNDQSRVKEYLPIVGLADFNKLSAKLIFGADSPAIQENRVATVQCLSGTGSLRVGGEFLARHYHEHTVYIPQPTWGNHPKIFTLAGLSVKTYRYYNPETRGLDFEGMLEDLGSAPLGAIVLLHACAHNPTGVDPTIEQWEQIRQLMRSKSLLPFFDSAYQGFASGSLDADAQSVRIFVADGGECLAAQSYAKNMGLYGERVGALSIVCKTADVASKVESQLKLVIRPMYSSPPLHGASIVAAILKDGDLYNEWTLELKAMADRIISMRQELFNALQAKGTPGDWSHIVKQIGMFTFTGLNSEQVTFMTNEYHIYLTSDGRISMAGLSSRTVPHLADAIHAAVTGKA

SEQ ID NO: 5000 - DNA, 1257 bp, Saccharomyces cerevisiae
  CDS (1)..(1257)
atgtctgccactctgttcaataacatcgaattgctgccccctgatgccctttttggtattaagcaaaggtacgggcaagatcaacgtgctaccaaggtcgacttgggtatcggggcctacagagacgacaacggtaaaccatgggtcttgccaagtgttaaagccgccgaaaagctaattcataacgacagctcctacaaccatgaatacctcggtattaccggtctgccaagtttgacatctaacgccgccaagatcatcttcggtacgcaatccgatgcctttcaggaagacagagtaatctcagtacaatcactgtctggtacgggtgctcttcatatatctgcgaagtttttttcaaaattcttcccagataaactggtctatttgtctaagcctacttgggccaaccacatggccatttttgagaatcaaggcttgaaaacggcgacttacccttactgggccaacgaaactaagtctttggacctaaacggctttctaaatgctattcaaaaagctccagagggctccattttcgttctgcactcttgcgcccataacccaactggtctggaccctactagtgaacaatgggttcaaatcgttgatgctatcgcctcaaagaaccacatcgccttatttgacaccgcctaccaagggtttgccactggagatttggacaaggatgcctatgctgtgcgtctaggtgtggagaagctttcaacggtctctcccgtctttgtctgtcagtcctttgccaagaacgccggtatgtacggtgagcgtgtaggttgtttccatctagcacttacaaaacaagctcaaaacaaaactataaagcctgctgttacatctcaattggccaaaatcattcgtagtgaagtgtccaacccacccgcctacggcgctaagattgtcgctaaactgttggaaacgccagaattaacggaacagtggcacaaggatatggttaccatgtcctccagaattacgaaaatgaggcacgcattaagagaccatttagtcaagttgggcactcctggcaactgggatcatatagtaaatcaatgcgggatgttctcctttacaggattgactcctcaaatggttaaacgacttgaagaaacccacgcagtttacttggttgcctcaggtagagcttctattgctggattgaatcaaggaaacgtggaatacgtggctaaagccattgatgaagtggtgcgcttctatactattgaagctaaattgtaa

SEQ ID NO: 5001 - protein, 418 aa, Saccharomyces cerevisiae
MSATLFNNIELLPPDALFGIKQRYGQDQRATKVDLGIGAYRDDNGKPWVLPSVKAAEKLIHNDSSYNHEYLGITGLPSLTSNAAKIIFGTQSDAFQEDRVISVQSLSGTGALHISAKFFSKFFPDKLVYLSKPTWANHMAIFENQGLKTATYPYWANETKSLDLNGFLNAIQKAPEGSIFVLHSCAHNPTGLDPTSEQWVQIVDAIASKNHIALFDTAYQGFATGDLDKDAYAVRLGVEKLSTVSPVFVCQSFAKNAGMYGERVGCFHLALTKQAQNKTIKPAVTSQLAKIIRSEVSNPPAYGAKIVAKLLETPELTEQWHKDMVTMSSRITKMRHALRDHLVKLGTPGNWDHIVNQCGMFSFTGLTPQMVKRLEETHAVYLVASGRASIAGLNQGNVEYVAKAIDEVVRFYTIEAKL

SEQ ID NO: 5002 - DNA, 2114 bp, Saccharomyces cerevisiae
  CDS (466)..(1821)
cttgctgtaactaattggtttatatttaaatatttcactttttaaagggcgtttgcatgcgaccatcgtcgatgattcatattgttcggatgcggaagatggcttccatgagttttgcacgccgtctcatgtgattgttggagtcatagctcgcatatcttcctattgtcagatgtaatatcgacggaaatggcatcttggagtatggaagcactattctgctttgctccaatatttaggatgccgcatttttcatatttttttttacatttttcgcttacgtatataaattgctagcaagtattcgctctctctgtcttggttatctaattgctaaccgtcgcaattgaaaagaaaaaaaaaatacagaatagacgatagcggattgaacgatagcatactattgagtgcgttttcccttctcatttgaaaattactatccgtttttcactgccgaaagacttgatgttgaggacgaggcttactaattgcagtctatggaggccctactacacgtcatcgcttagtagagtaccaagagcacctccagataaagtcttggggttatctgaacacttcaaaaaggtaaaaaatgttaacaaaattgacctgaccgtaggaatatataaagatggttggggcaaagtgacgacgtttccctccgttgcaaaagctcaaaaattgattgaatctcatttagagttgaataagaatctttcatatttaccaataacaggttccaaagaatttcaggaaaacgttatgaaatttttgttcaaggaatcatgtccgcagtttgggccattttatttagcccatgatagaatcagctttgttcagactttgagtggtacaggcgccctagctgtagcagctaaattcttggcattatttatttcaagagatatttggatacctgacccatcatgggcaaatcataagaacatttttcagaacaatggttttgaaaatatttaccggtattcctattataaggacggtcagatagacatcgacggatggattgagcaattgaaaacctttgcatataacaaccagcaagaaaacaataagaacccaccttgcataatcttgcatgcgtgttgtcacaaccctacaggtctcgacccaactaaagagcaatgggaaaagattatagatactatatatgagctaaaaatggtacccattgttgatatggcttatcagggtttagagtctggtaacttactaaaggacgcatatttattgaggctatgtctcaatgtaaataaatatccaaattggagtaacggtatctttctttgtcaatcttttgccaagaacatgggcctttatggtgaacgagttggttccttaagcgttatcacgccggcaactgcgaacaatggaaagttcaaccctctacaacagaaaaactcattgcagcaaaatattgactcccaattaaaaaagattgtcagaggtatgtattcttctccaccaggatacggttctcgtgtggtaaatgtagtattatcagatttcaaattgaaacagcaatggttcaaggatgttgatttcatggttcagagattgcatcacgtcagacaggagatgtttgaccgtctagggtggccggatcttgtaaatttcgcacaacagcacggtatgttttactatacaaggtttagtccaaagcaagtcgaaatattgagaaacaattacttcgtctatttaacaggtgatggtagattgtcgcttagcggagtcaatgattcgaacgttgattacttatgtgaatctcttgaagcagtctcgaaaatggacaaactcgcataattttttcaccttacagttcacctttgtctttatttttttattacttttcccttctcattttgccacacaataatttatagaatataataattttttgtaataattaataaaccttttttttatctactctatatacacttttcagataactagattggattaattcgtgatcgaactagttattaaattttaaatgaaaagaaagctagcgctagccaactattttaattacggtggcagtgcatcatatccttacatttcattttaggtttcctatgttttcttctttcaaa

SEQ ID NO: 5003 - protein, 451 aa, Saccharomyces cerevisiae
MLRTRLTNCSLWRPYYTSSLSRVPRAPPDKVLGLSEHFKKVKNVNKIDLTVGIYKDGWGKVTTFPSVAKAQKLIESHLELNKNLSYLPITGSKEFQENVMKFLFKESCPQFGPFYLAHDRISFVQTLSGTGALAVAAKFLALFISRDIWIPDPSWANHKNIFQNNGFENIYRYSYYKDGQIDIDGWIEQLKTFAYNNQQENNKNPPCIILHACCHNPTGLDPTKEQWEKIIDTIYELKMVPIVDMAYQGLESGNLLKDAYLLRLCLNVNKYPNWSNGIFLCQSFAKNMGLYGERVGSLSVITPATANNGKFNPLQQKNSLQQNIDSQLKKIVRGMYSSPPGYGSRVVNVVLSDFKLKQQWFKDVDFMVQRLHHVRQEMFDRLGWPDLVNFAQQHGMFYYTRFSPKQVEILRNNYFVYLTGDGRLSLSGVNDSNVDYLCESLEAVSKMDKLA

SEQ ID NO: 5004 - DNA, 1191 bp, Escherichia coli
  CDS (1)..(1191): transl_table=11
atgtttgagaacattaccgccgctcctgccgacccgattctgggcctggccgatctgtttcgtgccgatgaacgtcccggcaaaattaacctcgggattggtgtctataaagatgagacgggcaaaaccccggtactgaccagcgtgaaaaaggctgaacagtatctgctcgaaaatgaaaccaccaaaaattacctcggcattgacggcatccctgaatttggtcgctgcactcaggaactgctgtttggtaaaggtagcgccctgatcaatgacaaacgtgctcgcacggcacagactccggggggcactggcgcactacgcgtggctgccgatttcctggcaaaaaataccagcgttaagcgtgtgtgggtgagcaacccaagctggccgaaccataagagcgtctttaactctgcaggtctggaagttcgtgaatacgcttattatgatgcggaaaatcacactcttgacttcgatgcactgattaacagcctgaatgaagctcaggctggcgacgtagtgctgttccatggctgctgccataacccaaccggtatcgaccctacgctggaacaatggcaaacactggcacaactctccgttgagaaaggctggttaccgctgtttgacttcgcttaccagggttttgcccgtggtctggaagaagatgctgaaggactgcgcgctttcgcggctatgcataaagagctgattgttgccagttcctactctaaaaactttggcctgtacaacgagcgtgttggcgcttgtactctggttgctgccgacagtgaaaccgttgatcgcgcattcagccaaatgaaagcggcgattcgcgctaactactctaacccaccagcacacggcgcttctgttgttgccaccatcctgagcaacgatgcgttacgtgcgatttgggaacaagagctgactgatatgcgccagcgtattcagcgtatgcgtcagttgttcgtcaatacgctgcaggaaaaaggcgcaaaccgcgacttcagctttatcatcaaacagaacggcatgttctccttcagtggcctgacaaaagaacaagtgctgcgtctgcgcgaagagtttggcgtatatgcggttgcttctggtcgcgtaaatgtggccgggatgacaccagataacatggctccgctgtgcgaagcgattgtggcagtgctgtaa

SEQ ID NO: 5005 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 5006 - DNA, 1191 bp, Haemophilus influenzae
  CDS (1)..(1191): transl_table=11
atgtttgaacatatcaaagcggcaccagccgatccaatcttaggcttaggcgaagcatttaaatccgaaactcgcgaaaataaaatcaatttgggtattggcgtttataaagatgcgcaaggcacaaccccaattatgcacgcggtaaaagaagccgaaaaacgattatttgataaggaaaaaaccaagaattatctgactatcgatggtattgcggattataacgaacaaacaaaagcactccttttcggtaaagattctgaagtcatccaatctaatcgagcaagaacagtacaaagtttaggcggaacaggtgcattacgcattgcggcagaatttattaaacgccaaactaaagcacaaaatgtttggatcagcacaccaacttggccaaaccacaatgcgattttcaatgctgtcggtatgaccattcgtgaatatcgttattatgatgctgaacgcaaagcccttgattgggaacacttattagaagatttaagccaagcaagcgaaggcgatgtggtgcttttacacggttgttgccataatccgactggtattgaccctactccagaacaatggcaagaattagccgcactttcagctaaaaatggttggttgccactctttgactttgcttatcaaggtttagccaacggattagatgaagatgcttatggtttacgtgcttttgcagcaaaccacaaagaattattagtggcgagttcattctcgaaaaactttggtttatataatgaacgtgttggtgcatttacccttgtggcagaaaatgcagaaattgcatcaacctcattaacccaagtaaaatcaattattcgcaccctatactctaacccagcttctcacggcggggcgaccgtagcaacagtattaaatgatgctcaacttcgccaagaatgggaaaatgaattaactgaaatgcgtgaacgcatcaaaaaaatgcgtcacttattcgttcagttattaaaagaatatggtgcagaacaagatttcagctttatcattgaacaaaacggtatgttttctttcagtggattaacaggggaacaagtggatcgtttaaaaaatgaatttgccatttacgctgttcgttctggtcgtatcaacgtagctggaatcacagaagataatattcgctatctatgtgaaagtatcgtgaaagtactttaa

SEQ ID NO: 5007 - protein, 396 aa, Haemophilus influenzae
MFEHIKAAPADPILGLGEAFKSETRENKINLGIGVYKDAQGTTPIMHAVKEAEKRLFDKEKTKNYLTIDGIADYNEQTKALLFGKDSEVIQSNRARTVQSLGGTGALRIAAEFIKRQTKAQNVWISTPTWPNHNAIFNAVGMTIREYRYYDAERKALDWEHLLEDLSQASEGDVVLLHGCCHNPTGIDPTPEQWQELAALSAKNGWLPLFDFAYQGLANGLDEDAYGLRAFAANHKELLVASSFSKNFGLYNERVGAFTLVAENAEIASTSLTQVKSIIRTLYSNPASHGGATVATVLNDAQLRQEWENELTEMRERIKKMRHLFVQLLKEYGAEQDFSFIIEQNGMFSFSGLTGEQVDRLKNEFAIYAVRSGRINVAGITEDNIRYLCESIVKVL

SEQ ID NO: 5008 - DNA, 1197 bp, Pseudomonas aeruginosa
  CDS (1)..(1197): transl_table=11
atgagtctgttttctgccgtcgaaatggcaccgcgtgatcccatccttggcctgaacgaagccttcaacgccgatacccgtccgggcaagatcaacctgggcgtgggcgtgtactacaacgaggaggggcgcattccgctgttgcgtgccgtgcaggctgccgagaaggcccgcatcgaggcccacgcgccgcgcggctacctgccgatcgaagggatcgccgcctacgaccagggcgtacagaaactgctgttcggtaacgagtccgagctgctggccgccggccgtgtggtcacgacccaggccgtcggcggcaccggcgcgctcaagctcggcgccgacttcctcaagcgcctgctgcccgacgccaccgtggccatcagcgacccgagctgggaaaaccaccgcgcactgttcgaagccgccggcttcccggtgcagaactaccgctattacgacgccgccagcaatggcgtgaaccgcgccggcctgctggaagacctgaatgccctgccggcccgctcgatcgtggttctgcacgcctgctgccataatccgaccggcgtcgatctcgagctggacgactggaaacaggtgctggacgtgctcaaggccaagggccacgtgccgttcctcgacatcgcctaccagggcttcggcaacggcatcgaggaagacgccgccgcggtgcgcctgttcgcccagtcgggcctgagcttcttcgtttccagctcgttctccaaatccttctcgctctatggcgaacgcgtcggcgccctctcgatcgtgaccgaaagccgcgatgaatcggcccgcgtgctgtcccaggtgaagcgggtgatccgcaccaactattcgaacccaccgacccacggcgccagcgtcgtctcctccgtgctcaacagcccggaactgcgggccctctgggagcaggaactgggcgagatgcgcgaccgcatccgcgacatgcgcctggcgatggtcgagcaactggcagcccacggcgccaagcgcgacttcagtttcgtcggtcgccaacgtggcatgttctcctattccggcctgaccgccgaccaggtcgagcgcctgaagaccgagttcggtatctacgccgtcagcaccggccgtatctgcgtcgccgcgctgaacaaatcgaacctggagaccatcaccaaggccatcgtccaggtcctgtag

SEQ ID NO: 5009 - protein, 398 aa, Pseudomonas aeruginosa
MSLFSAVEMAPRDPILGLNEAFNADTRPGKINLGVGVYYNEEGRIPLLRAVQAAEKARIEAHAPRGYLPIEGIAAYDQGVQKLLFGNESELLAAGRVVTTQAVGGTGALKLGADFLKRLLPDATVAISDPSWENHRALFEAAGFPVQNYRYYDAASNGVNRAGLLEDLNALPARSIVVLHACCHNPTGVDLELDDWKQVLDVLKAKGHVPFLDIAYQGFGNGIEEDAAAVRLFAQSGLSFFVSSSFSKSFSLYGERVGALSIVTESRDESARVLSQVKRVIRTNYSNPPTHGASVVSSVLNSPELRALWEQELGEMRDRIRDMRLAMVEQLAAHGAKRDFSFVGRQRGMFSYSGLTADQVERLKTEFGIYAVSTGRICVAALNKSNLETITKAIVQVL

SEQ ID NO: 5010 - DNA, 1191 bp, Salmonella typhimurium
  CDS (1)..(1191): transl_table=11
atgtttgagaacataaccgccgctcctgccgacccgattttgggcctggccgatctgtttcgcgccgatgaccgtccagggaaaattaaccttggcattggcgtatataaagatgaaaccggcaaaacaccggtgctcaccagcgttaaaaaagccgagcagtatttactggaaaatgaaacgacgaaaaactatctcggcattgacgggattccggaatttgctcgctgcactcaggaactgctgttcggcaaaggcagcgcgctgattaacgataagcgcgcacgcacggcgcaaacgccgggcggtaccggcgcgttacgcattgccgccgactttttggcaaaaaatactccggtaaaacgggtgtgggtgagcaaccccagctggccgaaccacaaaagcgtgtttaacgctgccggcctggaagttcgggagtacgcttactacgatgcggaaaatcacacgctggattttgaagcgctacaagccagcctgagcgaagcacaggccggcgatgtggttctgttccacggttgctgtcataacccaaccggcattgaccctactctggaacagtggcaggttctggctgagctttccgttgaaaaagggtggctgccgctattcgatttcgcttaccagggctttgcccgcggcctggaagaagatgcggaaggtctgcgcgcctttgccgcgctgcataaagagcttattgtcgccagctcctactccaaaaacttcggcttatataatgagcgcgtcggcgcctgcaccctcgttgccgccgatgcggaaaccgtggatcgcgcttttagccagatgaaatccgccattcgcgctaactactccaacccgccagcgcacggcgcgtccatcgtcgcgactatcctgagtaatgacgccctgcgcgctatctgggaacaggaactgacggacatgcgccagcgtattcagcgtatgcgtcaactgttcgtgaataccttgcaggaaaaaggcgcgaaccgtgacttcagctttattatcaagcagaacgggatgttctcattcagcggtctgaccaaagatcaggtgctgcgtctgcgtgaagagttcggcgtttatgccgtggcttctggtcgcgtgaacgtggcgggcatgaccccggataatatggcgccgctgtgcgaagccattgtcgcggtactgtaa

SEQ ID NO: 5011 - protein, 396 aa, Salmonella typhimurium
MFENITAAPADPILGLADLFRADDRPGKINLGIGVYKDETGKTPVLTSVKKAEQYLLENETTKNYLGIDGIPEFARCTQELLFGKGSALINDKRARTAQTPGGTGALRIAADFLAKNTPVKRVWVSNPSWPNHKSVFNAAGLEVREYAYYDAENHTLDFEALQASLSEAQAGDVVLFHGCCHNPTGIDPTLEQWQVLAELSVEKGWLPLFDFAYQGFARGLEEDAEGLRAFAALHKELIVASSYSKNFGLYNERVGACTLVAADAETVDRAFSQMKSAIRANYSNPPAHGASIVATILSNDALRAIWEQELTDMRQRIQRMRQLFVNTLQEKGANRDFSFIIKQNGMFSFSGLTKDQVLRLREEFGVYAVASGRVNVAGMTPDNMAPLCEAIVAVL

SEQ ID NO: 5012 - DNA, 1420 bp, Rhizobium meliloti
  CDS (175)..(1344): transl_table=11
gccggtccgacctgatgaagatcgcctgcgccgagccttcgcgtgcggcgcgaaagccgggggcgctggaggcctgaggctgtcgtttcgaccggtcgcggcgcggaacccgcttgcctttccggctgggggaaacgactatgatccgatccactgctccacaaggaataccggatgttcgacgccctcgcccgccaagccgacgatcccttgctggccctgatcggcctgttcaggaaggatgagcgccccggaaaggtcgatctcggcgtaggagtctatcgcgacgagaccggacgcacgccgatcttccgggccgtcaaggcggcggaaaagcggcttctcgaaacacaggacagcaaggcctatatcggccccgaaggggacctcgtctttctcgatcggctctgggaactcgtcggcggcgacacgatcgagcggagccatgttgcgggcgtccagacgcccggcggctccggcgcgctccgtttggcggcggacctcatcgcccgcatgggcggccgaggcatctggctcgggctgccgagctggccgaaccacgcgccgatcttcaaggcggccgggctcgatatcgccacctacgacttcttcgacattccgtcgcagtcggtcatcttcgataatctggtgagcgcgctggaaggcgccgcatccggcgatgcggtgctgctgcatgcaagctgccacaacccgaccggcggcgtcctgagcgaagcacaatggatggagatcgccgcgctggtggccgagcgcggcctgctgccgctcgtcgatctcgcctatcaggggttcggccgcggcctcgaccaggatgtcgcgggcctccggcatcttctcggcgtggtcccggaagcgctcgtcgcggtttcctgctcgaagtccttcgggctttatcgcgagcgcgcgggcgcgatcttcgcgcggaccagctcgactgcctcggcggacagggtgcgctcaaacctcgcgggcctcgcacgcaccagctattccatgccgccggatcacggcgcagccgtcgtgcggacgatccttgacgacccggaactcaggcgcgactggacggaggagctcgagacgatgcggctcaggatgacgggcctccggcggtcgcttgccgagggactccgcacccgctggcagagcctcggcgcagtcgccgatcaggagggcatgttctccatgctgccgctttccgaagcggaggttatgcggctcaggaccgagcacggcatctatatgccggcatccggccgcatcaacatcgccgggctgaagacggcggaagccgccgagattgccggcaagttcaccagtctctgatctctagatgacgatgcttttaggccgggtcgacctaaaagcatgaacgtgaccggttccgataggtcagagcggg

SEQ ID NO: 5013 - protein, 389 aa, Rhizobium meliloti
MFDALARQADDPLLALIGLFRKDERPGKVDLGVGVYRDETGRTPIFRAVKAAEKRLLETQDSKAYIGPEGDLVFLDRLWELVGGDTIERSHVAGVQTPGGSGALRLAADLIARMGGRGIWLGLPSWPNHAPIFKAAGLDIATYDFFDIPSQSVIFDNLVSALEGAASGDAVLLHASCHNPTGGVLSEAQWMEIAALVAERGLLPLVDLAYQGFGRGLDQDVAGLRHLLGVVPEALVAVSCSKSFGLYRERAGAIFARTSSTASADRVRSNLAGLARTSYSMPPDHGAAVVRTILDDPELRRDWTEELETMRLRMTGLRRSLAEGLRTRWQSLGAVADQEGMFSMLPLSEAEVMRLRTEHGIYMPASGRINIAGLKTAEAAEIAGKFTSL

SEQ ID NO: 5014 - DNA, 1200 bp, Pseudomonas aeruginosa
  CDS (1)..(1200): transl_table=11
atgagtcatttcgccaaggtcgcccgcgtaccgggcgacccgatcctgggcctgctcgacgcctaccgcaacgatccgcgcgcggacaagctggacctcggcgtcggtgtctacaaggatgcccagggcctgaccccgatcctgcgctcggtgaaactcgccgagcagcgcctggtcgagcaggaaaccaccaagagctacgtcggcggccacggcgatgcgctgttcgccgcgcgcctggcggaactggcgctcggcgccgcctcgccgctgttgctggagcaacgcgccgacgccacccagacgcccggcggcaccggcgccttgcgcctggccggcgacttcatcgcccattgcctgcccggccgcggcatctggctgagcgacccgacctggccgatccacgagaccctgttcgccgccgccggcctgaaggtttcccactacccctacgtcagcgccgacaaccgcctggatgtcgaggcgatgcttgctggcctggagcgcattccccagggagacgtggtgctgctgcatgcctgctgccacaacccgaccggtttcgacctgagccacgacgactggcgcagggtgctcgacgtggtgcgtcgccgcgagctgctgccgctgatcgacttcgcctaccagggcttcggcgacggtctcgaggaagacgcctgggcggtacgcctgttcgccggcgaactgccggaggtgctggtcaccagttcctgctcgaagaacttcggcctgtaccgcgaccgcgtcggtgcgctgatcgtctgcgcgcagaacgccgagaagctcaccgacctgcgtagccaactggccttcctcgcccgcaacctctggtcgaccccgccggcgcatggtgccgaggtggtcgcggcgatcctcggcgacagcgagttgaagggactctggcaggaagaggtcgaaggcatgcgctcgcgcatcgccagcctgcgcatcggcctggtcgaagccctggcgccgcacggcctggccgagcgcttcgcccatgtcggcgcgcaacgcgggatgttttcctataccggactgagcccgcagcaggtcgctcggctgcgcgacgagcacgccgtttacctggtctccagcggccgggccaacgtcgccggtctcgacgcgcgccgcctcgaccgcctggcgcaagccatcgcccaggtctgcgcggactga

SEQ ID NO: 5015 - protein, 399 aa, Pseudomonas aeruginosa
MSHFAKVARVPGDPILGLLDAYRNDPRADKLDLGVGVYKDAQGLTPILRSVKLAEQRLVEQETTKSYVGGHGDALFAARLAELALGAASPLLLEQRADATQTPGGTGALRLAGDFIAHCLPGRGIWLSDPTWPIHETLFAAAGLKVSHYPYVSADNRLDVEAMLAGLERIPQGDVVLLHACCHNPTGFDLSHDDWRRVLDVVRRRELLPLIDFAYQGFGDGLEEDAWAVRLFAGELPEVLVTSSCSKNFGLYRDRVGALIVCAQNAEKLTDLRSQLAFLARNLWSTPPAHGAEVVAAILGDSELKGLWQEEVEGMRSRIASLRIGLVEALAPHGLAERFAHVGAQRGMFSYTGLSPQQVARLRDEHAVYLVSSGRANVAGLDARRLDRLAQAIAQVCAD

SEQ ID NO: 5016 - DNA, 1334 bp, Paracoccus denitrificans
  CDS (131)..(1315): transl_table=11
cgggggtgacggcggccgtgctgttcctggcgcttgaacgcatcgggcaccgggaccattcgctttatgacggaagctgggccgaatggggcaggttccccgaccttaaaatcgcaaccggagacgcgtgatgctgggcaatctgaaaccgcaggcccccgacaagatcctggccctgatgggcgaattcagggccgatccccgccagggcaagatcgacctgggcgtgggggtctacaaggatgccaccggccacaccccgatcatgcgggccgtccacgccgccgagcagcgcatgctggaaaccgagaccaccaagacctatgccggcctctcgggcgagcccgagttccaaaaggccatgggcgagctgatcctgggcgacggactgaaatccgagaccaccgcgacgctggcgacggtcggcggcaccggcgccctccggcaggcgctggaactggcgcgcatggcgaacccggacctgcgggtcttcgtcagcgatccgacctggccgaaccatgtctcgatcatgaatttcatgggcctgccggtgcagacctatcgctatttcgatgccgagacccgcggcgtcgatttcgagggcatgaaggccgacctcgccgccgcgaaaaagggcgacatggtgctgctgcacggctgctgccacaacccgaccggcgccaacctgacgctggatcaatgggccgagatcgcctcgatcctggaaaagaccggcgcgctgccgctgatcgacctggcctatcagggcttcggcgacgggctggaagaggacgcggccggcacccggctgatcgcctcgcgcatccccgaggtgctgatcgcggcctcgtgcagcaagaacttcggcatctaccgcgaacgcaccggctgcctgctggcgctttgcgccgatgcggcgaccagggagctggcgcagggcgccatggccttcctgaaccgccagacctattccttcccgcccttccacggcgccaagatcgtctcgaccgtgctgaccacgcccgaactgcgcgccgactggatggccgagctggaagcggtgcgcagcggcatgctgcgcctgcgcgagcaattggcgggcgagttgcgcgatctcagcggttcggaccgtttcggcttcgtggccgagcatcgcggcatgttctcgcgcctgggcgccacgcccgaacaggtcaagcgcatcaaggaagagttcggcatctacatggtgggcgattcgcgcatcaacatcgccgggctgaacgacaacaccatcccgatcctggcccgcgctatcatcgaggtgggggtctaagccaccgcaagggcgccgg

SEQ ID NO: 5017 - protein, 394 aa, Paracoccus denitrificans
MLGNLKPQAPDKILALMGEFRADPRQGKIDLGVGVYKDATGHTPIMRAVHAAEQRMLETETTKTYAGLSGEPEFQKAMGELILGDGLKSETTATLATVGGTGALRQALELARMANPDLRVFVSDPTWPNHVSIMNFMGLPVQTYRYFDAETRGVDFEGMKADLAAAKKGDMVLLHGCCHNPTGANLTLDQWAEIASILEKTGALPLIDLAYQGFGDGLEEDAAGTRLIASRIPEVLIAASCSKNFGIYRERTGCLLALCADAATRELAQGAMAFLNRQTYSFPPFHGAKIVSTVLTTPELRADWMAELEAVRSGMLRLREQLAGELRDLSGSDRFGFVAEHRGMFSRLGATPEQVKRIKEEFGIYMVGDSRINIAGLNDNTIPILARAIIEVGV

SEQ ID NO: 5018 - DNA, 1374 bp, Oryza sativa
  CDS (1)..(1374)
atgccatccgctaacgtgcgcggggcgcagcctagcgccgaccgcaggttaagtacgctggtgcgccacctactgccttcctccgcacgaacagcaaccaccaccagcacctcctcctccgccgccgacgccgactcctccctccaagctttccccaccatggcgtcgtcgtccgtcttcgctggcctcgcgcaggcgccggaggaccccatcctcggggtgacggtcgcgtacaacaaggatcccagccccgtgaaggtcaatctcggcgtcggcgcctaccggaccgagcccctggtgctgaatgtggtcaggcgcgctgagcagatgctgatcaacaacccgtcacgtgttaaggagtatttgccgatcactggactggccgatttcaataagctgagtgctaagcttatttttggtgctgacagtcctgccattcaagagaatagggtggctacagttcagtgcttgtcaggaactggttctttaagggtgggaggtgaatttcttgcaaggcattatcatgaacgcactatatacatcccacagccaacctgggggaatcaccccaaagtgttcactttagctggcctgactgttaggagttaccgctactatgatcctgcaacccgtggactggatttccaagggctgttagaagatctcggttcagctccttcaggtgcaattgtactgcttcatgcttgtgcccacaaccctactggagtagacccaactttggaccagtgggaacagatcaggcagttgatgagatcaaaagcattgctgccattctttgatagcgcttatcagggatttgcaagtggaagtcttgaccaagatgctcaatcagtgcgcatgtttgttgctgatggtggtgaattgctcatggctcagagctacgctaagaacatgggattgtatggagagcgtgtcggtgctttaagcatagtttgtggaagtgctgatgtagctgtcagggttgaaagtcaacttaagcttgtaattaggcctatgtattcaaaccctcctattcatggtgcatctatcgtggctaccatacttaaggacagtgcaatgttcaatgaatggactgtggagctgaagggcatggctgataggattattagcatgaggcaacagctttttgatgctctgaaaacgagagaaactcctggagactggagtcacatcattaagcagatcggaatgttcactttcactgggctcaacagtgatcaagtggctttcatgaggcaggaataccacatttacatgacatctgatgggaggatcagtatggctggtttgagcgggaggaccattccgcatcttgcagatgcaatccatgccgcagtcacaaaactgaagtga

SEQ ID NO: 5019 - protein, 457 aa, Oryza sativa
MPSANVRGAQPSADRRLSTLVRHLLPSSARTATTTSTSSSAADADSSLQAFPTMASSSVFAGLAQAPEDPILGVTVAYNKDPSPVKVNLGVGAYRTEPLVLNVVRRAEQMLINNPSRVKEYLPITGLADFNKLSAKLIFGADSPAIQENRVATVQCLSGTGSLRVGGEFLARHYHERTIYIPQPTWGNHPKVFTLAGLTVRSYRYYDPATRGLDFQGLLEDLGSAPSGAIVLLHACAHNPTGVDPTLDQWEQIRQLMRSKALLPFFDSAYQGFASGSLDQDAQSVRMFVADGGELLMAQSYAKNMGLYGERVGALSIVCGSADVAVRVESQLKLVIRPMYSNPPIHGASIVATILKDSAMFNEWTVELKGMADRIISMRQQLFDALKTRETPGDWSHIIKQIGMFTFTGLNSDQVAFMRQEYHIYMTSDGRISMAGLSGRTIPHLADAIHAAVTKLK

SEQ ID NO: 5020 - DNA, 1218 bp, Brassica napus
  CDS (1)..(1218)
atgatttccatcttgtcaaacgttcttcctgctccggaagatcccgttctcagtgtcatatttgcttgtagagatgatccttgtccggttaagttgaatctgagcgtcggtgcttaccaaaccgaggagggaaagcctcttgttcttgaggtggtaagaaaagcagagcaacagttagcgaatgacctgtattgtgacaagggatatctcccaatcgatggacttgctgagtttaacaaatttagcgctaagctaatcttaggtgatgatagtcatgcagtaaaggagaatagagttgttactatccagtgtttgtctggtactggttctttgagagtcggagctgagtttctagcaaaacaccaccaacaacgtgtcattttcgttccaaatccaacttgggggaaccatccctttattttcacattggcgggtttgtcggtagagtatttccgttactatgatccgcatacccgaggactcgacttcgaaggcatgctcgaggatcttggtgcagcaccgtctggagctctagtggtattgcaagcttgtgcgcataaccccacaggaattgacccaacactggaacaatgggaacagattcgacaaatcgtgagatctaaaggcttattacccttctttgataatgcatatcagggttttgctagtggtaaccttgactcagatgcacaatcggttcgtatgtttgttgctgatggaggtgaatgtttaatagctcaaagttttgccaaaaacatgggtctttatggtgagcgtattggtgctcttaccattgtatgcacctcagaggatgtggctaggaaagtaaaaagccaactgctacttgttgttagacctatgtatcttagcccaccaattcatggagcatccattgttaccacaattcttaaaaacagtgatatgtacaaggactggaccattgagctgaaaggcatggctgaccgcattattagcatgcgccaacagttatatgaagctattcaagctagaggcacacctggtgattggagtcacattatcaaacagatagggatgttttcttttacaggattaaatgagaagcaagttcggatgatggcaaaagaatatcacatttacatgacttatgatgggaggataagcatggcaggtctaagttcaaagacagtgcctcaacttgctgatgctatacatgccgcagttacccgcattccctaa

SEQ ID NO: 5021 - protein, 405 aa, Brassica napus
MISILSNVLPAPEDPVLSVIFACRDDPCPVKLNLSVGAYQTEEGKPLVLEVVRKAEQQLANDLYCDKGYLPIDGLAEFNKFSAKLILGDDSHAVKENRVVTIQCLSGTGSLRVGAEFLAKHHQQRVIFVPNPTWGNHPFIFTLAGLSVEYFRYYDPHTRGLDFEGMLEDLGAAPSGALVVLQACAHNPTGIDPTLEQWEQIRQIVRSKGLLPFFDNAYQGFASGNLDSDAQSVRMFVADGGECLIAQSFAKNMGLYGERIGALTIVCTSEDVARKVKSQLLLVVRPMYLSPPIHGASIVTTILKNSDMYKDWTIELKGMADRIISMRQQLYEAIQARGTPGDWSHIIKQIGMFSFTGLNEKQVRMMAKEYHIYMTYDGRISMAGLSSKTVPQLADAIHAAVTRIP

SEQ ID NO: 5022 - DNA, 1242 bp, Brassica napus
  CDS (1)..(1242)
atgatgagccgtcagatctcggggttgagatccatgtcttcgtggtggaagaacgtcgagcccgctcccaaagatcccatcctcggagtcaccgaggcctttctcgctgatcctagtcccgacaaagttaacgttggtgtgggagcatatcgagatgataatgggaagcctgttgtcttggaatgtgtccgtgaagctgagcgtaggatcgctggcacctccttcatggagtatcttccgatgggagggagtgtcaaaatggtggacgagacattgaagcttgcctatggggacaactctgagtttatcaaagacaaaaggattgctgcagttcagtctctctccggcactggagcttgccggctcttcgcagacttccagaaacgtttccgtcccgattcgcagatctacattcctgtaccaacctggtccaaccaccacaacatctggagagatgcacaagtcactcaaaagacgtaccattactaccatccagaaaccaagggcttggatttctcagggttgatggatgatgtgaagaatgctccgcaaggctccttcttccttctccacgcttgtgctcacaatcctactggagtagaccctacagaggagcaatggagagagatctcacagctattcaaggccaaaaaccatttcgcattcttcgacatggcctatcaaggctttgcaagcggtgaccctgcgagagacgccaagtccatcaggatctttctcgaggacggtcatcatattggaatctctcagtcttatgctaagaacatgggactctacggccagagggtcggatgtctcagcgtgctttgtgaagatgagaagcaagccgtgactgtgaaaagccagttgcagcaactagctagaccaatgtacagcaacccacctttgcatggagctcaaatagtctcaaccattctcggagacccagcgttaaaaggcctctggctaaaggaagttaaggtcatggctgatcggataattggcatgagaactgctttgagagaaagcttagagaagttaggatcgcctctatcatgggagcacgtaaccaagcagattggaatgttctgctacagtgggatgacaccagaacaggttgaccgtttaacaagcgaatatcacatctatatgacccgtaatggtcgtatcagtatggccggtgttacaacaggaaacgtgggataccttgcgaatgctatacatgaagtcaccaagtcatcttaa
